United States Patent 11,549,145 (METHODS AND COMPOSITIONS FOR INHIBITING AND TREATING NEUROLOGICAL CONDITIONS) - sequence listing, part 36

SEQ ID NO: 652 - DNA, 24310 bp, Homo sapiens
gcctgcggaggactggcccagcaaggtcccaggtcttccctctcctcagcgcctaagagagaggcccagtgcgggtgaggagtcgcgaggaagaggcggaaggcgccggaaggtgagtgagcgagcggcccccggccctagagccttctgcacccattttgaagagcaggcagggagggacagtgggcaggcaggtggccctcctgggctggctccttcctggtactgctaggcagcggaggtggtcccttccaggtgccgtctctcgatccttagtgggtgcatgttaagtcacttacaccactttgccccatggccccacggtaggctggtagacgtcaagacctcaaatggcccgccctgcccccgggcccatcttcaggtctgatgcctgtcctgggtgagggtgtcaccgcggcagagtgcagggaattcatgccggggaagaggttcccaaacaggaagggtggtggcaggcccagtggctgtgcagggcagggtgggaggcagccgtgggagactcccgcaggagttacaggtgaagctgccgctccacacatcccagcccaccgctcattccccagatctccagacctgctcaggtggcatccgatctggagtgtaggtgctgctgggagcactggaggctaagccatgaagagctcccagggtgtaggttgcgttttctgtatcttgccccattctggtggttttttgggggcttttctgacttgtttttctgggtgaagggggcagaggggctcaggtctgtgtccatgctcgtttttggtggccggtgtggcataggttgccgcattggataagaaaacgcctggttccatgcaaggtgaggttcagcctgcagtgccatgaattctcctccatagtatataggacagtggccgaagacacatttggaaccgaagagagtggggtttgaatctatccagactttgcctttgactccttagacaagttgcttcacttctctacaaacttataaatggcctcatctgtaaaatgggaatgcgaatgccttcctcctcattaggcggttgtggggagtaactgcctcatcagcctccagctgctatgttgggaagggctaagccactccaagttctcccatcctggagagctttgagggcagtctggctgtttggcaagctattgtcagagggtattagagcaaagcaataggaataaagtaaaggtaggggtccttggagggcgagtagtgagagaccctaattcagggtctctggacctcgtggtgacccagggaaggggccattcctggaagaggatctggcttgggcatcagaaacagcagcgccccctgcacatcacacatgttcatgtgttcatgggtgaccctggaacctcaactgttgcctgggatagagggagcctctggcttgagcttccagtcccatctctgttctgcatagctgtgtgatccagagcaggtcacttgacttctctgggcactgggcattgtggatgagcctggagtttggagtcggagagatctgactttgaatcccagctccacacttactgtcttggacaattacttctctctgagcctcagtttcttcatctgtaaaacagagctcgcagtagctacaattagccattagatgtactaataaaaagcacctagcacagtctatccatgtggtgggcactttataagcatacctttcttttcttgcctcctccttctctctccagctccctgctgtctttaaaatgggcccaggaaagcaggttcagcccaactcacaatggtgttgtgagtgtaaagttgtgagtgttaaggaggtgaaatagaggtctggaaagttaagagctgtagaaaaaaaggcaatcttgtgattagggatgccagaggttccttctgcttagcatagggttccaatgccagaggttccaatgcttagcatagggtcctagctaggcattgaggaccctatgctaaggactcagacctctgtgtgcagaggctgttgagaatctagggtaggccgggcgcggtggctcacgcctgttgacacaagtgactgaatgagctgtattactgtattcttttaaacagcagcccattatctctcccctggggattcactggggccagtggtatgggaatagtgacaaaggcagagagcccaaacattttggcaggttgcatgtcatgctgtctgccctggcccatgctgcatctgtctgggtccctcaagtgggacagcagagcctcagggtcctgctcatcctcccagggcctctccgcacttcagcacactgaccctgagcaggttgtttgaatcttgtgggcatccacatgagggccacaacctgcgtctaggaccctcctcccccgcaggtgacagctgagcagaaaagcagatgaaatttccttcccccgtgtattttgggagccaggatagggtgctggggtgccacctctcctgactctcaagtcacgtgaagaggagcagatggcagactcggaccccagtagaggctgaggtgagacagagttcagctccacacaaggatcagcgaggggacagaggggacagaaggcaggggctgcagggggagcttttcatcgctgaatgagttctagcagagtgcgggcagcctcctgttgggaatgccagagggactgaactttgggccaaggggaaggtcagaccccgtcaggagtgccacagatcctgcactaccatctcttctggctgcagaaggttggcctagagcaacacctgtttggaagaagcaaactaaaccacacaggagtgaggatttcctctcgtttaccatggtccccagagcctggagtagagtaggtccataatagatactttctgaataaaggaatactataatttcccagctgggcacggtggtatgctcctctagtcctgaccactcaagcgactgaggtgggagggtgggttgaggccagacgttcgaggctgcagtaagctctgatcgcgccactgcatttcagcctgggcgactgagtgagactctgtctctaaaaaaaaattttttttttgaaacaaacttctgaaagtaaagtttgagaaaaatccttctggccaatgagaatattccagtgaaaggctgtcttctgttcgcggtaattctcagccaaggggtcaggtgaggcctgtcacctgtcagaatgtgtgtgggatgacagttcccaaagggggttacaaagaggtcaagaaaccctgctgcaggtctcagcatgtcagggcccagccctggaggtgacagggtcctctggaggccactctgacaggttggtgatggtagtagagtgctttcctaagttttgtagcactcggggctcacctctgtcttggggctgtgattctaggataggcccttccccagagtgtcttggatgggcctgagaataacagagggtggtggtaggagcagatggccactgcagccaagttcacatcaggtcctgggtcagactcgtgtctgccccttctttgcctctcggcttgaatgagtcacttagtctctccttctctgcataatggagacagtactagtgctacctcacaggcttgtggcgaggagatcacatgtgtgaaatgctcagcccagagcctgctacttccgtcttatgctaggctcttcctgagtgacgaccgtgagaaatatccaaagctcctccgtgagcaggaacagatgctccccctcactgtgcctggagaagctggcagaggtgaattaatccatcccttgtcatctacaaaaatgtcgaggcctacgtaaggcgagtaggccaaggtcacaagccgggacttaggaacaccaagcccaaggtccacgctgagccagcactcgggcttgtggcccaggacttgagccctggtaagcagaccctgagcctcactgtgagaaagcctgggcctgccgcccccctctcaccccctggcaccttgagcaacccaggagctggcccactaggcagcggcctcctctcttcccagtcgcccgcaaatggcagggaattccaccagcttcatttctaacagcttcccagcaatcccagcgcttacacagccagcccaacgctgacccctccgggtggctgcaaacccctttagactcactttctggaagccagcttcccagcctcagcgcgttcttgtgaatcccttcggtgggctgtgtcctttccttgaaagggactcagtatgcgcaaacagcccaaactcactctaggccaggtctggagggtcaggtgggtgaccacgtgggataccaccacttctggtgaaaagcggggtgacgggttaggaggacagctgaggtgggctcataacgtctccaaaggcagttcccaaagaggagttctggaaatgccagagcatgtttgaaacaggcaggtacattcccaagtggtctgtctcgcacagcaatgctcatttgaatgcccatgctctggcttgaggtttaacggcaggcatcctctgtagtgccaccctgcatctgtggggccctgatggctctggtggccctggcatcccagggcctggcccatggatgtctcctctccagggaggagacgttgaggagggtggcccacccacagtgcagctgcttttctcatctgtggacactagaccagccaagcctcagtgccatgctctgggaatccccttgtctctgtggaacagtagcatccgccacaaaacttactcaccccctcctcaagccaagcctgtgggtcgcctggcttcaggctgagcccctacagaggggctgtggatgcatcctgtgctggacagaacacacgcctgctgtttctgtagcttttcctagatgccaggccctgaccatcacagcccccaccatgacctcttggaaacattttactcaccccttgctgagtggaaaaacacctggttccttgcaagataagggtcagcctgcaagttaggacagccccaggccccctggcctctgactcacaggtcagcccaggaaagaattcagcaggcttcttccctggaggggccagccctgtcctacatacctcacgcacatcttgcccgtttctgttcataaagacctccagagagggagaagaaccacagctgactcagtccggggtaagcatggtggacggagcaggggctctggaatcagatctgggttcaaacctcaactcagtcatttcctggttctgtggcctcaggcaagctattgaacctctttgagcctcatctggatttgtggataacaattccttctctcagggttgctgtgagggttaaatgagctaaccctcggaaggggcttagcacataataggtgctcaagaaaagtttcttccctttctgtgtctgagattgctgctcctccaacaccactgtcccgcccctcagtgaccccaggtacatagctccttgaactgtccaccagctccgccctcaggtttactgggggtagcagcatttcctccagaaagtgtgtgccaggaaccgtcggtccccactggccaggctccggctggaggaagccccacagcaggggagcttccttcttgaactggtttgggctggacccttccctcccaggccttgggcatcccccgatgcagtcatgcgttagccagcaggaagatgcctgcagacatccagaagagaaaagttcaaagcagtcctcacacacggcagtgcctttccagcctgaggtggaatcttcagtgtggcctccctcccctgtgttaaggcgaagtgtcagccaggaggggctggggctgtgcccgagctggccaccccgttctgcttgtttccacttcagggtcttaggctcacatcacttctttcaagctgggcaggagaaacggcagggtctggctctctgagggggagtccccttccttcctcctcctggtgtcttcttggaggaaagctcctcccctagatgaattgcgtgcagatggagatgctagaggggcgacagtaacagctggcatggcctgtttgacttaaccttggggccccatggctggtgcagcagccacctccctcagcccagtggccttggagacatggatgggaaaaggagccctggaaatggcaagcggaggccctggctgaccgggtgggagtgctctgaggacacagcctgatgctggggagaggcagggcatgttttgtcctgggtgattcactcgcgatgactggggcaacactggtcccgttcaggtggatgaacgtctcttaggcactcagcctccatggatcactcttctctgtatttaaaaatattttgtttttggccggacgcggtggctcacgcctgtaatcccagcactttgggaggctgaaggcgggtggatcacctgaggtcaggagttcaagatcagcccagccaacatggtgaaaccctatctctactaaaaatacaaaaattagccggacgtggtggtgcacacctatagtctcagctacttgggaggctgaggcaggagaatcacttgaacctggaaggcagaggttgcagtgagccaagatcgcaccactgtactccagcctgggcaacagagtgaaacgctgtctcaaaaaaaaaaaaaaaaaaaaaaaattgtttttttttagagaagcaatccgtcgtctttaaggaaaacttagaaaaagagtagaaagatagaatagaaggagatcacctgtagccccaccaggtaaatgggacaactaatatgttgatgtatttccttcaaatagccattgtattcacactgcattgacaaattaccattggcaaaatctttaaaaaccccctacccctaatctatatcatcaagaattccactttcgccaaagtaaaccttgatagtttaatttgtgtctgggacccatgactgtggacaggtttaggccccagcaggtcgtgggatccaggagagaccaccaaatcgggcccctcataatgatcacactagacctgagggaggtgagagtcaggctacgggtacccgccgtcactcccaccagctttattattttacctttcacattgaggtttgtgatctgtctgcataattttggagtatgatatgagctcattcttccgggtttattttttttccatgcagatatcaaattacttcagctacatttattaaaaacatcatccattcccccagcatgttgcagggtcacctttgtcattaatcaaatgacctcataagagtgggtctatttttggattctctcttctgttccattggtctatttgtcaattccgtactaaatttgccaatttttgcctatttgcctattgcctatttgccaattccatactaaattaattattgtagctttctaataaatcttaatatctatttagtacaatcctccaacttcgttcattaagattgtcttggctattcctggttctttatatttctgtatacattttagaatcagttcatcaatttctaccaaaggaaatatgctgggattttgtttgagatttaaattaatctgcaggttaacttgggaataattgacatctttacagtattgaaccttctcatctatgaacattctttaatatctttaataatgttttgtattttccaatataaggactttgtatttttttgttagatttattctagatattttgtatttttaatgtaaaatgatatctttttaaaaatttcatttttttttttgagacagagtctcgctctgtcgcccaggctggaatgcagtggcctgatctcagctcactgcaagctccgcctcccaggttcacgccattctcctgcctcagcctcctgagtagctgggactacaggtgcccaccaccacacccggctaatgttttgtagttttagtagagacggggtttcaccgtgttagccaggatgatctctatctcctgacctcgtgattcgcccacctcggcctcccaaagtgctgggattacaggcgtgagccaccgcgcctggccctttttaaaaatttcatgttgttactggtatgtagaaatccagttgattttttaaaatattgaccttgagcctgggcacggtggctcatgcctgtaatcccagcactttgggaggctgaggcgggtggatcatgaagtcaagagatcgagaccatcctggccaacatggtgaaaccccatctctactaaaaatacaaaaattagctgggcgtgatggcgtgcgcctgtagtcccagctactcagtaggctaaggcaggagaatcacttgaacccgggaggcagagattgcagtgagctgagatcacaccactgcactccagcccgggcaagacagcgagactccatctcaaaaaatatatatatatatattgaccttgaatcagggaccttctaaattcactcccttaatcccagttttatgtagattctcccgcattttctacttacacagttatgttgtcccacacagtgttggcctcaccacatttcagatgagtcctagctgcctccctttaggtggttgattggttgattttccagacctaagtgatggcctctggtttctaaagctctactccctagcccccaaagcctgagctcagctgattgcttctgccaactcccaccctcaccatcaccactcctggccctgggacaccctctgggctgtccttctttcttctccagcctccctgctgcctctgggaagaacttgttccggaatggctcactattagaatggactcaagagaggctcccagagtcagagaccatttgctaaagatgctctccctgtgcatccccacagcaaaagctgagcgcttgggtggggcaggggagttggggagagggctgttctggggtgggtggtggggggcggattcaccagctcttcttcagctgcagtctgtgtccctgcacctccagaagatttcacagagctagggaggagggcgaaacaggcagctcaactaatccagggatagcaggtctatccaagggactgggggaatagacctgctgaataaagactcttctgtagcaaaaggcaaaggctgtaatcccagcactttgggagaccaaggcaggtggatcatttgaagtcagaagttcgagaccagcctggccaacatggtgaaatcccgtctctactaaaaatacaaaaattagccgggtatgttggtgggtgcctgtaatctcagctattcaggaggctgaggcaagagaatcacttgaacccgggaggtggaggttgcagtgagcccagatggtgccactacactccagtctgggcgacagggcggcaagactccttctcaaaaacaacaacaacaacaacaaacaacaacaaaaaaggcaaaggccaaaaggaggaggacaaattttaccaaaccatgatgtatatatggcgaggtccccaggtcccagacccctgacatcaggcatgacccctttgactggtaagtctgagcagaaagtggtttggtgttactcccagacttgtatctgcccaagtgccagtgtctggagggcctgagcttcaagacagggattcaaagagaggtgacatcacaagagaaacaaccgtcatgtatggggactctgcttacttcacacaccctaaaccctatgagctgtctttcattaacccccctggctcagatcatttcagttatttgttcaaaatctctccaaattattagtgggagactccctacaactcatctgcaactcacacaggttgttttattccaaagggcttggtctgtaagggtcctgtacatgtggctctacctctagggggtgttcggtggatcccgaacctcaagacccagaagcatggctgacattgagatgtgacgtgggctctgattgagtcacgcatggtgaattcctagtggggaaccactggctgtccagggtccctgcctttctgccagctgcctcccagatctgcgacctccttcagaacctgccaaaatgactaggaaaatgctgtttccatagcaagagccaaaagagaacatgacggccctgcactccagatcttcgggcggatgagtaatccaagctttcagttcaagaatcatgtttcagtttcttgaagcctggaagtgaccttttcagatacataagaacccagtgagctgttctgagcctcttcagatccaaaagcattcaagaggcagccctggccctgtctgccatcaacatgtgatcccaggtccgggatcccctgaaggcgaaactagagcaaccctttggaagtgtccctccccttcccaggcccccagttccccactctcagatctacccatgctatccattgcaagcctgtgtcacttctgtgtatgcagctcagcacgaccttaggcaaagccagaatcagcaaggcacgggacacaggcttgattgcaggttaagtgttttattgtttgttttttgagacagagtctcattctgttgcccaggctggagtgcagtggggcaatctcagctcactgcagcctcagcctcctgggttcaagcgattctcctccctcaaccccatgggtatccgggactacaggcacgtgccaccaggcccggctaatttctttgtatttttagtcaagacaggttttcaccatgttggccaagctggtctcaaactcctgacctcaggtgatccacccgcctcggcctcccagagtactaggattacaggcatgaaccaccatgcccggcccaggtgatgttttacatagagctccaataccagagagaagagtgtcaaggggaggtggtgctctctgccttctctggagagctttacccctaagttagctgcccctcacccaccccaggctatcctcttggctcagggcctttctggaattgaggtaaagcacatggtaaccatgaaggccctttgggggctccctgatacataatagtcccacaccgggcagcatgtctgtgatcagctggttggctttttattaacgtatcatattaacaggttcaaccatcctgggacaaagctgagttgtaataaaaaaaaaaagccaacaaaaaaataactttaatatactgttggattcaattcgatagttttaagattttcatagttacgttcctaaatgatattgagtcaaattttccttttcttgcactctccttatctggttttaagaatcaaggtcatactcgtttcataaaacaagcttgctaactttcctccctctttccccatttttaaaattcgttgacagacagtggaatgatacttgtaatgggctttggattttataaaaacacacccccagagtctgcctgctccataggggacttggcacaggcaagaagacacctcttttccttgtttatagtctgcactggcttatttatggcacgtttgttgtttctgggactgttctgctgggagccagccatttccctgaggaagcagagatggaggtggagggaagccctaggcttctaggggagctgtgctgggggaggggagggagccctgaacctggtgccccaggccctgctgcagccacccctctttcccgggagggagctcaaccttactctgcacttacaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaaggtaagaggggccggcagggatgaggttcagcctctcccagtactcagacaaccatgcctggctaaacctcagaaaggcccctggaggaaccacctacttcacagctatcagttaatcagctgttttaactccctgcctgtcagcctgccattctctccctgggtaagccagggcgaaggaggctggggagaccctctctgcagggtggtggggttgccagattcagcacatgaaaatgtgagatgctcaattgcatttgtatttcagatgacaacgaatagtcttttaggacgtgtcccattcaatatttggacctgcagccccatagggactgagggctctcccagaccaggagaattttagttgtgagggtcacgactagtagacccaagagcctggtagaaggtggggtcaggggccctatcagggtttggaggctgcgaagccagtgtgtgtggaggagcccccggcctggtgtctcttcctcagagggctgggcacatctctcccagccacccgtggagctagagaatggagccccgccccctgagctccagctccctggcccagccgaccacacccctgggcatgctggatgcagccccatggcactcaccatctgctctgctgacgctgggccttctccccgcatccctgcatccagcacaggcgggacccacggtgggccctgataaattatggaaaaattaatgggtggatgacacagcagggaaggtccttaggtggtcctccccagggcccccagggacattctctgaccctgatctcccagccacccctccctgccacaattgggcagctcccacacactcttttctcttccccctacagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaaggtaagtcaggagcctggcctgcaggtgtccactggggagtgggtgtagggacacaggccttgcctagccttccccttggaggactggcaaagaggctccctggactgcttccgcctaaggcggcagaaatgtgcacggtaacctcttctctaaggagggtggctcgcctcctccttccctcccttcctttccttcttttctctgtggctgttgtgttgtttcccatttctgtcagtatttgttcccaagtgtgtggccataggaaaagctggatttgcctagtccaggggcagcaggaggccgacttgtggcatgtgtgactgcttcagacgcacatttttcttgtgagaaaggaaagggtgaagggagcccccgtggtgacatttcttggcaggcagagtggagcgcacctttttgcttcttccaggccctccagcatcctgttgatagtgacagtaacctcttttcccatttggcagaggaggagactgatagagagagggtgagtcacccccaggcatgatggagagtgagtcagagaaggaaggtggggagtgctctggggctgcctgtccggcccgggccctcttggctcatgactcttgcgtatgaaggctttacaagcacagcagccacttgttctttagctccttcctgggagggtcaaaggcagtcctaagaaacggctgctgacagtggcatgggtaatggagcctcccctccctcctgggagggctttaagacaagcctgggtactcccctgtcatcggtggggtgagtgtggcccagcctgcacagggtgtgggtttggggatgacccggactacaacctctctgggtcactgcctgccagctgaggtactcagagaaagttctgggcggccgcgcgtggtggctcacgtctgtagtcccagcactttgggaggccaaggtggatgggtcacgaggtcaggagatcgagaccatcctcgctaacacggtgaaaccccgtctctactaaaaatacaaaaaaaattagccgggcgcggtggcgggcgcctgtagtccaagctactcaggaggctgaggcaggagaatggcgtgaacccgggaggcagagcttgccgtgagctgagatcgcaccactgcactccagcctgggggacagacagagcgagactccgtctcaaaaaaaaaagagaaagttctgagctttgtgcactctagtcccctactaggttaaaggacagtgggttgggatccccatgggttgtggcttgatgtatctgtgagaggaacacgagcatctgtgagctgcagggtgtctggaaggctgtgcccctggggagactcagccagaaaaccaacgtaagatcaggacagtgcaccctgctgggaaggtgagattcggagcttgacctccctctgtctctcaggagtcctgctgcgaggcctcagggatttggagaaaggggttgtcaacactgggctgggcactcatttgcatctttctgggctcctgccagcaccccacagcagggggagaggcctgtccatccctgcacaatgtactgagtactcaccatgggccactgctgctgggtatgccgggatgtcccccatacttgtgggagcaggcggtagttatctcgagctcagcaacaccatacttccaaatccaggggagtggtttccttctgggcaactcagacacatctttcaagatttctactctgaagccaagcctctcaatggcaagctgagaccccccgagctgctccgggccggggcttctcagcgtcctcactgcaggcgctcaggtcagtccatcctttgtggtgggctctccttgcactgtagcagcctccctggcctctactcactagaagttggtggtaccctcggttggaataaccaaaaatgcctccagacactgccaaatgtcactcgagcacacccattaagaaccactgccttaagcaaattcaataacagatggggagcatcagccttcctcctcctcctccaccaccacctaccccaggagtccccagatcaagccagcagcccttggcactggggctgactctggacacttgcagcagcttccataacagcagttaggccacagaggccatgcagtgtgccaggcatggctgcaggagggtctgagtatagactccagggctcctgtacctagccccaggcagtgaggcctggagtcactctagctaaagagatcaggaagacagggcgtgggggcacagagaccaaagaggcaagacagttttttaggagcttgcagggattagacatgttccacttagagtcagaagggcaaacattggttaagcacctaccgtgtactccgatatatgtcaaggatacatggcaccagtgggattgcagcatgggagtcagcagccacgggcgtcctgcgggttccagtgcctacaggacaaccaaacaacccacagggttatgaggattacatgagatagtacgttgaaggcacttgtcaaagtggtaagccctcaataaatggctttattagtagtatttgagatggcgtctccctctttcgcccaggctggagtgcagtggcacaatcttggctcactgcaacctccacctcctgggttcaagtgatcctcccaccttagcctcccaagtagctgggattacaggcacgctccaccatacccaactaatttttgtatttttagaagagatggggtttcaccatgttgcccaggctggtcttgaactcctgacctcaagtgatccacctgccttggcctcccaaagtgctgggattacaggcacctgagccaccatgccaggccggctttattatttttaaaaatattatgccatggcctctcccctttaggatacttaaggtatagccccctaagcccacagctggggagccatggctcagggcgggaaatgaggcattgctgtaaatgtatgcatgactcttctagtggctttcttcccaagaggtctatcacatgagtaacttcagaattaatccagagcctgtaacaattaattaattctgttgtcgtgtccccctttccctttcttgtgtggcctcacaagtttcatctggtccttgcttgtgattacattgataaaagctccctccctgtggagacaggcagtgaagccaacgaaaggatgctagagaccagaccttgccaggctgaagaccaagccagctccccagactccccagcctatgtcccagactctgcttgtgctgggctcctggctgggccatccctcccccagcctccagacgcaggctccgccctgagcccagccagcacctgcagcagcagcagcagcacagggacctggcctgtggagacagggaagaaacccctacctcagcctgtccacgtggtacccacacatcctcagagtagagctggcccatgcagaagccctcaaggccaggaggggaatgatctcattttacagcctttcttaggagcttcaggatgagaggtcatcagagccacctcaggaggagctttaggtggtccccaagcttctgccccgacccacctggatgggtgcctggagagcatgttttctgagttaagtccacactcaggccagcaggcagcttccttagagccccgagcctttctacaggttgactgtgtgatgcagtgagccctgccccacttccctccctgtccctgcctggtgacgtctcatggaacctctgttcccaggacctggtatcacagcctcagtcatggccatgcgccctccacccccctcacagccctcccagaggctccctgaggccgtaagatcatactgcccacttatgcagagtttctcaaagtatgttccatgggcctcctaggacccagggaccttgttcaaatgcagtctctgctctaggctcccaccgaatcaggctctgaggcgggaagtctgcggtttctctagctccccagatctctgcacacgtccctgcattgtagtggagacaggctcagagaggatgacttgcctaaggctcatcacagggcagagcagcccagggctgggccccaggtcctgacagcccagtccaggggtcccactgctccactacacagtggatggtgacagtgtcacagtgtcacagtggatggtgacagtcaggtgctggcgaggacatgggagaatgtttactgtccaaatgtactcatcagggatggagtgagtccaggcagtcctgggaggattgctagcttctttcctgtgaaggtcaagcacacactcgggtgggcaggcaggtgtgggggtggcagaagtctgccccagcatggctgtcggccagcaggagtgcctattccaccctaagcaggccagggacttggctggagagtagaagccctgaagctgcggggggtcggggaaggaagggagtgagggttgccaaagacactgaaaagactctggtggggcccaaggcccagatttggggtttggggtccctgagcaagcatcccagcccaaacttactgcttgagatttcctgtaagttgtttcagctatgggatcaggaccaggacccactgggcacctaagacaatggcttacatgatgggtttggagaagttcctagaaggctttttctgcatcccctgaagcatccctctccaggtgccctttaaaaacacgtaatccctgggaggggtcatggtgcatatcaccgctccttggggagaacccaaagatgggcgggcacctttcctgtcagaaagagcagaagggcttgggctcggaaaagcaagaagcctcgcaggcttccagggctgggcctgagcagggctcactgggggcccaggctgcccctcagctccaccttcccttcctccctccctgccagagccaatgaggataggccccctaccttctcctccctcccgggggctccttagccaggagtttcatgccagggaggaagtggaaggactcctttagggggtccttaagacatctccccatccctggcctcaaggcttgggtttggctggacctaccctcctaactccagatctctctggcaccagattcccagcccaggggagacacctgagaaccccccagatggtgacacacctctgtggtcctctgtcagggacataacctcccagcacagatttgcaaactccctgctgcaggcacaggcagggctatcgggccccaggtgtggctcccctgccttggttcagggagtggagacacagttgcccactgctccccaccccactgccaggcctcttctgcccccatgggtcctggggtgggggagccttgggagtgaagaatgcctctgacccagattcttcaagcagcctctgagctcagaggaagagtctgcctcacggcagcctccctggggtctagctgtcaatcgcccaggaagaaatacccagcgcaggacccggcggggagctggccttctctgtcttcccaggtgcagcagagcgagtgtaaggagctgtcttgggcctgcccagcctggtgccctgcgggggactgctggcacaggactgtgactgggcttcagctctgtctgaaaatctttgctcagagcacctccctagtttgatctgataccccgcctgaccctgccagagtccagaggtcacggcggccagcccctgcctccgggaaggttattccaaatgctcccacagccctgacccttcctgttgctttgtccctgcagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtgggaggacagggtgggacacagacgggggcgttggggatgggcagtgagcagccagccaggctggacatctgtgagcaggggcagtgggtggccatgcgtctgggcactgtgcctggcactcaggcccccgcctgcccccaggtggtgatcatgcgggactaccagcacttcaacgtggtggagatgtacaagagctacctggtgggcgaggagctgtgggtgctcatggagttcctgcagggaggagccctcacagacatcgtctcccaagtcaggtgggcagctgggagggctggaccctgagtgcaggctgccctcaccatggccctgccagggcaatgtggtcttctgcctgtggcccagaagacttgggatgcctgggctcccctgcctgctggggtaactgagacccaggggtcttgggagtggagaagagaaggatagcttctagccaaagctcaggccccagttttcaccagggctatggcctgactgtgctgccaaacagattgcctgggagctgtggggcctagcaccagggactcctactctgctcagccaccccacgacctgccagagctaacgttctctttcatcgggtggccccaccttcctgtccaggctgaatgaggagcagattgccactgtgtgtgaggctgtgctgcaggccctggcctacctgcatgctcagggtgtcatccaccgggacatcaagagtgactccatcctgctgaccctcgatggcagggtaggtcccatcctgtccctggcacagccacgctcccacttcctcctgatccaccactcactcccttttcaaccgcaggtgaagctctcggacttcggattctgtgctcagatcagcaaagacgtccctaagaggaagtccctggtgggaaccccctactggatggctcctgaagtgatctccaggtctttgtatgccactgaggtaaccgttccctccaccccccagacctcccaaaagcaacttggcaactggcagctcttctgctgtggcccctccagtgagctcaccaaaagcagccctggttttcagagtcccacctagtcaacacccttccccctttcgatggggctgctcttacccagtgactttgctgccaggaacgagtcctgcaagtgctttcctcagctcaagggcagaatggggtatggccgggcctcctatgtatgatggcctttctctgagtgactgacagctgtgtccctataggcagtggtcactcatgcaggcagtaactggccacagggcaggtgaccaggggaggaaggagacagacccaccaaggagagctggggccagctgtcccccctccaccactgctgccaccagaacgcagctaccaatgggccagggtctggccatggggtcagggacattttcctcctgcaggtggatatctggtctctgggcatcatggtgattgagatggtagatggggagccaccgtacttcagtgactccccagtgcaagccatgaagaggctccgggacagccccccacccaagctgaaaaactctcacaaggtcagttggcacacaagggtgcgacctcgcagaccccattcctcctgaggcaaggggaccagaacctgggctcccagcatctcccttccactgaagccacagggtctgggctcctggaaaaggctcctctttccccacacaaaacccgcacctgggtgtggagccgcatctacgcacaagttcgcatgtgcgctccgacaagtcgcctcccacggctgtggcaggagagttgctgcttggcagaagggttgctgcttggcaggcactggtcggaagcccagtggggcccatgagcagggaaagccaggacaccagcaatccctgctgtccagggagggatccggagaagcttcactgagcacaaacccttctaacccgtgtcgggagatccataccatgattcgatgtccctgtccatcacggcgagtcggctcatgctccatcgttgcacaccccgacacagctaagccacagcgttccccttaaagccagtataagtgcatggaagtgtatacatgtaaccctttttgccaaatcggccccaaccccgcaggccttactgtggacgccccctgctggcaggtcagcacggggctgctaagtggcaccgccatctggtggccaaaacaagaaatgtctcagagggctgaagcctctcctctaaaatagcaaaaaaacaagagttctgtggccccaacacaaagctggatgggaggaccaacaggaaacatcttccaagacaactggtccttggagcccgcaccgctaaccccaaaattagcatataaagatctccagttggctaattcctcagaggatgtagccttctgcccaagactcagcctcatcccaagatactggctcaaaatgaaccaagataagcccttgctttagactcttaaggcctagagcaacaaagaaatcttccttttcaggtctcactttattttctatttttcagagtacttcctcatccttgacttgtttgtttctgttgttgttggttttttttttttttttttttttggagatggagtctctctctgttgctcaggctggaatgcagtggtgcgatctcagctcactgcaacctccgcctcctgggttcaagcaattctcctgcctcagcctcctgagtagctgggattacaggcacgtgccaccatgctcaactaatttttgtatttttagtagagacagggtttcgccatgttggtcaggctggtctacgaactcctgacctcgtaatctgcccaacttggcctcccaaagtgctgggattacaggcttgagccactgcgcccagcgacctgtttttaaaatctcaaaagccctatgtggcagacagggcaagcatactttatcactagcccattttacagatgagaaaactgaggcctagagaaaactgtgacttgcctgagatcacggatagagccagatctggatcactgatgccaatcctctgccccttccacagagctatagcatctgaatgctgagagccttgagggggtggggagggacaagggaacaggaagttaaaaaaccagcgaattcatgactttcaaacaatgataagtccaggcaatcaggtcaccccgaagtgactgcaaattgtggcttcatcttactgccctgcctctacaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgagtctcgagagggccacggggtggtttttatgaccggaatcccgcttcctccctcacgtctgatgtcctgaaggtgcagtcccacctgtacagcccctccccgcccagaactgtgaatggcctgctccaggccatggctgggggcagggagtgaggggacaatttctgagtgaaagagaaagaatggggtcggtggtgaaggtgctctcactttacagaatggagagaacatcgtgtgtgtgtgtgtgtgtgtgtgtgtgtgtgtgtgtgtgtaaggggaggaaagccaccttgacagcccaggtccctccaggtcacccacagccagtttcaggaaggctgcccctctctcccactaagttctggcctgaagggacctgctttcttggcctggcttccacctctccactcctgtgtctacctggccagtggagtggtccatgctaagtctaacactcctgggagctcaggaggcttctgagcttctcctgtactgtgcatcgtgagggccagagacaggaatgtaaggattggcaactgtgttacctttcaagtttatctcaataaccaggtcatcagggacccattgttctcttcagaaccctatctgggagagaaggcgaaccacctccgggtttccatcatgtcaaggtcacaggcatccatgtgtgcaaaccatctgccccagctgcctccacagactgctgtctccttgtcctcctcggccctgccccacttcagggctgctgtgagatggaattccaggaaagaacttcaggtgtctggaccctttctatctagataatatttttagattcttctgctccctagtgacctacctgggggcaaagaaattgcaaggacttttttttaagggtcagagttttcaaaacaaaagcatcttccctagaaatttttgtgaattgtttgcacttgtgcctgttttaaattaaattgagtgttcaaagcca

SEQ ID NO: 653 - DNA, 137918 bp, Homo sapiens
aagtgagggcggcgatgagagcgaaagttgcgctcggctcgtcgctgggggcttgaagcggctccgcgctctgcccgtttgggcctcccccgactcggactcgcgcccgtgggctcccgccgcgcccgcccggccccgcgccggccccgcgccccctcccccgtctcggcgccccctcctcaggagccgcgggtccccgccactttcgcacggccccggcccccgccgatgccggccatggtggagaagggccccgaggtctcagggaagcggagagggaggaacaacgcggccgcctccgcctccgccgccgccgcctccgccgccgcctcggccgcctgcgcctcgccagccgccactgccgcctcgggcgccgccgcctcctcagcctcggccgccgccgcctcagccgccgccgcccccaataatggccagaataaaagtttggcggcggcggcgcccaatggcaacagcagcagcaactcctgggaggaaggcagctcgggctcgtccagcgacgaggagcacggtaggtggcagccgcccccgcggccccgggccccgcgccccgcgccgcgctgaccgccgtattctgcttcccccgcaggtggcggtggcatgagggtcggaccccagtaccaggcggtggtgcccgacttcgaccccggtgagtagcggccccggccggccggcggcggggatgagcgggagccccgggtccccggcgagcccgagggggcgggagcccgccgacaactttctttttgtgcgttcgccctgccgtccgtggggagaacagcagggcgaggacgaggaggcgcacacgcacacgagtgttctgcaaacgtgcctctgcacccgggggaggccaggtcgcccccagcagggccggcgccgctgcccccttgcgcctccgaggactgcgggtggcgtcggaggtggccacacctggcctgggggcgctgggggtccctgcgtccaggtgagctgcgcctcggccaggggtaagggtggcagtgccggagagttagtgtcctgcgagcgccccggacttaggaggtccccagagacccctttctcggaacccttcccaaaggctgctccccacgcctttgctcctcctctcagcctctgggctcttgctggctcctgactgccctcccatccagaaggcgagtagaagaacgaccccccaaaaccagtcaataaaagaagtgtgttttccagagggcgcctgcctggggaagagagtctcgcgtgtggcagttggattttaggacctatttgtaaatgtgtgtatttccttttttttggaggaagagattgtgaaattgagaagcatcagaagctttagcctaacaaatgcttttcacctacaagaaagccctacaccctagaatggaacacttagttccctggctgctattctgtgtagaagcaaatttaaagtggtacaagaaaaaaaatccgatcagacaaaggaattcgtcagattttaatgcatgagattctagccagtgtctgtatgagactgtctttaaaggttgttggtatggaaaatgtttgaaagaacgtaggatttatttcagaaataaaattcaaaagagcatcttgtaaagctggagttaacaatcctccatggttggagggctttagagctggggttctgtatgtgggttataccactagtttatttgaaaagataaacgcatacatgttttttccttggaaacaagactgcagaaaattgcaatgatctagtccttgaaaaaggcgattgctctcaagctgttattaaggtactaaactgcactttgaagtgaaaatacatagaggtcctaggtgagctcttggacactctggaaataaatgacttcctaaattggccttctaaattttgatttgttgacgtaaatctgttaaatttatttgtctaatactcgcgtttgtgtttcttttaagtccatgttagtgtttttgatagtttcctcttctccccaattcttttttttttttttggtagtcacttctcgtttatgagtgacaggatagaactaggtggccaggctatatctcttgtatgcttggctcctccgttccttggttggccaccaggggaagcatactgttttttggttacagttgaccctgtcttcattttgtaggtcaagtctatctttgctttaaaacacagaacataaagcttgttaccaaattttcctaatgtattatttttaaaaatcgacttccacaaatctttgagtaagttggtaggctttttgatacatttttgttaacataaattttgaaaactttatgtagatgtgttggatgtgactaaggaaaagggcatatttgtcaacaacaggaattagatttctgacattcatcgaaatattgacatcagctctgcattgttagtaatgagtttgacttctttggagttatacttttctttgaaacagcaaatataatattttgaactgtctttgggctttttgttggaatagatatgagcataaacttgctagtgaccagctattctaaaatggaaaacatttatcagattgcagtagctcacacctgtagtcccaacacttggggaggccaaggctggaggatctctggagctcaggagttggagaccagcctgggcaatgtagtcagactctgtctcaacaaaaaataaaaaaattagctgggcatggtggcatgtgcctgtagtttcagctacgggggggtctgaggctggaggatctctgggaagtcaaggctgcagtgagcagtgatctggccattgcactccagcctgggtgacagagtgagaccctgtctcagaaataaaaaggaaaacatctaactgttttgctgcatagtcttgctgccaattggttgagtattgatattaaaatttccaaatttcttttttttttttttgagacggagtcttgctctgtccctcaggctggagtgcgcagtggtgtgatctcagctcactgcaagctccgcctcccaggttcacgccattctcctgcctcagcctccagagtagcagggactacaggcgcccaccaacactcctggctaattttttgtatttttagtggagacggggtttcaccgtgtcagccaggatggtcttgatctcctgacctcgtgatccgcccgtctcggcctctcatagtgctgggattacaggcatgtgccaccgcgcccggccccaaatttctttattttgtgtttgttttaatctggaaaggaatctaactggtgtaaagtaatttcaaaccttgttttgccaacctaagcagggggacacagttttctagatatggcagaaaattgagactttactatttcctagtggttttttatgtgtcttttcatttaacttaaaagcttaaggggaaggaaggcttccattttggaatagaaatgatacaacattttttttttttttaatacggagtttcactcttgttgcccacgctggagtgcaatggcgtgatctgggctcaccgcaacctctgcctcctgggttcaagcaattttcctgcctcatcctcctaagtagctgggattacaggcatgcgccaccatgcctggctaattttttgtatttatagtagagacagggtttctccatgttgatcaggctggtctggaactcctgaacgcaggtgatccacccacctcagccttccaaattactgggattacaggggtgagccaccgtgcccagccaactgatgtttgttttatagcaaaattctttcttagctgtttaagacttaagacaggttctttccatgactgcaatttaagagtagtgaattgagtaataaattaagaattgagagtttgatccttactagtttttatttcctcctcctacttgtttttttcttttttcttttattttttgagaccaagtctcactctgttgcccaggctggagtgcagtggcacgatcttggctcactgcaacctccacctccgaggttcaagtgattctcctgcctcagcctccagagtagctgggattacaggtgcccaccaccacgcccaactaatttttgtgtttttattagagatgcggtttcaccatgttggccaggctggtctcgaactctttgcttcaggtgatctccccgccttgtccttccaaagtgctgggattacaggcgtgaaccactgtgactgcccctccccccgcctttttttttttttttgagacggagtcttgatctgttgcccaggctggagtgcaatggcacaatcttgactcactgcaacctccatctcccaggttcaagtgattctcctgcctcagcctcccaagtagttggaactacaggtgcgtgccaccatgcctggctaatttttgtgtttttagtagagacggggtttcaccatattggccaggctggtcttgaactcctgacctcaggtgatctgcccccctcggcctcccaaagtgctgggattacaggcgtgagccaccatgccctgtccctacctcagttttgagtgtgtctttgttcttctcttttactagaatttgaacagagaggtggacgtgaaacttaacaggcagctttttttcttttctttttttattatagtaaaataagtaactatggtagagatgcatgaatggaggaatttgactttgattttttttttttgagacagagtctcgctctttcacccaggctggagtgcagtggcatgatctcagctcactgcaacctccatctcctgggttcaagcgatcctcctgctgcagcctcctgagtagctgggattacagacgcacaccaccacacccggctagtttttgtagttttagtagagatgaggtttcaccttgttggccaggctggtctcgaactcctgacctcaggtgatccacccaccttggcttcccaaagtgctgggatttcaggcgtgagccactgcgcccgaccttttttttttttttttttttttttttgaaatggagtctttctatgttgcccaggctggagtgcagtggcacaatcagctcacacagcctctgcctcccgggttcaagcagttctcctgcctcagcctcctcagtagccgggattacaggcgtgtgccactatgtctggctaattttggtatttttgcaattttttttttttttgagatggagtttttttctcttgttgctcaggctggggtgcaatggcatgatctcgatctcggctcacctcaacctccacctctcaggttcaagcaattctcctgcctcagcctcccgagtagccgggattacaggcatgggccaccacacccagctaattttgtatttttagtagggatagggtttctccatgttggtcaggctggtcgtgaactcccaacctcaggtgatttgcctgccttggcctcccagagtgctgggattataggcgtgagccactgcgcagccctaattttggtatttttggtagagatgggtttcaccatgttggccaggctggtctcgaactcctgacctcaggtgatccactcacctcggcctcccaaagtgttgggattacaggtgtgagccactgtgcccggcctgatttttttgtcagattttacttatttgcggtatgccagcttgaccctatttaggtttgaaagcaaatggttggagctaagactatctgatatttcctatgcagttcaaaggaagatttaattctgtcatgccttacaaagagtgaatgaggtggatagagcacgttagtcttaaaatcctgattcagttcttttttttttttttttttgagacggtgtctcgctctgttgtccaggctggagtgcagtggtgtaatccgggctcactgcaagctccgcatcctgggttcatgccgttctcctgcctcagcctcccgagtagctgggactacaggcgcctgccaccacgcccggctaatttttttgtattttaagtagagacggggttccaccatgttagccaggatggtctcaatctcctgacctcgtgatccgcccgcctcggcctcccagagtgctgggattacaggcgtgagccgccacgcctggccctgattcagttcttataaaataattaatacctagattagatcggtgtagtgtggcattgcttggtagttagaataccatttgtgtttacactgaaataaaaagttttaccaacttttaaagagttaaaaaaaaaaagagttaaaaacctaagtgcagccctacacttttaacttaggctttgttcttacatgtgttgtccagactgcctttccatgctgtctgccgcagattatgctgagttgtcattggtttcttttaatattcagtagttacagaataatagggtaagaggggggatgcttatctatcctacctctggttggttctttcctacataagcaaagcatcacttattttgaaatgaataatgtttttctttccttttttttccttttttttttgagatagggtcacactctgtcaccagtatagtggtgtgatcatggcggcagtgaacttgaacctcctgggcgcacactatcctcccatccatactttacctcgaaagtagctgggactacagatgtccacgaccatgcctgactagtttttttgtattttttgtagagacaagagttttgccacgtagtccaggctggtctcgaactccttggctcaagccatctgcctgccttggcctcccaaagtgctgggcttacaggtgtgagccaccgtgttcagccattattattactattttttaattttttttattctctttatacacgtccttggtgcttcagaggcgtacattgttaatgatgaatatttttgagatagtggccctttaaaaaagcaacctttattttgaatgtttaatccaatgtatttaatcagatctgaaaatttgtggttgtcattggcttaactgtcacttcagagttgacttctgtcagaaaactgtgttatgttttcatgtggaataggtaattttactgaacagggtgtcttgatatgcctttcatttgttttcactggtgattctatgttctgctttttttatgctttagatcattgtaaaaaaaatatggtgaatgctttgtggttttgttttgttttgttttttttttttgaaacaaggtcttgctctgtcacacaggctagagtgcagtggccctgatgttggctcacttcaacctctgcctcccagactcaagtgatcctcccccctcagcctcatcagttgctgggaatacatgtgcacatcaccacgcttgagcccaggctggtctctaactcttgtgctcaagcagtcttcctgccttggcctcccaaagtgctgggatcacaggcatgtgcctggcaatgctttgtgatttatttatttaattattattattatttttttgagacggagtctcgctctgtcacccaggctggggtgctggagtgcagtggcgcgatctcagctcactacaagctccgcctcccgggttcacgcccttctcctgcctcagcctctctgagtagctgggattacaggcgcccaccaccacgcccggctaattttttatatttttagtagagatggggtttcaccgtggtcttgatctcctgacctcgtgatccgcccacctcggcctcccaaagtgctgggattacaagcgtgagccaccgcgcccagccagtgattgattgattgattttagttttattttttattgtattttgagacagagttttgctcttgtcacccaggctggagagcaatggtgtgaccttggctcactgcaacctctgtctcccaggttcaagtgcttctcctgcctcagcctcccgagtagctaggactacaggtgtgtgccaccatgcccagctaatttttttttttttttttttgaagacggagtctcactctgttccccaggctggagtgcagtggcgtgatctcagctcactgcaagttccgcctcctgggttcacgccattctcctgcctcagcctcccgagtagctgggactacaggtgcccgccaacacgcctggctaattttttgtatttttagtagagatggggtttcaccatgttagccaggatggtctcgatctcctgacctcgtgatctgcccgtcttggcctcccaaagtgctgggattacaggcgtgagccaccgcgcccggctgctaatttttgtattcttagtagagatggtatttcgctggctgggcatggtggctcacacctgtaatcccagcactttgggaggccgaggcaggcggatcacttgaggtcgggagttcaagaccaacctggccaacatgatgaaacccctctctactaaaaacacaaaaattagctgggcgtggtggtgcatgcctgtaatcccagctactcagaaggctgaggcaggagaattgcttgaacccaggctgcaaaggttgcagtgagcgtagatggcaccactgcactccagcctaggtgacaaagtgagactctgtctcaaaaaaaaaagacggggtttcactatggtggccaggctggtttcgaactcttgacctcaggtgattgacccgccttggcctcccaaagtgctgggattacaggcttgagccaccgcacccgaccaaacactgatttaatactaggcaatatttgcttcaggtacagctaaagcctcattcccgccttctttcttcattaattcacagttggtttatattatttctgtgatagtttgcatcttctgagaagcagatgacaagacagaattagatgtgcaagaggttcattagggtatgcttgtgaaggataaagagaggaaggaggtgtaggtggcaagagcctttacactggaagcatgtgtgacacctgtgaaagaagagagggaaggaatgatgattaatgattgatagaggaacctcaaactgcagtgcagcttgcagttcagagaaaatctcagccagagtagattgttagaagagtctgttgggcaggaatggtccttctttgtgaacatctgctgtgttcagtcattggctgggagcagcctagagtagcctagccttggtatgggtgctgtagtagatttctggtagctggggctgtcagttaactacactccttgcaacattttctctcttgaagggaaatctgagtggcacactcaaggctgtcagaattcccatacgtgtttttgtacttaaatacatgtgtgtaattccagcactttgggagggtgaggcgggaggatcacctgagatcaggagttcgagaccagcctggccaacatggcgaaaccccgtctctactaaaaatataaaaattagctgggtgtggtcgcgggtacctgtaatcccagctacttgggaggctgaggcgggagaattgcttgagcccgggaggcggagattgcagtgagccgaggttgtgccactgcactccagactggacgacagagctagactccgtctcaaaaaaaaaaaaaaagtgataatatgttttcttgttattgttagtgtttttgtaaatggaataatctatgctattcatgtacttttatgctttccaaacaagtacatttccactagcaaggtaaacaactttgttttcaccttgtcttcgtcatggtgttagttaggttattaattttttttaaatgctatcctttaatggcttatattagcatttttttcttttcttttcttttctttttttttttttttttttggagatggagtttcgctcttgttttgttccccaggctagaaatgcagtgacgcagtctcctctcactgtaacctccgcctccccggttcaagtgattgtcctgcctcagcctcccgtgtagctaggattacaggcatgtgctaccacgcctggctaattttaaaaaatatttttagtagagaaggggtttcaccatgctggccaggccggttttgaactcctgacctcaagtgatctcccgcatcggcctcccaaagtcctaggattacagacgtgatccactgtgcctggcctcttctttctttttttgtagacttgatatcgttctgcctcttaggctggagtgcagtggcatgatcacagcacactacagcctcagcctccagggctcaagtgatcctcctgtctcagtttcctgagaagctgggactacaggcatgagccagtatgcctgactgatttttgaactttttgtagagacggggttttgccaagttgcccagactggtctccaactcctgggctcaaccagtccttctgctgtgtcctcccaaagtgttgagattacaggcatgagtcactgtgcctgtaattaagttttccaattaatgatgaggttaagtgtcttatgtttttaatttttaatttttaatttttttaagaccttttttttccccttttttgagatgagttcttactcttgtcgcccaggctggagtgcagtggcgtgatcatagcgtactgtagccttgaacttctagggctcaagtgatcttcatacctcagtttctggagtagtttggactacagttgttcaccaccacacccagcaaagaatgtgacaaaaagtactaagtgtgttttagctaagtatcgataagaaaagagtgtctttttatttattttttatttgtttatatgtactttttgagacagggtctggctctgtcatccaggctggagtgcagttgtgtaattttggctccctgcatcctcagcctctcaggctcaagtaatcttcccaccttggcctccggagtagctgggtttataggctcttgccactatgcccagctaatatttgtattttttgtagagatggggtttcaggttttgttggtcttaaccctggcccaggggtgtctgtaaatttttttttcttttttttgccactcagtttcctcctgtgaatgtatctttcttttgctatttttcttttttttcccccttagggtcttgctctgttgcccaggctggagtgcggtggcttaatctcagctcactgcaaccttcatctcctgggctcacatgatcctcccacctcagcttccgaggtagctgggactacaggagtgtgccaccacgcctggctaatttttgtgtttttttgtagagacagggtttcaccatgtttcctaggctgttttgctgtttttctatagggtgttggtttttataggttttggttttttgtatggatttgtgtgagttctttttatttatatatttggatattctttgttagaattgcacatatgttttttgttttttctttaatattatgtgtgttgcggggaggaggattgagtttatttgactaggaagggataaaaatacattcctgactggagactgtactcagagattggtcttggtgtatacccctgatttctaagatgaatgttactgagaattgacaattttttttgttgattgttgtgtttccactaagttattcatctcattttggcctgctattagctagttgacccaaatcacagtgctggatgacttgaaaagctctgatttaatttttgcctagtatatagttatagtagcatataggttaaaggttaaagttacagctttgatcctataatggtcagttagtttcccacgaaaggttaaaatgctatagactaaaactaacagctgtcttagggatttgccactccttataaggcaatgggtagtgtgtggatagggaggtacaacttgtcatcactaacaaaaccctcgaaagaatgatctatccaggttgcttactctgtgccaggctagttttaacacacatcaaatcatttgaccctcacaacagtcatatgatgtaaagttactatctccattttccagatgaggaaacagaggcattgagaggcttagtcttatggttgaacctaataacttgccgtggtaatccagtccgagaggccctcagctgtaagaggcacctttattttatgtttcagtaagaaaggaaaaggatcaacaagatagactgttaattttaagtattataagaattctgatttataagtataatcagaattcaatttagtgtattttagagagggtcagccagaatcctctttaagagaaaacacttaggctgggtgcagttgctcactcctgtaatcccagcactttgggaggctgaggcaggtggatctcccaaggtcaggaattcaagatcagcctggccaaaatggtgaaaccctgtctctactaaaaatacaaaaaattagccaggctataatcccagcattttgggaggctgaggcgcgagaattgcctgaacctgggaggtggagctacagtgagccgagatcgtgccactgcactccagcctgggtgacagagcaatattccatctcaaaaaaaaaaaaaaaaaaaaaaggaaaagaaaaaacacttaggagcaagactttattggatccattgattagttgtttccatgtggccccaggtgttggggaattttatgtttcgggttgccagagccaacttgtagtccagttacattcctcttcttcctggcagtgagaacaccggtgaaatgggaggtggttagcttggttgcctggggacaaattggactgagttgctttattcctgcatgtatgttgaaatagtcatcttcacaacttagaatatagttggagttttttttagaagagccatttattttgatggtgtgactgaaggctatacatacagtcatgtattgcaaaacaaatgtcattttggtcaaggacagtggtcccataagattataatggaactaaaaaatttctgtcgcctagtaacttcaccttgtctatagtgcaacagcgtgtagcattacttaggtgtttgtgtggtgttggtgtaaacaaacctactgcactgccagtcttacaaaatctagcacatggagttatgtatagtacatagtacttggtaatgacaataactgtattactggtttgtggatttactatgctatactttgtatggttattttagagtgtattcctacttataaaaattatcagtttgctgtaaaacagcctcaggcaggtccttcaggaggtattccagaaggaaggcattgttactctagaatatgacacctccatgggtcttattgcctctgaagaccttccagtgggacaaggaaggtatggagttggaagatggtgatattgatgatcctgactgtaggctaggccaatgtgtgtgtctttgtggttttttttgtttttgtttttgaaatggagtctcgctctgttgcacaggctggagtccagtggcatgatctcggctcactgcaacctctgcttccctgcttccagtgattctcctgcctcagcctcgtgaatagctgggattacaggtgcgcgccaccatgcctggctaatttttgtatttttagtagaaatagggtttcatcatattgggcaggctggccttgaactcccgacctcaagtgatctgcctgcttcggcctccgaaagtgctgggattacaggcatgagccaccgtgcccggcctaatttttgtatttttagtagagacggggttttgccatgttggccaggctggtcttgaactcctgacctcaggtgatttgcctgtcttggcctcccacagtgctgggattacaggtgtgagccactgcacctgactgtatttacacccatactctccctgaaggttgtagttcctgccctgctttacttttactggcatagaagctgctgggcttggtgttctgctttcaaacttagcgtggatatagggagttcagcggggaggaagagaagagtaggtgcttaactagttttgatcttactcagtaccagagagtgttctgggagctagtggtgtcatgtatgtctgatttctttgagggtggtagcgtagttttttgaaccaccaaatcaggttttaagttttttttttttttttggaggggagatagggtctcaccctgtcccccaggctggagtgcagtggcgggaacatggcccactgcatgcagccttgacttcttgggcaccagtgatcctcctgcctcagcctcccaggtagctgggattacaggtgtgaggcactgcacctggctgttaagtattatctagtataaactcgtcagagctaaataggggctgaattttctaagaatatgtgcttggtttgggtcttttcttgaataggcttttgtttttgtttttttgatttttttgggttttgtgttagtttttttttttttttttgagacgaagtctcactctgtcgcccaggctggagtgcagtggtgtgatcttagctcactgcagcctctgcctcccggattcaagtggttctcctgcctcagcctcccaagtagctgggattataggcatgctccaccacgtctggctgattttgtatttttagtagagacggggtttttccatgttggtcaggctggtctcgaacttctaaccttaggtgatccgtctgccttggcctcccaaagtgctgggattataggcgtgagccaccgcgcccggctgagtaggcattttttaatggacatttgataaggaccaagtgcaactgtatatcaaatggaaatctagggaaaaattgtcttttaaattgcagttaaaagctgattatccctattgtctcttgctttccttataatgaatttgtataaattggagatgcacatcttgcatagatgtgttttcttttttttatataaagtggtgcaagtcacatcacaaaattgactattttttggccaggtgtggtgactcatgcgtgtaatcccagtgctttgggaagctgaggcaagtgggtcacctgaggtcaggagtttgagaccagccaggccaatatggtgaaaacctgtctctactaaaaatagaaaaaagctagccaggcgtggttgctcatgcctgtaatcccagcactttgagaggctgaggtgggcagatcacgaggtcaggagtttgagaccagcctggccaacatggtaaaaccccatatctactaaaagtataaaaattagccgggtgtggtggcacctgcctttaatcccagctactcaggaggctgaggcaggagaatcgcttgaacccgggaggtggaggctgcagtgagctgagatcgtgccactgcacactagcctgggcaacagagcgagactctgtctcaagaaaaaccacaaagtacaaaaaattagccaggtgtggcggtgcacgcctctaatcccagctacttgggaggctgaggcaggagaattggttgaaccggggaggcagaggttgccatcagccgagatcacgctactgcactcaagcccgggcgaaacagagagactccatctcaaaaaaaaaaacaacaaaattaaccgttttacaatgaacaattcagtggcattcagtgcactcgcattgttgtggagccactgcccttgtctagttccgaaacattttcatcaccctaaaaagaaaatctcacatgtgttagaatgaagaatgagttacttcttattctccattctcagtaccaggcaaccactaacctgctttttgtttctggattacttattctggaactttcacgtaaatgggtatgtgaccttcatgtctggcttctatcacttagtgtaatgttttcaaggttcattcatgttgaagcttgagtcagtattggtactttctgtgcttcattgcttttgttttgtgttgttgttttttttgttttgccttgtttttgttttttgagatggagtcttgctctgtcgtccaggctgaagggcagtggcgtgatctcaactcattgcaacctctgcctccctcgttcaagcgattctcctgcctcagcctcccaagtagctgggattataggtgcgcaccaccatgcctggctgatttttgtatttttagtagaaatggggtttcaccattttggccaggctggtcttgagctcccgacctcaggtgatacacctgtctcggcctcccaaagtgctggggttacaggtgcctggcctaattttaaaattttttttttgtggagagacggggtttgtttatgttggccaggctggtctctaactcctgacctcaagcactcctcctgcctcagcctcccaaaatgctgagcttataggcatgagccactacacctggctcattcatttgttgatggacatttagcttgttgttaccttttgattattgtgaaccgtgctgttatgtacattcatgtacaggtatttatctgttttcatccttttaggggtatatatctattagtggaattgctgggttatggagtaattctgtgcttcacttttttttttttttttttttttttaaatttttattttgagacaggctcttgctctgttgcccaggctggggtgacagtggtatgatctcagctcactgcaacctctgcctcccgggttcaagcaattctcctgcctcagcctcctgagtagctggggttacatgtgcatgccactacacctggctaatttttgtatttttagtagagatggagaaacatgttggccaggctcgtcttgaactcccgacctcaggtgatccgcctgcctcggcctctcaaagtgctgggattacagatgtgagccactgtgcctggtctgtgcttaactttttgaggaaccattaaattgtttttcacagtagcttaaccattttatactccatgattaacgtatgagggtttcaatattctactttttattttctgttttttgagatggagtctcactctgttgtccaggctggagtgcattggtgcgatctcggctcactgcagtttccgccttccaggttcaagtgattctcctgcctcagcttcctgagaagatgggattgtaagcatgtaccaccaagtgtggctaattttttttttgtattttttagtagagacagggtttcaccgtgttggccaggctgatcaggctggtcctgacctcaggtgatctgcctgtctcggcctcccaaagtgctgggattacaggcgtgaaaatgctactgatgacagtgcagagagtcctgagatgcttagagtagtggagttactcgatccttccctgtggtggagggttgggagttgaagaaaccaggaagtcctatatgaaatggtcctttaaggccgggtgcagtggctcacccctgtaatcccagcactttgggaggccgaggcaggcagatcacgaggtcaagagattgagcccaccctggacaacatgacaacatggtgaaaccctgtctctactaaacatacaaaaattagctgggagtagttccagctactcgggaggctgaggcaggagaatcgcttgaaccctggaggtggaggttgcagtgagccgagattgcgccattgcgctccagcctgggcaacaagagcgaaactccatctcaaaaaaaaaaaaaagagaaatcgtcctttaagtcaagccttaaaacgtaggaattacctagttaatttgaatattaatattatatgatatataagctgtacatgttataaaaattattttgaaaagtttaatctttaaaattttagtttagattttccttgtagttatctagagctgtgctgtccaatagtgtagccactagctacatataactattgaaatttaaattaattaaaattaaataaaattaaaaattcagtccttctgttacactaggcacattttagatattcagccatcatatatagctagtaggtgccatattggacagctcagaatagagtatttttatcctcccagcaagttcagttgggtggcaatgatctagacattttgatgaaatgaaagcttcattattattgctattattattattatttttgtgtgtgtgtgacagagtgtcgctctgttccccaggctggagtgcagtggcgccatctcagcttactgcaagctcgcccacccgcgttcacaccattctcctgccttagcctcctgagtagctgggactgtaggcgcccaccaccacgcccggctaattttttagtagagacgaggtttcaccgtattagccaggatggtctcaatctcctgacctcatgatccacccgcctcagcctcccaaagtgcagggattacaggcgtgagccaccgtgcccagcccaaaagcttcgttattattaatttttataattcagacgttttgcctcttttgtcaagtgcatgaaatttgagatgggtacagctgagaaatgtatgatggctgtgtgctgaattcctctaggggtgtatttgtttaaatattgccaataaggtgttcaaaataaggttatttgaaagagcaagttgaaatggaaagcttaggagagcttagttttttgtttgtttgtttttttgagatggagtttcgctcttgttgcccagactggagtggaatggtgtgatcttggctcactgcagcctccgcccccacaccattcaggcgattctcctgtctcagcctcctgagtagctgtgattacaggtgctcaccaccacgcctggctaattttttgtattgttagtagagatagggtttcaccatgttggccaggctggtctctcctgacctctggtgatcctcccactttggcctcccaaagtgtagggattacaggcatgagccaccatgcccggcctcagcctatagttcttttaatgcccttgtctactaattctatcatctgtgtcatttctgggtcagtttcagttgcttgattcttttttttcttcctctttttgggttgtcttttccacctactttgcttatctgttgatttttggatgccagacatcatgaattttactttgttggaggctggatatttttgtatttctataaatattcttgagttttgttctgagatgtggttaaaatacttaaaaatagtttgatgaagtcttgcttttaagctctgttaggtgagatcaaaaccattttagtgtagggctaagtatttcccactattgagtcaaaatccttttggggattctgtgtgatagcccatggactatgtggttttccactctggctgtgaggaactggcactcttcctgttcccatgtgagccttgtggattgttccatttgattcttttgggtattttatttatatttttagagaaggtgtcttgctctgtcactcaggctggagtgcagttttgtgatcatagctccttgcagcctcaaactcctgggctcaagccatgcaccccatatagctggggctataccatgcctggttatttttattgttttagagatagggtctcactgtgttgcccaggctggccttgaagactccagggttcaagcgatcatccctcctcagcctccccagtagctgggattacaggattttgccatcacatctggctaagggggtgtggaaccagggacaaagaccaaatacatatttcataatatactacacaaggtaaatctggttcatgtcactctaccttgactggaagcataagtatagattttgccatgttgcccaggctggtcttgagctcctagcctcaagcggtcccctcttcccaaaccttggcctcccaaaggtgctaggattgcaggcatgagccactgcacttcctgagtagctgggattacaggtgcgcgccaccacgcccgctaatttgttttggatttttagtagagacggggttttgggccaggctggtcttgaactcctgctcttaagcgatctgcccgcctcagcctcccaaagtgctgggattacaggtgtgagccaccacgcccggtctgatttttgtattttttgtagggatgggggtttccccatgttacccaggctgctcttgaactcctggcttcaagcaatccacctgcttcggcctcccaaagtggtgggatttcaggagtaagccactgcacccagccttgttcatttcaatattcctgatgaagtactccatctgatctcatttgctcttagaaatctgcttgctggttaccctgtgcagtggctcacacttgtaatcccagcactttgggagactgaggtaggaggattgcttgatgccaggagctagagatcagcttgggcaacatagcaagaccttgtctctacgtgcacctgtagtcctggctacttgggaggttgagatgggaggattgcttgaacccatgggtttgaggctgctatgaggtatgatcacaccactgcattttagcctgagagacaggagacagtatctcttagcaaaaaaaaaaaaaaagaaaaaacaaatctgactaccgtattgatgattctagtccagaattttccaaaggagtataggtggtttttttggttgttgttgttgtttgttttgttttttgagatggtgcgagtctcgctttttttgttttgttttgtttttttgagatggagtcttgctctgtcgcccacgctggaatgcagtggcacaatctcggctcattgcaaccttcgcctcccgggttcaagcagttcttgtgcctcagcctcccgagtagctgggactacaggcgtgcgccaccacgcctggctaagttttgtatttttggtagagttggggtttcaccgtgttggcctggctggtatcaaactcatgacctcaggtggtccgccattctcagcctcccaaagttttggaattacaggtgtgagccatcgcacctggcctttttttttcttttttaaacatatttatttatcatttttttttttttttgagacggagtctcgttctgtcgcccaggcgggagtgctgtggcgcgatctctgctcactgcaagctccgccttccgggttcacgccattctcctgcctcagcctcccgagtagctgggactacaggcgcccgccactgcgcccggctaattttttgtatttttagtagagacggggtttcaccatggtctcgatctcctgacctcgtgatccgcccgcctcggcctcccaaagtgctgggattacaggcatgagccaccgcgccccgccatccttttttttttttttaaagaggtggagtataactatgttgcccaggctgatcttgaactcctggcctcaagcagtcctctaccttggcctcacaaagtgctgggattacaggagtgaaccaccgcgcctggctgagataggttgttttttgaattaactattcttttttttttttttttttttttttgagacagagtttcgctgttgttgcccaggctggagtgcagtggtgcaatgatctaggctcactgcaacctctgcctcccaggtttaagggattcgcctgcctcagcttcccaagcagctgggattacaggcatgtgccactacacccggctgattttgtatttttggtagagacggggtttctccatgttggtcaggctggtcttgagttcccaacctcaggtgatctaccctccttggcctcccaacgtgctgggattataggcgtgagccactgcacccagccatgtttttaagatttttaaacatctggctcttttttttttttttttttgagacggagtctcgctttgtcacctaggctggagtccagtggcgccatctcggctcactgcaagctccgcttcctggattcactccattctcctgcctcagccccccgagtagctgggactacaggcacccgccaccatgcccggctaattttttgcatttttagtagagacggggtttcaccacgttagccagcatggtctcgatctcttgacctcgtgatccgcccgcctcggcctcccaaagtgctgggattacaagcatgagccactgcacccagcccttctggctctttttaaatgtcagatattgataactcccagactgaattaagattttatatgtcagatgattaactatcattttgagttgttgcttagttctctgcttgcttggcaacaggtcagtttccatggtattgccatttttgtaccgcattcttagtggagctgagaggttgggggtgaggctacagggccgaactctataaactagaatagctaaacttttatccagtttggtgtataaaattttttgatatacagctcaggaaaagcatataaaaaacaaaaataaaaataatttctgaataatttttttttttttttgagacggagtctcgctctgtcgcccaggctggagtgcagtggcgtgatctcggctcactgcaagctccacctcccgggttcataccattctcctgcctcagcctcccgagtagctgggagtacaggcacgtgccaccatgcccagctaattttttgtatttttagtagagacggggtttcaccatgttggccaggatggtctcgatctcttgacctcgtgatgtgcccgccttggcctcccaaagtgctgggattacaggcgtgagccatagtgcccggcccccccgcccccacctttttttgagacagagtcttattctcacccagcctggagtgcagtgttaacgatcttggctcactgcaacctcttcctcctgggctcaagtgattcttctgcttcagcctcccaagtagctggaactacaggtgtatgtcgtcatgcctggctaaatttttttttttaatattttttagtagagacggggtttcaccatgttgtcccagctggtctcgaacccctgggctcaagcaatccacccatcgtggcctcctgcagtgctggggttataggcatgagccaccttggcctgcataattcttttttttttttttttttgagatggagtttcgctcttgtcgctcaggctggagtgcaatggtgcgatctcggctcaccgcaacctccacctcctggattcaagcaattctcctgcctcagcctcccaagtagctgggattacaggtgtgcaccaccatgcctagctaattttgtatttttagtagagacagggtttctccatgttggtcaggctggtctccaactcccgacctcagattatctgcccaaccttggcctcccaaagtgctggtattacaggtgtgagccaccacgcctggccattaattcttttttaagaaagagtttcattgctattaaacaagtttgaaaatcacagtttctgcttgagtagaaaatacaaacttgggtttctaccactacactttcacaacatgcttttgactccagatttgaggggggatttctccccaacaggaggtaggccatcagttctgcagtgggcagcagctgggcatcctctaattgaattcagttctgacactgtctacactacccgcttagagatggatggtgacacatcacacaggttgaggactcagtcctatctttgatagtgaacgtaaaccttcatttattttgtctgtggttctgaccagccagctgcaaatttcaagagttcctgcagatacctccttgacttcaattactttgctagagtaacttacagaactcagggaaatgtgtttatccatttattacaaaagatacatgtgtatatgtgtgtgtgtgtgtgtgtgtgtgtgtgtgtgtgtgtgtgtgtatgtgtgtgtgtgtatatatatatttaaattttatttgagttagggtctttccccagttgccaaggctggagtgcagtggtgcgatcacagctcactgcagcttcaacttcttggactcaggctatcctcccatctcagcctcctgagtaggtgaaactatatacacacagcaccatgcccagctaattaaatttttttttggtagagatggggtcttgctgtattgcccaggctggtcttgaactcctgggctcaagcagtcctccggccttggattcccaaagtgctgcaattacaggtgtgagtcatcatgtttggcctacaaaggatatttggaaggatgcaaataaacagtcaggtgaagagatacatatagggccaggattgaaatggtccctagcactggcacttctgtcttcttggagttgggatgggccaccctcccctcacatggctgtgcttctctttactcctgcaatcccccatgtgtttggctccctacaagccatgttcagctccctgcaagctctctgaacccaatcctttcaggtttttatgaaggcctcattacgtagggatgactgattaaatcttttggccattggtgatgaattaaaagttcagtccctctcccctccttggaggttgaggtgggagttgaaaccatttgtcatcctaagctaacaaacggttgccagctattggtcaactcattggcatacaaaaagacacattactttgaagataccgaggattttaggagttgaagggccaggaaacaggaaggccaaatatatatttcacaatatcacaatatgttattaagagcaaatagtgatagaaaagtgaaagtgatgatagcagaaatgtaaagtgtaggttctataaacagtgcagatgagaacaaagctaacagttatcaggcagtctaaatgcatgcagttttttaccttagacacattcgttcgttgactgtttaattgtaaagaaaaatcaatttaagaacatgtatgaaattgcatttatactctggaaaaatgagatgtaagtaggtattttgtattttttagcgtttcaagagcataattccccttatggtatgtctgttgccttgctttcacacattccacttgtgtacatgtttttgggaactcattatgtaagaaagtaatggacttcttacacttctgttaggtaaaaccatagtaattggctgggcatgatggcatggggtgggaggatcacttgaggacaagagtttgagcttgcagtacactgatctttgctgtgaatagtcactgcactccagccggggcaacgaagacactgtctctttcttttttttttttttttttttttgatggagtcttgctctgtcgcccaggctggagtgcagtggcacagacttggctcactgcaacctccacttcccaggttcaagggattctcctgcctcaggctcccaagtagctgggactacaggtgcctgccaccatacctggctaatttttgtatttttagtagagacggggtttcaccatattggccagactggtctcgaactcctgaccttgtgatctgcctgcctcggcttcccacagtcctgggattacaggcgtgagccaccgtgcctggcccaagactctatctcaaataaaaaagaacacagtaatttttctcttttatgggatactacacttacataagtttcttttttttttcttttttttttttttttgtgagacagagtcttgcttttcccctgccaggctggagtggagtggcatgatctcagtcactgcaacctccgcttcctgggttcaagtgattcccgtgcctcagcctcctgagtagctgggattacaggcgtgccccaccacgtctggctaatttttgtatttttagtagagatggggtctcaccatgttttcccaggctgttctcaaactcctgagctcaggtggatcccccctgcctcggcctcccaaagtgttgggattacagtcgtgagccactgtgcctgtctgggatgtttgccatatttgtttcatcagtatatatttctttgcttgggttgagtacagggactgatgcctgtaatcccagcacttagggaggccgaggtgggaggattactggaacccaggaagttgaggctgcagaccaacctaggcaacagagtgagaccatgtcttcagggggaaaaaaaaagcgctgggcatgggcatatacctatagtctcagctactctggaggatgaggtgagaggatcgcttgagcccaggaatttgaggctgccatgagccgtcatcatgcccatgccaatgtactccagcctgggcaagaaagtcgaccctgtctcaaaactaaactaaacaaatttctctggctgaagtttagtaatttgcttttaagtgacgtttgtacattttagaaaataactttgtatattagacatcatttatggtacttaccgttttccatggtcataaaatacctagtctagtgtgataaatgccaggtgatagaggtatgcctggggcataaacctaggggcttggtgggatggggtgagatggttgaaatagtatgtagaaggaaaggctttccagagtttactcttagggtggctcttgaagggcaagtgaaggaaagacatttcaggctgagggaagacacgtttagatggagtcctgtggatggagagtgctggacttgtttgcgaagtcaggagtagtttgatatgatcagatgcttagggaggtgattggtaaagtggtggaaggtgagattgtggaacaggtaggcatggaccctatcacaagcgtcctggcttgtgtatctagctaaaggatctgtctgtctgtctgtctgtctttatattttttgagacggagtttcgctcttgttgcccaggctggagtgcaatgatgcaatcttggttcattgcaacctccgcctcccaggttcaagtgattctcctgccttagccttctaagtagctgggattgcaggcgtgcactacacgcccagctaactttttatttttagtagagttggggtttcaccatgttggttaggctggtcttgaactcctaacctcaggtgattcacctccctcagcctcccaaaatgctgagattacagatgtgagccaccccacctggcccatgcctctatctatctatctgtctgtctgtctatctatctattctatctaatcttttttttttttttttttttttttggagtcaggttcttgctctgttgcccaggctggactgtagtggcgtgatcttgcctcactgcagcctctgcctcccgggttcaagcgatcttcctgcctcagcctccctggtagctgggactacagatgtgtgccaccatgcctggcaagtttttatatttttggtagagatggggtttcactatgttggccaggctgatctcaaactcctgacctcaggtgatctgcccacctcagcctcccaaagtgctgggattacatgcgtgagccactgtgcctggcctgttaagtattaccataaactcttctcctatctgtcttgtaagttatgtacacctcatctatgttcttgatgtagcttgttacttagtctgttatagtaataatctctttaattattagcttttatgtcttctccattgtccactgacagccataactgcgtatatctttttgtatacctgtctacagaccagccatcctaggttgaagaatagaattacttctcattgcttccacagttcctgtcttcctttaaatcatcatgtataacacaaattatacagtagctttcttgtaaatctcctgcttctgtattttatatctgttaggctgggtgcagtgactcacttctgtaatcccagcactttgggaggccaaggtgggaggattgcttaaggccaggagtttgagaccagcctgggcaaaatagggagacaccccgtcaccacacacttatacacacacacacacacccccccacacccaccatgaaaaaaattagtcgcggcggggtgcggtggctcacgcctgtaatcccagcactttgggaggccaaggcaggcagatcacatgaggtcgggagttcaataccagcctgaccaacatggagaaaccccatctctactaaaaatacaaaactatctgggcgtggttgcacatgcctgtaatcccagctaccctggagtctgaggcaggagaatcacttgaacccgggaggcagaggttgtggtgagccgagatcgtgccgttgtacttcagcatcaacaagagcgaaaccgtctcacaaaaaaaattagtcgggcacaatggtatgcatctgtggtcacagctatttgggagactgagctaggaagattgcttgagctcaggaattcaaggctcagtgagctctgattgtggcactgcactccatcccgggccacagagactctgtttctaataaataaataaaatgtaaattagctgttcctctgtggcttacaaccttccagtggctcccatttcacttagagtaaaagtgaaagccctcaccgtggtcccctccttttttgctgctccattactctttctttatctccttcacttcattcagatcattgctcaataaggcctctcctaacctacctatctgcaagtatctctagaatatgacttaaaaacaatctaaacacagatgtcacaactaaaaaaaattaatacttagtccttagtgtcattaaatttctggtcacctattgttaaatagttgctttgtttgaaggtcactgcaacctgcatttcctgagcccaagctatcctcctgtttcagcctcccgagtagcagagactacaggtgtgcaccaccatgcccagctagttttttagaattttttgtagagacaggatctaactgcgttgcctaggctggtcttgaactcctggcctcaagtgatcctctcaccttggcctcccagtatgctgggattacaggcacaagccactacatctagacacgaatttctgatttaaataattctttgtaagaacacttcttaggaggcatttgaatggataactgtcttaactgtcttgcacaccagtctttgtcttttttttttttttttttttttttttgagaaaaggtcttgccctgtcacccaagctggagtgcactggtgcaatcacagcttactgcagccttgaactcctgggctcaaatgatcctcccaccttggcctccaaagtgtttggattacaggcatgagccactgagcccagcctcaggttgtctttctcctgctttactatttcatttttttcttttcgtcttctagcgtactgtaaatttacatatattttaatgtctgtactagaatataagctcaacaagggtagggctctttgtgtgtagacattgctcagtacatagttggcacgaaataaaatcacttaaatgaatgaatgagtgaaatacaaaggcggaatttgactgtaaaacagtcttgttggagaaggtatatggggaataggggaaagagagggcctcttttcgccctcctacattgatacagatagatctcagttggtctctgatcttgtttgtagggattttgttggatgaatgcaaggtgggatggtcttcagattgtaccaatttagctggcattgctaaccaactgttggaatctctgaaaataaaagatcttgaaattcctccccctctccccgcaaagagaaatacgaaggcagacaactgggtaaattgtcctacccctaactgccatccacagaaaagtaacattttgttttatttgattaactgtgcttgacaacattagaaacagtggaaaatcatctgggacttgggcaggtagaaactccagaggtaggactggaggaggggctgtgtaacctctctttcttactcttaagaataacctttttatctacccgagatttattggctccttaaaatcataactaaaacctgtagcctctttcagcagaaagcaatgcttagagtaagacttctactacactgccagcccgaaggcttgaacagaaggcaagtggaagccctaaaactttggctgttcctggcacgattccagtcccactctccctaccctcacccacagcttccccatcactgtctgcttgggaaccgtgagcattgttctcatcttgtgcttctttctgagttatcaggcagccggaaggccagattcccttgtcttccctcttttcatggactctgcattttcttttctgatcctgtttttcaccttgatcttcttggaacttttccctgagcccttttaaactcacggtatatcagcaaaattcccctaatcttcagtttcttctgtgatttccgccccccgccccacacattcttattctgactgaaaataggccatctcctgatgacactgcctccctgcagccctccgaaagagtacttgcctgcccctccatcccttttgtgttactaggcttcacagtagcatgtcctctttttctttgttgccatttctttacttttcttctcgcctccctaaaaacacctctgaatgtgatgtcatgagtttgtactatgcgctcctgatttttgctgcttaatccagtgtgctgtggaggattgaacctcttatgatggagttcccctctttaactctagtaatgcttcttgccttaaagtctgctttgtctaatatcagtatagctatgccagttttctttttgttcgtgtttgaatggcatctttttctgtcttttttattttcaacctttctttattcttgatgtcttggttatgtctgaacaggttttcatccacatcttaaaagcacatctttgcttttaacttgcatttagtttcattcacagtttcatttaatgtatttattgatatatctgtatttagatctaactcagagatttctatttgacccacctgttctgtgtgggtttgttttgttagtccttttgatcttcctttgcattgatttagtatttattgttattcttccctcttccttagcttggtaattgtgtgctatttggaaaaaatactattctctgagtagttatcctagagataacaatttacttcctttatttatttattatttatttatttatttatttatttatttatttattttgagacggagtctcgctctgtcgcccaggctggagtgcaatggcgcgatcttggctcactgcaagctccgcctcctgggttcacgccattctcctgcctcagcctcccgagtagctgggattataggcgcccaccaccacgcctggctaattttttgtatttttagtagagacagggtttcgccatgttagccaggatggtcttgatcccctgatctcctgatccacccacctcggcctcccaaagtgctgagattacaggcgtgagccacagcgcctggccaacttccttaatttattaatctcatgttgacttggcttctcaagaaggcttaagaatcctaaagggaagctgggtgcggtggctcacgcctgtaatcccagcagtttgggaggccgaggcaggcggatcatgaagtcaggagatcgagaccatcctggctaacacggtgaaaccccatctctactaaaaaaaatacaaaacattagctgggcatggtggcgggcacctgtagtcccagctacttgggaggctgaggcgggtggatcatgaggtgaggagatcgagaccatcctggctaacatggtgaaaccccatctctactaaaaaaaatacaaaacattagctgggcatggtggcgggcacctgtagtcccagctacttgggaggctgaggcaggagaatgacatgaacctgggaggcggagcttgcagtgagctgaaattgcgccactgcactccagcctgggcgacagagggagactccgtctcacataaataaataaataataaaataaggctgtgcatggtggctcacggctgtaatcccagcactgtgggaggccgaagtgggcggatcacctgacgtcaggagttcaagaccagcctggccaacatggtgaaaccctacctctacaaaaaatatacaaaaattagctgggcgtggtgccacccacctgtaatcccagctacttgggaggcttaggcagagaatctcttgaacccaggaggcagaggttacagtgagccaagatcatgccaactgcactccagcctgggcatcagtctaaaataaataaataaataaaattcacacctaggacatcacaataaaatagatcgcttgagcccaggagttcgagaccagcctgggcaacctggtgaaacactctctctacaaaaagtacaaaaattagccaggtgtgatggtgcgtacctatagtcacagctacttcggagactgaggtaggaggaacacttgagcctaggaggtcgaggttccagtgagctgagatcttacccctacactccagcctgggtgataggacgagaccctgtctcctcctcagaaaaaaaaaaaaagcattacttaatctcttagcctcttaatggccccctctggaataggcaaataagggggaaactgtgggggaaagcccaatacctacacttcccttttgttttttctggaagtcttcccctttttccccagctggaatgcagtggcacaatcatggctcaactgcagccttaatcccctgcgctcaagtaatccttagcctcccaagtagctgggactacaggtgcatgctaccatacacctggctaattaaaaaagaaaaattatttttgtagagataaggtgttactgtgttgcccaggctggtctggaactcctcacctcaagggatcctcttgcctgggcctcccaaagtgttgggattacgggcgtgaaccactgtgcctggcctgaagttccctttctgaaggcagcagtctctcttgcattccaggtctatcttgttacttttttttttttttttttttttttgaggcagagtttcactcgttcccaggatggagtgcaatggcacgatcttggctcgccgcaacctccacctcctggattcaagcgattctcctgcctcagcctcccgagtagctgggattacaggcatgcgctactatgcccggctaattttgtatttttagtagagacagggtttctccatgttggtcaggcttgtctcgaactcctgacctcaggtaatctccccgcttcggcctcccaaagtgctgggattacaggcatgagcaaccgcgcctggctttttttttttttttaaatagagacagtgtctcactatgttggccaggttggtcttgaactcctggcttcaagcaatcctcttgcctcagcccctcaaagtgctagattacaggcatgagccattgtgcccagttgttacttttctgattccttcaaacagatgttaatattttgttcactttttccagttgttctgtagtgggaggggtctgaatgacttggtttcctagaagggaagtaggtagtttctacctttctgttacgtagtctagtataatttctgtgtcttttcttatttcagtatgcctaatgatattcttcccagagccgctgtgaatgactgcataggttgaacacaacaacacagtgaccctaatccttccgataccttggcttcttagttccttgacctctattcctgggatcctgttctctgccctacctcagccacccattcctttgagttactgttacctgaaattcatacccttttatctctgtttcagacttagcactctacatcctcctgatctttccagctgatgcccttccagcatccctgtgatctttgactccatcatgacgtcagttcattgattataccaccttttcccttgatgtttcttacgcttttgttcagcttaaattccagtcattagaacacaacctctcctcctattcctttgtcttcttgtttcattagttcttttggctatgccacaacctgtgttttactctcattccccggaaaatagagcatacaacaaagcttttactgggctaatactttacttgaagttagaatgaaggggaaaatagaaagtgagacaggaaaggagggaaagcaaatacagagtgctacgttatccagcaggctacagcatcataagaaccttagctggctgctcagtcatgttggaaatctctggagaatcatggcacctctcagaatacttctggggacaggtttgagggaggatggctgagagatttatttgttggctccctctcatatcctgtctcttactggtcagagttgcctgaaggatcttaattattctatacttttgggtttgttacttggcttctctatgcagctgctggaaaagcagctgatttggggtaacagggcttctgccacagcaggcacagtgaggaccaccaaagcctacctgttaacactggggaggtagagaccactagtggtaggctgagttcatatgatcctcccagattgcaggattttgcttgtgctgctgagcctgcttcagctgggaagtagaacagcaggcaggaccgagtggattttggaaagtgtgtatgagctgcatttgttataccttgtgtaatccaactttttgcctattctttgcttgctttcccatagctcaatgtggctggagaaaccatactgatcactctgacttcacagtcatgattaccaagaccaagaggcttttattataggttatagtctgttttcctattccaattactcttctagatagtttaaatgtcttactttaatcctctaattctccctgccttatcctccctttatttcattggggaaaaaacctgaatcaattagaagaaaactactcactccccttaccagatgtgctacctgtctacatctgtgcctggtactctgccttctgtaactgctagctaaggccaaaccctgtgcacgtatactaggctccatgcttttctacctgtttaaggataatcactccagtagttcatcctttatttgcatcatcaaatttttcatctctgttgtatcattcttatcagcgtattaaacgggctattacttcttgtttaaaaacttttttgccgggtgtggtggctcacgcccgtaatcccaacactttgggaggccaaggctggcggatcacctgaggtcaggagattgagaccagcctggccaatgtggggaaaccccatctctactaaaaatacaaaaattagctgggcgtggtggcgggtgcctgtaatcccagttactcaggagactgaggcaggagaatcgcttgaacccgggaggcagaggttgcagtgagctgagattgtgcccctgcactccagcctgggcgacagagtgagactctgtcttaaaaaaaaaaaaaaacacacacacacaccaaaaaaacaaacttcttttggttattctgattctgtatattctttcttttctcctattcttttacacatttcattcaggcttttgcccccactgctcctctagagttgctcttgaggtgatcaattgctccatgttgctaaatccagcaatctgtttgcagtcttcaccttatttgaaatatctaacccaagagacatatgtgtctgtgtgtgcgtgtatatatatatgtatataatatgtatgaagggtttatatatgcataaatttaaaaggggtgtgtgtgtgtgtgtgtgtgtaaaattgaccgacatgactgtgaaggccaggaagtcccaaaatctgcagctggcaatctggaatcccgagatagctgacagggtaagttccagttcaagtccgaaggcacgagagccaggtgagccagtgtctcagctcaagcagtgagacccagaggagttccctcttaaactcagcctttttgttctcttcaggctttctgtgggttgtatgagtcccacccacattaaggagggcagtctgctttactcagtccacggattcaaatgttcattttatctgaaagcactgtcacagatagacccagaataatgtttgaccaaacatctgggcactctatgctgtagtccagttgatgcataaaattaaccattacagaaccttttcttcacttgacatttagaacaggatgccaatatagtccctataagagctagtccctggcttcagctccactacccgctcccccgcttttctctctctctctctcttttctttttttgtttttttggagactgagtcttgctctgttgcccagtgactcactgcaactccaaaaaaaaaaaaagccttactaataaaactcttagcctcttagtggatccctctggaatgggccaataagggggaaagcccaatacctgaacttctcaatgaaaatcctgggttcaaacaattcttgtgcttcagcctcccgagaggtgggattacaggcacccaccgccatgcccggccaatttttgtatttttagtagagacggtgttccaccaagttggccaggctagtctcgaactcctgacctcaagtgatccacccacttcggcctcccaaagtgctgggattacaggcgtgaggcaccacgctcggcctccccttttctctactgcagtcagaggtgccaacttgctctttttttttttttttttgagacggtctcgctctgtcacccaggctggagtgcagtggcatgatctctgctcactgcaaactccacctcctgggcccaagcgatcctcccacctcagcccctccccaagtagctgggactacaggcgtgcgccaccacatgcctggctcatttttgtattcaacacgctgtttcctgaccgtagctggataggcttctgtgttgggggctttgcactcattcatctgcctgaagtgcctccttgctgctgggcacctcctccccatccacatagcccatggccttattcttgccacgtgtactgaaatgtgacattctcatgagggttttcctcatcagtctgtctcagttttcagctgcatccccggcacttcctgttccccttccttgtttttcttttttctcatttactcttatcgtcatctaacacacttccttatttatcttgtttattgtatgattccttcaactagacggtaaactgtgaggtgagaggagagctttttaaaatcttgttgccttaacagcctcccccccccccaccactgcttctagaatagtgcctggtgcaaatttgcctctcagtaacaagttttctgtttatttaaaaatacggacggaatttcgaagctttgtgatagagataaaaaaaatggacaggagcttttcccaggaggtatacaaagtataggtgtctggcctggaactctccacaaagaatacctttattgctctacaaatgctatttgtagtctaaacatggatgagctgatacaattctgaaggcaccttgcagccttctctccttgcttctagctccacgtgtgtgcgagtctgcatatgtgagtgtaagggcagcactgtgttaaagagatttacaaacatctttttaatcctcataacaatcctacaccacacatgtcatcatcccctttgtacagaccataaaactgatatttagagagcttaaacgtcttgcttgaggcctcaagtggtaagtggcagaactcagcttgaagtgacttgactattattacattatatgtgacctcctagataaagagatgcctccttattttgtgtaaggcagaagtggggagtcttgggcagattacttaaccactgctatagtttggatgtggtttgtccttagcaaacctcatgttgaaatttgatctccagtgttggaggtgggccctaatggaaggtgtttgtgccatggggctggaaccctcataaatagattaatgccctcctgggtgaggggtgagtgagttcttactcctttagttcctacaagagctggttgttaaaaagagctggcgcctctctcttgctgcttctctggccatgtgacctcttcacatgctggctccccttcaccttccgccatgtgtggaagcagcctgaggctttcaccagatgccccatcttccagccggcggaatcatgagccaagtgaatttcttttctttgtcagttacccagtgtcatgtattcctttataggaacactaaagggactaagacaacccctttaggtcctaatcatatacatacttatagattcaaagtatctgcttagcatgtactccattcaaagcaactgttcaaaggtaagaatcctatcagggatcagtgcagaaatacgacaccttacacatttctcagctttcaccttcccagagcttcctcggattggtcctcctgttagtttcctggatctgaaggtaatacctcatccagaagataagaagggtagtggggactgtcaccacgaaggagctttccttttctggttcaagttatttcccagctccactcacctccggactgtttcatgaagaattccagaagtccccttctccctcataggaaagtgcaccgaaccactcagatttaatggcttaaaacaactgctggtatttgaggatttgttcaggtgggcagttgtggttctgggctaatgggggccggtgtcatctgcttgctccactgtgatctggaacagctgggccttttttcttggttactgtgtagtctcacgacctctccttttccagtgaggtctgcagtaggacctgatggcttatgcagtggttcagggcaaacattcccagaggaaggaaacagaaactgccagttctttttgaagtgtaggcccagaactggtatatcatcacttctgtcacatttccccgatgactttgtgtctctgaccatcccaaactcactgtgagaagtgactgcatggggtgtgggagtaggtccattgggagtggactagtccagaccttttttttttttttgagacggagtcttgctgtgtcgcctgggctggagtgcagtggcgcaatctcggctcacggcaagcctcgcctcccaggttcacgccgttctcctgcctcagcctcccgagtagctgggactacaggcacccgccaccatgcccagctaattttttttttttttaagtagagacggggtttcaccgtgttagccaggatggtctcgatctcctgacctcatgatccgcctgccttggcctcccaaagtgctgggattacaggtgtgagccatcacgcccggcccagtccagactatttttgagaataaaaaggggcctattaaaaattatgtcaggttgacagacataaactggaactgtcctcacctagtctggacatgtgggtatcattatcatctctacaacttggagaaaacaacacataggtgtgaccttgaatcttgaatctgttttcctgcagttctcctaatgtgaaaatgtgactgcattgagtatgcatgtgatgttttaaattgaatatagcttctaagcagaacccatcaactcttcttttctgttctgttctttacttttctttcttttttttcttttctttttttgagacagggtctcactctgtcgaccaggttggagtgcggtggcgcgatctcgtctcactgcaacctctgcctccagggttcaagcgattctcctgccttagcctcccaagtagctgggactacagactacaagcgtgagccaccacgcccagctaatttttttgtatttttagtagagacggggtttcaccatgttggccaggctggtcttgaactcctgacctcaagtagtctgcacgccttggcctcccaaagtgctgggattacaggcgtgagccaccgtgccgagccaccatcagattttcttggtgggcactgaatgatgacagaaagagtttaatttaacactggagggaaaaattggctttgaatttcctgagaaataatttcgtttgttgggttttttttttttttttgagatggagtctcgctctgtcacccaggctggagtgcagtggcatgatctcggctcactgcaagttgcgcatcctgggttcacgccattctcctgcctcagcctctccaagtagctgggactacaggcccccaccaccacgcccggctcattttttgtatttttagtagagacggggtttcaacgtgttctcgatgtcctgacctcgtgatctgcctgcctcggcctcccaaagtgctgggattacaagcgcgagccaccgcgcccggccagtttgttggtttctaatagagagctttcctgaaggatttttcgttcttttttcttttttcccccctgcaaggggaatttttcaagactgattttgactgcatgctatcctttcctttcctttcctttcctttcctttcctttcctttcctttcctttcctttcctttcctttccttttccttttccttttcctttcctttccttttcctttcctttcctttcttctcccctcccctcccctcccctcccctcccctcccctcccctctcctcccctctcctctctcctctctcgtctctcctctcctctttcttttcttttttttgagacaggatctcactctgtcacctagactgagtgcagtgaagtgattatagccccctgcagcctcaaactcctgggctcaagcagttctcccacttcagcctcctgagtagctgagactatttgtgccactacatctggctaatttttaaattttttttacagatgggggtctcactgtgttgcccaggctgatcttagactcctggacacaagccatcctcctgcctcagcatcccaaaagtgctgggattacaggcataagccactgtgcctggccagctgttttcaacctatatgctgacctggatctaatcctctcataagataaaatttcactctgctgattaatcagatcattttaaaggtctcatctagctctaagagactctaataatccaatagaaagtggttacaaacaccgaaagtacaattgggaagatataataaaggctttcacagttcatatgtgatctggggtcagatgggattcaggaaactccatactttgtgtttttctaatattaaaaaaatttttatatagagatggggtcttgccatattatattgcccaggatactgttgaactcccaggctcaactgattgtccctccttggcctcttaaagtgctaggattacaggcttgagccaccatgcttggctaccccataatttgaaggagagttagttgcaattaaaaatggaggtttttttttcttttctctttgagacggagttttgctctgtcacccaggctagactacaatggcatgatctcagcttacagcaacttctgcctcccgcattgaagcgattctcctgtctcagccttcttagtagctggaattacaggcgttcgccaacacgcccggctaactttgtatttttagtagagacagggtttcaccatgttggccaggctggtctcgaactcctgacctcaggtgatccacccacctcagcctccccaagtgctgggattacaggcatgagccaccgtacccagtcctggagtttgttcttaacagaatatcaaatcttgagaagttgactataaaagaaaattctaaaattaaaaattctattctctgtataatacatagaaggtagatttttgaggtatgacatttaagatgtgaggtgcctctaaaatgtacacatacatgcttgtgtactccacgtaattgtgcctcaaggaggtagggtgaggctttctgtctttcctgaaacatgttactcttgttcagtgcttggaaaaaggatgtggttagatggagtactggcttgatacaattctctgtcttgcccagggttgagggtggtgtcaatgaaaattctcaatttgaatgccatgtaataggctccttattaatcctgactacagtataaaaaacaggctgggcttcatggctcacacctgtaatcccagtgctttggttggccgaggcaggagggtcactggaggccaggatttcaaggcttcagtgagctatatgattatgccactgcactccatcctgggtgacagagcaaaaccctgtctcaaaaaccaaccaaccaaccaacccgcaaaaccaaaacagatctctccaagcttcggcagatttgagtaattatgtgatctcttcttgactgaacaagtcacttgtcagatgaatatctggttcccactatctagggacagaaggttcccactaacattgatttcaggtaatgcataacaaataaatactaagttttttgacatctttccacaacatgtttatattacgtgtgtgtgtgtatgtatgtgtgtgtgtatgtgtgtatatatatatatatgtatatatatatacacacacacgtacatacatatatatatgtgtgtatatatatatattttttgggacagagtcttgctctatcgctcaggctggagtgcagtggcgcgatctcgactcacgacaacctctacctcccaggttcaagtgattctcctgcctcagcctcctgagtagctggaattacaggcacgtgccaccatgcctggctaatttttgtatttttttttttttttaagtacagaaggggtttcaccacgttggtcaggctggtctcaaactcctgacctcaggtgatccgcccacctcggcctcccaaagtgataggattacaggtgtgagccaccatgcctggcctttttttaaagagatggagtctggctgtgttggcctggttggtcttgaactcctggcctcaagcagtcctcctgccttggcctcctaaagtgctaggattacaggcatgagccattgcacccagtccaatgtttcctagtttttcttatgcaaacttttaaattcttctcagtatatatgtctaaaatcttctgttacaaaaaaatactgaagctgctgcacacggcggctcatgcctataatcccagcactttgggcggcccaggcgggtggatcacttgaggtcaggagtttgagaccagcctggccaccatggtgaaaacccatctctactaaaaatacaaaaagtagccgggtgtcatggcaggtgcctgtattcccagctactcgggaggctgaggtgggagaactgcttgaacccaggaggcggaggttgcagtgagctgagatcactccactgcactccagtctgggtgacagagtgagactttgtctcaaaaaagaaatggaagcaatgtatatttattaaaatatgtatatacatatacagaaatgagctaaaagtagctatattattattaaaattgtatgcaataatgattgcatagcatgttggtatgaatatgaccataatttgacgcaagttgacacatttttttttctaatattctgtattacaactaatctgcatggattgtttttctgcatgtaatctctgcttacttggtttaactttttggtcgagtcctggaagtggaattggtgaattaaaaatttagatataaactcccaaattgagccaggcgtggtgtcatgcacctgtagtcctagctgctaaggtgggaagatcacttatgcccagcaattgcagtgggctatgattgagccattgcactccagccttggtaatgcagtgagaaacataaaagtttctccctccctccctcccttctgacagagagtctcactctgtcgcccaggctggagtgtagtgtcaccactgcaacctccgcctcccaggttcacgccattctcccacctcagcctcctgagtagttgggactacaggcacctgccaccacacccggctaattttttgtttttgtatttttagtagagatggggtttcaccgtgttagccaggatggtcttgatctcctgacctcgtgatctgcccgccttggcctcccaaagtgctgtgatgataggcgtgagcaaccacacccggcagtgagaaactgtttctaaaaaaaattttttttaacgtagaaatcttttcctttttttgagatggagttttgctcttgtcgcccaggctggagtgcagtggcgtgatcttggcgcactgcaacctctgcctcctgggttcaagcgattctcctgcctcagcctcccaagtagctgggattacaggtgcctgccaccacaccccgctaactttttgtatttgtttactagagatagggtttcactatgttggccaggctggtctcgaacttctgacctcaggctatttcttcccccagggcctcccaaagtgctgagaatacaggtgtgagccactgcgcctggccatagaaatcttttcatatgtttgtagatcattcttctttgagtattctctattttttaccttcacccgttttactgagtttcttattggtttataagaattttttttgctgggtgcagtggctcacacctgtaatcccagccctttttggggccgaggcaggcggatcacctgaggtcaggagttcgagaccagcctggccaacatggtgaaacccccgtctctactacaaatacaaaaattagctgggcatggtggtgcacgcctgtaatcccagctatttggaagactgaggcatgtggatcacttgaacccgggaggtggaggttgcagtgagctgagatcgcaccattgcactccagcctgggtgacaagagtgaaactctgtttcaaaaaaacaaaacaaaacaaaacaaaactctttgcatattgaaggaacttactagcaagccttttgacatagactttgtaaatgtttttcttttgatgattatatatatggttagtttggctgtgtacaagttttttttgtttgtttgtttgtttttttatttttttttttttgagacggagtcttactctgtcgcccaggctggagtgcagtggcacaatctcggctcacggcaacctccgcctcctgtgttcaagcgattctcctgcctcagcctcccgagtagttgggattacaggcgcccgccaccatgcccagctaatttttgtatttttagtagagacggggttttactatgttggtgaggctggtctcgaacctcctgacctcagttgatctacctgccttggcctcccaaagtgctgggattacagacttgagccactgcacctggccgcatatatatattttatttttttatttaaaaaaatgtttctgagacaggatctcactatgttgctgaggctggagttcagtggtgtgatcatggcccaccgcagccttggcctcctgggcttaggtgatcctcccatctcagcctcccaagtagctaggaccacaggcaccatcgtgcttggctaatgtttagtatttttttgtagagtcgagatttttgccatgttgcccaggtagtctcgaacttaggagttcaaaacgatttgcctgccttggcctcttcaagtgctgagattacaggcttgagtcacctcacatggctgcaaagcgattttttttgagacacatttagttttttcggtgatgtcagtaattttacaattaaagaaaaagttatctgaacaaagggagagtgcccttaaattgctaagagggagcattgctttgtttttttctagtttcgttgtgtcttacagtgttcaaacactgtactggaagtaaataattaagtttaaaataattttcttctccagtgtttgattatccatttctttttgttccaatttctgtatctgaaaaacaatattggcttcaaaaacgaacaaaaaaaaatttaacttcccccagattgcagatttaccatgtaaatgtgtttccaccctgttttcaagctaatgtgacaaatttgctacattataaagaacagaaacctgtgtacagattttggggatagcacacataaaatagtccaaggacattatcaactcaggtgcagaagttcttgctgaagttctattaacaattgtgtttaaaaacaccagatgggagcagatttaaagagggagattctaatggaaggttagttgggatttgtagggaagagagagaaggattttaattgaaaagatactagaccgtattcttacctttatagcgttgtcttcttttctttcttttctttttttttgagtcatattttcgttcttgtcacccaggctagagtgcagtggtgtgatctcggctcactgcaacctcagcctcccgagtagctggaattacaggcccctgccaccatgcccagctcatttttgtattttcagtagagatggggttttgccatgttggccaggctggtctcgaactcctgacttcaagtgagctactggccttggtcttctcaaaggttgggattacaggtgtgagccacctcgcctggcctatagtagtgtttttttttcttttcttttctttttttcttgagacggagtcttgctatgttgtccaggctggagtgcagtggcacaatcttggcttactgcaacctctgcctccctggttcaagcaattctgctgtctcagtgagtagctgagattacaggtgcgaaccaccacatccgggtaatgtttgtatttttagtggagacggggtttcgccatgctggccaggctgatctctaactcctgatgtcaggtgctccgcctgcctcagcctctgaaagtgctgggattgcaggcgtgaactactgtgcccagcctagtagtattttctatccaagttttggatgtaattctcttgggatttttttcctaatttgtacagctaccactgtactgttcatgactgtatccatgggaacataagtaggatgacataagtttataacttgttgctaggcagatctagcttgtaatgtattaagattttcccattaaaaagcatttggatggttttcttttgtgcggtgaaggtaactaaacagcgtaatttggaattaaaactgtgaagttgtataaattccttctaggagaaccaactactctttgttttctttctttcttttttttttttttttttgagacaagatctctttttgtcacccaggctggactacagtgacatgatcaggtttcactgcagcctggacctcctggacacaaatgatcctcctacctcagccttctcctcccctttaccagctcctccccttcccttccccagctctccccctccagtagctgggaatacatgtatgcatcagcatgtctggctaattaatttattttttaatttttatttatttatttatttatttatttatttatttatttatttatttatttattgagatggagtctcgctctgttgtccaggctggagtgcaatggcgtgatcttggctctttgtatcttcctcctcctgggttcaagagattctcctgcctcagcctccctagtagctgggattacaggcacctgccattatgcctggctgatttttgtagttttgtggagatgcagtttcaccatgttggccgggctggtcttgaactcccagcctcagaagatctgcccacctcagcctcccaaagtgctggggttacaggtgtgacactgagctcagcctattcattcattcattcattcattcattcattcatgagacggagtctcgctctgtccccaggctggagtgcaatggcatgacctcggctcactgcaacctccgcctcctgggttcaagtgattctctgcctcagcctcatgagcagctgggattacaggcatctgccaccacacccggctaattttgtgtttttagtagagatggcgtttcaccatgttagtcaggctggtcttgaattcccaacctcaggtgatccgcctgcctcagcttcccagagtgctgggatgacaggcgtgagccgccacacccagccatatatatatgtattttttatttgagtttgcgttttgccgtgttgcccaggctggtcttgaactccggaatttcagatcgcccacctcagcctcctaaagtgctgggagccgctgtgcccagcctagtcatgtttttaattaattgaatgtctgaaatggaagataatgagttaaaataattgtgtcttaagcctgtcctcttcagctaaaacagtcagtatttagatatgtatgaacgagatgtgaacacttgatccatcctaaagtacatagcagatttcaagatgatgacaggtatcttgggtagttcttccgactctcaaagacttggtggactaaccaagaaaacctcatggagatcgagacacctgtcttgtattttggttgcaattttttaaaattaatttttaaaaaatgtaatattagtgtaaaataactaaatttcaaaaaagtttagaatgagatgtaattgaggtcacatagctcttttctgcagaggctatcacacttaacaccttatctgattgtaatttaaagaattttttgaggctggacacgttggctcacgcctgtaattccagcattttgggagactgaggtaggagggacacttgagcccagcctgggcaacatagtgaaaccccgtcttacagaaaattaaaaaattagctggctgtcgtagtgtgcacctctggttccaggtactttggagtctgaagtgggaggatcacttgagccagggaggttgaggctgcagtgaactgccattgcactccagcctgggtgacagagcaagatccctgtctcagaagaaaaacagaaaagaggctgggtgtggtggctcacgcctgtaatcccagcactttgggaggctgaggcaggtggatcacgaggtcaggagatcgagaccgtcctggccaacatgttgaaaccccatctctactaaaaatacaaaaaaaattagctgggcttggtggcgcgtgcctgtggtcccagctacttggaaggctgaggcaagagaattgcttgaacccggaaggtggaggttgcagtgacccgaaattgcaccactgcactccagccttgcggcagagtgagactcggccttaaaaaaaaagaaaaccagaaaagaattatgtaagcagttattcaataataaataatatttatgcagctgggcacagtggttcacacctgtagtcctagcacttttggaggctgaggcgggtggatcacttgagcccaggagttcgggaccaacctgggcaacatggcaaaaccccatctctacaaaaagtacaaaaattagccggttatggtggtgttctcctttagtcccagctattcaggaagctgaggtgggcggatcacttgtgcccaggaggttgaggctgcagtgagccaagatgtcgccactgcactccagtcccaacaacagagtgagaccctgtctcaattaaaaaaaaaataataatatttatgccgtttttttgtaccagctactatgataggtgctttataggacaatttggggaagtaattgctgttaactccattttactcatataaggaaagtgacgcttgcacaaggtttaatatttcttgcccactaacatgtatgcttcaagaaagcaggggctatgtgttacttctgtctagccccctcctgtatctagcatagtttctttggggtttgggtagtgtgtcaaatacagtggaaaggctggttttacaaagatgattgttgtatcttcatttattacctttgaacttgtagcttcatagggaaatcatgggaatttgagcagcactgaatctgcatgtattaaaaaaacttgcatcatttctggatttcatgtggtgaatatttgatagtacctctcgtgatttgataaggtccattatttggggacaagggtggttaacatagggattgatggaattgtgactccattctgttgtggcgtgtttagtttttacctctttccctttactcctcgtgccccagctgcgtctgtgtccattgtcctttcagtttcttactctaattgaaagaatacataggtaaagaaggaatctgatagaaggaataaacttctttgacggtattaacaagtgtctgatcttgattagtgtaagttgtattcagtgcctcatgtttcttacctttgaattgtagaaaataaaattttagatctggttaagattcttgagattatttggcaggaggaaattgaagcgcagttcagttccatagaatgttgttgaatgcgtttcttcatttgttaagagtgataatatttgtctcatagggttgatacaaggaggaagagatactctttataaaaaagtcttaggccgatttgatgataatactaatagttaaacttgttcagaagttaatctgggctgggcatggtggctcacacctgtaatttcagcactttgggaggcagaggtgggaaggatcgcttgagcccagaaattccagaccagcctgggcaacaaagtgagacctcgtctctataaaaattataaaaataagccgggtatggtggcacatgcctatggtcccaggtactcgggatgctgagatggaaggatcacatgagcccaggaagtcgaggctgtggtgagctatgatcattgccactgcactccagcctaggtgacagagtgagaccctgtctattaaaaaaagttagtctgtgttagcatagtatcggcagaaaagtattctgacacagtataggagggatcagggtatgggggaatgagtcaggaaggccattttaaagattttacagtgtcctaaacttgatagtgaaggctaagcattagaaatggaagagattggctgggcgcagtggctcacgcctgtaatccctgcactttgggaggccgaggcgggcagatcacgaggtcaggagatcaagaccatcctggctaacacggtgaaaccctgtctctactaaaaacacaaaaaattagccgggcgtggtggcgggtgcctgtagtcccagctacttggcaggctgaggcaggagaatggcgtgaacccgggaggcggagcttgcacagtgagcccagatcatgccactgcactccagcctgggcgacagagcgagactccgtctcaaaaaaaagaggaatggaagagattagaaaagatgtgaacaaaccttatagagcttccaggaaaggaagaaaggtaaaaacattgagatttggaatgttgagtaatgggatagtataaacagtatagcagtatagagatgtcactaatgttttagaaactgaaataatagattaatgcatggtaattaccttgccagaactgaaaagcggtggtagtgatgctggaggaagcagattgctgctgcagaactgcagcaaggcctaggaggtggaggcaccaggtatcttcagaggcccaggtgtggtgtggttggccctaagctgatgggctgactgaaagtctccaggaattcttcctgtctctagattatgcttcattccagcagtccaggaattagactttccctagcctagcacaagacaagtttacttttggtagagtttgaaccagagctgtaccctagacttgaaatggggaggacgggtggaaactatctggacgtggtgggggagacgtatctatgaagtgaaagtttgtatattgaatggtcattccagaattcttaatagcctggcttatactctccagcaaattagaaggttcttctttgggagaaaactggcccagatgctaacaattgagtgttaccctgtattccagttattaccgcctaacaactgttgctgttactattgtctttaaacaacaacaatcgttttattatctcacactttctggtgatgaggatttaggaagacatcagttgggcagctctggcttgggtttctctgacttaagttgtgttcacatggtggctggagctgaacagtagggtgctgaagtggccttggctggccagacagctttcttcctggtgtctcagcatgggctgatttgtgctcctcacaacattatggcctctgactgcttacaagaaagtgcaggcttccaaagcaagtatcgcaagaaaactgactattaactgattcacttttcatgacccagcctcggaagtcacataggctcctttccgatgtagtcacaagtctagtcagcttcaagggcagggaacatagattccatctcttggtaggagtacagaagtggaattgcagtcagagtgtaaggggtccctgtgggatgacatgagaaacattctgtgaccacctttggaaaacacaatctaccacattttctcatttggtcacaataattcacattcctccttcttgtcacttgtgctcacaccctctcccatcacatcgctcccccttcctgctatggcattaacttcaagttcagcatcttgtcacctgaatcaagcccagttgtggccacccaaagctcctcaggtgtggttcctctagagctgaactcatgtgacgtcaagagaaggaatctgttgcttcctctgacttaaaatggcaggacaagcttaggataattgctgtagacacatctgcccagaaaagaggaaacaggaggcacagtagtttctcatccattgccattctgaaattcagcagggcacacgttaccaattccttgatttggtctcagttctggtgcctgggaatgattgtttcaggctctggtttctgctgagaattttgttttgtcttctgagttacccttttccctaagaaatggctgatttttatagctgagtagttttcttagcctttgtgctttcggtagttttggaggaacaaaaaaaccttcccctcattttgtactgtttttgtctctttcagtccaaactggtataattcctttgaaaattttgtgggctctctctgtgtcaatttgtaacctactacattagacaggaaccacacttagcctgtttgtggtaggtccttcatttccttgggctccttgtgtgtcaccagccttagtattcttagaagccctgttgtttgatggagaggatcttaaaatccttagaaggctcttggtctcttggaaaggacagtgcagaaccttcttagatctttttgaggttttaagaaagtattacagtcacagtctgggtttgttctttaccactgagaattttgagaattgtttctttttttaaaattctgcctggaaatatccttaggtagatcatggagtttattaggtgcatttcctgttttccacatttctaaaggccacattttccactacttagacaacaggggacccttttcctgtaatgtacaatagtagttttcatagtttctattaagcttttcctgatagtttccttgttgaggcccttcaggcttttgctgatagcctcttaaaggccttgcaatttccacctgccacccagccccaaagccagtagcacagttctgggtttttgttgcagcatctcacttccaggtgccaaaatctgttccttagtcttgctgcctgaaaaatgacccccaaaagttagtgacttaaaataattccgtgatttctgtaggtcaggaatttaggaagagcttgattgggcaattgtggctcaggttcttgctttggctgcagtcagatggtagagctgaagagtagtgcacaggcaaggcagtgtgcacagctggagagggccgagctgagccgcctccacaaggtctctgtgtgaatttgtttgtgctgcttcttcagggcactcagactgcccacatagctttgtgtccaaatgtatgtcctgtgggaggatgagcagaatctgtattaccttttatgatgacttagtcttggaagttacatcacatcatttctgctctagtcaacaacttgcctggggttctaggggaggaaaacagacctcatatcttagtgtcagttggccacactgtaagaaggtgatatggggtgggagataatgtgatcagctctagaaaaatgtaatccaccatagctcttagtgaaacagttacatccctgtctgatcaccttgcaggggagtcttgccattaataagcaccagctgtgtatgtgacattaaaacttactttttagtacttccttcttaactgtgacttaacagtcaaggattatcaggcacatgaagaaaaagccataacagtctaacacagacagataaaaagaaaccaagtgaagaaataggaaatacaggttgcataagaaaagctcaaatttgaaaaaacaaaaaagcttgaagagctaagagaaaatgcatgacataaaagcaagaaggtataaagtaggggtccattcagagaacaagaaagagctcttggaaaataggattgcaggacaaattttcaataggaaaccaaggaaatcttccagaaagtagtaggcaaagacagacaaaaagagaaagacaatgcctgattggcttcttgactgaaacatatttaggtgggaagaggaagtgtggaaatgtgaataaggactgtatactaatgataatgaattaatattaatttttgcttaagtgtgataatagcactgtggttatagaggagaatgcccttaggcttagaagatgcatactaaaggaactgtcatgatatttgcatttttcagatggttgtgtgcacacacgtgcgctcacacacagtgggagagggagggagaagggagagcggttatgtacaagagagacaactaaagcaattatgatataatattagtaattgatgatgaatacaaaaacaaaacagaagggaatactttagagttaatggattggttcaggagctccaacatctgcactgttagatgttctagagagagaaaagataattgagaggaaacaatattaaatcaacacattaaaaatgttcagaagtgaaaatcacaaatctccacattgagcagacccactgagtgcccagcgcagggaataaaagaaaaaatagattggtacatcacactgagatttcagaacactgagaatagagaagatctcaaaatcctccagtggaagcaagtcaagttacagcagtggactgagaatctgtatgacactagaatctaggtgacagtggagcagtgtcctcagaattctaggagcatacccatctaggatttttttttcttcttttttgagatggagtctcgctctttcgctgggctggaatgcggtggtgtgatctcggctcactgcaccctccgcctcctgggttcaaccagttctcctgcctcagcctcccaagtagctggggttacaggtgtggaccaccatgcttggctaattttttgtatttttagtagagacggggtttccccaccatgctggccaggctggtcttgaactcctgacctcatgatctggccaccccagcctcccaaagtgctgggattacaggcgtgagccactgcacctggcccaatttaggattctatgccaaactgtagtatgaacataaagacatctttatttttatttatttattttatttatttttgagacggagtctccatctgtcgccctggctggggcccagtggcaagatctccactcattgcagcctccgcctcccggattcagggagttatcctgcctcagcctcctaagtagttgggactacagacgcgtgccaccacacctggttaatttttgtatttttagtagagacggagttttgccatgttgaccaggctgatctcaaacttctgacctcaagtgagccgcctaccttgtgctcccaaagtgctgagatcacaggcatataccaccatgctcggcctattatttttaatttgatggtcatattattccagatttggccaatgggatttccttcaagctgactcctgtgtccttttgacaaatatctataatcctttatttatttttatttttttgagacagagtcctgttctgtcacccaagctggaatgtagtggcgtgatctcgcctcactgcaacccccgcctcccgggttcagacaattctcctgcctcagcctttggagtagctgagatcacaggcatgcgccaccacacctggctaatttttgtatttttagtagagacggggtttcaccatgtcggcgaggctggtcttgaactcttgatctcaggtgatctgcctgccttggcctcccgaagtgctgggattacaggcatgagccattgcacctagccctctataatcctttaaatgcttgtttatggtatcttagaatatttcaaatttatcttgtatgttctctgcctcatcctggagtcaactgtttgtctaaggaggagccattctcttgaagtggagaatagtattatagaaaccaatatcttggcactagctgtatttattgctgccaggatattgttgttttcagccctcttagtgggcagaacaagtagatctatgtgtatttatttattagacatatttattgtctatatctctgcctacacatatatataaccatgaattttaccacaaatgccaccattttgatccaacatcataggattcattttagcccttttcctttccttatttgtagctctcgtctctgacagtgagaatcttggttctcatccttaatatagttactcatttgcttaatctccctgaaagcttggcccagacatggaatccagcaaaggataaggtgaagggaattcttaaagagaaatcttgggataatagctgtgtaggcattcaccagttagtccagattggtgagtgaagacagggctccaaaggggtgttgtcaagaaataaacaaccaatagatagcctgatgtgttgagacttacacatgtagtagaagtttggaggtgaattagtgatacatatacagaaaaccaaacaagcaaaaaaaacaaaaaaaaaatagaattattaattccaggtaaaaaaatcacacataatcacaccactgaactctggcctgggtgacagagtgagaccctgtctcttaacaaacataaattaaaaatcaggtaaaacaaattgtacaagaatggacttacaacaacagaatgcaacaggattcagctatgaatagtatttactagtcataaactacgagagtgccataacactgaacttagggagcaatttagggaataaactgagaaaaaaagtacacaggggccttaggacctaagcagctagtgtgatatcacttgtggatgtttagtatgcattttgggtaccagccccttttgaacactgtctttgaggggaaattgtccactccacagtagaagctattaatatgttttcccatcctctcttgtagtttgtcatagatgtgtgacttctattccatgcaccagggcaagactaggattaggaagcaagtgatgtgaagtagacaagcatggctgccaggtttcagaggcagcgttttctagcggtggtgtccactatgcactgccaagtgtccttgtgtttaacacctgcagcagttaagacctccactgaagcagttctgtggggtaattctggtgttgtcctagttgcatggcttgtaaatctggtttgatgaccttcctgtagagccatttagttgcttatattagctagaatgggctttgtttactgtaaaaaatctggttgacgaaattggcattaggaatgatcctcaagaaaatgaattggttatctaacttggttgtgtatgaaggcagtgaagaaaggtgagagcttaaagaatcatagtggccttgggccgggcgcggtggctcacacctgtaatcccagcactttgggaggccgagatgggcggatcacgaggtcaggagatgagaccatcctggctaacatggtgaaaccccgtctctactaaaaatacaaaaagttagccgggtgaggtggcgggcacctgtagtcccagctactcaggaggctgaggcaggagaatggtgtgaacctgggaggtgcagcttgcagggagccgagatcgcaccactgcactccagcctgggcgacagagcgagactccaccgcaaaaaaaaaaaaaaaaagaatcatagtggccatgggcatggtggctggtgcccataatcctggcactttgggaggctgaggtgggagaatcacttgaggtcaggaattagaggcctgcagtgagtgccactgcacttcagcctgagggacagagcacagagcaagatcctgcttcaataaatggatggatgggtgggtgggtgggtgggtggatggaggaatcatagtgatcagcagtgcttaatgactgagattagtctattctgaagtatgttaataaagcttgaaggatcagaggaagagagtaggaaaaaagcacacacattctacaaacctcgccacatccactcagttaaaagacagaacaggattcccttggatgttgggaaagggaagtcagacgtgaaagttgtagacaggattaagccacttaattttcctattaaatggactctagagagtaagttcatgcttctcattttactgatggagaagcagtaccacatacttggtgaaattcctgtgtctgcaaaacattggttattctgcaattgttatatataaagggataaacattgaagttattggtctcttccttctcattggtattgtgggtgttctttaccaactgagttaggaactgacttgagatattttaaacttacgggacttgatttagagcacttactcttagatgttaaatatttggtttgctctttattgaataacttaattatcttattactaataattcctgtattagacaatgagacttagactcataatagaatacaggtatcttaatgagaatgttctcatttaaaacactaactcctaattcactagcagctaataaaactaacattgttgcacagtacattgttgactagttagaagaatttgacagtatgtttggtgctgagaccagctcggtcggggagaccctaacccagcggcgctagaggaattaaagacacacacacacaaatatagaggtgtgaagtgggaaatcaggggtctcacagccttcagagctgagtattgctattaataaagggtgtagaatttgaaaataggccaggcgtggtggcccacgcctgtaatcccagcactttaggaggccgaggaaggcggatcatgaggtcaggaggttgagatgagcctgaccaacacagtgaaaccccgtctctactaaaaatacaaaaattagctgggcgtggtggcgggtgcctgtaatcccagctgctcaggaggttgaggcaggagaattgcttgaacctggaaggcagaggttgcagtgagccgagattgcgccactgcactctagcctgggcaacagagtgagactccatctcaaaaaaaaaaaagaaaaagaaaaaagaatttgaaaatagcttgagagactagagaagaagtgaactgatttattttatatttatgtatcttattttttggcttgttgaccagaagtgaattgatatgaataagcacacttgcaaaataaatgggttatttatttatttatagagacagggtcttgctttgtttcccaggctagagtacagtggcaccatcatagctcactactgctgctggcaacttctgggctcaacgggtcctcctgtcttgacctcccaaagtgctgggattataggcatgagccgtcatgcctggccccctaattatttagatagccctgtagacctgatttcttgtggctgaaggtctctcaaattgattctcagtaggcttcataaataaaagggaacttacactggaggatctttatgctgaattggcttagaataagtagaaattgctaggaatgttttatttttgtttatttaatttgctaaatctgctttagatatgagccttgtaactggatttcttaaaagtgtccttatgattgaatctatttgtggtgtttggattgattattttaagttcctactatgtaccagacgtttgctacttgttttaacttgctgtttaatctctttgaagaaggaactgtttcctccatttttatagaagagaaaattgaaacttaaagagattagagaactctccttcagtctaggcagagctgggattccatttcaggactgttatgctacaccaaataaatgcttgctgcgttaaagaatgacttaacagtgaacaccttaagtcttcattgcccagttacgtgaatggaagaaaggctgagcagtgaattacaaacactctctcctctagtcttctggcagtgttcctttacctaattctgtgtcctcaaacgccctgttttctttaggtgattatattatttgtttcttttaagcttgcctgtctgcttgttcttctgaacagttcccttcaaatgttacaccatccacccacatctgtatttcagtattttattgtgtcctttcattgagactctaatttgggtgaaaattctccaaactacatttctttttagcatattctatttttgtcacctagaatcagcctcccagctgactttttcccatagatacgtaacaaccacctgctttaacattttctatcttccacttaacaaaaatattactgttgataaataatgaatacttagcatgtataactgtgcaaataaaatgggaggaatgtgtatcgggaagatttgaggggagtgtggataaaaaactgtttgaaaataccagctgttgaattttatagtgttactctttttatttttattttttagttttattattactattttttgagatggagtttcgctttgtcgccaggctggagtgcagtgacgtgatcttggctcactgcaacctctatctcctgggttcaagcgattctcctgcctcagcctcccgagtagctggaactagaggcgcgcgccagccaatttttgtatttttagtagagacagggtttcaccatgttggcaaggatgatctcgatctcttgacctcatgatcttcctgcctcggcctcccaaagtgctgggattacaggcgtgagctactgcacccagcctattattattttttaattgagacttgtcttactttcacccaggctggagtgtagtggtgcaatcttgcctcactggagcctccgcctcctgggctcaatcgatcctcccacctcagcctcctgagtagctgggaccacaggcactcgctaccgtgcccagctaattttttctatttttggtagagacagggttttgccacgttgtccaggctggcctcggcttcccaaagcgttgggattacaggcatgagccaccacgtgcagcctatagtgttattctttagtagttcctaaaaggcttgtgttagatgtttatagctgatagttgtggtttgaatctgtgtccccagccaaatcttgtgtcgaattgtcatccccagtgttggaggtgggggcccatgattggatcatgggggtggatatcccccttggtgctattttcatgatagtgagtgagctctcgggcgatcgggtcgtctaaaagtgtgtagcacctccctcttgtctctcttgctcctcctctggccatgttatatgtgcttgctttccctttgccttccaccatgattataagtttactgaggcctccctagaagctgagcagatgccagcatcatgcttcctgtacagcctgcagaaccttgagccattgaaacctcttctctttataaattacctagtctcatctcaggtatttccttctttctttctttctttctttctttctttctttctttctttctttctttctttctttctttcttttttttttttttttttttgagacggagtctggctctgtcgcccaggccggagtgcagtggtgcgatctccactcactgcaagctctgcctcccgggttcacgccattctcctgcctcagcctcccgagtagctgggactacaggtgcctgccaccacgcctggctaattttttgtatttttagtagagacagggtttcaccgtgttagccaggatggtttcgaactcctgacctcaggtgatctgcccgcctcagcctcccaaagtgtcgggattacaggtctgagccattgcgcccggccaggtatttttttatagcagtgtgagaacagactaatacaatagccatcatgtaaaatacagtttccattttgagccaggcacttgggtaaaaatgaagagtaggtaaaagacaagatgtagttctaatttgagcttgtcatttagtatttgagtaatgccgcataatggctgtgggtttccgatgacacacaccttttcatgatgtgggtggcctagggagtagtgtgtttgttggaaccacagttctctgcagagggaatatgattaagtctgatctttgtaatttagaattaatgaggccaggcgcactagctgacacctgtaataccagcactttgagaggcgaagatggggaggatcacttgagcctgagtttgagaccagcctgggcaagatagtgagaacctgtctctacaagaaaataaagaaaaaaatttttaaaaaaagaaaaaaaatatagaattggtatcttggccacacctctttccctgtggttgagttttttttttttttttttttcctgttcttttcctttttttttgagacaagatctcttcgtcacctaggctggagtgcagtgacatgatcaaggcttgctgcagtgtcagtctcctgggcttaaaggatcctcctgtctcagtctcccaagtagctgggactggaggtaggtgacactagcctggctcactttaaaaacattttttgtagagataaggtcttgccatgttgcccagggtggtctcaaactcctggcctcaagccatcctccctcctcagcctcccaaagtgctggggtctctggcattcaccaccgcggacaacctttttttttttttttttttttttttaagctaaattttgttgaatatttggataggcaatacaggcatatggtacaaaattaaaagatgcaaaagggttatgcacaagagaagtacatttcttaggcattcctggccttccattttcccttcctggaggcagttttctgatttattttctacaaggattctgtttaaatactggagaatatctgacctgttgtactttactttagaatggcaggaagctgaatgactcatgggcatttttccctttgtgaagctcattgacattccttcctctcaataccttaactatggcatgttttataatttgcttttgtttttgctttatcacagtattttcctatgttttttatagtcttaatttttaagcactgctttaggtatctattaatagttcagaaagttgcgaagattacaagctcatatttgtgaaagtgtctggcacataataggtgatcaataaatatttccttctagcttgtctgtcccctatctcccactggttgtatgtatgaaacaaaaaaatgaaggagaaggctgagcatagtggctcatacctgtaatcctagcactttgggaggctgaggcgagcgaattgcctgaggtcaggagttaaagaccagcctggccaacatggtgaaaccccgtctctactaaaaatacaaaaattagccgggtgtggtcacaggcgtctgtaatcccagctactcaggaggctgaggcaagagaattccttgaacctgggaggtggaggttgcggtcagtcgagatcgcgccactgcactccagcctgggcaacagagtgagactttttgtcacacacacacacacacacacacacacacacacacacgtgaaataaacctatgaaccaactaatgcagtggattccaaaattaagattaagcttgtgtaagttgtaatgtttcttgatgtacccatttatttgagtggaaacagattcttttcattctttgaaatcactttgctgagatttttttattttttttattttttttttggagacagagtctcgctgtgtcgcccagactggagtgcagtggtgtgatctaggctcactgcaacctccacctcccgggttcaagcgattctcctgcctcagcctcctgagtagctaggattataggcatgtgccaccacactcagctaatttttgtatttcagtagaggtagggtttcaccatgtaggccaggctggtctcaaactcctgacctcaagcgatccgcctgctcagcctccctgagtattgggattataggtgtgagccacggtgtcccgccaagctgagacatttttaagaaaatgtttctgtttttttgtttatttgtttgttttgagatggagtctcactctgtcacccaggctggagtgcagtggtgccatcactgcaacctctgcctcctgggttcaagcaattctcctgttccagcctcctaggtaactgggactgcaggcttgccaccatatacctggctgattttttgtatttttagtagagatggggttttaccatgttggccaggctggtcttgaacttctgactcaagcgatctacccacctcagcctcccaaagtgctgggattactcccacagcacctgctcagaaaaggtttcttttcttttctttttttttttgagatcaggtctcactctgtcgcccagggtgtagtgcagtcgcgcaatctcagctcactgcaacctccgccttccaggttcaggtgattctcttgcctcagcctcccaagcaggtgggatttcaggcatacaccaccatgcatggctcatttttgtatttttagtagagaggggtttcaccatgttggccaggatggtcgcgaactcctgacctcatgtgatccacccgcatcagcctcccaaagtgctgggattataagcgtgaatcactgcacctggctagaaacatcttctaaagcctaatcttttttttttttccttatataatttaggttgactatgtaaacccaaaacacatagggtagaaactcgtgaaaaatatttttgaggatatctttgcaaagtgttgtgcctcacggtgctggatatggatgtgtgcttagtgtcagtgcatagatttaggatttcccacctgtatgtatgcttttggtgagtccttttaggcgatatgtcctcatgttcaaggagtaatggcatactggttcatttaaacccatgttttaatcctaatttaagaccgatttacttcttcttggagctaatttcttaacttttctgatgatgtttttgttgcttaagttaagactaatataacacagaagtcttactcatcctttttgatattagagattttggtttattaatctagtggaattttaaatatcattttacatgtttactctcaagatctgatgattgactgactgggtgcagtggatcacacctgtaatctcagcactttgggaggccaaggcgggcagatcacttgaggtcaggagttcgagaccagcctggctaacatggtgaaaccctgtctgtagtaaaaatacaaaaattagccggacttggtggtgcgtgcctgtaatcccagctactggggagacagaggtgagagaatcacttgaaccccagaggcggaggttgcagtgagcctagatcactccattgcactccagcctgggcgacagagtgagactccgtctcaaaaaaaaaaaaaaaaaaaaagaagattgaattaagggcaaacttggaacaggccagtttcccattatattgcctctctgaaacaagtgaaagagttttctttatgaggggtgttctttttaatttaatttaattaatttttatttatttattttgagacagagtcttgctctgttgcccaggctggagtgcagtggcatgatctcggctcactgtaacctctgcctcccaggttcaggtgattctcctgcctcagcctcccaagtaattgggattacagatgcccaccgccacacccagctaatttttgtatttttagtggagacggggtttcaccatattggtgaggctggtcttgacctctgaacctcagatgatctacccacctcggcttcccaaagtgttggggttacaggtgtgagccactgtgctgggccttctttttaaaaaaggtttttctggccaggtgcggtggctttaatccatatgtgtgagaccaggcacggtggctcatgcctgtaatcccagcactttgggaggcagatcacctgaggcatgagaagtgcttgaactagggaggtaagaagttgcagtgagccaagatcacaccattgcactccaggctgggtgagagtgagactctgaaaaaaataataataaaaatggttttcttacttttatgacttgaattatggaaagtttttagaatgtgactcttttctcaggaacaggatggctacctacctaccccccatccttttcctgtatgctatggattatcagacccctcacttgggttcctcttacatcaccaaggtgtgcttgtcaatacccagaaaccaacactgatacattactaagttccacattttatttagattccaatagttttcccattaatgtccatttctgttctagaatccaatccaggttactgtatgcattgcatttaattatgatgtctccccagtttgctgtttttcacatgactagactagggttatgaatttggggaattcatatgattggagtggtgggaggtgtagtgcatgctactccatgatttattgctggtaatgttaatcgtggccaaggttgtttccctactgtatacactcaccaccttccatacttatttttttggaaacaagttagtaagtccaacctacactcaagtcggggagatttaagctccatctcctagaggggagtggggaatatttacataaattatttgaaattctcccacgaggaagctgctttttctaggaaaggtctttgcccgttattctaccgacttactggactttttatttgactttttaaaaagaagctctttagataaaatctccataaatacttagataaattactgcaattttatatttgcatatgaacaagtggagttttgttgatgcagggttgcattggccttcactatcaaaacaaatgtctcatctgatcagcatttataaatagtgaggtaccagaatcattaaggctcataaagtcttccgtttttattttggctattctggtggtgggtaacaatattaacaacaataaaaattcatcttattttactggagattcctgcaaagtggcagaataccaggacaaggaaccaattctggcacacatgtgtcaaacaagaaagctctgggaatgtaataatgtaataaagtgtggtcgagagagctctgggctggaataggcatggggtccttgacactatcacctctgccaagacacttcatgtgtatggtttccccacctttaagtaaactctatttatgaagttctttgtagctttaatagtttctagagttgcttgaatttggggtgacttcttgcaagggtaatgtgaagtagtgtcacatggacagtaacggagaggtatctgctgctgccatttatataataaatctgaatttggaggcagagaaaggaggcagaaagtttggtaaggacgttattgcaacctgaataagccacttagggcctagatcagtgtttgggaatgtgggagaagacagccatagtcaagaagcgtgaagtagttaatgttgagttatttttaggtggtttttctgttctttttactccagacactgactttcgtaataagataaataatctggtgagtcgcatgctcatggtgtgctgaggcatttagccaagcagcttatgcatgtattatctcatttaattctgtcactatgaggtagagattatctttaaccattggttccaaatgagaaagccctgtttgaaataatttttccagtgtatttaaattttgtaggtacacacctagaatttcaaactgatggtctgagttctgagcccatctgtttaattcatcctaatgggttatcttgtggatatgctgattatagtaaaacaactttaagaatgtgatatacattatgagtgatacttgtggtttgaatgggtttttttaaacaacatgaaaatttgaagatattttgcatagatttgcttttgggtaaaacttttttttttttcatatcttctgtaattaacttctttccccccttttttgagatggggtctcattctgtcacccaggctggagtgcagcttgatgtatgatcatggcttactgcagccttggactcctgggctccagcaatcctcccaccttagcctcccaagtagctggaagtacaggagtgcaacaccatgccctgtagagacggagtcttgctgtgtttcctaggctgatctctaactcctggcttcaagtggttctccctacttggcctcccacagtttgattagagatgtgaaccactgtgcccagccaaaattaactttttaatctattctaaatcaagaagaaaatagatgtgtcttttctgggactagtaatgagaaattgacagcatctggtttttggctgttgttaaagtgtgattattactatactggtatgctgataaagagattgcatggtaattttcatcctttcatctaaaaacataatattataaggatagatatttccttagtatggggtgacttgtgtagattactatctcataaattggttcagattagtttttaaaaagggcaaaattgtatattagtgatattgctcagctctttttcaaagggataaagcactgtaaagagagaatgtgggggtagaagtctaataaaatcctcacaaatctggatcagtaacagaaaagtcagttataggccaggtgccatggctcatgcttgtaatcccagcactgtgggaagctgaggcaggtggattgcttgagcccaggaattcgagaccagcctgggcagcatggtgaaaccctgtctgtactaaaaatacaaaaaattagctgggcgtgatggtgggtacctgtagtcctagctacttgggagtccaaggtgggaggattgcctcaacccaggaggcgcaggttgcagtgagtcgagattgtgccgctgcactccagcctgggcaacagggtgagaacttgtctcaaaaaagaaagaaagaaaagtcacttataattatgtgggctttaaaaaacctgactgatagtgctctgtttttagtttcaccaaaagataggtagtacttccatcctctttcatgaaactacagtatgtctattctcaatgtttcaaaaccttgtaagactcagagggaagaaatagtttctcattaagaaaaatttagtcaacagtataattatgtattaagtgcttcaggaaaagcaatgggggaaagtatttcctacagtattaggtctctcattagaggtgagcagagggagttccttcagcgcaggacgggcatttctgcaggtgaagtgggatgagacaaccggctatagcaagatgttagcatatgtagttagcttatggaaacataatttgaattggacatgagtttttgtttgtttttgaggcagagtcttgctctgttgcccaggctctattgcaatggcacgatcatggctcactgcagccttgaactcttggactcaaggagttcacccacctcagcaacccaagtagctggaactacaggtgtgagccacaatgccttgctaatttttttttttattttttgtagtgacagggtctcactttgttgcccaggctggtctcaaattcctgacctcaagcaatcctccagccttggcctctcaaagtgctgggattataggcgtgagcactgtgccctgcctatgagttgttatagactgggtgattttgtagtaggcagcagtttgttgtcatttgcatgttgtacttcatgtatggttttcccaagtcattaaatgtacatacttctgcaactttttattttttattttttctggtgaaaagatatacatatatttagaattagccagctggactcagtttagatgaccccaattttgttggcaacatccaaagcatcataatcaggagctagttgaacgtatgcctccttctctccatcaggccgaatcagggtgttgaccgggccacatcaatgtcatagagcttcttcacagcctgtttgatctggtgcctgttggctttaacatctacaatgaacacaagtgtcttgttgtcctcgctcttcttcatggcagactcagtggtcagcggcaacttgatgataatatggtggtcaagcttgtttctcctgggggcgctcttctgaggatatttgggctgcccctggagtcgcagtgttttgggccgctggaaggtgggtgatgtgtggatcttttttttttccggctgtggacgcctttcaacactgctttcttggccttcacagcctttgctttggcttcggcttgaggaggggcaggagcttccttctttgctttcggtgccatcttgtgaaaagggctctgcagcttttaatgtgtacagtttccatgatatgattgtaccagattataagattatgttggacatttgagttctttccaatttattgctgttttcagcagcacttgatgaataactttgtagataagtttttgcaaagctttatgaatattttcttttgggataaattgctagaggctcgggtaaacattgccaaactacccttcagaaagcctgaacttatttacagtacacttatggtatggtttggctctgtgtccccacgcaaatctcatcttgtagctcctataactcccacatattgtaggagggacctggtggtagataattgaatcatgaggccagatctttcctgtgcttttctcttgctagcaaatgagtctcatgagatatctaatagttttaaaaaggggattttccctgcacaagtgctcctctctgcctgctgccatccacgtaagactgagttgctcctccttgccgtccgccatgactgtgaggcttccccagctgcatggaactgttaaatccagttaaacctctttgttttgtaaattgcccagtctctggtatgtctttatcagcattgtgaaaacagactaatgcaacttctctcaacatttctagtggacaggttttctatgttcccttctaacatcctgttttgccaaacttttgcaaagaatttcatattgtcttttttcctaattcaaccttttgtaaggaactcttacaacattggtgtaaaggtatgtccttagctggtggtacagtagttagaagttttctctgggttatggtgatattgggagtaattgtgttataggataatctgggctctctgtatttcataagattgtggtgcctcaccatcagtcagactgtagcttcagggcttttttttctcttggattgcttggtggtgaaatatcaatacagccttgcccattctgattagtgtgttacattactgatagggcagtgttaagagaaataggagaaacctgagcctaaaacatttcactgtgaaattaattggtctctgaagtgttttgtctttgtttaggtttgacgatcgtatgtggcgaaattacattggtggtaaatgataagcttgttatattgataacatggaagaaaagtgtttctggtttctcttagagaaaatcgattcccagtccaaggcacctgtgagtccaagagaatgagagaaggtaagatgttattagttagaaactgactatacaattccagtttctagtgcagagttgacttcagtagcatttgattagcatctaacttccttcttgggggaatcagaaaagggacatagattaggcattagctgaactcagattactggaaagtgattgagtcagttctattttttatttttattttttgagacagtctcactccgtcacccgctggagtgcagtggtgcagtcttggctcatgtcaacctccgcctcctgggttcaagtgattctcatccctcagcctctctagtagctggaattgcaggtgtgagccaccacgcccagctgggtttggttttttttgcatttttagtagagccaggttttcaccatgttgtccaggctgttcttgaaatcttgacctcaaatcgtctacccgcctgagcctcccaaagtgctgggattacaggtatgagccaccatgcctggctttgagccagttctaagggaaattattcatttatttttgtcagcttgtaatattgcaaatcatagtatttttgaaataaccttcccatgggaatagagtttatgcccttaaagggtagagtgctattataaagagagatacaagaagagagggagtgggtggcattccagagatcaggtctacatgagttgctgcccagccttcttggttctcaaacttgtcggtctggattgctgtgtttaaggaaagggaatagaacaatatactccctttctaaaatttttcattaattggctacctaacctatgttatgcatattaatttacttaacatttatgaagtacttataatatgctagacactgaagatactatggtctgaaagatggcaaataatagaggagaaagaaaatcataattgctattatttatgaagtattaagtacaggcagttcttaagcattcgacttagtatttttcaactttaagatggtacaaaagtgatacacactcagtagaaactgtattttgaattttgatcttttcctcggctagcaatatgtggtgtaatacccttacatgagatattcaaccctttttttttgttgttttttggagacagagttttgctcttgttgcccgggctggaatgcagtggcgcaatctcactgcaacctctgcctcccgggttcaagcgattcttctgcctcagcctcccgagtagctgggattacaggcatgcaccaccatgcctgactaattctgtgtttttagtagagatagagtttctccatgttggtcaggctggtctcaaactcctgacctctggtgatccacccacctcagcctcccaaagtactgggattataggtatgagccaccacacctggcctcaacactttttttttttttttttttaaataaaataggctttgttagatggccttgcccaactacaggctaatgtaagtgttctgagcatgtttaaggtaggctaggctatgatgcccattaggttaggtgtattaagtgcatttttggattacaatattttcaatttgtgatacatttatcaggactaacactgttgtaagctgaggagcatctgtatgtaccaggtacttaatattaaggtggcctttctaattctcatagaaacccatgcaaggtaggcattatcctctccatttttctttagggttagtgaagctaagtagcttgttcgtcatcactcaataacaaagtggttaaaatgggatacaagtccaccatgggattgagtcccagatgggagttcagatgctgaccagtgttaggatctaagtgcaagtcacttaactcctcttttcaaatgtggactacaacagttcttatctcatagggcttttttggtgtgtgttatgtgacagataggtgaagtggttagcccagttactggcacgtagtaatagttaataattatattagatcatactggctcaaaagccattaatagtagttactgctggtagttgagtcttacaaagccattgttttctccacatgtctttatgcaaatcattaatgacaagagcctaaactgtgatagagaaggtgtccccagtgttatgagagtattgaagaggaatggactgctaacctggactaggagagtaagcagacttacaaagatggtgatccttgaggggtcttgaagcattattaggagttagctggtgggaaaagataaagagaaggaagtgggttagaggaaagtcatggcaaagcaaaaaggcccagaaatgtaatgactgtgtgagggatagagtcctgagggtgagacataggttagaaagataagcaggccagattatgaagggtcttgcatgccatgggttttttccctaaagacagcgggggaagcagcagaaggactttttattttggaataattttagatttacaggaaagttgtaaagatagtacaaagagtttccatataccctacacccagtttccccgttattaacatcttacattagtatggtacatttgttacaattagtgattgattgatttgtaattattacctgaagttcataatttattcttatgttcttagtttttacctaataccccttttctgttccagaatcccatcgaagataccacattacatttagttgccttgttgctttaggttcctcttggctgtgacagtttctcaagatttttcttgtttttgatgatgttttagttttaagaagtactaatcagaaattttgcaggatgtttctcaattgggatttgtctggcatttttctcattattgtactaaggttatgagtttggggtaggaagaccacagacgtagagtgccatttcatcccatccaagggtacataccatcaacatgactgatgactgctcatgttgaccagtgttgcctggcggagtactttacagtggaaacgtctgagtttgtcagaagtttcagctgtaaagtactcttccatctcctgctccgcccctttccatacaacccccttttttggaaagaggtcactatgcacagcccacactgaaggggaagggagttatgatccatatctcaggaaggacttttaacgtggaaagtgatttgatcagaattatgttccagggccaggcacggtggctcatgcccataattccagcactttgggaggggaggcaggaggatcagttgagcccaggagtttgaggctgcggtgagctatggtcatatcactgcactccatcctggacaaacagggcaagaccttgtttcttaaaaaaataaagaatgggctgggcgtagtggctcacacctgtaatcccagcactttgggaggccaaggcaggtggatcaagtgaggtcaggagttcgagaccagcctggccaacatggtgaaaccccatctctactaaaaatatgaaaactagccgggcgtggtggtgggtgcctgtaatcccagctgctcgggaggctgaaggaggagaattgcttgaacccaggagatggaggttgcagtgagctgacatggtaccactgtgctccagccttggcaacagagtgagactctgtctcaataataataataataatgataataataaaaaataatgaattgtgcttcagaaagattgctctagctagtggagaaactgaatctggggagaccgaatttagcctgcaacctttaagacaggacaagatgagaaaccatgaagttggaaactgaaggtcagtggcagcagggttggagagcgatggatttgagaaaagtcgaagagattagtggatggggctcagtgggttttgcagagtgtgtgtgctcgagtgctagtagcagatgaggggactccaagatgacttgccagccatattgctgggagttggtgactatacaagtgatagtgttaatttttttaggtaaacaagaagaaacagcttgttgttgatagtgggaagggtgaatgagagggcaataagctgtgtcaagatgctttttgagttgttcttggcttatatgcgtattctgtcttgagataaagatttagaagtcattaccataataaatgtggtttgagaaatttgcagtgttagatgttatggcataggaagagtaattaataccagatgaaaaagaggaacccagggaacactgatgtttaaaaaagtggtagagaaaacgtggggaaaggtcaacttttgttaaaatctcttattcatgtggctgtttaattcctctacatcacatcctctcttctgttcaccctggaggtgtaaaacactataccaaaggacagaacacactatacacgtttagaacatttcttctgaggatagttactgctgcggtaatgcaggtactgttgtggtgatgctaatgagaataaatcttgctaaaattaagaatcaagacagctgaagacctatggaaagcaattgaccgaacagtactacttcaggtcaggtaagcagtggcagtacaagaatgaagaatggattctttgttaccaagcaattaacaatctagttgggtatttactgggtaatacaatacaaagtaagcaatggtaattggttatgtgtatgtcagttgtggcatgatagtttctacctcggctatctgctgaagccctttctgtctgtcttctctccctgtccagctttgttcttgcctgcctttttattttttacagtccctctccttttttgcaggggggcggggcggtgctagtgggagtatacatacccctcgttaaccacctgtgatgtaagttaagatttttttttaaatgtttctgttttttaaaaacaagtgaatagagcatttattatcatggaggataaaatcctcaaagaaaaaatctgtttagcttttaaattcttcgtgaaatcgctaatctttgaggcgaaaaattttttcccgtaaatttaggagaacatgagatttgagtttttaaggactttatagcgtgcctatgtttattgtagattttaattccagagagctggtgattggaaatcatggacctatttgttccaatttaaactttcagcatttaaaaaggaagagataagagagaaccagacaggaggtatatagtttgtagaaagatacagatatttaatgtaatcccagcactttgagaggctgaagcgggcagatcacctgaagtcgggagtttgagaccagcctgaccaacatggagaaaccctgtctctactaaaaatacaaaattagccaggcgtggtggcacattcctgtaatcctatctacttgggatgctgaggcaggagaatcgcttgaacccaggaggcggaggttgcagtgagctgagatcgcgccactgcactccagcctaggcaacaagagtgaaactcggtctgaaaaaaaaaaaaaagagaaaagaaaagatacaggtattgaaataccaaagttgcttctgacttcctcattttatagagagtgaactgttgtcagttgagaattcttaagccatttaacttaaatgctaaaatacttaatgtggatatcatggggaggaaaaatgttctttacattctttggtttttgatcataatgtatggtgtctttaaaatctaggcattgtagcataatggttaacaccaccgactctgtcttctgctgttttcatacctcttccttaagcttcgactcagcttcactgctcataggtgtgatgttgggcagcttacttcatctctctgtgctttaattttctcatctataaaatggatagtcgtaagattgaaatgaactaaggcacgtcaaagtacacagtgcctagcacatagtaagcatttataactgttacagcaatagtaatcatatatactcttgccattccctttgatttctatctttttgattacccaacgtcagaagccaaaaattttggagtcataaaacgttttttggtccctaacataattaagttaaatttactcatgcgtagcatctcaggatatattgaaagtatgggtggccagtccatacatttaagaataagaattataagaatttagagacagagccttgctttgtaccccaggctggagtgcagtggtgtgacctcagctcactgcaacctctgcctcctgggttcaagcaattctccggcctcagcctcctgagtagctgggattacaggtgtgtgccaccatgcccgactaatttttatatttttagtagagacggggtttcaccatgttggacaggctggtctcaaactcttgacagcaagtgatctgcctgccttggcctctcccaaagtgctggggttacaggcatgagccacttcacccggccagaatttacctttttaaaaagctttatttattatctttttgagtcctactgatgagtaatttggagtttcatgtgtcctttttatataggtattagagtatgacaatgacatctataatgggatagaatttaaattttaaagcaaaccaaacagctgtcctatttatgagtgctaacttaaagatggtttgataacatgaaggtaacggtactatgaatgtgaatgtaatgaccctatatatacacaataaatatacacaatatatatacagttctctgtttatacttttcagcttcagttttcttgttctgaatttaagcaagaaggtagcatttaattcatagcttattgtgctactcctgttttcatacctcttccttaagcttctggtaaaattaaaacatttcaagtagagtttaggattgtagaaaacaaggcatgttgttaaaacctgtaattgtgagcgtgtcttaaaatgacaagattattatatatatatatatatttatttattttacttatttattgattgattttgagatggagtcttgctcttgtcgcccaggctggagtgcagcggtgttgtctcagttcactgcaacctctgcctcccgggttcaagcaattctagtgcctcagcctcccaagtagctgggattacaggcacctgccaccatgcctggctaatttttgtatttttagtagagatggggtttcaccatgttggccaggctggtcttgaactcctgacctcaggtgatccacccatcttggcctcccaaagtgctgggattgcaggtgtgagccaccgcacccagccctatcttataattattgatagcaagaaaagcatattcaccatttgtttcagttctcattgttttcgcttccccttctgtgtttatccatttggccattctctttcttgtgttcatctttctgttctgactcaggtcattgaggatatggttggaccctgaatggtagaaacacaactccctcttcccctcgactccacagacttaatgtgattttttagggtataggggagggggttatgagaatgtgggaacccaagcaggtgttctaatggctgtggagtaacctgtcttctccttccagttagtttctgtgttttgtttgtttgtttgttttaaagagacagggtctctccctctgtcgcccaggctggagtgcagcagggtgatcatagctcactacagccttgaactcttgggctcaagcaatcctttagcctcaccctctgaagtagctgggactacaggtgcttaccaccatatctggctaacttttaaaaactttcagagatagggtctcactgtgttgcccaggctggccttgaacttctggcctcagctgatcctcccacctcagcctcctgagtagccttgctttttaaataacagctttactacaataaaattaacaaaacacgcagttcacttatttaaaatatgcaaaattcagtggttttcggtatattcagagttgtgtaactatcaccacaaatcaaatttaaaacattttatcatcccatgaagaaatgctgtacctgttagcagtggcaccctgttatttcaaatgccctacagcctctggcaatcactaatcatctttctgtctggacggttcatgtaaataaaatcatacaataggctgtggatttttgtgcatgtgactggctgctttcacttagcatagtgtttcaagtttcatactgagcatgtgttagtgttttattttcatggcagtataaagttctgtcatatagacatactgcatttttttattcaatcggttgatgggcatttgggttgtttctaccttttagctgttgagtaatgctgctatgaaaatttatatacaaattattatgtggatatatgtttttatttctttgggctgtatacctaggagtggattttctgggttatatgataattttttttcttttttgagatggagtctcgctctgttgcccagtctggagtgcagtggtgcgatctcggctcactgcaagctccacctcctgttacgccattttcctgccttagcctcccgagtagctgggactacaggcgcccgccaccacacccagctaatttttttttgtatttttagtagagacggggtttcaccatgttagccaggatggtctccatctcctgacctcatgatccgcccgcctcggcttcccaaagtgctgggattacaggtgtgagccaccacgcccggcctctgggttatatgataatcttttgaggaatggcaccattttatattcccaacattttagccaaataatctgactaaaaacaggcaaaagagctgaatagacatttctccagggaagatactcagatggccaataaacttatccaatatgctcaacctctttattcagggaaatgcaaatcaaaaccacagtgagagactacttcacacctgctggctagaatcaaaaagtcagataataacaagtgttggtgaggatgtgtagaaattggaactctcataccctgctggtgggaatgtaaatgtaaattgctgttctgctcccaaacagttgacaagtaaaatatagcattatagagtgagaaataactcagagtttcagagtagaactgaaaatatactagaagagtattttccttagtgttggactagatgattttaaatttgaacacagacattgtatcaggtaacatcaaatcatacagtgaagggtttctcacaatgtacacaaaatagtatttgtctgcttaacactgggatttgcaaagaacagtgaaatattacagtgttacaaagcaagatcttcctctctttaaatgcctgttaacctgattttaagaatatctttattgtatacatcttattctttaaatgtaccccataactaatagtaccaattttatgttttcaacatttaagttatgatattatacatttcctttaacttgctttttctattcaaactggttgatagctgtagatctgattttgttttctatatttaattcccttgaagtcacataccacggtttatccaatccctgattttttttttttttttttttaagacagagtctccctctgtggcccaggctggagtgcactggcaggatctcggctcactgcaagctccgtctcctgggttcacgtcattctcctgcctcagcctcctgagtagctgggactacagtcgcccactaccatgcccggctaatttttgtatttttagtagagacggggtttcactgtgttagccaggatggtctcgatctcctgaccttgtgatccgcccgccttggcctcccaaagtgctgggattacaggcgtgagccatggctcacgtgagacagagtttcactctttttgcccaggctagagtgcaatggcacgatctcggctcaccgcaacctccgcctcccgggttcaagtgattctcctgcctcagcctcccaagtagctgggattacaggcatgtgccaccatgcctggctaatgttgtgtttttagtagagacagggtttctccatgttgctcaggctggtctcgaactcccgacttcaggtgatccgcccgccgccgcctcgccaagtgctgggattacaggggtgagccaccgcgcccagcccccgttgatgtattttaaagattttcctctatttttgtcctatagacgattctgtagtaactatctatgttattatgtagatagggttcttcagataaacagaactactagaatatgtatgggtgtatctatgtgtacatatattcagagatttattttaaggaattggtttatgtagttgtaggggcctgacgagtctgaaatctgtgcaggcctataagaaggagttagggccttagtctcaacttctggaaaaatctcaatttctgctcttatgacctttaggtgaactggataaggcccacccacattatggagggtaatcaagagattatagatgttaaccatatctactaaatacttttcacagtaacacctagattaatgtttgattaaataactggctactagagtctagccaagttgacacagaaaactaagcaacacactgtccttccatgtgcaccagagactttcagactttaaaaaacctccaccaatagtttatacacatacttaatgaaaccatatgctgatgttttctgttcttattcttttttttaaaatgctgattaggaacccaaaattcaatgtgagtagatctgaccagcaatttgaaaaacattgcatatatatgtagtctagaaatggaattgctggcttgcaaggtatccacacgtccactttactatacattgccagtttttttctctgaagtagttgaaccactgtacagccctactagccgtgtgaataaaccttctttcttacccccttgatggcaactggtaattgcagtttccttgtagacctaattattccagataggtctgggcttattttttaaggtctttaaaacttgataaaaatcgactttaggccgggcacggtggctcatgcctgtaatcccagcactttgggaggccgaggcgggcggatcatgagaccatcctggctaacacggtgaaaccctgtctctactaaaaatacaaaaaattagcagggcgtggtggcaggcgcctgtagtcccagctacaggctggggcaggagaatgacatgaacccgggaggcggagcttgcagtgagccaagatctgcactctagcctgggcgacagagcaagactccacctcaaaaaaaaaaaaaaaaaaaaaaaagtcaactttaaacaaagagacctgcctgtgttggcaccttcagcaaatattagtatctacccagaaattaatgacatttctttattttcattgtatttatattttttgatttacatatagcaaaactgaataatttttggtgcacatttttgtgagtgttaagacatgtatacaatactcctcccttatccatgaaaggtatgtttcaagacctctggtggatgcctgaaactgtgggtagtactgaaccctatatatatactatggttcttcctatgcatacatacctatgataaagattaatttataagttagacacactgagagatcaacaacaaaaaataataaaatgaacaattataacaatatgccaacatcgccaatactttggggctgttagtaagtaaaatacaggggacttgaacacaaatgctgcgatgctatgacagtccagctgataactaagatgacccaagtgactaatgggcacatagcacctacagaggggatgtggtgcacaaatggatgattcaggtactattcctggaattttcatttgaatgttttcagaccacagttgatcatgggtaactgaaatcacagaaagcaaattccaatgcggggcaccactggagtttcatataccaccaccacaattaggataccaaagagttccagctcctccaaaagctacctcagactttcttaagcttcctcacacttctagaccctggaaaccttggatctattcattatccctgtacttttgcctttttcagagtgtcgtatgaatgaacttgtactggcttctttcactcactgtaatgctttggaagtaggtctaggttgttgaatatattagtagttcactatttttgttgctgtgtactgttccagtatatggatgtactacagttggtttatccatttacgcattgaaaacatctgaatatttcacagtttttttttttttttttccccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcgcttcccagtaggggcggccgggcagaagcgcccctcacctcccggatggggcggctggccgggcggggggctgacccccccaccaccctcccggacggggcggctggccgggcagaggggctcctcacttcccagtaggggcggccaggcagaggcgcccctcacctcccggacggggcggccggccgggcggggggctgacccccccacctccctcccggacagggcggctggccgacccccccccacctccctcccggacggggcggctggccgggcagaggggctcctcacttcccagtaggggcggccgggcagaggcgcccctcacctcccggacggggcggctggccaggtggggggctgatccccccacctccctcccggacggggcggctggctgggcggggggctgaccccccacctccctcccggactgggcggctggccgggcggggggctgaccccccccacctccctcccggacggggcggctggccgggcagaggggtcctcacttcccagtaggggcggccgggcagaggcgcccctcacctcccggacggggcggctggccgggcgaggggctgaccccccacctccctcctggacggggcggctggccgggcggggggctgacccccccacctccctcccggacggggcggctggccgggcagaggggctcctcacttcccagtaggggcggccgggcagaggcgcccctcacctcccggacggggcggccggccgggcggggggctgaccccccacctccctcccggacggggcggctggccgggcagaggggctcctcacttcccagtaggggcggccgggccgaggagcccctcacctcccggacggggcggctggccgggcggggggctgacccccccccacctccctcccggacggggcggctggccgggcagggggctgaccccccctcccccctcccggacggggtggctggccgggcagaggggctcctcacttcccagtcggggcggccgggcaaaggagcccctcacctcccggacggggcggctggccgggcagggggctgaccccccccccacctccctcccggacggggtggctgccgggcggagacgctcctcacttcccagacggggtggctgccggacggaggggctcctcacttctcagacggggcggttgccaggcagagggtttcctcacttctcagacggggcggccgggcagagacgctcctcacctcccagacagggttgcggcccagcagaggcgctcctcacatcccagacagggcggcggggcagaggtgctccccacatctcagacgatgggcggccgggcagagacgctcctcacttcctagatgggatggcggcggggaagaggcgctcctcgcttcctagatgggatggcggccgggcagagacgctcctcactttccagactgggcagccaggcagagaggctcctcatatcccagacgatggggggccaggcagagacgctcctcacttcccagacggggtggcggctgggcagaggctgcaatctcggcactttggggggccaaggcaggcggctgggaggtggaggttgtagcgagctgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatcagagggagaccgtggaaggagaccgtggagagagagggagacgagagggagagggagagggagagctgtttcacagtttttgatgattgtgaataacgctgcctatgtgtgcaggtgcttttttttgtttgtttgttttgaggtggtgtctcgctctgtcgcccaggctggagtgcagtggcgcgatcttggctcactgcaagctccgcctcctgggttcaagccattctcctgcctcagcctcctgagtagctgggtctgcaggcacacaccaccacacctggctaatttttgtatttttgtggagatggggtttcacagtattggtcaggctggtctcgaacccctgacctcaggtgatcctgagcctcccaaagtgctgggattacaggcgtgagtcactgctcccagcctgtgtgcaggttttattgtgaacatatgctaattctgtagggtatatggctgaacagtggggttgctagatcagtcatttggtaaatataattatgtctttgtaaaaaactgcaaaactttcccagaatggctttataattttgcatttacaccagcagtgtatgagaatttcagttgttcccattcttgtcagcactttgtagtgttgatgccttttattttagacagcctaacaggtaaataatggtttctcatcatggctttaatttacattttcctaatggctaatgatgtagagcatcttttcatctaatataccccctttatatctactttggcgaagtgactgttcaaatcttttggccattttaaaaaaattgtgttattttccttattgttgactttgaaagttctttatgtattctggatagaagtcctttgttgcatatgcgatatgcaaatattttcttacagtccgtagtgtatctcaacagtgccttttgcagagcaaaagtttttaaattttatttttagtataccattaaaaaatgtttggtggattgtgattttggtactgtatctaagatctcctttcccaatccaaggtcaaaaagatttccatgtgtttttctttagaaattctataatttttcagttttacacttagttctgtcatctgttttgagataattttgaggtatggatccaaatttttttaaaaaaatgtttgttttgtttttgcatgtgaatattcatttgttcctgcatcatttgttgaaaagattattatttttggcttgattttgccttcgtgcctttatggaaaatcatttgatcctgtatgtgtggttctgtttttggactctattccatttatttccctttttttttcttttttttttttgagacagaatctcgctctgtcacccaggctggagtgcagtggtgcaatcttggctcactgcaagctccgcctctcgcgttcacgccattctcctgcctcagtctcccgagtagctgggactacaggcgcccgccaccacgcccggctaattttttgtatttttagtatagacggggtttcatcatgttagccaggatggtcttgatcccctgacttcatgatcctcctgcctcggcctcccaaagtgctgggattacaggcgtgagccactgcacctggccttttctctgtctttatgccaataccatacattcttgattactgattttttgtaattagtcttgatttagatagtgtaagtcttccaactttgctctttttcaaaattgcattggctgtctcatttactttgcctttctttatgaattgtagaatatttatcaattacggcaaaagaaggtgctacaattttgattggagttgcattgaatctttagagcagtttgggaagaatgccttcttaataataagtctatatctatgatctatttcttcatcttcttagatcatctttagtttctctcagcagtgttttgtagttttcagtgtacacatcttactttatccctaagttatttcatatttgatgctaatgatctttaattttgatttttgattttttttttattgctggtatatagaaatagaattgactatttactattaatattatttcctacaaccttactaaacttgtttattctggtaccattttgtagattctacaaaatgtagattttctacacagataatcgtgcagttttgattgtacctttccactgtggatgcctttatttttgttttactttagacttttattggaaatacagcaggacttatttgtctttgtattccctttggggtccctccccacacatacctttgatgacttttgttttagattctttgtagcgttagcattgttctgaagtcagaactatgtatatatctataaaaaaggtatacttgggctgggcgtggtggctcacacctgtaatcccagcactttgggaggccaaggcaggcagatcatgaggtcaggagttcgagaccagcctggccaatatgatgaaaccccgtctctactaaaaataaaaaattagctgggtgtggtggtgcacacctgtagtcccagctactcaagaggctgaggcaggagaattgcttgagcctgggaggcagaggttgcagggagccaagatcacaccactgcactccagcctgcgtgactgagtgagactgtctcaaaaaagaaggtaaactcaaaggcggtcactccatcttttttgtcatatttctttctcatctacatcctcttcccatctgcaacagaaattcaacttttaattttacctaattcatacttttcacactttgggtccttttcactattctgttacggttctttaaagtaactgcctctcagattttactaaaaatgtaaaatttcctctttatgaaacctagaacacattggtagacaaaattaaagatgggagatctggtggtatcataaaagaagaaattcgtcaaccagactgtgggtttcctagatttttgtttatagtaggttgtatgttatatttagttgcatttttccccctagagtttaggttccataactttcatcatattttcagagtaatttatttaaaggaaaaaaagtggccaaaattaacctttagaatgaataagtctgggcctaaccagtgtgaaggtatggtcactgaacctcctgtttctcgagtctttgccttctgaagatatgtgtattgtaatagatgacagccgcttgcggttaattcagtaatacatgtcagctccacccctggcacttttaaaccttttggcctactattttgcaaaacagatttttaagaattagtatgcattttagaagtttcctttcaggttaaactttttaaatagttattctttaataatgctgttaaaagaattttgggatttctattgccaagtcactaaaaagtaactcaggcagagaagggtaagggtgctgcaagcacacatgaagaattaacattttaaaagaacctttgagcaccttggcacctgtggatttcttcttggatgtctcatgcctaaaagcagagcagcatactgtaaaatcagtaaaagtaggaaaggacttgcaagtagaaatgtttcagcagactctcgcctcccccatctccatcctcactctgatgttaagtgtggggcccattgggccagatacaggtaaaaaggtgggtgatgtcattaaaaggtattgttacttatagcttattatatgtgttaaattttaataagaattttcttttttctttctcccaagccaaactggcaagacgcagtcaagaacgggacaatcttggcatgttggtctggtcacccaatcaaaatctgtcagaagcaaagtgtaagtcttggagcactttattttccacctttcttgtttaatgtaaggttttaaaggtacctttgaaggtaaaagcttctatatgtattaaatttcttttctattttaagataaataatttaaagagttttaaagtgtatatttctttttttaaaattttttattttttgagatggattctggctctgttgcccaggctggagtgcagcagcacgatctgggctcactgcaatctctgcttcctgggttcatgtgattctccagccccagcctcctgaatagctgggattacaggcacccattaccacacccagctaatttttgtatttttagtagagatggggttttgccatgttggccaggctggtctcaaactcctgacttcaggtgatccgcctgccatggcctcccaaaatgttgggattacaggtgtgagccactgcgccctgtgatctgttccatttttgaacatgttctttcttacagagcactaaaaatctgcctccctgtaatttgtaaaagctttgttttcctgaactttgctaaataagtttgcttccatatgtgtcctttaaatgttcagtcatcgtatctcctttactgtctgagtccaagctagttgcttcaggtgccttttcagatggtttttttggggatctcttttcatctcctgttgtccttctaagtgtgttccagttggccacaatgtccatcttaaattgtactcagaactgaatatgaagaatactgagcattttttgaacctttatgccagcacagtactaaaatgtttttcatactcctgtatcattcagtgttcacagtaacccaggaggaagattttttctctgttttacagatggcatcccatagttcaaagagtcagagggttgtaaaagtagcacagatagtgagtggcggaaccccaagtagttcactcctgggtcataatctcacttatttctcaggctgtgttcatttagcctgttagccactatctttctgttattacagtttaaagttgtattagtcacttttcctattgtattgcttattggagtctttggagtcagaatttaattttaatgttatcttatttttcatagacctagaagaaaagggcagaatatgtaaagttaattgatttttaaacagtggtgttgcctataaaataaatttacagttttattgtaagccctgattacaatcgttttaagtttaaagttggttaaaactttaaactttaaaaaaactaacctgtccactgaggctcccagtggacagcgagctcggcttgtggctgagacacacttgagccaggccagaggcataggaggaccaaatttgacagatatcaatacacgattcttactgaggcctttgaaacggacccttgtcctggaattactgtcagaaaagaaccggccagaaaaacagactcccgagccacgagtccaggtttggtttcagaattggagaggtggagcacggaaaagaagccagagcagcgccagcgtggaggccacctgggcgcaggtccccccgatcccagaccctggtcagcctggggtgctgacccctactgttccaccagcggggcttccccgggggtcccaagcaatgtgggcaacttctcttgggaatcggaggatgctttgggccaagctctcctctgggggcgcgctgatgttccgtgcgcgaatgtggcccccgctgacctggagatggcagccagtgcgctcggccacgcttagggagatgtcccttgatctccgccctcgggcccagtgctgcttccgggtccctcttgccaccagcccttcccacagctggaagctggcagtgctgggcctcaagttcatcccggggcacccggcctgctccccatacaccagtccctagctctgcgggggctggggctgcaccctcctgctgtggagcagcagccgaggtggggctggcagctgggggaggcgcctgggtgcgccgtgacctgggagcagccctctccgccccagcccccgcagctctgaccgtatcccgcctctctgcctctttcctggccatagtcacagccacagccatcgcaggacccggctgagcgctaggaacaggttccttgtcttcctccagaatccaactcgcacgggaggccccagcacccctgcccccaacccgctgcggagtctgaacctcaagcggctgcatagcaaacccgtggaaatgacctgtcagtgtcaggcagtggaagacagatgaactaagcaagggctcatcggtagtgttcacgttatgaaaattgaagagaaatatcaagatttatttactttgtcacggaagggcttccagacatacctttcagggaaatcgagttgttagggtggaagggccttggggtgcatgagacctaggggttttccttagatggcataaaaaaggattgactttatagaatacatctgtctttccatttattaaccgagtaaacacggagcactgagagtgaacaaagtccactagcgagaaggcaggatgaggacggctttgtagaaatgcattattttctatcaggaaagagcaatgatttctactctgggaaaaaaacaaaacaaacacttacctaaaagtaatatttacatattgttgaaagttcatagataaaagtataaagaataaaaaaaattcacctattattccatcacccagaggtgataatcgttaaacattttggggtatttcttccaattttttttgtatgtatttatataagtgagatgatagattatctgtgtgtgtgtatgtgtgtattgtcttcctgagcatcggacctaagcagtttccacgttgttaaaactgcttataaaggttttaaataactaggtgtaatactttattacatggatatgtcagtatgtttaacaattactctattgaaaatttaggtgtctcagttttggaagaatatggaagtcttggttgtccagcatttattctgacattaagtagaaataagtgatttaggacatatttctagcagatactaaaaaactgtgtataggatgtctggagatccctggcttttcttgtgtgtgtgtgtgtgttttttttttcctcttcttttcaaagtggctgttcagagttctgcctcttagggttactgaaagcttataaagttatgttgtaattataaaaataaatgctattttagaaaattcaaatagtacataatgcataatatataattgttttccacaaaatgtgaactgttatcagtctgctcataagtacatctgggactttgtttcatctcagtatatctacagttatctaatttttttttactgtaactagtatggatgtatcataatttagcctttttttaaacaaaattacctgtattacctattgatgaatatttataatcttagttctttttttaaactctgttttttaaaaaacctgatccgtagaatgactctagtttaacattaatgaattgtacatttcttttttttttttttgagacagaggtttattcttattgcccaggctggagtgcagttgtgcgatcttggctcactgcaacctccacctcctgggctcaagagagtctcctgcctcagcttcccaagtagctgggactacacacgcaggcccctgcacctggccttgaattgtacatttcagaatagctagaagagggctgagtgcggtgtctcacccctgtaatcccaacagtttgagaggctgaggcgagctgatcacttgagctcaagagtttgagaccagtctgggcaacatggtgaaaccccatgtctctcaaaaagtccaaaagttagctgggtgcgtggcatgtgcctgtagtcccagcacttggaggcagagatgaggatgcttgagctcaggagttcaagaccagcctgggcaacatagatctcccctctattaaaaaaaaacggggaggcgggggctagaagagaataattttgaatgttcctaatatagagaaaatgtaaatatttaggattatggatatcccagttaccctgatttgattatatgaatgtatcaaattatcacatgtaccctggaaatatgtacatctgatatgtatcagtaaaataaaatacatacattttaagagaggatcttggctctgttgtccatgctggagctcagtggcacagtcatagctcactgcagccttgaactcctgggctcaagctgtcattttaaaaaaagcaatagtgaagatttttgccccttaatacatttcttattttcttgtttaaaatagattttatattttagagacattttagcttcacagctaaattgagcagaaggtacagagtgcccatttatcttctgcccccacacacccacaccctcccccagtgtgaacatcctgcgctggagtccaccaaagggatacgtttgttacaatcaagcagcctacagtgacacattcttatcacccgaaattcatagtttacattaagcttcactcttgtgttgtatgttctgtggattccgacaaatgtataatgacctgtccaccaatgtagttatcatcgtttcactggtttaagaaacctctgtgctccacctgttcatctccctctctgcctcctaaaccctggcaactgttgatcgttttactgtttctgtagaatgccttccagctggaatcatatagtatgtagccttttcaaattggcttctttcacttagcaatatgcatttaaggttccactgtctcttttcatggctggatagttcatttctttttagtgctgaataatataccgttgtctagctatgccacagtttatctggtgtattgtcatgctaggaacccctctcccacccccacattacaaacagactgatgtcttctgtcgtcttctccttttttacatcgttgtttcaactgaaattattggattatattttttccttcacttacattaaactcatacatactttgtgcctggacttcattcttttcagtgtacctggctctatatttattcttttaggtgaatcttagatttgtggtaacaagttctgtccaaaagtatctcaattcagattatacggaattcgtgtttatctactgagttttcatttacgttttatattgaacagctttttgtctgggaatgtaccaggagtgaaaggttcaggaatctcatactgtaatggagagacagaaaaaatgaacatgtgagcaaataatttatgtgtagttttcctaggcaactcttcctttttagaggtagaaacactggggtctacagaagtaaagtcaagtgtttaaggtcccatagccagttattacagtagccaagttttagctagatctcttgtctccagacaatatttaccacacctgtctgcctttgtaggctgcttcatttaataaactgtaattcaacgcttaaaacattaatactatactagtttttttgggctgtgtctaagtaaaacccatttaatgagagatataacttatgggatatgcctagaaaatgtggcctgtagagagacatttcatgttgaggaagcgtaaataattcccaataacatagattagaacaatgagtttaaatattaagtgatcatggaaaattacttgatgaaaccatggcttgagatttcagcaacaaaggagtgaatgaagtacaatctgccatcatgtgtaatctggagggtggcagactgagaaactgaaaaatgttcacttattggagaagagtacagttgactcatatgatttttacatcaagcatctcccatgtaccactgagtcagtattctgatgttcccgttgggactcagcagaaggtgctagctttcctaggtagaaacaaagagttgaagatggttgacatttgattgaaatgtggaagaatgagtaggagtttgctggctggaccaggggcataagtgcacactagacagaagaaatgatagcatttcctttttttttttttttttttgagatagaggtctcgctctgttgcccatgctggagtacagtggcgtgatcttggctcactgcaacctctgcctcctgggttcaagcagttctcctgcttcagccctgcgagtagctgggattacatgcgtgtgccaccacacccggctaattgtgtgtttttagtagagacagggttttaccatgttggccaggctggtcttgaactcctgacctcaggtgatcctcctgccttggtctcccaaagtgttggaattataggcgtgagccactgcgcccggccagcattttcatttttaaaggtgtgaagatgtggagaggaaatccagcacttaattttggagatttgcctgactgtgacaagtgttgtcctggggcagagagaaatgaaactagaaaggcaggccagcttcttaaaggtttggaggatctcttgacggagttttagctagaactgatatgatttacactgaaaagctcttgacagtcctgtggtttagagaagagtagagaagaggtttattggtggtagtaaggtgttgatgcaattccaagtcagagaagttgattgcctaaccgggtcagtgctgttaaaaggcggcatgatggaaattcaggaagtcaagtcaggagtatcttaacttgccccaaagagatggagaccatagaattgtgggcttagtgactggttcaggcagcctttaacatgcctgtaaagactattaaatgccgttaagtataggtgcactgttccatcatttactccacacgtttctgttgaacccctatgaggcactccgttgctgtgatacggtatcatctctcctcagtccccactgtgatattgtgcagccaccctttgcatggattccacaccctacctctgcacatcctgtttataccattccaggctgcccgcctttggggactccatcctcattccagttgatctgcaccctaaatgcccaccttgctcagccctacccaccagctttaggataccacctcttgccttcatgcagacaccactgcactgcgcagtgtacttttgacagtcccctcttgtcactgtgcttacgtgtagacctacctcaagtttggacttcgtttgtttagagaagcagctgaacgttaacaaagtgggcgtattagagtttaaaatatatgtagagtttaggccagattgtaggcccagtctggttccttttactgacttaggaaaaacaaagtttacccaggcacgtgtggttaaatataatgcaaaactgtggtccaagggtcttaatgaaatggatagattaatctgaggattttttttttgttgcttgattattattattttttttaaggtagggcttgaaaagaaggggagtggaactagaggggaagctcgggtatagccttgtctgttgtttatagtctgctttttaaaaatatataatcaactaaattgctcatgctgaatgatgttgatagttcccagaaggagcaaatttctcagatgggctgctgttgccttgggtgtagaatttagcaaggtgacttttggctattggatatccatagaaacagatggtcttgctcatttatgcattatgcattttataagttatatatagtaagtgtttgtgcagttatttaagtgtttgcattttgggttttttattttataaaaatgaggaaaaactggtccagtggtaagaatcatggatctctgtgttaaaatagacaaaaatggaaatcgttagctgtgccaaaaacaagctggctgatttttttgagacagagtctcgcactgatgcctgggctagagtgcagtggcgcaatctcagctcactgcaacctctgcctcccaggttcaagctattctcctgcctcagcctccctagtagctggaattacaggcacccgccaccatgcccagctaattttttgtatttttagtagacacggggtttcaccatgttggccaggctggtctcaaactcctgaccttgggatttgcctgcctcagcctcccaaagtgctgggattacaggcgtgagtcaccgcgcccggcctgattttttttttaagctagctattaactatataaggaaaaaaattgcatgtaacatggtggaggtagataatttaaagttgtgtcaaaagacaagtttaagttagggatttaaaagtaagttttagctttcttggaataagagccgtacctatgacatacgcacaattcatttctactttaggatgtttgacttactatattgtacatgaaagtttagagtaatatgaataatgtgtaatatatcatatataattctaaactttcatgtagatacatagtaaatgtcaggtgtctctattcagagcatcccagtagcttttcaattcattgtaagttaaagtcaaaagaacctgacacaccctgggcagcatggcaaaactccatctctacaaaaaaattaaccagtcatgatggtgcacacctgtagtcccagactgttgggaggctgagatgggaggatcacttgagcccaggaggtccaggctgcagtgagctgtgattgcgccactgcactccagcctgggcaacagcaggaccctgtcttaaaaaaaggaaaaaagaaaataataataacacaaaaaaagaacttgatgtccacatggctcaccccccagttcattctggttattgcttaagtgtcactatatcagagaagccttctttgaccacacaaaccactcactgtcttaactcactttctttcattctgcttatcatcaccggacatcgtattatctactttatgtctctcgtctctctccactgtagtgtaaaactgagtggaggaacttggtatgtgtgttcagttctctgtcagtcccctcttggcatgtggtgggtgtataataaataagttattgaatgaatgagaaggtggtgggagtgcaggattcccctggatagagatttgcaaatacaggcttttctgccatttgctctgtaacttgggttgtctggaatcttataacatttccttctttgtcccttaccttgtggctatcatttgtttactcagtaacttgcacaactgcttgtgtaccaagcgctagcaggcactggcgaaatacacgaacagtccgacaagtccctgcccaagtgtagcttacagtctacgggaagctgcactggtaaataagttcattgagcgccgtgaaggagaagtgtgcttaaacaaataccacatattctcacttacaagtgggagctaaacattgggtgcacatggccataaagatgggaccaataaataagacactggggactacctaggatggggagaggtggggacaagggcttaaaaagaacctgtgctgagtgagtcatgggttcatttgtaccccagacctcagcatcacgcagtgtgtctttgtaacaaacctgcacacgtgcccccgattctaaaataaaaagttgagggaaaaaaacaaaacaaaacaacttattctttgacttgggtgtgagcagcagtagcgatagggtaagcctatattggcctagttttcagctttttaaaaatatatggctagaagaggttgaaacttgtgattaaaatgagtcttttgagtgtgtgaaaagtattttcatcactttaatttttttaagtgctctagaactagctaaaatgggcaaaacgtactagaataaacatagctgaatgagttgaatttacaaactagtggaagccttctattaaacagtaatttaccttgtaatcatattaatgtctaatctgtatctttatacagaaaaacgtttcattgtgttcagttttagtttatcctttctgttgacagtggacatccattatcagttcttgactattacaaatattactgctggggaagcattcttggacctatttcttgatgcccatctagaatatatatgctaagttctgagagatcagtgccaaattattttcaaagtggtcaaactggtttacactgctaccagcaaaatgcagaatttatttgctccacatcctctccaataattgctgttgttggacttatacgtgttagaccagtctagtgtgagtataacactgtttcatataccaaggaattttgctgttttagttaggtctgttaatggcattggtgttatgaaacaaatattcccacattttaaaaagaggtgtatattgatatatgtagggatgaaatgaaataattgggatttactttaaaattcttcagcacatgtaaagcacattttgggatcagttcaccaaattgttctgtggatgcagattaaagtattgtttccgtgtttaatttactgtcctgtggttatgtaggacagtatacctacccttagaaaacacttgctgaatgtttaagagtactgggtcataatatatgaaagctgctctcaagtagttcaggaaaaagttaacacacacacacacacacacacacacacacacgcttatttttattattaaaaatagcctctaacttaccccaccatgtggacataaccactattaaagtttgcttccggatcttttcggtatgcttatatgcactctgattttaagcacaaatggttacatcttctatgtagtggttttcaactttaattttcctgcaattaaaaattaaaccgagttttgatcctgaataatatcacatcttgtagcatactttattcaactacatctctccttccttccttccttccttccttccttccttccttccttccttctttttctttttctttttttttttttttttgagacagtcttgctctgtcgcacaggctggagtgcattggcacagtctcagcccattgcaacctccgcctcccaggttcaagcaattctcgtgcctcagcctcccgagtagctggaattacaggcatgtaccaccacacctggctaattttcatatttttagtagagttggggtttcaccatgttggccaggctggtcttgaattcctgacctcaagtgattgacctgcctcagcctctcaaagtgttgagattacaggcctgagcttctgctcccagcccacatcccattcttgaacatttagatgttcttcttttttcctcctataaataacacaagtacacaggaatttataatgtcctctccccagttgaaaagaaagccctccttaattctgcagatcaggtttctcaattatgtgcattcatagttctttttctcggtcacttacgacaattggaattcatttgtatgactatttctctctctccagtcagacatgcgggttccataagggcagagattgtctattttaatcacagctatcaaagcagcaccaggcacacagtaggcctgaaagatttgttaaatcagtggagaataatttcaacataaacaatatattttataaaagatcactgtgttgcaacttactttgaaagctcttaaataacttgtttgtatagcagtgcttatggaaggctactctattggatgaagaatagaaaaccctccacattgcaaacagtgggacttaacagtgggagggcctgcccctcccaactccctctcacaggcaggagagcctgccctctcatactcagtctcacaatggggtttagcttccttttcagagctaaagaacccacccagccttcctataacacagactctctttcatctttaatggacagaatcaagattattgctgccagagatagaaagttggggaaaagtcctcgagggtccccttctttgtttggagcaatttgatgcaggtagcttgtatttctgtttatctgcttcctgtttcgtcttttatcttttatccatcaccttaagcatttatgcttttttttttaatcttaagaaatgggggttcactgtgttgcccaagctggtctcaaactcctgggctcaagtaatcctcccgtcttggcttatcaaagtgctgggattacaggctataagtgtgagccactgcatctggccaatcttttgttttttgtatgagggtagctggagcacttttaattttctaaggttaaaaacttacctttgcttcacttaaggaaaccatgtgagagatcttgaaaaatgcacttttcattttcatcactgccctaccagcaactactggtgtactctgccaagataagcttcagacaagtcacttctctggggattggggttggagactgacttattctgtaaagtgggattttaacaaactcccactaagaaatagctttaaaaaatttatttttttgagatggagtcttgctctgttgcccaggctggagtgcagtggcacaatctcagctcactgcaacctccgcctcctgggttcacgccattctcctgcctcagcctccccagtagctgggactataggcacccgccaccatgcccggctaatttttttgtttttgtttttgtttttgtatttttagtagagatggggtttcaccgtgttagccaggatggtctcaatctcctgacctggtgatccacccgcctcgtcctcccaaagtgctaggattacaggcgtgagccattgcgcccggccaagaaatagcatttttataaagaacgtacattttgttacctacttggaaggacggattgatgaaatcctcaggcagagtctctggcttggcttcctgtgctgttttccaccccagagagggagcgttcagatgtttactgtagtaatgtctgtacccaccaggtggcacaattgctttacttaaatgatttaagctcattttgattctcagcgaggtgtgataactcatttcttattttaataataaaagatgccacaatatttgttactgtatttttaaagagaatttttgcatgttcagttgagtgatgagagagaaattggtgtcatgtttcctctgtggtacctaatcctacagcaagagtttcaaaaatatttttttaaaaaagctctaagaaggctataagccttgtcatcagcccaccatatggtgccagcctattgctttgcatagaatatccaagatcacacagtgttctgaatatctgcagtatctagggggagggaagggtgagttaaggttactgtggcaattttcatctgcatttctcccttcttttgcacttgagacttactgagggtactagggcatttcgttcattgaattaaaatgaatatagaaacaattgaagtttagcgtccatctgtttcttacccctgctttctgtcacttcatcaaccacagttctattaacttcattcaagctagatacagtatgttgattagccttggttccctgtaccaaggaggctgttctaatctgaagagcccttctgcctctatcttctctcctcaagagatagaactgtgttggctggtccgaagtagtgagttatctcaactgattcttcacaattgcagatggaactccttgttcttctctcttcctgcttctcactactggacccagctggtcttttttaaaagaaggaaaggagggaaggagggaggaattgtgcatagaggttgtttgtttttgtttttgttttagatggagtcttgctctgttgcccaggctagagtgcagtggtgcgatctcggctcactgcaacctctgcctccctggttcaagcaattctcctgcttcagcctcctgagcagctgagattacaggcatgagccaccatgccctgctatttttttttttttttttttagtagagacggggtttcaccatgttggccaggctggtttcgaactcctgaccttgtgatccacccacctcagcctcccagagtgctgggattataggtgtgagccactgcgcccagtgcatagaggtcttaaaccttataccttatctgatatttaccagctgtgtgaccctagccagactacttctgtgagcctcagtttctttgtgaatgagagtgataatggaactatcagagaagattaaaaaaaagattgtaaagagcttaaaacaatggctcataaataataaattctcagacgttagctgttgtttctgcttgtcagtatagatgccgaacctttaggaagcattccttcattgatcattattatcatctgatgacttggcattcccatactgtcctacatctgtgttgttatttcgtgtgtttgttctcttctgttgcctgtgtgttgtctcaagctactgtgggaaatcggttcatttttgcttatttcggcttgctatttaatacagtgctttgttcatggtaagtttaattcagtacatgcttgattaggcttttggaattttataaattttcttgaagaatgaggatttcacattctgtctttaagtgatattatgaggaagcccataactcattcacctatgctctccataatggtaaaacgcagtggatggattcttgtgcttctgactgacagattggaatgtcggccaggttgcacaggcaggcctgctttgcgcaccctgtacactggggaagggtgatgggtgcaaatgcctgggcccatagaaacgtgctggcattttcttgagcagcgtggactttgctcattgtcctgattagcgtttacttcatgagtccctgccctcagtggctcctcacttccagattggtgaatttttaatcgataagggacagaattaagattgttgttgccagagttggaaaagtccccacggatccctcttttctttaagagcagttttttgtaggtagcttgtatttctcctgctcctcttccttcctgtttcatcttttattcactgacttttaagcatctgcttatctttttttttttttttttttttttataagggtagctgggaacacattttattttcttgggttgaaagctttttttttttgcttcagttaaggaaaccacgtgggaggttttgaaaagtgcacttttcattttcattgctgtcctaccagcagctactggtataactctgtaaaggaacagggtaggtggtgggaagggaatagcatcagggattctgaaaagtatggcagctatgcatgtcccttgattaaagaaaacaaaagctgaggattatgtagagcaggaatacagtaagagacaaggtctgtcaacagcattgcttgtgcagatggctatattctgagtaaactctagtccagaacattctgtgaggagaggaggaggagtacctactgtggtgtcattttcccagttaggtgataacctggctttattggtgagaactaattcttgggaaggtcagggcgttgctaaagataacatagtcatacagtgctgactgtgtgccatgcactgctagacaaactcattttattttgagacagagccagaatttgacccgggtctttcttaccctgtacataacctgtgctgccttttatcttgtgggacaggaaacctcatatgttgacattgtacataatacagcaccccaggcattcattcagcaaatgtctgtctgatttttgttggacattgggaacaatgaaaagaatgaaaaagtgtatatttgctagtaggtattagatggtaattccttttacaggttagagggctcctggtacattaacttacttcatcacaaccttccgagcacctagtagacacaccatgtgtcttcatttaagtagttactacagtagagtgctttcttcctttactttagatttgagtcatcagggtgatcttccaagaattttttttttttttttggacagggtctcgctctgttgcccaggttggaatgcagtggcacgatcttggctcactgcaacctctgcctccaggattcaagcgattgtcctgcctcagccttccaagtagctgggattacagacacgcaccaccgtgcccagctgatttttgtatttttagtagagatggggtttcaccatgttggccgggctggtctcgaactcctgacctcaagtgatcctcttgcctcagcctcccaaagtgctgggattactggcatgagccaccgcacccggccatccaagaaaatccaaaagttacatgactttaaaggttaccttagtaagaataccttattgtttacaatatggcagatgtcctatataacctcagctgcagcattcgggatctactgttactgtcttgttgttcctgtcaccagctgattcttaagatataaagcaaaagaggagttgaaaatggagtagcattcaacaaatgcttgtgtgtgtcttaaaatttgtagctaaatctggttgcagacagtgggcacaggcattacaggccttgttactgatgtagcaggagggactctgagcagataacatatgcccaagaaccacaggcaggactagcccctgtgctgggccactccagggactcctgcatcactttttcagcctgtgcatgtgtttgctcaaagatcgtgctactggtgatcatacatacattccttactcagttaaggtagataatagtgtgctctgagacttgagatttacagcagaagcttaaggttcatttgttgttcattcaccaagtatttattaaaggaaggaacccttcaagccagttttaaacaagcagaccttctccagagttgaccctcaatttaccgcagattgttttcgccttctgtccttacatattcctgagtgcatctcatgacctggtttttaatcagctggcctgctgtctgtttctaggtctggtatgctgccatttgcatctcatctcctccagtatgaacccccatattacctgtgtctctctgcagggttctggccaggtatacagaaccacctgttcgagcagcctcatctgacattttttagaatctgagagcacttttatttggcataatctaatgtattgtgaaggaaaaagcaagggacacactttggagtaattccctgccctgcctttttttttttgagatgaagtcttgctctgtcaccaaggctggagttcagtggcacgatcttggctcactgcaacctcagcctcccaagtagctggaactacaggcatgcgccaccacgcccagctaatttttgtatttttagtagagatggggtttcaccatgttggccaggatgatgttgatctcttgacttcgtgatccacctgctttagcctccggaaatgctgggattacaggcgtgagccaccgcgcctggcctctgccctgctttttaaaatcaccagttatacttttgtgacaagctatggtcatttcatttgtcatttgctgaccttcaagtaaattgaaattttactgtaatctgagtgaagtaaccagtttgtaactattttaaatattaaatcggaaattagtggcttagtattagaattaatattgagctgcagtatataattagttattgtttgaattaggttgactttttcttttgtcaatggaatatttttccccaatttttagaatacatgcttctataagagttggaattctttttcaaaattgatttctgtttcctaaattggttgacagttctcccagagctgggagcatgcttttggtataatcgcatggcaaactaagttgtagaagctcagacttttattaggactcctctgtttactctttgtgtcatagtgggaaagtggatcactctgagcctgttttctctaagtttggccattgtacctagagagtaagatttaggagccaagagggaataggggctagtcaggattttactgcctacttcatacagttctatgctccttgattttttttttttttagcttgtgttgttgttatttttttaattcataaaggaaaatcatgcatgaacatatggcagtgctattgactagtgcattattttttcttgtacacttgggaagaaagactagaatatcctcagggaggaaattgattcatctttgggggtggcagcttctcctagaggttgagtcaattcattttccttggtattttccatggttcttgaaagctagccaccttatattggagtagtacatatttgaaagcaaataccaagcactgggtcacgtaatctatctcttaagaattttttaaaacataaagaatagtttgttcattattcaacctgagctgaaactaaaaatgacgcccaatttcatatttctttttactgctagacatgttgtttaaagtagtacttgtttgttgtagaaagttttaagtagaactaaagattttgtcttccttttccctttttctttttttgagacagagtcttgctctgtcaccaggctggagtgcagtggtgcaatcttggttcactgcaacctctgcctcccgggttcaagcgattctcctgcctcagcctcccaagtagctgggattacaggcatgtgccaccacacctggctaatttttgtatttttagtagagatggggtttcgccatgttggtcaggttgctctcgaactcctgacctcaaagtgattcgcctgccctagcctcccaaaatgctgggattacaggcatgagctgcagcatccagccctgactaattatttttaaaaattatttgtagagacaggatttcactatgttatccaggctaatctagaactcctggcctcaagggatcctcccgcctcagctttccgaagtgttaggattacaggcatgagcctttgtttttctcttttaaagaagactcataatctcatcaccaggtgatactgctgttaatatttgagaatattcattcagacgtttctctgcaggatcaataactattataatggttctgttttgttactgtgtgttctttatttttagtcttgtacaggacaagtgtattagtccgtttttatgctgttggtaaagacatacccgagactgggaagaaaaagaggtttaatggacttagagtttcacatggctaggaaggccttacaatcatggtagaaagcgaggaggagcgaggagcaagtcatattttacatggatggcggcaggcaaagagagcttgtgcagggaaactcccctttttaaaaccatcagatcttgtgagacttactaacaggagaatagcacaggaaagcccatcctccatgattcagttacctccagttgggtccctcctacagcacttgggaattgtgggagatacaaatcaaaatgagatttgggtggggacacagccaaaccatatcagcaggcctgaaatatacacgtatatcaattctagcagaccatagggtgtactctgtccctcagtttgtttaatggcatctcttcttgtttttcagtggatgaatacattgccattgccaaagaaaagcatgggtacaacatggaacaggtaatatcatggttttctttcttttgctgttaaaaaatgagtatttgtaactaaataattatatttttttcttctttgtattgagtagcagtgtttcttcattagcaactttttggtaattactagtagtgttacacaaactctggtcttctttttcttgttcaagatgaatattagaggaccctttgatttgaaaggcatatctgtcatctgcagatctacagcctttaggacactgattacttagtgattactaaggagctggatgcttgagcataatgctttctcatttgaatatgtgatttgtttgtcattcttctggttgtatcatgatgttttttgacgcatgttttcacattcttacctaaagtgttttaatattcaccattttgaatcattttcagtttgagatggagtctcgctctggtgaccaggctggagtgcagtggcgcatctcagctcattgcaacctctgcctccggggttcaagtagttctcgtaattctcgtgcctcggcctctcaagtagctgagattacaggtgcacaccaccacgcctggctaatttttgtatttttagtagagaaggggcctcccaaagtgttgggattacaggcgtgagccactgcgcctggccaagattttcttttaaatattgtttggaatgtactaataagaaatccacaagatttatttttctgcaaaagtgtggtgataccttatttcagctttaatgatttattttaaacacatcaagttggattaatgctttccatggcattaatctagatcttacaacctggaagttactgacatttcttatttttctgaatgatggaagttaccaagagtttagattatgtgaaattgtaccctttcttttggacttggccttacatttaattactctatcctggtcattgaagctacttttgattgcaaaatatacctgtatgaattcttaaggatggtagtcttgatcatttctcctttaaaaatgatcattagcatgaaaatttcctatattataattccagcataaaaattaccattagcaaagtattgctggatctcatcttacctcttttgttgcttattctatttctactttttttctttctaagctgagaagacctttatatatcatatatataacatataaatatatataatttttaaaataaaagaataacagcaattgttctttcataaattacttttttcatttatatattgaggcagtaaagtgtgatacttgaagagcacagatcctagaactatgctggttctgtgaccagaggcagggaaaggcagtgcctcagagaagaccttcagtttatactcaggctgatcctcacaatggaggcaagcctacaaccaaaagaaaacaaaactgtagtaaaaacatagcaaaccctgaggaagagtgtgattatgagtttactacattattagattcagatgtccaggttttaacagaaaaatcacagagcatacaaagaaatggtaaagtatgcccattcagtagaaaaaaattaatcaacagaaactgtccctgggaaaagaccttagtggcagatctactaggcaaagattttaaaacaactatcttaaagatgtttttaaagaactaatggaagatacagaaaaaatcaagaaaatgatgtatgaacaaatggaaataacagtaaggaaatggaaaacctgaaaggaaaccaaaatgaaattctagaccctaaacacttgaaatgaaaaattcactagacgtgctcaaaggcagattggaagagtctcaacaaagaacatgaagaaaggacagtggaaatgatttgagtctgagcagcaggatgagaaaagattgaagagtgaacagagcctaaggtaccctagggacacaatcgggtggactaacatatgcatgtggaagttgcataaggagtaagagagatagggacagagagattacttgaagaaataatggccaaaaatttcgcaaatttgttgaaagatgtgaatataaacaaacatccaagaaactcagtgaactccaagtagaataaactcaaagaggctcaccagagcacataatgaaactttgaaaagacagagaatcttgatagcagcaagagagaactaacctattacatataagggatcctgaataagcttattagggtatttcttgtcaaaacctttggaagccagaggcaatggtctgatatattcaaagcagcaagagaagaaaactgtcaactaagaattctatatctgagaaaattctttcaaaagtaaaggggagaaatgaagatattgtcagttaaaagctgccggagagtctctctgaagagaccacagtggagctgaacttgccaactggtaatcccatggtctataaattggacaagaacttgaagcccatcaagcccatgaataaaaaaagttcctggggatgaagagaccattcataaagccatggaagctgtggctgcccagggcaaggccaagaagtgaaggccagcaggctgactgctctctcaaggagcactctccctgcccaacccattcttcttcacctccctgctgcacatgccacaccgaccacatctgcaggcatcttacgttggagctgcagatgggaactcatggctcccattttcattgtaatcagttttgtctcctgcacccactcccttcatataatctagtcagatagcacctctggtgcagggagaaagctcctcttatccaagagagttgagaggtagtgactagggcttttgccagggcttgtttactaaggacctttgtgggaggaaccatgctgtcatgaccaaagaggagaagcaaagagggcctgcttgaccccaggacccaatcctgtactcttctctagtcatgccactgtcaggagagctctgctcattccagtggaagatgacagtaacctgcacggtgatgtgaaaaaacaacgatttcctccctgatcccagggtaggtggctctagaaggttgagagcaatcctgtattaagttcatgtgttggatttacttttacaaaaaattgtatgtataaataatacaaaacaaaaacccttctgagattttttattttatttttttgagatggagtctcactctgtcacccaggctggagggcaatggtgcgatctcagctcactacaacctccgcctctcgggttcaaacaattctcctgcctcagcctcctgagtagctgggattacaggtgcctgccaccatgcccggctaatttttgtatttttagtagagacagggtttcaccatgttggtcaggctggtctcgaactcctgacctcgtgatccactcacgtcggccttccgaagtgctgggattataggcgtgagccaccgcgcccagcccccttctaggatttttagtggcagttcaaatagtcccacatgtggtcatcagaaataagccattccatcctggacaacatggcaaaatcctgtctctacaaaaaattaaaatcagccaggcatggtggtgtgtgcctgtggtcccagctacttgggaggatgagatgggaagatttgttgagcccaggaggttgaaaccagcctgggcaatatggtgacacctcatctctaaaaaaaagtttaaaaattagccaaacatggtagtgtgtgcctgtagtctcaattactctggaggttgaggtgggaggatcgcgtgagcctagaaggcagaggttgcagtgagccaagatcatgtcattgcactctagatcacaactctatatcaacaacaacaacaacaacaaaaaaaaagaggggggaaagaagccattcctcacaccaatatgggataagctccttgacctctaagggataggattgcatcctgctgtgggttttcgaatctctcccctaccttgttttgtggctgtgaaatgcctcatgatcatgtccaagtatgtctttcactggctgatttccgaatcacgttctaattgcttggccctgccatgtggacccagtattcattttgagcataactgtactaaatctttctttctagatcagtgtaataaaggtgtaatgtgcaacttaaaataaataaaagcttgtgtctttttgtttgttttgttttgagacaaggtcttgctctgtcatccatgctggagtgcagtggtgtgatcatagctcactgcagcctcaaacccctgggctcagtcaagcagtcctcctgcctcagccccccaagtagctgcagttacaggcgcgcaccaccatgcctggctaacttgttgttgtttgtttgtttttcgtagattcatggtcttgctaagttccccaggctggtctccatgttctgagctcaagtgatcctctcacctcggcctcccagagtgctggggttacaggtgtgagccacaacacccagcctcagaaaatagctatagaatatatacacaaggaaatagaaaggaatttaaatctttcactataaataatcaacaaaacataaaaaggaggctggatgtggtggctcacacctataatcccagcacttcaggcagatcacttgagctcaggagttggagaccaacctgggcaacatggcaaaaccctgtctctacaaaaaaaaaactagctgcgcatggtggcacgcacctgtagtcccagctgctcaggaggctgaggcaggagaattgattgagcctggaagggagaaggttgcagtgagccaagatcatgacattgctcctccagcctgggcaaggagagtgaaaccctgtctcaaaaaaaaaaaaaaaaaaaaaaaaaaaacctaaaaaaacagtaattcaggaaatgaaggacataaaaaactttaaggaatgtacaaaacaaatagccaaatgacagaagtccctccttatcagtgattactttaaatataaatgggttaaactttccaaaggacagagattggcataatgggtaaaaattacaggatcccagtatatacaagagatttacattagttccaaaaacacaattttaaagtgaaagggtggaaaatggtatcccatgcaagtagtaaccaaaagaaagcaggagtgattataataatatcagtcaaaatagactttaaatttaaacaggttgtaagagacaaggacattcactgttggtgggaatgtaaaatggtacacctggtggggaaaacaggatggcagctccttaaaaaattaaaaatagaattaccgtattatccactaattctacttctggccaaagtgggtagatcacttgagcccaggagtttaagaccagcctgggcaacatggcaaaaccctgtctctacagaaagtacaagaaattagccgggtgtggtggcatgtgcctgtatcccagctacttgggagactgaggtgatcaaggaggattgcttgagcctgggaggtggaggttgcagtgagtgccactgcactccagcctgggtgacagatccagaccctgtctcaaataataataataataataataataaattttttaaaatttattttagaagaattatttatagtttctctgtgaccacttccctgatgatacatatgttgccatacttaacaaataccaccttcccttgttgctgtacctaacaagttatcaccatcctgaattgtatacttatcatttccaagaaaaatatttttattgtatgtgtaatttccaattaaaacatattgcatattgtttgaaaattaaataatttatttaaattgcttcactctttcttgatacttatacctatattaaaagacattatacctataataaaaattacatcacctgaaaaaaaagtatgtgtatattaccacagttacaaagaatagaaaaaggggcctctgacagtgtctgccacttagcgctgtagatgagttagtttgtctaaatatgaagtcgtttttacttttcttttgctggtctcatttccattttcattgttttttgtttgatctaaaattttactgatatcatttttgtaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatggtaagtagatgagaccactgagttctattttttttctcctatctaactctcttttgcagcatacttgagatagggatatcatactcaaacataaatattcccatttttgataaagttcccctttagattcagcttagtacatgctgctctgtggatgggagttttccagttacaggagtaaagcacttctagcacttcccatcctgtcgtctgtgactggaccctccccacccaccccagtccctcttgttgggactcccaaaagattagacccatacgaaggactttttttttttagacggagtctcgctctatcaccaggctggagtgcagtggcatgatcttggctcactgcaacctccgcctcccgggttcaagcgattctcctgcctcagcctcctgagtagcttgggactacaggtgcgtgccaccacggccggctaattttttgtatcttttttttttttttttgagatggagtctcactgtgtcgcccaggctggagtgcagtggcgcgatctcggctcactgaaagctccgcctcccgggttcacgccattctcctgtctcagcctcccgagtagctgggactataggcgcccgctaccacgcccggctaattttttgtatttttagtaaagacaggatttcaccatgttggccaggatggtctcgatctcttgacctcgtgatccacccgcctcggcctcccaaagtgctgggattacaggcgtgagtcaccacatccggcctaattttttgtatctttagtagagacggggtttcaccatattagccaggatggtctccatctcctgacctcgtgatccgcctgccttagccacccaaagtgctgggattacaggcgtgagccgctgcgcccggccttaaacatttgatttttaaagattacttttttatttaaataaaccaactcattttttatgtttagcttccagataaatctatagcaagtctggtgaaattttactattcttggaagaagacgaggactaaaactagtgtgatggatcgccatgcccggaaacaaaaacgggagcgggaggagaggtgagcacatggctggggtgttgtctaaccacttaggggactatctaagagccccagatacacaaaggcaaggcagaatgactggttttccctccgcgccttcctggtggaaccacatgttcatgagatgtattagagcgtgtcacattattcaggtattttttctcaccactctttccctgcagtcagtgaacttccattttgagtcagttaactttgacccattttttttccttcccatttagaaggggtggctccttttaataaaaaagaatcttttattttgtagtttgaggtttaacgtggtatatttttacaagattcatttggtgtgtttttatgtttgccatgtggaaacaaaaatacaacttagagttgctgcttctttttttgaccatctgttttttgtgtgtgaatgagaaagagaaacattttataatctcttagtaaggatattagttttaaggatagctcagtatggagaatacttcttaaccatcacttcctcagtcttatatgtagcatagagaagtagaaatggccaggtactcacactcagaaatgggctctggtctcagctctgaagattccacttacatgccacaggctacactgggatgtttaaggtctttaatttattttttaaaatgtgtaaaattgtacatactcacaggcaggtgacttcaacatgcgtcttccccaagcttctgttttccttaactctaaaatgaagatgtttgaagtccagaaggcagcatgcagacctagtggtttccttgttagggtggtgagatatataggtgggttttaaaaaatcctattttccacatttcctgtaatatttttatcaattaataataaaaaaataaaatgaaggaggatgaaatatatggtccccggtgtcccatctcaggatggaattttatcatttcaaatgaaagagtaacatgtgagaacacattgaaagttgagtatcacttttggagaattcaaacctcttggcccaagtataaattgagagtgatgttaagaacatctccaaagctcttttaattgtaagagcctataaaattatcgaccatgatacatctgcatatttttgcctctgacttatatactagtaggtttatttatggatgagtactcttattaacttttaatgaagctttttcatttccctagtttactgtctatatagtaagtctgttactataagcagatgcagtttactaagcagcaatcaaaattaaataatacagagtgggattggatatccttgagtgtgaaataagaatacctgccaacacttccattcttactccctggaggctttttttttgcattagtcccgatggggccaggaagtgctttgcctccacctcccatgtgcacctcaaccacttttgggatgcggggatggaggtgctgcagcagcacctgataaattgttggctttctaacaggacttgcctgtgaaagtcatggcagggactgggacaaaattcccttagccgaaggctctttcttgttgtggacactctttcctcagctagagcttcctgctaccttggtggaggatggggaggaggtggcgcgtagtgggcatggtcccgtgggatggattccagaggcagtgcgaggtgggcaaactggggcaggctacttgacttctgtagacttagttttctttttttacagttgcattcctacctacatcggggcttttcttgtttctttgttttaaattaaatgaaatactacattcaggatattacaaaaagcatttaaagtgctataccaatgtaagttttctttttaaaattaaacataattttaaaacatcagttgtccaggacaccagaaaagcctcagactttgtgtggccttgggtagaaagacggtacttggaaaaggatttttttactgttagcaggtttattcccaatgcagtggaaatttattctcccataatttctcagttttgtttagtaatcatatcctagtcctcaatagataattatgagaaaataacatgtaaatgcattttcattttgatattttcagtttacagatatagagcaatagtgttttagatctggattgggaagttaggaatctattttagtagtttctcatcacttagactgaaagaactatggagttggtattctgtttgaattacaaagatgtttttatctcagcagcctgaaaacatactaattttatattaaatcagtttattatttatatttggtaaaattagtacaaaattttcagttaaatcaatttatcgtttgtattcggaaaattagtacaaaataatcattcagtaacttgttcttgtcttccagcgaggatgaactggaagaggcaaatggaaacaatcccattgacattgaggttgatcaaaacaaggaaagcaaaaaggaggtattttttccccctagtattgtttaggcgaataaattttattactagtttcataaataaaacattcatgttgcttgttctacttaatatattaagtgctatgtggaaagcagcatgatatgactatttttcaacaatactgtctttgctttatagattgtataattttgtttgctaatagatatgaataaaggaaggcttaaaggatagaaaatagcactaatgagtaatgatgttccctagaacagcagtcctcactgactttcttcgtaagccattagctcagtaggttaacaagtggtctagtgaattccaggcagccttagggtctccattcacgctatagatgccccagcgtctgcccatcctaggcacccatgccgtgcctggggtgactgcagggagctggcagggactcggcacagccctcctgttactcagaagcagcaatttggtcacaccagggggagccaggaccatcctctctcacatggtgactgtttcatcttatcattttaaaaaatcattatacaagagattgtagtttctggattcagggggctcgtgaacctctacaattgcatgtaacttttacataggttcatagaggtatttttccaaagacacagtctatagtttcaaaaaaatttctcagagagttctctctctctgctccaaattataagaatagttattattttaagcctataaaaacagaagggtctaaatttatctaaactttaaaatgacatcagtaatatatgtttcttatagacaaggtaggaaatacagctaactgaaagaagaaaattaaagtgatttataatattatccataatcactgtcaaccttttggtgactttttcctgagaactctttctgtaaaatgtatatgcctgtatattcataattctgaatctagtcactttttaaaaataatataatggaagctttgtaatttttagaaccttttaaatttactctaccttgattttttttttctcttttttcttttttgagacagggtctcctgtgtcacccaggttggaatgcagtggcaccatgactcactgcagccgccaactcctgggctcaagcagtccttccactatggccttgcaaagtgctgggataacaggcatgagccacctccagcccttgattttatttttttttattttgtttttgagacagtctctcactctgttgcccaggctggagtgcagtagtatgaccttggctcactgcaacctctgcctcccagattcaagtgattctcctgcctcagcctaccgagtagctgggattataggcacatgccaccacgccctgctaggtttttttttttgtatttttagtagagatggggtttcatcatgttggccaggctggaccttgaatttttttttatgtcaaatatatttgtatacgtagctatatattattctgtcacatgaatgtttcataattgagttaccttatcctatgtggatttcccagttgtttattcctcctgttttttgcttttataaacaatgctggattgattctcacataactcactatctgtgctcatagatttttttcattagaaccgattcctggaagttgtattgttgagtcaacgtgttctagatacattgttaaggcttttttttttttttttggttgtatatcaccaaattggaaattggtcgtttttttctgcataatttatatgaatgcccaaataagatcctgagggttagctaaattagattgtttgggaaatcaaattgtagttgtagtttttattaagctttgtgttgatgtattgctatttactaggtttttcagtggcacattttaaatgagagaaaacacttgatttcatacatttttataattcttatttatataatttctgattcagaaagaaaatggctaaatcattgttttttttttttttttttttttttggagatggagtcttgctctgttgcccaggctggagtgcagtggtccgatctcagctcactgcagcctctgcctcccaggttcaagcagttctctgcttcagcctcccaagtagctgggattacaggggcccgcaaccatgcctggctaatttttgtatttttactagagacggagtttcaccatcttggccaggctggttttgaactcctgacctcaagtgatccacccacctcggcctcctaaagtgctgagattacagccgtgagccaccacacctggcccgtagtttcttttttttttttttgagacggagcctcactgtgtcgcccaggctggagtgcagtggtgcaatctcggctcactgcaagctgcgcctcccaggttcatgccattctcctgcctcagcctcccgccattctcctgcttcagcctcccaagtagctggggctacaggcgcccgccaccgcacctggctaattttttgtagttttagtagagatggggtttcactgtgttagccagggtggtctcaatctcctgacttcgtgatccgcccgcctcagcctcccaaagtgctgggattacaggcatgagccaccatgcccagccacctggcccgtagtttttttaagtattaaaatgatactagaacagacgtagtcagttggtgatctttattaaacatcgtagtcccatacacagcagtttattgcctactaatatttttgtattacccacttgttgaagaaattatcactaccattatagttttgcagtgtctttagctcagtcttttaaaatatgaagcagaaagtcatattttcagctttatcagtgaatgctaatgcactaacaagatggaattatgagcaattataaaaacttcttgttcttaaaatggttaccagtaagttatattctttaacttgacaagattttactgtgtttcatttctgaaagttttggttttacagaaattaatagccgtcatgcattttaaaatgataaggtatattattttagagtaagttatataagttgccgtaaaaattgtgttatccaaaaatgtgtataaaaagctgtaatttcatgtagctaaatacagatgtgtgtgtggccacaaaactcattagcagagaatacagatttttttctttctatattactagaggaagctgagaattcttattttcattggcttgaaacgatagagtaaggaagtatttgtacaagaaggagtggaacacagtttcattgtgtttagtcaaaactcagtagcccaaattctgtctgtgaactgcctgttagaatttatagatctcatttggttctgatagggcatggtatttgtcttagattgttttggtgccatgttaaggaaataaatatgtttattactgatcatttgactttttttaagtttcattcatcacctgtgtatatcatgcaggttccccctactgagacagttcctcaggtcaaaaaagaaaaacatagcacacaagctaaaaatagagcaaaaaggaaacctccaaaaggaatgtttctttctcaagaagatgtggaggctgtttctgccaatgccactgctgctaccacggtgctgagacaactagacatggaattggtttcagtcaaacgacaggtactcataagcctggtcttggatgtaaaagaattaattagcactttagaggtgtttctgttattcatatatgtgaatgttctctttccgcaaatctcaaaggagcattttgtttcgaaggaattggacagatcttaagtaccagcccattgtttttctttttaatgaacatataaattgaagtgtatggatatagtgtgatctgaaagtatttctgaagtatatagcaaagcatatgaatatcatatttatattatatatgtgtctgtgtctccatgatttctcacaatatgaacataccctagtaacctgcatctggatcaaaaaatggaatgttgcccccaggcccatgcattttccctcctggtcactattccatggaatgttgcattccctcagcaactccacccctcttttattacctgactcctccttgtaggtggccactattctgattttttttttttttgagacggtgtctcgctctgtcgcccaggctggagtgcagtggcgcgatcccggctcactgcaagctctgcctccccagttcatgccattttcctgcctcagcctcccgagtagctgggactacaggcacccaccaccacgcccagctaattgttttttgtatgtttagtagagacggggttttaccatgttagccaggatggtctcgatctcctgatctcatgatccacccgcctcggcctcccaaagtgctggaattacaggcgtgagccaccgcgcccggccctgattttttttaattttattttgtttttgagacagtgtcttgtcctgttgcccaggctggagtgcagcggtgcgatcttggctcactgtaacctttgcttccggggctcaaatgatcctcccatctcagcctcccaagtagttgggagtacaggcgcttgtcatcacacctggctaattttttgtgtttttggtagagacggggttttgccatattccccaggctggtcttgaactcctgagctcaagtgatctgcccgcctcagcctcccaaagtgtactgagattacaggtgtgagctaccacactcggccctgttctgatttttaaaaccataagttgtttttgtccatttttgaattttatataaatgaaagtcatgtggtactgtttattttatgtctggctttctttcaacctgagagctaaacagtttttcaaagtggtcctgtcattttatgtgcgttttgtttgcacatcagcgtttcccagctgtagcactatcctcatgatgggccgttctgtgcactgtaagatgttgagcagcatccctggtcttgacccagtagatgctagtagcaccctcccctaccagttgtgacaacagaaatatccctaggcatcaccagattacctcacaggggcaaaattgtccccatttgagaaccactgctctacatcattgccatattttggtagtcttaaattttagcccttctgatgggttataatgatgcctcattgtactttttatttggcagttccctgatgactaatgaggttgctcaccttttcatccatttgttggtcatttggatatcctcttttgtgacatgtctactcaagtctcatctgttttttttctgtcaggttgcgtattttcttattggtttataggtgttctttaggctctgagttgttttctacaacttgtattttaaatgctgtaaatatgttttgcattctgtgactctcaatggtatcttttgatgaacagtaattcttcattttaaggtagtttagtttcttagtcttctgaggttagtgtttttgagttctgttcacctttctcaaggtcatgacgatattctctcatgttagtcttagaagtgttgttttaccttttacattttgatctagaaatgtttttctgtatttgttgttacatgtcggattaatagtcactgttttgttttcatatgagtatcaatttggtcaagtatttattgaagaaactgtcctttatcctttgcaacgcagcaggacctttgttttacatccagtgtctgtatgcatatgggtctggtttgaggttctctgttcctttaatctctttgtccatccttcaccaatacatactgtcctaactttatgtactttattaatttagttatctggtgtaatataagttctccaagattgtcttggttatccctggccttttactttccatataaaatttagaattactttatcaattttcagaaaaataattctattagagttttgattgggattgtattgcatctatagataaaaatggagaattaacatctttattgagttttctgatcagtgaacctgatatacccctctacttctataggtttgtaatttctctcaatgttgtattgttttctgtgtaagaacttaacgcatcttttgttagtcattccatgatatttggtacttttttggtgctcttgtaaaggatattgttttttaaattactttttataattatttttgcctgctatgtagcttattattttaatctgattgcatagtacatttaaactgaaaattcaacctagtagttgggtcctgtcctttcattctctctctggaattcagtttccagaaatccatcagcaagttgttgactgactatttttggtttttgctgcttttgatttatcttgatggttcccttggaaggtcaaacagtagaccaactgtcatctcatagacgcgaagagcagggcgtgctgctgtctttcttgtggtttagggaggcagcccagaccaggacccaagcacactctgtgtgctcagaggagcggcttcttcttgtggctgctggcacagctgcactctaatcttaggagaatcacttaatctttctaggcctcttttcaaatgagattaatcctggcctgcctgatctcacagaatatgtctgggctactgtgtgagagagcatttgaagttctgtttgcactggaagaactgtctcgggctgtgagctcttgttgacattgtcatcttcctttacaaggatgctcctttctccctctgctgagtgagctcctggtggttgctgtttaatatattgagaaaagaaaaagaggccttcctcttgcaccgaggtgttattgactccatagggtgagagagaaaagattctttagttttcagagcagggtcaagagcaagaatttttaaaatttgaaggtcgctcacaattatgaagagggaggactcagcctcactcagagaggaggtgggtgatttcctttccacagccttttagcgccacagtgcagcagtgtgttcattgccaaatgtgcttctagactcaaaatgggcagtcagtccacttgggccacttgttctggaggccgccatgtttggtatatcaaggatatattctgaaaataacagcaaactcgactaacaacagcttaaacaatttagggtttatttttctcaaatggcaagaagtgccaacatcagtggctactggtgttagttcatgtgttcagtcatgctctcagggacccaggtacttttcaggtcttctactgtgccattctcagctgttggcttttcatcttgcttgttgcctcatgttggaagctactggagccattttgcaaccctcacatctgcattcagggcagtatgaagaggaggtgggggtggaggtaacctgtctgtcccttttagcaggacaagcaaaagccttaccggaagctccttagctgaattctgtgtgcccgtgcgttgcgtactgctcttcctccttcccaagacatcatcaacctctaccagcgagaagggggctgggcatgtctcttaaattagccagtgaacagtgctggttgcatcaggtctttctctgagtggagaataaagtgatctgatgttaaaagaggaatcactgtgcccacagtaaagtagaaaacagaaagttctgtatgactgagggttgggtgggagggtggtgtctaggtagggcgtcaggacaagtggatggcttttctttttcatcttgttttttctttaagtgtgattacctttgcatcctatttcttacctatttcattgccactcactttccagttagcatgatggtggcagtaatctctgtttttttcctgcttaataaacactagatgtttggcggggggaagggggcgtattttgttttttggagacaggatcttgctctgttgtccatcctgggactgtagtgatacagtcatggatcacagtagcctcaaaggcctgggctcaagcagttgcccacctcagccccctaagtaggtaggactgcaggtgagcaccaccacacctggctaattttaaaatttttttggtagagacagggtcttgctgtgtcacccaggctgttcttgaactcctgggctcaaatgatccttcctgccttggcctcccaaagggctgtgattacaggtgtgagccactgcactagcataatttttttttggcagggtctggcactgtcacccaggctgaagtgcagtggtgcgatctcggctcactgcaacccctgcctcccagactcaagctatcctcccacctcagcctcgcaagtagttgggactacacagcctagatatttcttcttcttcttcttctttttttaaaattatactttaagttctagggtacatgtgcacaacgtgcaggtttattacatatgtatgcatgtgccatgttggtgtgctgcacccacttcgtcatttacattaggtatatctcctaatgctatccctccccactcccccaaccccacgacaggccccggtgtgtgatgtttccccatcctgtgtccaagtgttctcattgttcaattcccacctatgagtgagaacatgcggtgtttggttttctgtccttgcgatagtttgctcagaatgatggtttccagcttcatccatgtccttacaaaggacataaactcatccttttttatggctgcatagtattccatggtatatatgcagcctagatatttctgatacggaaaatgcatcaggaagaggggtataggctactgagcatttagagctagcttttagttcagaattttagatgttttgcatttactctctctgcttcttttataacgttacttaatcacagtgcaatatatacccagttttgtactatctatgaacaaccagctagagtgacaagagtggtctgtttcactggaatgcgaagaggacatgtaatattctaaaccttgactttttcctgccaaaagttgctatgttgcatttttagccaaaaaggaatccagtgaacataatctgagtactttgcaattttcctgggttttcggtaactgaaagaccactgagcaagatcctaagagattgtaatgtctagcatggcagccagcagccccatgtgtggttgtttaaatttagattaattacaagtgaaaaaaatttaaaaattttcgggtagcatcttctactcatgaatgtcttttacattttacttgagaaaatcaagctcctcttccgttggctttcttagttgcttgtgtgattattcaaagatgaaaaatgctggagttcagagttccctggtgcttgacacggatatgccctctacttggagtagagagaaaatagcatacttccgtgacctgtctcattcaagggtccatgggaaaattaaggagcagccatagcctgggaggttggtattgtttgtggtctttctttcgactgggtaaggacagtgaaagattaccttgagccaaggcagtaatgtggaaaaagataatttgtaggaaagtgaagacgtgacagttaatcaaagttagacttctggaaatctcactgacattgtgttttcctcgcccccccatcattaaagaaatctatgcttgtgcacttctgccctgtgtagaagcggtggacagcacagtgatcttggggcgctgtgaggctgcacccgcagttctgttgtaaagactgggcctttttggtccttactgtggctgctctgttacttcagttcaatcctatgtggtagtaagcccagggatttcttctgtcttttatgtaagactccaggtaggtgttttgctgctcaggtatcacctgttaggaagctgtggatccaggactgtgtacgtgagagccctccgtcccctcctccttgggttgtaccttatctgttgctctgaacaagcaaataataaacctagttagatgcttcaaaggataccatagggatctcagaattcagctacaacagatgttagtaacgtctttactcttgggtttttgtttctttaggtttttaagttctgttttcatacctttatatagtttttatttttaaaatgaaaattattttttccttcctagatccagaatattaaacagacaaacagtgctctcaaagaaaaacttgatggtggaatagaaccatatcgacttccagaggtaggattatgttaacatcatcttagaagtcatattcaagttttacatgtttaagaatttaatatcggtgtgatacatccccagtatacatctcttggaagagtatatggacataattttatgaacccagttgatgttaaaattccgataagagaaaatgaaaggttcgttaagctcataaggacatactcatctctaaatgtaatgtgctaaaatgactcatttggatatccaggtcattcagaaatgtaatgcacgttggactacagaagagcagcttctcgccgtacaaggtagggggaagttcttctaaagagtttaggaggccggctgtggtggctcacacctgtaatcccaacattttggaaggttgacgcatttgcttgagcccaggagctcaaggctgcattgatccatgatcacaccactgcattccagcctggacaacagagggagaccctgactttaaaaaaaaaaaattttttttttaatggaaaaaaaagagcttaggagcattggtagattttagggaaaagttacgtcctgccctactcccagcacctagattcttggacaattatgtcctagtggatatcattttagccaaattactgtattcctttgggcttttttcttttcctttcccacttctcacaagttgtaaaaacttaaccgggaaccctgagtcttctaaaggtgtatttcattttactagttactcatcgagctctgactagccaggaagtacaaaaccccaaaagaagcagacagagtgttcagctttaaaggttgggggtgctctggacctgcgataccaaaagatgaatgcagaatgtccccaaccctagggcaattgctgggtgacttcagctgttatgtgacatgtaatgggaagacagatatcaaaatgacagggtcggtcatctccagaatgtgtctagaattggctggtactttttcctactctaataatacacgaaattattgcctgctgttaaaagcctgtatgttttcttatctggataaagaggtaagtgtcacttgtggttttaaaaaaatgtttttctcttgtattttaaaaaatgctttcttacatccttagccatcaggaaatatggccgagattttcaggcaatctcagacgtgattgggaacaaatcagtggtacaagtgaaaaacttttttgtaaattatcgacgccgcttcaacatagatgaagttttacaagaatgggaggcagaacatggtaaagaagagaccaatgggcccagtaaccagaagcctgtgaagtccccagataattccattaagatgcccgaagaggaagacgaggtaaatctgaaacaaaacagtcacttctcttgtcaggttcacgcttgatactccagtttctaaagtgatgaattttttcagctatagagatttttaggtatcagctgtattagtaacttcactcttacctgtaaatagccggaatgtgtatgcattgactccagttcttggtgcctgtatattattcacatgttaatttctgggcaaatcctgaattacatcctgatttcctccagctacaaaatactctgcattatcagtttttccttaaatacagtaaaatcttgagtgacaaagacaggggagtgggggcataaacaaaaagtaaaaatgcagtgaaagctgtcctgtctgtgagggatgtcgatgaagctccgtcatctgcaatgtgcagtcacatcatcatgacgcagcacagcgagccagccaggagctcctgaggcctctccctgctgtccagatctttcagcctttgatgctctttggggctgattggcttaagtattgatggggacagttctgtggctggctggaacttctgtgatggtggctaatttctggaatgataaccctggtctcatctgtcacctccctgcttcctgtgtcaggggcacctgccatttccccatctagcctggcctgccttgctgttacatttgtccctctattcccagagcagatgagcctggggctgggcataagaaagagttacttgccaatcactttgcatctgaatttgttcacaggcatggtaatttaagaattaatttagctttgtaaggaaagtcactttcacatcaaagccttttcaaaccatactggaatgttttgagattacctattttgtattgcgtgtgctaccattttgctccaagggcctggctctggaaacagcccagaaggcccctcctgacctgagcatggaagtacctcgtgaggtattggcatcccctgggagcgtggtgccgccactccatgcagggcctctttgctgactggagaaaggacctcaaggcacagccatctgtaagaacaccattgaaacatattaaatttgttagaattagattctttagagccttttgccagaaaatctttataataagtgtaccacgtctataatattgccaaggtcagtacccctgaatcacccccatgcatagctctgcctgaaaagagcatgtgaattaaatgatggtgtttttatctttcagcagtgatttttttctttattattatttctttttattttcagtgatttttgtaccagcactaattgcccctgttagcactcagtttcggaagcattgaaaagctggagactgctggggaagaaccattagaatttgcaggaatgaaagcttgcttcttgtgtgtgtgttttccggcttcggtcccaggatgactggaagcagaaacagttgggaacgctggctctattccctcttcgcatttgatcaaagccagtgttggctgggctggcataacaaatctcatagtaaatttaggaccaagagtccctaccaacaggatgtcagttgttgtgcatatgtttttttcttcattctcttattcttggatcattggttgactgacttaagtgagtcaagtattttttttttaaccttgttattagcccagaaggttcttccgtaatgatccacttaccgtgtggattgcattatcaaagtaccgtctttcttttcacagtctagttatggctcctccaagcagcagatcatagtttttccttggtgattgatcttccatgtctctatttacccagccttctctgcaaaacaaaatgaagaatggtattatctaactcgtgtttagtttcatagtccttatatccctttacaaactttttcactccgctagtcatttaaaatgtaccccctcatacctttcttttcttttttttttgagacagagtctccctctgtcacccaggctggagtgcagtggctcaatctcggctcactgcaacctccatctcccaggttcaagtgcttctcctgcctcagccctcagcctccctagtagctgggattatgggtgtgcaccaccatgcttggctaatttttgtatttttagtagagatggggtttcggcatgttgaccaggctggtttcaaaactgctgatctcaagtgatccgctcgcctctgcctcccaaagtgctgggattacaggcatgagccaccgtgcccggcctatttcttgagtttctttctttttctgcttcttgtagtgccacccctgccctgccacctagttttatgttctccatatgttagtttgcagaaggaaattaatctagtgaccagctgcttctctgtgtccaagggcctaagggaacttgttagaatgctggcttacttgtctgtctggtgagtccacagaacttggggtgtgtgtaatttcacctttttatttgtcctgtagagtccaacagctgagaaagatgtctgctggtgtcttgcctgtcccttctgccctcaggttttatgtattatgcagaagccacagggagaacatgagaattcctagaagttctagtaacagaatggtctgtcagttatagattatttccttcagggcttagaggcaggtaggtagcccaaggcattttgagcttttgaaattcatagttatttgacgtggacaagggtgggttgggaacagtgtcatatccaaccttacactgaagaaaggatgccatggattggacagaaagatgtcacttaaaattatgaaatgattaagtctgttaccagtgaggagaaatctcctcctgtatctaagaacagttcttgtacatggtatggtttttagctgaaggaacaatcactttgcgattttggatgcatggcccagttgtttctccagcaatgagatgccatgagcatggcagagagcagtaagacgctatgcagcctttaggtttgggtctgggagtcctttttaaaaaatgggagaggggagttaggaaatgcctcatagcttttaaagaagatcctgggatcgtatgggctcctgtatcccagctagaaccagtgactgggtgctgaacgggctgggtgccacagcatgccctcaagccagtgagaggagttagggctgccactgtgcttatatgcccttttcaggtttttttgttcatttgtgtttttgagacggagtcttgttctgttgcccagagcaagtggagtgcagtggtacgatcttagctcactgcagcctccatctcccgagctcttgattctcgtgcctcagcctcccaagtagctgggactacaggtgtgcgccaccacgcacggccaatatttcttttcagtagataggttttgcctttttggccaggctggtctcgaattcctgacatcaagtgatccacctgcctcagcctcccaaagtgctgggattacaggcgtgagccactgtgccgggccgttttcaggcacttaaatttaatcctggtgaagtaggtattatcactatgtgtcttctgcacatgaagaaactgaaactcaaaaacactgataacttctttgcacatattggggtttgaggccaagacgtctggctggagaggccacacgcttgccctgcccttaagaacatggtgggctgggcgtgggggcccacacatgtaatcccagcactttgggaggccgaggcaggcagatcacgaggtcaggagttcgagaccagcccggccaacatggtgaaaccccgtctctactgaaggtacaaaaattagctgggcgtggaggcaggtgcctgtagttgcggctacttgagaggctgaggcagaggaatcgcttgacccaggaggcggaggttgcagcgagccgagatagcgccactgcactccagcctgggagacagagtgagacctgtctcccctccaaaaaaaaaaaaaagaactcggtgtttgctctgcaggtttgctggctaccttctcttttcagtacactggaaatagcagcttgtgttgtttacctactctttgatccttttttttttttttttcctcttggcctcaggctcctgttctggatgtcagatatgcatctgcctcctgagaaactggtggctttgaacacttggtgtggactactgtgttatccgggatatcaggtattatgagacatcacctagccatctgcatcacatctctctggacaagcagctattaccaaaaaaggcatatacttccagtcctgtgctccatctgccttaattctttgctcgttcctccatgttggcgccacttcccagagagctccactgcatctcacactctgcccacgtgctggggaagtctcacggcctgcacatctcttgtgactctgggaaccgcctctcccgccggagcccccgagccccaccaatggcagctcttcccagtcagcagcttcagagcaggcagtctccttggaaggcccgactctgttcctgcatggcctgcagtttctactttgtgcatagagtcattttcagagtcaccgcgaccctgttggccttctagaaagtttcttttgttcttttctgagacaaccacctaagtgataatacgcttttttggaaactaatatatattgccagactgcatcataacctttatcatgccaagcatcctgatgcaactcacatttccctaaacatggggtacagttatgatttataaattgagttggcttaaatctccctcttctcccttcccaagtgttacaaagatcatttactgcaactgtcgttggacactgtagcttaaagggaacgtggacctcaatgctttctgccttcaacttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgagatgaaaagaaataacctacagagtggtctgtaatgccttttggttggactgggaacaagtaaaaatttctaataaacattttgagacttccagaatcacttttgttatcttatcagaccatgggcctgctgagggttgagcagacagcctgcattctaacataccctgttcccaccccacggccattcagactgcactcaatacgctgaagtcgcttttgttgttgttgttgttgtttgcatcatttggatttttttcctgctttcaataccaaaaaaatgcagatgctttaaggcctaaacagaattctgaagaatttaaaatatgcaattaaagtttgatatgttttgtctcccaagcaccttgttttttgttgttgttgttgttgttgaagtcagctgattttctctttagaaagagggtcagctagaaacctaggttttttggaattgtaaatttttttttagtatagtctggagagaaaggtcattcaaaaggaaagtacaatgggacttgctgcccttcatcatctcgttcccgtgccaggtgtgtgttggtcacgtaaaagcctgggaagcatcagaggagtcccggattgctgctgctacctggagacagggttagcaaaataacactagtgatgagggagaggcttcttttcaccataagcctgctgtgtacaccgagggcggcaggagaagcatgggaaggagtcagcctaagtttgcacattgcataaagggtacactaaggtatgagctgaagctttaggttctccgtgcttccctcaagacctccttcttgctaacagaagcagtaggcaattgctgcagtgcgtttctcaccctgccaataggtctgtctgtatctctgttaaggaaaatagcctggtccctcctggcagtgcttggaagcttgatgctaatttttatatagcgtggcaaactgaccagcagtgccaggccttgatctgtattctgcactatccctttacttggttcctggcactgaatggtctccagccctgaagaatcacgtgtgatcacagcagctgacctgggctttctccccgagaggaaggggcatgtcatttttatttgacagagggaaaatgggagctgtccttgactgcctttgttgtgctttcccgcgtaagatagcactgtgttttaaactgttgcattacactgtctttgcaatgatgtaaatgtaagaaatcacttagctttaaaagcgcagtggtttgatcttatttatatgaagactttttaacatatcaagaattaggtgcattggcaggtagggtttggggtgtgataactgcttcagatggaatgttcacttaagctttgtcttcttaaaaattatcaatgtgaatgtcataattatatatatttttgtggaaaattttctcctaagtataagttattgtgcaaaatatagtgtcattgatgcaaataatagtttaacttttagtttagaactcctaaaagatataaattgtattgcatatgcattaaaagtttgttttatttaattttatgtagatgtgtgaagtgttaggtaaaatttttttcacttatccatttaaacaccttgttacttgaatattgtgttgactggtctgcaacagtgatccattctgtaatatagctcttttaactgggaaggaaccacaccccagttgtgccgattacattagtgttggcacacagtcgggtgctagtgtaacacaaatgccgcgttgtctgggtgtacagtgtttgtggagacgccacttcctcaaaatggtttttgattgtttttaacctataagacgttctgatgctcacaaacctctattcaacacacaaaacaaacatgaaaaggtagttagttgggttgtaacagcttactggggtggactcataaaacagtggctttctgttcatctaaagtttcctcagataccacagaccactgttaagtgtgctcattgtcactttaaatttcaacgataccctatttttgtcattctaaatatcagatgtactattggtataattgcacaccaaaaataagccaaacagtgcattacgctaactggatccctgcttttatgtgagctaaggaaagatggagccaactccaacgagggcctctttttctctcttgtctagcctgtttctaaaccgaatgatccaggattcaagcttctattgtcaagtgaaactttcctcagatggactccaggtagccaggtcacctaaacctagtggtcctgtgcgatgctctttctgccagtccctgaatctctgcagcttctcttacctgtcttacctgtagtaaagcacaattgcagtggcgtcgcattcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattttaaaagatgtataaggttaagtttgcaaatataatggaaatgctgtatatcttttgaagtgatgaaatccacgttggaattttaaagaaaatatgttgtaataatgctgttgtaagtaatattttaatgtctctttgcctgttttctatttcagcacattcattgtggtgaatgttcatagcattataactgcttagccattgaatgataacatttgttagtggaaattggaaaatttatttgtgaaattctgcagaattcatttttctatttccaatatttgctgaggttaaataaaaattttcaagccattgatgtaataaaatatgaaatgaaagca

SEQ ID NO: 654 - DNA, 25798 bp, Homo sapiens
agaatgccattggttaggccttttacttttgtcgttttaaaggacactctggacatccaaccgatgcacatcccacgcccccaccccccacgtttcctgaggctgcgtctggcctggaggaaccgcccagtgaagacaggtgctcgcagatatcaccgcctagtgttccctgggcccacttgcggggaagtcttggaggtgaaaatccaggtctggaatgaatgcattccacagatgcatatggagagctactgcatgcccagcaccattcctaggctgggagcaaaacggtgagacacaaaccccaacccgctggagacagtgaccagccactagatgactgccatgtttttagtgaggcattcaggttgtggaagcctctggaaaccttctcttgctttttgtcccccctcttttcttttcggagacatcttaggcttcacatttcttcctcttggttctacattttgaagccagagcaagtggatgaatttctcactcggttcgtttctagggtggtcaggtgtgctcagctgaacaaaagccggttgtataaggttgatgccattttatgtcaggatccggcaagggctccacctgtttttgaaaattctacagtggaaacagctactagttctgacctaaataagaagcagctcaacatctacagaccttggtatgtgcccagggtgtagtaaaagttctcaataaatgccagccgatggcgctgctgctattataagcaaagttaggagagcctggggcagctgacacttaaaatagacatctgtacacaggatggatgtcacatcttttaatagtcgtgccaggcacgttgttagatgcagggacacagcatggaggaatcggtggaggttgctgccctcaagtttcctgagcttgaaggggtttagaatatgccacggtggcatgaaaattattttgagcagaaggcatgtgaattcctgaaatctggtcgggtgtggtggctcacacctgtaatctcagcacttgggaaggccgaggcgggcggatcacctaaggtcagggtttcaagaccagccttaccaacatgatgaaaccccgtctctactaaaaatacaaaaattagccaggcatggtggcggacgcctgtaatcccagctactcaagaggctgaggcaggagaaccgcatgaacccaggcgatggaggttgcggtgagctgagattgtgccactgcactccagcctgggtgacagagtgagatcttgtctcaaaaaaaaaaaaaaattgtggtaagatacccataatataaaattcaccattaaaaaataacacggaagggatcatcgtgaatgcaatgtgagtattgatgaggatggtggtgatcttccagaaccttctctgacgccacccaggccgccagccttactttaccggcttcggcgctcatcatactgtgctgcaaatgccagtttcctccttcccccttgggaagtttcctccttgggggtcggcacctagactgtataccccccagggcggaaacagcggttcacccaccaggtgcttaagaagggtttgtggaccagtggacctcctgctctccctggggaaaggagctgggacatgtgtacacacctgcagctacaagattcggagggcgcacagagcctcaaccgtaagaaggagaggcgatcaggctgaggaagatggggcagtggagctggatggatagagagagggtgggttcattcattcgttcactcattcgtttattcatattcatccatccatcattcatgccctgagcgtgcgttgtgttctgggcagggcctgtgctgggcaccgattgtgtaatatatcatctctcccttcaaggtgcacccaatctgggtgggtgggtagagagaagctacggtgacaaggcaaaaatttgggaaacactctcgttaacaattcaaactgtggtcccctcccagatgtataaatccaaatgtttaggggtgggcacagtactctgcatctccagacagcatcctccgctgattcggatgcatgatgacgtcagaacacttggatattgtggtaacttttgggccaggggctctgaaaccccgaagacctccccctgggagatccgggacagctcccagagaaggtgagtcttaaacacatccgtgacaggcaataaggaaaataaggggggtccgctctgctgatcagccctaagagccgcggcggttgtcggctggggcggggcactccacgactttcccggccagacacggtcgccttcctaggtgtcttggcctgcgaggcactcgtagcccgcccctctcctaggtgacgtacattggagacgccgtcgctcagcgacccgggttcgagtccccgcctcggccgccatggcggatgcggagccggaggctgggggcggcagcgaggatggcggcggcggcggcggcccggctcctccgggccagagcggcagcgtcgcacgtgtggccccgctgggccccgagcagctgcggcaggtcctggagcaggtgacgaaggcgcagccgccgccgccgccgccccccttcgtgctgcgggacgcggcgcggcggctgcgggacgcggcccaacaggccgccctgcagcggggccggggcaccgagcccccgcgcctgccgcgcctgctcccgccccaggtgaggcgtcgggagggacgtggggaaactgaggcccgaagggggccgacgccccgcggcggggtagctgcttgtccggggaggccagtatccgcccgggttaagactcagggcgtccccaggctgagcttcttagggacggcgttcggcccccacctgtcaccaccctggcattttcaccccaggagcctcactctaggagcggttgctcacgctgggccctgtgcctggaacgccctcgtgccttctctgccttcacagccctgctgggggcttttgcgtgctccctagctcttcttacaggcctttcaccgctggttcagcctttgtggagcacttagagaccgtgttcccagcactccccactatgtgcaggaggtgaagccttgaacacacttgctgaagaacgaacataaggcaggttctgggattgacgggggctgctttagagtgggtggtcccgtaggccagacactggagctgaaacataaatgaattaaaaggaaccaacttagcttttcagttgtaaggtgccaaggcccaggcttggaacaaagtcaagcacaatacactagttcgctgcaggacttaacatcctgggtgatagtgactgatttgtaaccgcagtacccagcacagtgcctgatacacaatgtttggaatatgtgaaagcactctgtatactacaaaacatcctttcccagtgggtttatttcctgggccacacaccttttggttgctaggggggtgataactagaagacggtcgcccaactccggagggtgaagcatagcgcctgaagccagagggcctacacggcatctgtaaaattccaccccatttcagcgctggggttgtaaacaaaattagtctcaccccaaaattgccaaaagaagacagctttttccactagaagaaacgggttagggaatagaatcaggaaccttcactcgttgagtttttttgactgatgttagctgcttagggttgtatccagttaatcatcaagactggagagttgtcttgctaaggtttaggaagaccagtgtgattctgtccagatgccacactatcactatctagaggtgtgaccttgggtaagtcaacctttttggactttggtctgggtcagaaggctgcaaggtgccatctgggggcagctatctgcaaagcctctgctctgcgcccggcgctgtgcggggccgctcagttttcagcagtgtttttgtaccggcattttgcaggtgggaaacaagctcagggaggttgcgtggctttgcccaaggtccctcaggtgtggctgctctccctagcccctgtactcctcaccataccctgctgaatatggccacagctttttgggtttggaatccaaaaatgacatatttttcgtaaagcaaaagcaaacttattcgagcttaggcagcatgatgggattgtattttgtagctaatctaatggagacgatataaattctacctgcaataatatacctttgcagcacattcttttaatactctttcagccccagctgtgtcatggaggccacaaaggcaaaccggatgcgtactttgcccctcagtagtttatgaactaacaggagatgaaacaagacccagataacttctagtcaaggccagaaagctaaagatagtgaaaaagaactgaatgtatttagagaaagggagattgttcctggctgaggacatcagaagcagctttgttgaagaagtggtatctgaactagatttgaaagggtgcgtctgagttgaaaatgcagaaggggagaggcaggttctggggcggttgggggtgcatttcaacaaccacagcagaaggcccagtgttcgctgtgggggtggtgtggatcagcagcacagaccaatggacacacttgggtcagatcgaggcccctgtctctccccatcctccctcttccccaccccacagaaatttccagttccatccaacatgctgtgccccttttcatgcatccgtgcatttacacatggatgtgtgccctttttcacctggcaaaaattcccagccttcaaaatgcccctcagagatcacagcttctgggcagcccaccacctctgggctgttcctgcctcttgattgcacctgttgtaccatgatgacatttttcctgtctgcctcacctgtctgcattccttagggaagcttgtctgccttcagaatcatcagtggagcttttgaaagggcagatcttggggcctcaccccaggagatccgattcagcaggtctgcggggactgaggtatggcaggggaaaccgcccccatctcaagggtgaggttaggacttggctcctgtgtatgtattccacccagaaatactgagttaacattagctgaattaactaaacaaagtatcaagcataatacccacagggtaagccagtgaggatagaggataaatacattattagtctggctttgccgctgtggttatcctcaaacagtagggtttagtgtatgtatgtatatgtattatgtttttgttttggggttttgttgagacagggtctttctttctcacccaggctggactgatctcggctcactacagcctcgaactcccaggctcaaatgatcctcacacctcagcctcccgagtagctggggctacatgtatgcaccatcatgcctggctaatttaaaaatgttttgtagagacagggtcccgctatgttacccaggctggccctgaactcctggcctcaagcagtcctcccgcctcagcatcccaaagcactgcgattacaggtgtgactggcagtaaaatgaaagagatggggttcttgaaggatatgcgcagtcaatctcgttgtcatttgtttcacaagtagcccaggagtcggggactcccagggctatggtgccacctctctacaattcttcatacaaagtgttggctgacctctgctatttgtactagtataacagacagacgagagacacactccagcttgatctcagtgaggatctttattctgtcctgtgtgacatttttgttgatgctccactgtttgagggtcacaccagaaggttgagtccaaagagggccagttggtcgtcccaaataagtgattctcaaccgagggcagttttgccccacagggggcacttggcaatgtcttcattgtcaggactcgggatcactactggcatctagtgggtagaggcagagatgctgctggccatcctccagccacccatgtcaaaggattatgttctgaaatgttggttgggaaatcgtgctctggatgatgaggtttgcctctttttctccctggaggaaagtgctcattatttctgctctgtgagggcgggagccttgtttcttttgcttccccgtccttctcccctaagctgtaagacagctgtttccctgacacctgtaacagtgtttctggcacgcggtcagtgctcaataaatatttgtggggtgttattgaaggtagttctcccctttggtaggtgttttgctattatagacagtgctgccctgaacttcgtagaacagaacatctttgtggccacctgcgtgttttttttatagaatccaggaaatggaattactgggtcaaaaagcacatgtatttgaaattttgttagatatatttgtaaaaagttattgaagatactcagccctacgcctaggtacatgcccctggagaaagtcacacatgtatacacatacatcgtgaagattcagagcagaacttaggaacagaaggttggaaaccacctgtccatcaataggagactggtgtactcatactgcagagaaaatgaacccgtgacacctacccatgttaatgtggataaaattcacgaagcaaaatgaagtaaagaaacccagaaaagccctttcaagttgcaggagatgatatcatttatataaagtttaaaaacatttcagaactgaactatatatttttagaaatatctgcatatgccacataaatttttaaaatcataagaatgctaaacagcacattcaggacagggtgaagaaacaggcatgcaggttgtgcagtaggaagctgggtaacattgttccttatggctttgttgtcgcttccagaatttcattaaaaactttttaaaaaacatgggcccacattatgaattacgtctgcttttagagtactaaaaactccaagcaaaaacacatgggtaacgccgggcacggtggttcatgcctgtaatctcagcactttgggaggctgaggcggacagatcatgaggtcaggagtttgagaccaccctgaccaacatggtgaaaccccgtctctactaaaaatacaaaaattagccaggtgtggtggcaagcgcctgtaatcagggctactcaggaggctgaggcaggagaattgcttgaacctgagaggcagaggttgcactgagctgagatagcgccactgcattccagcctggaccacagagcgagacttcatcttaaaaaaaaattagctggtcatggtggcacacacctgtgatcccagctattcagtaggctgaggcaggagaatcatttgaacctgggaagtggaggttgtggtggcactccagcctgggcgacagaacgagactccatctcaaaaaaacaaacaaacaaaaagccagccgggtgtggtgaggcaggtggatcgccagaggtcaggatttcgagaccagcctgaatggtgaaaccctgtctctactaaaaatacaaaaattagccggggcgtggtggtacgtgcctgtaatcccagatacttgggagactgaggcaggaaaattgcttgaactcgggaggcggaggtcgcagtgagccaagatagtgtcgctccactccagcctgggcgacagagcaagggtccgtctcaaaagaaaaagaaaaacctcacatgggtaaaactgttaggaaggctcttatctcttcactggtcatgaaatcaacttagtggattatgactagtattttttaaaaagtgatgtagaatagggctgggcgtggtgtctcacgctggaaatcccagcacttcgggaggccaaggcaggtggatcaatcacttgacgtcaggaatttgagaccagcctggccaacatggtgaaacccgtctctaccaaaaaatacaaaaattagctgggtgtggtggcagctactccggaggctgagatgagagaatcgctgaaactgggaggcagaggttacagtgaactgagatcgcaccactgcactctagcctgggtgacagagtgagaccctaatctcagaaaaaaaaaaaaaaaatgatgtagaatagatacaatcagcgggcatttatatagggatggtaagtagttccatcaactttattttatttatgtatgcagatatttatatacacgtgtactaggtcataatgtaaaatgtatcattgtggtctctgtttttgtttttgtttttttcagatggagtctcactctgttgcccaggctggagtgcagtggtgcgatctcagcttactgcaacctcctcccgggttcaagcgattctcatgcctcagcctcctgagtagctgggactacaggagtgcatcaccacgcccagctcatttttgtatttttagtagagatggggtttcaccatgttggccaggttggtctcgaactcctgacctcaagtaatcggcctgccttggcctcccaaagtgctgggattacaagtgtgagccaccaagcccagcttatatcactgtggtctctggtcagaaaggtctggaaaataccaccttagtacaaacacattacatcaacttttatatgtaagatgtaatttagaaaaaatgtcaataatggttttatgacgagactgaaattgcagacatgttcataagcacaatgcttcttttctctttcttgtctttctgtacgtaagcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcaggtaatgtttctgtctgggtatgtgtctttttatttggccgttctcggattgctataaagaaatacctgagaccaggtattttataaagaaaagagggttggctcacggttccatagactgtacaggaagcatggtgctggcatctgtttagcttctggggaggcctcgggaaacagagtcacggtgaaggcagagtgggagcaggcgcctcatatggccacagcaggaacaaggggcagggggaggtaccacacactcatttattttttttgagatggatcctcgctctgtcatccaggctggagcacagtggcctgatcttggctcactgcaacctccgcctccccagttcaagtgattctcctgcctcagcctcgcaagtagctgggattacaggcgcccaccaccacgcctggctaatttttgtatttttggtagagacagggtttcaccatgttggccaggctggtcttgaactcctgacctcaggtgatctgcctgcctcagcctcccaaaatgctgagagtacaggtgtgagccaccacgcctggccaccacacacttttaaacaaccagatatcatgagaactcactcactgtcatgctaaaccagccatgagggttctgcccccatgatccagcagtcacctcccaccaggtcccacctctaactttggagattgcacttcaacatgagatttggtggggacacagattcaaaccaaatcagtcccagttcctgcccctgcctgctcatcatccttacattgacccttatggtgtctgatctgatggggattcaggcgaaggctgtagcgggaccagaatcactctagtggaggatctgagacccccacgttgtctgcactgctgccaaacaggccaggaaatgtgtgtcttctgtgtgctaggatgatttagtgagcacatctcatgggaatgcatccgtcagctctaggtttggtcagtaaaaccaatggcagtgcgctcttggctgatgttgccattacagagggtgttgagaaaaggagtccctgggggtgcttctggagtgtcaacagctcctggctgcttagcgtgtcctctcccccttctgctgcttctgcaactcctgataaagtaggtgtgagtcgctatgaatttgcattatcacatcaaaaaatttttttctaaaatattttattgagccgggtgcagtggctcacacctgtaatcccagcactttgggaggccgaggtgggcggatcacctcaggtgacgagttcgagaccagcctggccaacatggtgaaaccccatctctattaaaaatacaaaataagctgggtatggtagcacatgcctgtaatcccaactacttgagaggctgaggcaggagatttgcttgaacttgtgaggtggaggttgcagtgagccgagatcatgccattgcactccagcctgggcaacaagagtgaaactccatctcaaaaaaaaaaaaaaaaaaaaaatatatatatatatatatatatatatatatatatatgtatacacacacacacatatagtagtaaaaaaacacatagcatgacatgtaccatcttaaccatatttaagtgtgtggttcaggggtattaaacacattcacagtgttgtgcagccatcacccccacacatctccagaactcttttcatcttctaaaactaaaactccgagcttcacgttgggctaagtgaaaaagaaacaaaaaaactaaaactctgtccctgtaaacaccaactctccattcccttttcccccaaccttcgactttctgtcttctatgatcttgactactctaatttccgtatagaagtggagtcacagggtatttgtctttctgtggctggcttatttcactttgcacgatatccaaggtttatgttgtagtaagtgtcagaatgtcctccctctgtaagactgagtaatatctcactgtgtgtacatatcacacgttgcttgttcatctgtcagtggacacttgggttgctttcaccttctggctattgtgaacgatgctgctatgaacacagatgttcaattacatctttgagaccctgctttcttctttttttttttttttgagatggagtcttgctctgtcgccaggctggagtgcagtggcgcgatctcagttcactgcaacctctacctcccgggttcaagtcgttctcctgcctcagcctcccgagtagctgggactacaggcacgagccaccacgcccagctaagtttttgtatttttagtagagatggggtttcaccatgttagccaagatggtctcgatcgcttgaccttgtgatccaccgccttggccacccaaagtgctgggattacaggcgtgagccaccacgcccggcccaatttctttgggtatatatccagaagtggaattgctagattttaagtggaattattttctttattttcttttcaaattgttcattgctagtgtttagaaatgcagctgattttgtgtatttatttatttatttattttttcagtctgactctgttgcccaggctggagtgcagtggtgtgatctcagctcactgcaacctctgccccctcgtttcaagcaattctcctgcctcagcctttttagtcgctggaattacaggcgtgtgctaccatgcctggctaatttttgtacttttagtagagacggggtttcgccatattcgccaggctggtgtccaatttctggcctcaagtgatctgcccacctcagcctcccaaaatgctgggattataggcatgagccactgcaccttgcctcatttattaattctaatatttgtgtgtgtgtgtgtgtgtgtatgtgtgtgtgtaatctttaggcatttctacatataagatcatatctgcaaatagagataaccttttttttttttttttttttttgagacgaagttttgctctgtcacccaggctggagtgtaatggcgtaatatcagctcactgcaacctccatctcctgggttcaggcgattctcctgcctcagcctcccgagtaggtgggattacaggtgcccaccatcatgcccagctaattttttgtatttttagtagagacagggttttaccatgttggccaggctggtcttgaactcctgacctcaggtgatctgcccgccttggcctcccaaagtgctaggattacaggcgtgagccattgcgcccggcctcagattttctacttctttgtgatttagttttggcaggttttgtgtatgtaggaatttgtccatttcatttaggttattcatgttgttcagtgttgtagtatttagtattctattataattctctctctttttttaatttttattattattttttgagacggaggtttgctcttgttgcccagtctggagtgcaatggcatgatctcagctcactgcaacttctgcctcctgggttcaagggattctcctgcctcagcctctctagtagctgagattacaggcatctgccactatgcccagctaattttttgtatttttagtagagacggggttttactatgttggccaggctagtctcaaactcctgacctcaggcaatccacctgcctcagtccccgaaagtgctggcattacaggcatgagccactgctccccgctctttttttttttttttttggcgatagagtctcactgtgttgccctggctggagtgcagtggtgcgatttcagctcactgcaacctccacctcctgggttccagtgattcttctgcctcagccttcaggtgtgcaccatcacacctggccaatttttgtaattttagtagagacagggtttcaccgtgttgtctaggctggtctcaaactcctgacctcaggtgatccacccgcctcggcctcccaaagtgctgggattacaggcatgagccaccgggcacgcctggcctttattttatttttctacgttattattcctgttttcagaggagggaattgtcagggaatgaggaaacaggacatgaggacaaggccagatctagggttctcttcaaaagccatgcagatgcatggagacagaaagtagaccggtggttaccaggacctgtcgggagggaggaggaggagtgactgctaatgggtacagtttctttctgagctgatgaaactgtgttggaattagatagtggttatggttacacaatttcgcgaatattttgtatccactgaattatgtactttcaaaggatgaattttatggtattttaaatctatccagtaaaataatttaaaagtttaaaaagtcatggatacgtaatgaattaggaacaaaattcaggtcaggttttaaaatgacagtcacatcagagaaatctttttttttcttttttttgagacagagtttccctcttgtcacccaggctggagtgcagtggcaccatcttggctcactgcaacctctgcctcccaggttcaggtgattctcctgcttcaacctcccgagtagccaggactacaggcgcgcgccaccgcgcctggctaattttttgtattcttagtagagatggggtttcaccatgctggccaggtcggtctcaaactcctaacctcaaatgatccacccgccttgggctcccaaagtgctgggatttcaggtgtgagccacggcgcccggccactaaaaggtttttatggggtatataaagcatgattgttttattttacttttgggtgtgcaacactgtctagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggaggtacctcactcttaaaccctgtgcttgaaacccgtgtctttagcatggatgtggcaatcactatcagtttctgaatcacctaagcagttcacctgaaatgtcattgcattaagtgtgtgatgatgccaaggacagtaatatctgaactaattcgtactcttacctgtttaaagtgactgtacagcctttggtgcagctccaaaagctgcttgacttgataagttttggaataattataacctgtgtttatatggaagcagtttagaaaacaacggaagtggttttcaaaaccattctttttttttagacggagtctcacactgtcatccaggctggagtgcagtggtgccatcccggctcactgtgcttctccacctcccaggttcaagcgattctccttccttagcctcctgggtagcttggattacaagcgcctgccaaccacacccagctaatttttgtatttttagtagaaatagggtctcaccttgttggtcaggctggtctcaaactcccgacctcgtgatccacccgccttggcttcccaaagtgttgggattacaggcatgagccaccatgcccggccttcagaaccattcttgacttacagatgataatttctccagaaatggatattaatttatacatttactgggtgtccatcaagtatcagtccctgttctagggatggaggggacagtgtgcacaagatagacagggctcggctcttaggggagaaacaggacagtcaaaccagtcatctgacaaaactgtcagttgaggccgggcacggtggctcacacctgtaatcccagcactttgggaggccgaggtgggcggatcacctgaagtcaggagttcgagaccagcctgaccaacatagtgaaaccctgtctctactaaaaatacaaaaattagctgggcatggtggcaggcgcctgtaatcccagccacttgggagactgagggaggagaatcgcttgaacccaggaggcggaggttgcagtgagccaagatcgtgccattgcactccagcctgggggacaagaacgagacttcgtctcaaaaacaaaaacaaaaacaaaaaaaactgtcagttgaacctaagtgttaagcagaaaattgtggagtttccctgtctgctgttattaagctcatacagaatttaggtcaggccatggcaaggtaatatcccatattcccaccttctcccacttcctgtggagttgaaagtcagctggccacttctttcaaaagatttttgaaagtcttaattaaacatttttgtcttataatgaaaagatttttctgtagcttttctgcttgttttgcgagcatctgtggccctcctctgaagcccttccagccctttgcagctcctactcaatctcttgctctctctctaaatgccaatctttttttttttttttttttgagagagggtctcattctgtcacccaggagcgtagtggctcaatcatggctcactgcagcctccacctcccaggctcaattgatcttcctgcatcagcctcccgagtagctggacccacagcacaggcgcacacccccacacccagctgatttttaattttttttagagacagggtctcattatgttgtccaagctggtctcgaactcctaccctgaagtaatcctcctggcttggcctcccaaattgcagggattacaggcgtgagccactgcgtctggccttctaagcactgatcttgtgatctccctggacctcagaagacttcctgtttctaggacttcctcagcttccctctcactttattgcttccctggggatctcaccgtcctcctggtttcccaggccttcttccctctacagactcccacgcttcccgttcagacctctctctggtgcctcagatctcttcattgaaacatctccacctggctgtcctgtgaacccctctgcctttcatgtctgagcagagcccacaagctggctttctgtccacccctgcattgtcaggggccgtttcgcctaccccaggctcaagctgggaacccagagccattcttgactttctccttcactcactcctccccatgtcctgtggtcgctaagcctggagggctatgctctcccctcatctccctcccctgccacccacatccctctccttacctgagtcctcatcttttcctgactgtactgtgggggtagtcttgactgcctgccaggcttccagccctgccccatcctctgcaccaccacccaaggcaccttcctaaaacctccctccacagctgcctggagaaggaaatccaaaccttggcccctctcagcctgggcctgggttgcctttcagcccttctggcctgcccgtctccaggcgccgcctccagctgtgccaccccctcacctgagtatgcggcgcagcctgggtgagtcctggagggcaggacacacatctccttatcaccgtgtccttattccagggccttgcccaggacagtgcccagagcttgtcatgggggacccagaatggatcatagtacttcattaaggagcaaacaggtgaaatagttaataaagcagaatgtttagagttacttggtcactgaaatttttggagaactttctgttttttatgttgtatattgcaccaacttgttggctattgggaaattcttacgggacattcaaaggcatgaaatgctttcccttggtagttcctccagcagtgtgaccgggaggatctggtggaattggctctgcctcagctggctcaggttgtgaccgtgtatgagtttcttctgatgaaggtgagtactcttagtgtttctaaatgatagcgggatgattagaagttatttagaaataatattattatttattaattatttttcaatagcctgcatagttgttaattttatttttgagacagggtcttgctctgtcgcccagctagagtgcagtggcaccatcgtagctcactgcagcctcaaactgctggtctctagcaatccttccacctcagccttccaagtagctgggactacaggcatgcaccatcatacccggctaatttttaatttatttaaaaaaattttttttgtagagatgggatctagctttgttgcccaggctggtctcaaactcctggcctcaagtaatcctcctgcctcggcctcccaaagtgatgggattataggtgtgagctaccgtgcccagctcatagttgttttggaaagagccaggccatttggaatcgttttccttttgcaggacagctgaagtgagcctgctggtcacacaccgtgcctggtgtgggggccgctgcctgggtagctgggtgtctcgggcaggtgcccgtttactcccttgacttttaacttggtacaggaggaatggaagtggcagccacaaataatggctatcctgggctctcctagaacccactcgccccagctggcctcttctgcccgcggctctgctccttctgagcccactctgaggctgcagcccaggctgcctgtgccccacactccctctggagctgacagtccagccggggctcagggcctttctgccttcccttcccaccctgtccaggagctcacccatgccctacatggcccccacccagggcttgtttgtttcttggcctgctcctcccatgcccatcctggcttctctgcaccatgcggggcacacagtaggtgctcactggggactgaaggaaacgcacaccactgagggctgctgaggggttaaggaaccgaaactttgtttagattttcttctgtattttccatatcagtgccttgagtttaaactttttttttggtctttatcttcacgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggtaacaatctcccatggcagaaagagttttgctcatagagttagccagaagaaagaagggccacgtgcagtggcttatgcttgtagtcccagtgctttgggagactgaggcaggtggatcacttgaggtcaggagtttgagaccagcctggccaacatgacaaaactcagtctctactaaaaatacaaaaattagctgggcgtggtggcacatgcctctaattccagttattcaggaagctgaggcacaagaatcatttgaacctaggaggcagaggttgcagtaagctgagattgcaccattgcactccagcctgggtgacagagactctgtctcaaaaaacaaaacaaaaccaaaaaaaaaaaaaactccatgtatgaaggagaatgtttttagtaatgacattttcctgttcgacctcattttagctttttcccatcaagtgaaaatttttttttctttttgtttttttgggagatggagtcttgctctgtcacccaggctagagtgcagtggtgtgatctcagctcactgtaactgccgcctcccaggttcaagcaattctcctgcctctgcctcccaagtagctgggattagaggcgcacaccaccatgcccagctgattttttgtattttagtagagacagggtttcaccgtgttgcccaggctggtctcgaactcctgagctcaggcagtctgcctgcctcagcctcccaaagtgctaggattacaggtgtgagccaccacatccggtccccagttttttttttcttaaagcaataaatgctcttccagaaaactcaaaaatgaagataagctagaagaaaatggaaaacaccataatcttcccactcactgatgatcagagttaaaacctcaggtatcattttcttctttttttttttttgttttgaaacagggtttccctctgtctcccagactggagtgcagtggcacaatcacagctcaccgcagcctcaaccttctggtcccaaacaatcctcccacataagcctcctgagtagctgggactaccgccgtgtgtcaccatgcccagctaatttttaaatttttcgtagagaaggggtctcgctgtgttgtccactctggtcttgaactccagggctcaactgatcctcccttataggcctcccaaagtgctgggattacaggcatgaaccaccatgcctagccctgttttcttccttatgtgggtttttggggatggattatataggggccattcatttttgtttgtggtggttccgacacaattctcatttcagtgtcattgttattatcaaattgcctttagctacattggattttttggggtgtttttgtttttttgagacagagtctcgctgtcagccaggcttgagtgcaatggtgccatcttggctcactgcaacctcccctcctgggttcaagcgattctcccacctcagcctcctgagtagctgggactacaggtgtgcaccaccatgcccagctaatttttgtatttttagtagagacagggtttcaccgtattggccaggctggtcttgaactcctgacctcaagtgatccgcccgcctcagccttccgaagtgctgggattacaggcataagccaccatgccctgccttattttcttaaattacatatgatgaaaatgtaaaaggtttttgctaagcctcatgtagatgccctccacagcagtcacctgtgtgttttttaaactcttgagtttagcaagtgtgggtatcatcctgctttgaggcggaactcggcacacacacactgtgcctgccctacagaatccggctttttcagcagctcagactgtgccatcgcctcttgggagcatgacagtggctccgtttgtgaggggacaccatccaggttggtccgcgcagaacccacatggcccgttttctcctttaaccttgttctgccgcccttcctgccgtgcccacccccatctcatgctctgtggggttctctttataacatccatgtataaatgataccagctgtctcttagcactttcacatctggtgtttacgtaggcattgcatatggagtcaaatctcatcttcacaaaagcctttccaggtagctgtaacctcttgtctggataagtcagggagatggacaagggagactcaggagatggtggctcaccaagatcacccaggccatgggcagagaagctgggatccagctcaggcccccaagcccatgcctttttaccagctgggaagggagatctgggtgtgggataggcaggatcgtttttctcaagagaccagtgagaagtcagtaaaggagggatagtgggaaagaaagttactatggtatcagctaacattattaagctcgtgatagcattaaagagagtgttttaaatgttttgtaaagactgttctgggctgagcacagtggctcacgcctgtaatcccaacactttgggaggctgaggcgggtggatcacttgaggccagaagttcaagaccagcctggcaaacatggtgaaactccatctttactaaaaatacaaaaattagccaggcatggtggtgcatgcctgtaatcccagctactcaggaggctgaagcaggagaatcacttgaatctgggaagcggaggttgtggtaagccaagatcatgccactgcactccagcctgagcgacagagccagactctgtctcagaaaaaaaaaaaaaaaaaaaaaaaaaagattggtctcctcctctaaattgtgctcacatagaaccttctagtttttataatccatttttatcatcagctagtccatctaacattatattgatcttcatctttctcattgttgagatggcatctcacagtaggtgaggaactttgtagatttaattctatgaagtcgtttaattcttgcatgtgaatgtgcttctgggggtgtgtgctgtttgggtgaagtttattctcttggcccatttcttttcaggttgctgagtcattaggaatcacagaattcctacggaagaaagaaatacacccagacaaccttggacccaagcacctcagccgagacatggatggggagcagctagagggagctagcagcgagaagagggaacgtgaggtgggcatggctgaagtgggtgccaggtgactgtgcacggtgaattagcgtggtttggcttcttctgttcacaccaggaagaggaggtagcggtttgcctattccttcctattctagctgattgggtcttctcttcacaggctgcggaggagggactggcctcagtgaaaaggcccagaagagaagccctgtccaacgataccactgaatctcttgctgccaacagcagaggccgggagaagcccaggcccttgcatgctttggccgctggtgagggtaaaatgctgtttgtggggtgtatccatggcctggcagccctgctgacatgcacagatgtacccaggattgccatttttcaggttgggtgacctgtgctggatttaaggggaccctctggtttctcaagtttcattccagcctcccagtgttctgtcattccagattcattccctgcgagtcttgaggtcttcagggttttctagagtgccttgttaaaatggagagccacaggccaggtgcagtggctcacgcctataatcccagcactttgggaggccgaggtgggcggatcacctgacgtcgggaattcgagaccagcctggccaacatggcaaaaccccgtctctactaaaaatacaaaaaaaactagctgggtgtggtggcgtgtgcctgtaatcccagctacttcggaggctgaggcaggagaattgcttgaacctgggaggcaggaggttgcagtgagccgagattgcaccactgcactccagcctgggtaacagagtgagactccatctcaaaaaaaaaaggagagccaccaaatggtagtaaacaggctataccaggagggtcccaagaggttaggctgagacgggtcccaggacacatccatctatggcttggctttcatgagacttcgctgtacatgccagctgagatttaacatttgaaaacaagacaggtcctggcttttattctggctctagccagaacctatcaactaggcacttaaaaaattatatatataaattttttttttgagacgggagtcgcactttgtcacccaggctggagtgcagtggcacaatctcggctcactgcaacctctgcctcctgggttcaagcaattctactgactcagcctccccagtagctgggattacaggcacccgccatcatgcccggctaatttttttttgtatttttgtagagatggggttttaccattttggtcaggctggtctgaaactcctgactgcaggtgatctgcccacctcggcctcccaaagtgctgggattacaggcatgagccactacgccagcctttttttttttttttgagatggagtcttgctctgtcacccaggctggagtgcaatggcatgatctctgctcactgcaacctctgcctcccaggctcaagcaattctcctgcctcagcctcctgagtagctgggattacaggcgcccaccaccacatctggctaatttttgtatttttagtagagatagggtttccccatgttggccaggctggtcttgaactcctgacctcaaatgatctgcccgcctcagcctcccatagtgctaggattacaggcgtgagcagccaccgtgcccagcctgatggtgattcttaattggggcatgtgttggaaccacctggggaggttattgtgaaatacaggggcctggacctctgggaattccaggtctgcaggtagggttgttgggagggtgtggatgtgagtatttggaaaggcctctttgggtgattctccagctcactctgatgaagaatcaccaatcattcattcagtattggcataaaatcactgttgctgggtgtggtggctcatgcctgtaatcccagcactttgggaggctgagtcgggtggctcacaaggtgaggagtttgagaccagcctgacctacatggtgaaaccttgtctctactaaaaatacaaaaattagctgggcatggtggcgcatgcctgtaatcccagctatcaggaggctaaggcaggagaattgcttgaacccaggaggtggaggctgcagtgagctgaaatcgtgccactgcactccagcctgggtgacagagcgagactccatctcaaaaaaaaaaaaaaaaaaaaagcacactgtcgattggctcttagagcatatttttaatacaaaatctgtctttgtgaatagagaatagggacgtattttttaaaattgctaccaatcccaaggagcaaggagcatcgatgctttgacttttctgcagggcaggtgacttggcctagctggttttgggtggtgagtgcagtgagtgggccatgacacagtacacgccatgttcacctgtttcccaaaatgtttaggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgccctgctgtctacatttttctatggagcttgtcataataatagcagatattacctgatcaggaatccctgtggcgcgtctgacgctcatgagtttttcatgatggtgatgagtagcactgcactgtcacctgatgattggccctgctccgtttcccttctctcctgggagatatgctgcttttccaccagacttgctccatactagaagcttcttttgggttcaattaaaaagaaaataagctagtcattctgggcagcattttattgatagaagggggaaaaagtcatttctacttgcatgattttttaaattaaattaaattaaattaatttaattatttttgagaccaagtcttactctgtagcccaagctggagtgcagtggcgcgatcttggctcactgcaacctctgccgcctgggctcaagcgattctcgtgcctcagcctcctgagtagctgtgactacaggagcatgccaccatgcccagctaattttttttttttgtattttagtagatacggggtttcaccatgttgcccagggtggtctcaaactcttgagctcaggcaatccgcccacctcagcttcccaaagtgctgggattacagtacaggcatgagccactgcacctggccaatgatttttttttttttttttgagatggagttttggtcttgttgcccaagctggagtgcaatggctcgatcttggctcaccgcaacctccaccacagggttcaagcaattctcctgcctcagcctcccaagtagctgggattacaggcatgtgccatcacacctggatca

SEQ ID NO: 655 - DNA, 23877 bp, Homo sapiens
gaaacactctcgttaacaattcaaactgtggtcccctcccagatgtataaatccaaatgtttaggggtgggcacagtactctgcatctccagacagcatcctccgctgattcggatgcatgatgacgtcagaacacttggatattgtggtaacttttgggccaggggctctgaaaccccgaagacctccccctgggagatccgggacagctcccagagaaggtgagtcttaaacacatccgtgacaggcaataaggaaaataaggggggtccgctctgctgatcagccctaagagccgcggcggttgtcggctggggcggggcactccacgactttcccggccagacacggtcgccttcctaggtgtcttggcctgcgaggcactcgtagcccgcccctctcctaggtgacgtacattggagacgccgtcgctcagcgacccgggttcgagtccccgcctcggccgccatggcggatgcggagccggaggctgggggcggcagcgaggatggcggcggcggcggcggcccggctcctccgggccagagcggcagcgtcgcacgtgtggccccgctgggccccgagcagctgcggcaggtcctggagcaggtgacgaaggcgcagccgccgccgccgccgccccccttcgtgctgcgggacgcggcgcggcggctgcgggacgcggcccaacaggccgccctgcagcggggccggggcaccgagcccccgcgcctgccgcgcctgctcccgccccaggtgaggcgtcgggagggacgtggggaaactgaggcccgaagggggccgacgccccgcggcggggtagctgcttgtccggggaggccagtatccgcccgggttaagactcagggcgtccccaggctgagcttcttagggacggcgttcggcccccacctgtcaccaccctggcattttcaccccaggagcctcactctaggagcggttgctcacgctgggccctgtgcctggaacgccctcgtgccttctctgccttcacagccctgctgggggcttttgcgtgctccctagctcttcttacaggcctttcaccgctggttcagcctttgtggagcacttagagaccgtgttcccagcactccccactatgtgcaggaggtgaagccttgaacacacttgctgaagaacgaacataaggcaggttctgggattgacgggggctgctttagagtgggtggtcccgtaggccagacactggagctgaaacataaatgaattaaaaggaaccaacttagcttttcagttgtaaggtgccaaggcccaggcttggaacaaagtcaagcacaatacactagttcgctgcaggacttaacatcctgggtgatagtgactgatttgtaaccgcagtacccagcacagtgcctgatacacaatgtttggaatatgtgaaagcactctgtatactacaaaacatcctttcccagtgggtttatttcctgggccacacaccttttggttgctaggggggtgataactagaagacggtcgcccaactccggagggtgaagcatagcgcctgaagccagagggcctacacggcatctgtaaaattccaccccatttcagcgctggggttgtaaacaaaattagtctcaccccaaaattgccaaaagaagacagctttttccactagaagaaacgggttagggaatagaatcaggaaccttcactcgttgagtttttttgactgatgttagctgcttagggttgtatccagttaatcatcaagactggagagttgtcttgctaaggtttaggaagaccagtgtgattctgtccagatgccacactatcactatctagaggtgtgaccttgggtaagtcaacctttttggactttggtctgggtcagaaggctgcaaggtgccatctgggggcagctatctgcaaagcctctgctctgcgcccggcgctgtgcggggccgctcagttttcagcagtgtttttgtaccggcattttgcaggtgggaaacaagctcagggaggttgcgtggctttgcccaaggtccctcaggtgtggctgctctccctagcccctgtactcctcaccataccctgctgaatatggccacagctttttgggtttggaatccaaaaatgacatatttttcgtaaagcaaaagcaaacttattcgagcttaggcagcatgatgggattgtattttgtagctaatctaatggagacgatataaattctacctgcaataatatacctttgcagcacattcttttaatactctttcagccccagctgtgtcatggaggccacaaaggcaaaccggatgcgtactttgcccctcagtagtttatgaactaacaggagatgaaacaagacccagataacttctagtcaaggccagaaagctaaagatagtgaaaaagaactgaatgtatttagagaaagggagattgttcctggctgaggacatcagaagcagctttgttgaagaagtggtatctgaactagatttgaaagggtgcgtctgagttgaaaatgcagaaggggagaggcaggttctggggcggttgggggtgcatttcaacaaccacagcagaaggcccagtgttcgctgtgggggtggtgtggatcagcagcacagaccaatggacacacttgggtcagatcgaggcccctgtctctccccatcctccctcttccccaccccacagaaatttccagttccatccaacatgctgtgccccttttcatgcatccgtgcatttacacatggatgtgtgccctttttcacctggcaaaaattcccagccttcaaaatgcccctcagagatcacagcttctgggcagcccaccacctctgggctgttcctgcctcttgattgcacctgttgtaccatgatgacatttttcctgtctgcctcacctgtctgcattccttagggaagcttgtctgccttcagaatcatcagtggagcttttgaaagggcagatcttggggcctcaccccaggagatccgattcagcaggtctgcggggactgaggtatggcaggggaaaccgcccccatctcaagggtgaggttaggacttggctcctgtgtatgtattccacccagaaatactgagttaacattagctgaattaactaaacaaagtatcaagcataatacccacagggtaagccagtgaggatagaggataaatacattattagtctggctttgccgctgtggttatcctcaaacagtagggtttagtgtatgtatgtatatgtattatgtttttgttttggggttttgttgagacagggtctttctttctcacccaggctggactgatctcggctcactacagcctcgaactcccaggctcaaatgatcctcacacctcagcctcccgagtagctggggctacatgtatgcaccatcatgcctggctaatttaaaaatgttttgtagagacagggtcccgctatgttacccaggctggccctgaactcctggcctcaagcagtcctcccgcctcagcatcccaaagcactgcgattacaggtgtgactggcagtaaaatgaaagagatggggttcttgaaggatatgcgcagtcaatctcgttgtcatttgtttcacaagtagcccaggagtcggggactcccagggctatggtgccacctctctacaattcttcatacaaagtgttggctgacctctgctatttgtactagtataacagacagacgagagacacactccagcttgatctcagtgaggatctttattctgtcctgtgtgacatttttgttgatgctccactgtttgagggtcacaccagaaggttgagtccaaagagggccagttggtcgtcccaaataagtgattctcaaccgagggcagttttgccccacagggggcacttggcaatgtcttcattgtcaggactcgggatcactactggcatctagtgggtagaggcagagatgctgctggccatcctccagccacccatgtcaaaggattatgttctgaaatgttggttgggaaatcgtgctctggatgatgaggtttgcctctttttctccctggaggaaagtgctcattatttctgctctgtgagggcgggagccttgtttcttttgcttccccgtccttctcccctaagctgtaagacagctgtttccctgacacctgtaacagtgtttctggcacgcggtcagtgctcaataaatatttgtggggtgttattgaaggtagttctcccctttggtaggtgttttgctattatagacagtgctgccctgaacttcgtagaacagaacatctttgtggccacctgcgtgttttttttatagaatccaggaaatggaattactgggtcaaaaagcacatgtatttgaaattttgttagatatatttgtaaaaagttattgaagatactcagccctacgcctaggtacatgcccctggagaaagtcacacatgtatacacatacatcgtgaagattcagagcagaacttaggaacagaaggttggaaaccacctgtccatcaataggagactggtgtactcatactgcagagaaaatgaacccgtgacacctacccatgttaatgtggataaaattcacgaagcaaaatgaagtaaagaaacccagaaaagccctttcaagttgcaggagatgatatcatttatataaagtttaaaaacatttcagaactgaactatatatttttagaaatatctgcatatgccacataaatttttaaaatcataagaatgctaaacagcacattcaggacagggtgaagaaacaggcatgcaggttgtgcagtaggaagctgggtaacattgttccttatggctttgttgtcgcttccagaatttcattaaaaactttttaaaaaacatgggcccacattatgaattacgtctgcttttagagtactaaaaactccaagcaaaaacacatgggtaacgccgggcacggtggttcatgcctgtaatctcagcactttgggaggctgaggcggacagatcatgaggtcaggagtttgagaccaccctgaccaacatggtgaaaccccgtctctactaaaaatacaaaaattagccaggtgtggtggcaagcgcctgtaatcagggctactcaggaggctgaggcaggagaattgcttgaacctgagaggcagaggttgcactgagctgagatagcgccactgcattccagcctggaccacagagcgagacttcatcttaaaaaaaaattagctggtcatggtggcacacacctgtgatcccagctattcagtaggctgaggcaggagaatcatttgaacctgggaagtggaggttgtggtggcactccagcctgggcgacagaacgagactccatctcaaaaaaacaaacaaacaaaaagccagccgggtgtggtgaggcaggtggatcgccagaggtcaggatttcgagaccagcctgaatggtgaaaccctgtctctactaaaaatacaaaaattagccggggcgtggtggtacgtgcctgtaatcccagatacttgggagactgaggcaggaaaattgcttgaactcgggaggcggaggtcgcagtgagccaagatagtgtcgctccactccagcctgggcgacagagcaagggtccgtctcaaaagaaaaagaaaaacctcacatgggtaaaactgttaggaaggctcttatctcttcactggtcatgaaatcaacttagtggattatgactagtattttttaaaaagtgatgtagaatagggctgggcgtggtgtctcacgctggaaatcccagcacttcgggaggccaaggcaggtggatcaatcacttgacgtcaggaatttgagaccagcctggccaacatggtgaaacccgtctctaccaaaaaatacaaaaattagctgggtgtggtggcagctactccggaggctgagatgagagaatcgctgaaactgggaggcagaggttacagtgaactgagatcgcaccactgcactctagcctgggtgacagagtgagaccctaatctcagaaaaaaaaaaaaaaaatgatgtagaatagatacaatcagcgggcatttatatagggatggtaagtagttccatcaactttattttatttatgtatgcagatatttatatacacgtgtactaggtcataatgtaaaatgtatcattgtggtctctgtttttgtttttgtttttttcagatggagtctcactctgttgcccaggctggagtgcagtggtgcgatctcagcttactgcaacctcctcccgggttcaagcgattctcatgcctcagcctcctgagtagctgggactacaggagtgcatcaccacgcccagctcatttttgtatttttagtagagatggggtttcaccatgttggccaggttggtctcgaactcctgacctcaagtaatcggcctgccttggcctcccaaagtgctgggattacaagtgtgagccaccaagcccagcttatatcactgtggtctctggtcagaaaggtctggaaaataccaccttagtacaaacacattacatcaacttttatatgtaagatgtaatttagaaaaaatgtcaataatggttttatgacgagactgaaattgcagacatgttcataagcacaatgcttcttttctctttcttgtctttctgtacgtaagcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcaggtaatgtttctgtctgggtatgtgtctttttatttggccgttctcggattgctataaagaaatacctgagaccaggtattttataaagaaaagagggttggctcacggttccatagactgtacaggaagcatggtgctggcatctgtttagcttctggggaggcctcgggaaacagagtcacggtgaaggcagagtgggagcaggcgcctcatatggccacagcaggaacaaggggcagggggaggtaccacacactcatttattttttttgagatggatcctcgctctgtcatccaggctggagcacagtggcctgatcttggctcactgcaacctccgcctccccagttcaagtgattctcctgcctcagcctcgcaagtagctgggattacaggcgcccaccaccacgcctggctaatttttgtatttttggtagagacagggtttcaccatgttggccaggctggtcttgaactcctgacctcaggtgatctgcctgcctcagcctcccaaaatgctgagagtacaggtgtgagccaccacgcctggccaccacacacttttaaacaaccagatatcatgagaactcactcactgtcatgctaaaccagccatgagggttctgcccccatgatccagcagtcacctcccaccaggtcccacctctaactttggagattgcacttcaacatgagatttggtggggacacagattcaaaccaaatcagtcccagttcctgcccctgcctgctcatcatccttacattgacccttatggtgtctgatctgatggggattcaggcgaaggctgtagcgggaccagaatcactctagtggaggatctgagacccccacgttgtctgcactgctgccaaacaggccaggaaatgtgtgtcttctgtgtgctaggatgatttagtgagcacatctcatgggaatgcatccgtcagctctaggtttggtcagtaaaaccaatggcagtgcgctcttggctgatgttgccattacagagggtgttgagaaaaggagtccctgggggtgcttctggagtgtcaacagctcctggctgcttagcgtgtcctctcccccttctgctgcttctgcaactcctgataaagtaggtgtgagtcgctatgaatttgcattatcacatcaaaaaatttttttctaaaatattttattgagccgggtgcagtggctcacacctgtaatcccagcactttgggaggccgaggtgggcggatcacctcaggtgacgagttcgagaccagcctggccaacatggtgaaaccccatctctattaaaaatacaaaataagctgggtatggtagcacatgcctgtaatcccaactacttgagaggctgaggcaggagatttgcttgaacttgtgaggtggaggttgcagtgagccgagatcatgccattgcactccagcctgggcaacaagagtgaaactccatctcaaaaaaaaaaaaaaaaaaaaaatatatatatatatatatatatatatatatatatatgtatacacacacacacatatagtagtaaaaaaacacatagcatgacatgtaccatcttaaccatatttaagtgtgtggttcaggggtattaaacacattcacagtgttgtgcagccatcacccccacacatctccagaactcttttcatcttctaaaactaaaactccgagcttcacgttgggctaagtgaaaaagaaacaaaaaaactaaaactctgtccctgtaaacaccaactctccattcccttttcccccaaccttcgactttctgtcttctatgatcttgactactctaatttccgtatagaagtggagtcacagggtatttgtctttctgtggctggcttatttcactttgcacgatatccaaggtttatgttgtagtaagtgtcagaatgtcctccctctgtaagactgagtaatatctcactgtgtgtacatatcacacgttgcttgttcatctgtcagtggacacttgggttgctttcaccttctggctattgtgaacgatgctgctatgaacacagatgttcaattacatctttgagaccctgctttcttctttttttttttttttgagatggagtcttgctctgtcgccaggctggagtgcagtggcgcgatctcagttcactgcaacctctacctcccgggttcaagtcgttctcctgcctcagcctcccgagtagctgggactacaggcacgagccaccacgcccagctaagtttttgtatttttagtagagatggggtttcaccatgttagccaagatggtctcgatcgcttgaccttgtgatccaccgccttggccacccaaagtgctgggattacaggcgtgagccaccacgcccggcccaatttctttgggtatatatccagaagtggaattgctagattttaagtggaattattttctttattttcttttcaaattgttcattgctagtgtttagaaatgcagctgattttgtgtatttatttatttatttattttttcagtctgactctgttgcccaggctggagtgcagtggtgtgatctcagctcactgcaacctctgccccctcgtttcaagcaattctcctgcctcagcctttttagtcgctggaattacaggcgtgtgctaccatgcctggctaatttttgtacttttagtagagacggggtttcgccatattcgccaggctggtgtccaatttctggcctcaagtgatctgcccacctcagcctcccaaaatgctgggattataggcatgagccactgcaccttgcctcatttattaattctaatatttgtgtgtgtgtgtgtgtgtgtatgtgtgtgtgtaatctttaggcatttctacatataagatcatatctgcaaatagagataaccttttttttttttttttttttttgagacgaagttttgctctgtcacccaggctggagtgtaatggcgtaatatcagctcactgcaacctccatctcctgggttcaggcgattctcctgcctcagcctcccgagtaggtgggattacaggtgcccaccatcatgcccagctaattttttgtatttttagtagagacagggttttaccatgttggccaggctggtcttgaactcctgacctcaggtgatctgcccgccttggcctcccaaagtgctaggattacaggcgtgagccattgcgcccggcctcagattttctacttctttgtgatttagttttggcaggttttgtgtatgtaggaatttgtccatttcatttaggttattcatgttgttcagtgttgtagtatttagtattctattataattctctctctttttttaatttttattattattttttgagacggaggtttgctcttgttgcccagtctggagtgcaatggcatgatctcagctcactgcaacttctgcctcctgggttcaagggattctcctgcctcagcctctctagtagctgagattacaggcatctgccactatgcccagctaattttttgtatttttagtagagacggggttttactatgttggccaggctagtctcaaactcctgacctcaggcaatccacctgcctcagtccccgaaagtgctggcattacaggcatgagccactgctccccgctctttttttttttttttttggcgatagagtctcactgtgttgccctggctggagtgcagtggtgcgatttcagctcactgcaacctccacctcctgggttccagtgattcttctgcctcagccttcaggtgtgcaccatcacacctggccaatttttgtaattttagtagagacagggtttcaccgtgttgtctaggctggtctcaaactcctgacctcaggtgatccacccgcctcggcctcccaaagtgctgggattacaggcatgagccaccgggcacgcctggcctttattttatttttctacgttattattcctgttttcagaggagggaattgtcagggaatgaggaaacaggacatgaggacaaggccagatctagggttctcttcaaaagccatgcagatgcatggagacagaaagtagaccggtggttaccaggacctgtcgggagggaggaggaggagtgactgctaatgggtacagtttctttctgagctgatgaaactgtgttggaattagatagtggttatggttacacaatttcgcgaatattttgtatccactgaattatgtactttcaaaggatgaattttatggtattttaaatctatccagtaaaataatttaaaagtttaaaaagtcatggatacgtaatgaattaggaacaaaattcaggtcaggttttaaaatgacagtcacatcagagaaatctttttttttcttttttttgagacagagtttccctcttgtcacccaggctggagtgcagtggcaccatcttggctcactgcaacctctgcctcccaggttcaggtgattctcctgcttcaacctcccgagtagccaggactacaggcgcgcgccaccgcgcctggctaattttttgtattcttagtagagatggggtttcaccatgctggccaggtcggtctcaaactcctaacctcaaatgatccacccgccttgggctcccaaagtgctgggatttcaggtgtgagccacggcgcccggccactaaaaggtttttatggggtatataaagcatgattgttttattttacttttgggtgtgcaacactgtctagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggaggtacctcactcttaaaccctgtgcttgaaacccgtgtctttagcatggatgtggcaatcactatcagtttctgaatcacctaagcagttcacctgaaatgtcattgcattaagtgtgtgatgatgccaaggacagtaatatctgaactaattcgtactcttacctgtttaaagtgactgtacagcctttggtgcagctccaaaagctgcttgacttgataagttttggaataattataacctgtgtttatatggaagcagtttagaaaacaacggaagtggttttcaaaaccattctttttttttagacggagtctcacactgtcatccaggctggagtgcagtggtgccatcccggctcactgtgcttctccacctcccaggttcaagcgattctccttccttagcctcctgggtagcttggattacaagcgcctgccaaccacacccagctaatttttgtatttttagtagaaatagggtctcaccttgttggtcaggctggtctcaaactcccgacctcgtgatccacccgccttggcttcccaaagtgttgggattacaggcatgagccaccatgcccggccttcagaaccattcttgacttacagatgataatttctccagaaatggatattaatttatacatttactgggtgtccatcaagtatcagtccctgttctagggatggaggggacagtgtgcacaagatagacagggctcggctcttaggggagaaacaggacagtcaaaccagtcatctgacaaaactgtcagttgaggccgggcacggtggctcacacctgtaatcccagcactttgggaggccgaggtgggcggatcacctgaagtcaggagttcgagaccagcctgaccaacatagtgaaaccctgtctctactaaaaatacaaaaattagctgggcatggtggcaggcgcctgtaatcccagccacttgggagactgagggaggagaatcgcttgaacccaggaggcggaggttgcagtgagccaagatcgtgccattgcactccagcctgggggacaagaacgagacttcgtctcaaaaacaaaaacaaaaacaaaaaaaactgtcagttgaacctaagtgttaagcagaaaattgtggagtttccctgtctgctgttattaagctcatacagaatttaggtcaggccatggcaaggtaatatcccatattcccaccttctcccacttcctgtggagttgaaagtcagctggccacttctttcaaaagatttttgaaagtcttaattaaacatttttgtcttataatgaaaagatttttctgtagcttttctgcttgttttgcgagcatctgtggccctcctctgaagcccttccagccctttgcagctcctactcaatctcttgctctctctctaaatgccaatctttttttttttttttttttgagagagggtctcattctgtcacccaggagcgtagtggctcaatcatggctcactgcagcctccacctcccaggctcaattgatcttcctgcatcagcctcccgagtagctggacccacagcacaggcgcacacccccacacccagctgatttttaattttttttagagacagggtctcattatgttgtccaagctggtctcgaactcctaccctgaagtaatcctcctggcttggcctcccaaattgcagggattacaggcgtgagccactgcgtctggccttctaagcactgatcttgtgatctccctggacctcagaagacttcctgtttctaggacttcctcagcttccctctcactttattgcttccctggggatctcaccgtcctcctggtttcccaggccttcttccctctacagactcccacgcttcccgttcagacctctctctggtgcctcagatctcttcattgaaacatctccacctggctgtcctgtgaacccctctgcctttcatgtctgagcagagcccacaagctggctttctgtccacccctgcattgtcaggggccgtttcgcctaccccaggctcaagctgggaacccagagccattcttgactttctccttcactcactcctccccatgtcctgtggtcgctaagcctggagggctatgctctcccctcatctccctcccctgccacccacatccctctccttacctgagtcctcatcttttcctgactgtactgtgggggtagtcttgactgcctgccaggcttccagccctgccccatcctctgcaccaccacccaaggcaccttcctaaaacctccctccacagctgcctggagaaggaaatccaaaccttggcccctctcagcctgggcctgggttgcctttcagcccttctggcctgcccgtctccaggcgccgcctccagctgtgccaccccctcacctgagtatgcggcgcagcctgggtgagtcctggagggcaggacacacatctccttatcaccgtgtccttattccagggccttgcccaggacagtgcccagagcttgtcatgggggacccagaatggatcatagtacttcattaaggagcaaacaggtgaaatagttaataaagcagaatgtttagagttacttggtcactgaaatttttggagaactttctgttttttatgttgtatattgcaccaacttgttggctattgggaaattcttacgggacattcaaaggcatgaaatgctttcccttggtagttcctccagcagtgtgaccgggaggatctggtggaattggctctgcctcagctggctcaggttgtgaccgtgtatgagtttcttctgatgaaggtgagtactcttagtgtttctaaatgatagcgggatgattagaagttatttagaaataatattattatttattaattatttttcaatagcctgcatagttgttaattttatttttgagacagggtcttgctctgtcgcccagctagagtgcagtggcaccatcgtagctcactgcagcctcaaactgctggtctctagcaatccttccacctcagccttccaagtagctgggactacaggcatgcaccatcatacccggctaatttttaatttatttaaaaaaattttttttgtagagatgggatctagctttgttgcccaggctggtctcaaactcctggcctcaagtaatcctcctgcctcggcctcccaaagtgatgggattataggtgtgagctaccgtgcccagctcatagttgttttggaaagagccaggccatttggaatcgttttccttttgcaggacagctgaagtgagcctgctggtcacacaccgtgcctggtgtgggggccgctgcctgggtagctgggtgtctcgggcaggtgcccgtttactcccttgacttttaacttggtacaggaggaatggaagtggcagccacaaataatggctatcctgggctctcctagaacccactcgccccagctggcctcttctgcccgcggctctgctccttctgagcccactctgaggctgcagcccaggctgcctgtgccccacactccctctggagctgacagtccagccggggctcagggcctttctgccttcccttcccaccctgtccaggagctcacccatgccctacatggcccccacccagggcttgtttgtttcttggcctgctcctcccatgcccatcctggcttctctgcaccatgcggggcacacagtaggtgctcactggggactgaaggaaacgcacaccactgagggctgctgaggggttaaggaaccgaaactttgtttagattttcttctgtattttccatatcagtgccttgagtttaaactttttttttggtctttatcttcacgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggtaacaatctcccatggcagaaagagttttgctcatagagttagccagaagaaagaagggccacgtgcagtggcttatgcttgtagtcccagtgctttgggagactgaggcaggtggatcacttgaggtcaggagtttgagaccagcctggccaacatgacaaaactcagtctctactaaaaatacaaaaattagctgggcgtggtggcacatgcctctaattccagttattcaggaagctgaggcacaagaatcatttgaacctaggaggcagaggttgcagtaagctgagattgcaccattgcactccagcctgggtgacagagactctgtctcaaaaaacaaaacaaaaccaaaaaaaaaaaaaactccatgtatgaaggagaatgtttttagtaatgacattttcctgttcgacctcattttagctttttcccatcaagtgaaaatttttttttctttttgtttttttgggagatggagtcttgctctgtcacccaggctagagtgcagtggtgtgatctcagctcactgtaactgccgcctcccaggttcaagcaattctcctgcctctgcctcccaagtagctgggattagaggcgcacaccaccatgcccagctgattttttgtattttagtagagacagggtttcaccgtgttgcccaggctggtctcgaactcctgagctcaggcagtctgcctgcctcagcctcccaaagtgctaggattacaggtgtgagccaccacatccggtccccagttttttttttcttaaagcaataaatgctcttccagaaaactcaaaaatgaagataagctagaagaaaatggaaaacaccataatcttcccactcactgatgatcagagttaaaacctcaggtatcattttcttctttttttttttttgttttgaaacagggtttccctctgtctcccagactggagtgcagtggcacaatcacagctcaccgcagcctcaaccttctggtcccaaacaatcctcccacataagcctcctgagtagctgggactaccgccgtgtgtcaccatgcccagctaatttttaaatttttcgtagagaaggggtctcgctgtgttgtccactctggtcttgaactccagggctcaactgatcctcccttataggcctcccaaagtgctgggattacaggcatgaaccaccatgcctagccctgttttcttccttatgtgggtttttggggatggattatataggggccattcatttttgtttgtggtggttccgacacaattctcatttcagtgtcattgttattatcaaattgcctttagctacattggattttttggggtgtttttgtttttttgagacagagtctcgctgtcagccaggcttgagtgcaatggtgccatcttggctcactgcaacctcccctcctgggttcaagcgattctcccacctcagcctcctgagtagctgggactacaggtgtgcaccaccatgcccagctaatttttgtatttttagtagagacagggtttcaccgtattggccaggctggtcttgaactcctgacctcaagtgatccgcccgcctcagccttccgaagtgctgggattacaggcataagccaccatgccctgccttattttcttaaattacatatgatgaaaatgtaaaaggtttttgctaagcctcatgtagatgccctccacagcagtcacctgtgtgttttttaaactcttgagtttagcaagtgtgggtatcatcctgctttgaggcggaactcggcacacacacactgtgcctgccctacagaatccggctttttcagcagctcagactgtgccatcgcctcttgggagcatgacagtggctccgtttgtgaggggacaccatccaggttggtccgcgcagaacccacatggcccgttttctcctttaaccttgttctgccgcccttcctgccgtgcccacccccatctcatgctctgtggggttctctttataacatccatgtataaatgataccagctgtctcttagcactttcacatctggtgtttacgtaggcattgcatatggagtcaaatctcatcttcacaaaagcctttccaggtagctgtaacctcttgtctggataagtcagggagatggacaagggagactcaggagatggtggctcaccaagatcacccaggccatgggcagagaagctgggatccagctcaggcccccaagcccatgcctttttaccagctgggaagggagatctgggtgtgggataggcaggatcgtttttctcaagagaccagtgagaagtcagtaaaggagggatagtgggaaagaaagttactatggtatcagctaacattattaagctcgtgatagcattaaagagagtgttttaaatgttttgtaaagactgttctgggctgagcacagtggctcacgcctgtaatcccaacactttgggaggctgaggcgggtggatcacttgaggccagaagttcaagaccagcctggcaaacatggtgaaactccatctttactaaaaatacaaaaattagccaggcatggtggtgcatgcctgtaatcccagctactcaggaggctgaagcaggagaatcacttgaatctgggaagcggaggttgtggtaagccaagatcatgccactgcactccagcctgagcgacagagccagactctgtctcagaaaaaaaaaaaaaaaaaaaaaaaaaagattggtctcctcctctaaattgtgctcacatagaaccttctagtttttataatccatttttatcatcagctagtccatctaacattatattgatcttcatctttctcattgttgagatggcatctcacagtaggtgaggaactttgtagatttaattctatgaagtcgtttaattcttgcatgtgaatgtgcttctgggggtgtgtgctgtttgggtgaagtttattctcttggcccatttcttttcaggttgctgagtcattaggaatcacagaattcctacggaagaaagaaatacacccagacaaccttggacccaagcacctcagccgagacatggatggggagcagctagagggagctagcagcgagaagagggaacgtgaggtgggcatggctgaagtgggtgccaggtgactgtgcacggtgaattagcgtggtttggcttcttctgttcacaccaggaagaggaggtagcggtttgcctattccttcctattctagctgattgggtcttctcttcacaggctgcggaggagggactggcctcagtgaaaaggcccagaagagaagccctgtccaacgataccactgaatctcttgctgccaacagcagaggccgggagaagcccaggcccttgcatgctttggccgctggtgagggtaaaatgctgtttgtggggtgtatccatggcctggcagccctgctgacatgcacagatgtacccaggattgccatttttcaggttgggtgacctgtgctggatttaaggggaccctctggtttctcaagtttcattccagcctcccagtgttctgtcattccagattcattccctgcgagtcttgaggtcttcagggttttctagagtgccttgttaaaatggagagccacaggccaggtgcagtggctcacgcctataatcccagcactttgggaggccgaggtgggcggatcacctgacgtcgggaattcgagaccagcctggccaacatggcaaaaccccgtctctactaaaaatacaaaaaaaactagctgggtgtggtggcgtgtgcctgtaatcccagctacttcggaggctgaggcaggagaattgcttgaacctgggaggcaggaggttgcagtgagccgagattgcaccactgcactccagcctgggtaacagagtgagactccatctcaaaaaaaaaaggagagccaccaaatggtagtaaacaggctataccaggagggtcccaagaggttaggctgagacgggtcccaggacacatccatctatggcttggctttcatgagacttcgctgtacatgccagctgagatttaacatttgaaaacaagacaggtcctggcttttattctggctctagccagaacctatcaactaggcacttaaaaaattatatatataaattttttttttgagacgggagtcgcactttgtcacccaggctggagtgcagtggcacaatctcggctcactgcaacctctgcctcctgggttcaagcaattctactgactcagcctccccagtagctgggattacaggcacccgccatcatgcccggctaatttttttttgtatttttgtagagatggggttttaccattttggtcaggctggtctgaaactcctgactgcaggtgatctgcccacctcggcctcccaaagtgctgggattacaggcatgagccactacgccagcctttttttttttttttgagatggagtcttgctctgtcacccaggctggagtgcaatggcatgatctctgctcactgcaacctctgcctcccaggctcaagcaattctcctgcctcagcctcctgagtagctgggattacaggcgcccaccaccacatctggctaatttttgtatttttagtagagatagggtttccccatgttggccaggctggtcttgaactcctgacctcaaatgatctgcccgcctcagcctcccatagtgctaggattacaggcgtgagcagccaccgtgcccagcctgatggtgattcttaattggggcatgtgttggaaccacctggggaggttattgtgaaatacaggggcctggacctctgggaattccaggtctgcaggtagggttgttgggagggtgtggatgtgagtatttggaaaggcctctttgggtgattctccagctcactctgatgaagaatcaccaatcattcattcagtattggcataaaatcactgttgctgggtgtggtggctcatgcctgtaatcccagcactttgggaggctgagtcgggtggctcacaaggtgaggagtttgagaccagcctgacctacatggtgaaaccttgtctctactaaaaatacaaaaattagctgggcatggtggcgcatgcctgtaatcccagctatcaggaggctaaggcaggagaattgcttgaacccaggaggtggaggctgcagtgagctgaaatcgtgccactgcactccagcctgggtgacagagcgagactccatctcaaaaaaaaaaaaaaaaaaaaagcacactgtcgattggctcttagagcatatttttaatacaaaatctgtctttgtgaatagagaatagggacgtattttttaaaattgctaccaatcccaaggagcaaggagcatcgatgctttgacttttctgcagggcaggtgacttggcctagctggttttgggtggtgagtgcagtgagtgggccatgacacagtacacgccatgttcacctgtttcccaaaatgtttaggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgccctgctgtctacatttttctatggagcttgtcataataatagcagatattacctgatcaggaatccctgtggcgcgtctgacgctcatgagtttttcatgatggtgatgagtagcactgcactgtcacctgatgattggccctgctccgtttcccttctctcctgggagatatgctgcttttccaccagacttgctccatactagaagcttcttttgggttcaattaaaaagaaaataagctagtcattctgggcagcattttattgatagaagggggaaaaagtcatttctacttgcatgattttttaaattaaattaaattaaattaatttaattatttttgagaccaagtcttactctgtagcccaagctggagtgcagtggcgcgatcttggctcactgcaacctctgccgcctgggctcaagcgattctcgtgcctcagcctcctgagtagctgtgactacaggagcatgccaccatgcccagctaattttttttttttgtattttagtagatacggggtttcaccatgttgcccagggtggtctcaaactcttgagctcaggcaatccgcccacctcagcttcccaaagtgctgggattacagtacaggcatgagccactgcacctggccaatgatttttttttttttttttgagatggagttttggtcttgttgcccaagctggagtgcaatggctcgatcttggctcaccgcaacctccaccacagggttcaagcaattctcctgcctcagcctcccaagtagctgggattacaggcatgtgccatcacacctggatca

SEQ ID NO: 656 - DNA, 23424 bp, Homo sapiens
cccgcctcggccgccatggcggatgcggagccggaggctgggggcggcagcgaggatggcggcggcggcggcggcccggctcctccgggccagagcggcagcgtcgcacgtgtggccccgctgggccccgagcagctgcggcaggtcctggagcaggtgacgaaggcgcagccgccgccgccgccgccccccttcgtgctgcgggacgcggcgcggcggctgcgggacgcggcccaacaggccgccctgcagcggggccggggcaccgagcccccgcgcctgccgcgcctgctcccgccccaggtgaggcgtcgggagggacgtggggaaactgaggcccgaagggggccgacgccccgcggcggggtagctgcttgtccggggaggccagtatccgcccgggttaagactcagggcgtccccaggctgagcttcttagggacggcgttcggcccccacctgtcaccaccctggcattttcaccccaggagcctcactctaggagcggttgctcacgctgggccctgtgcctggaacgccctcgtgccttctctgccttcacagccctgctgggggcttttgcgtgctccctagctcttcttacaggcctttcaccgctggttcagcctttgtggagcacttagagaccgtgttcccagcactccccactatgtgcaggaggtgaagccttgaacacacttgctgaagaacgaacataaggcaggttctgggattgacgggggctgctttagagtgggtggtcccgtaggccagacactggagctgaaacataaatgaattaaaaggaaccaacttagcttttcagttgtaaggtgccaaggcccaggcttggaacaaagtcaagcacaatacactagttcgctgcaggacttaacatcctgggtgatagtgactgatttgtaaccgcagtacccagcacagtgcctgatacacaatgtttggaatatgtgaaagcactctgtatactacaaaacatcctttcccagtgggtttatttcctgggccacacaccttttggttgctaggggggtgataactagaagacggtcgcccaactccggagggtgaagcatagcgcctgaagccagagggcctacacggcatctgtaaaattccaccccatttcagcgctggggttgtaaacaaaattagtctcaccccaaaattgccaaaagaagacagctttttccactagaagaaacgggttagggaatagaatcaggaaccttcactcgttgagtttttttgactgatgttagctgcttagggttgtatccagttaatcatcaagactggagagttgtcttgctaaggtttaggaagaccagtgtgattctgtccagatgccacactatcactatctagaggtgtgaccttgggtaagtcaacctttttggactttggtctgggtcagaaggctgcaaggtgccatctgggggcagctatctgcaaagcctctgctctgcgcccggcgctgtgcggggccgctcagttttcagcagtgtttttgtaccggcattttgcaggtgggaaacaagctcagggaggttgcgtggctttgcccaaggtccctcaggtgtggctgctctccctagcccctgtactcctcaccataccctgctgaatatggccacagctttttgggtttggaatccaaaaatgacatatttttcgtaaagcaaaagcaaacttattcgagcttaggcagcatgatgggattgtattttgtagctaatctaatggagacgatataaattctacctgcaataatatacctttgcagcacattcttttaatactctttcagccccagctgtgtcatggaggccacaaaggcaaaccggatgcgtactttgcccctcagtagtttatgaactaacaggagatgaaacaagacccagataacttctagtcaaggccagaaagctaaagatagtgaaaaagaactgaatgtatttagagaaagggagattgttcctggctgaggacatcagaagcagctttgttgaagaagtggtatctgaactagatttgaaagggtgcgtctgagttgaaaatgcagaaggggagaggcaggttctggggcggttgggggtgcatttcaacaaccacagcagaaggcccagtgttcgctgtgggggtggtgtggatcagcagcacagaccaatggacacacttgggtcagatcgaggcccctgtctctccccatcctccctcttccccaccccacagaaatttccagttccatccaacatgctgtgccccttttcatgcatccgtgcatttacacatggatgtgtgccctttttcacctggcaaaaattcccagccttcaaaatgcccctcagagatcacagcttctgggcagcccaccacctctgggctgttcctgcctcttgattgcacctgttgtaccatgatgacatttttcctgtctgcctcacctgtctgcattccttagggaagcttgtctgccttcagaatcatcagtggagcttttgaaagggcagatcttggggcctcaccccaggagatccgattcagcaggtctgcggggactgaggtatggcaggggaaaccgcccccatctcaagggtgaggttaggacttggctcctgtgtatgtattccacccagaaatactgagttaacattagctgaattaactaaacaaagtatcaagcataatacccacagggtaagccagtgaggatagaggataaatacattattagtctggctttgccgctgtggttatcctcaaacagtagggtttagtgtatgtatgtatatgtattatgtttttgttttggggttttgttgagacagggtctttctttctcacccaggctggactgatctcggctcactacagcctcgaactcccaggctcaaatgatcctcacacctcagcctcccgagtagctggggctacatgtatgcaccatcatgcctggctaatttaaaaatgttttgtagagacagggtcccgctatgttacccaggctggccctgaactcctggcctcaagcagtcctcccgcctcagcatcccaaagcactgcgattacaggtgtgactggcagtaaaatgaaagagatggggttcttgaaggatatgcgcagtcaatctcgttgtcatttgtttcacaagtagcccaggagtcggggactcccagggctatggtgccacctctctacaattcttcatacaaagtgttggctgacctctgctatttgtactagtataacagacagacgagagacacactccagcttgatctcagtgaggatctttattctgtcctgtgtgacatttttgttgatgctccactgtttgagggtcacaccagaaggttgagtccaaagagggccagttggtcgtcccaaataagtgattctcaaccgagggcagttttgccccacagggggcacttggcaatgtcttcattgtcaggactcgggatcactactggcatctagtgggtagaggcagagatgctgctggccatcctccagccacccatgtcaaaggattatgttctgaaatgttggttgggaaatcgtgctctggatgatgaggtttgcctctttttctccctggaggaaagtgctcattatttctgctctgtgagggcgggagccttgtttcttttgcttccccgtccttctcccctaagctgtaagacagctgtttccctgacacctgtaacagtgtttctggcacgcggtcagtgctcaataaatatttgtggggtgttattgaaggtagttctcccctttggtaggtgttttgctattatagacagtgctgccctgaacttcgtagaacagaacatctttgtggccacctgcgtgttttttttatagaatccaggaaatggaattactgggtcaaaaagcacatgtatttgaaattttgttagatatatttgtaaaaagttattgaagatactcagccctacgcctaggtacatgcccctggagaaagtcacacatgtatacacatacatcgtgaagattcagagcagaacttaggaacagaaggttggaaaccacctgtccatcaataggagactggtgtactcatactgcagagaaaatgaacccgtgacacctacccatgttaatgtggataaaattcacgaagcaaaatgaagtaaagaaacccagaaaagccctttcaagttgcaggagatgatatcatttatataaagtttaaaaacatttcagaactgaactatatatttttagaaatatctgcatatgccacataaatttttaaaatcataagaatgctaaacagcacattcaggacagggtgaagaaacaggcatgcaggttgtgcagtaggaagctgggtaacattgttccttatggctttgttgtcgcttccagaatttcattaaaaactttttaaaaaacatgggcccacattatgaattacgtctgcttttagagtactaaaaactccaagcaaaaacacatgggtaacgccgggcacggtggttcatgcctgtaatctcagcactttgggaggctgaggcggacagatcatgaggtcaggagtttgagaccaccctgaccaacatggtgaaaccccgtctctactaaaaatacaaaaattagccaggtgtggtggcaagcgcctgtaatcagggctactcaggaggctgaggcaggagaattgcttgaacctgagaggcagaggttgcactgagctgagatagcgccactgcattccagcctggaccacagagcgagacttcatcttaaaaaaaaattagctggtcatggtggcacacacctgtgatcccagctattcagtaggctgaggcaggagaatcatttgaacctgggaagtggaggttgtggtggcactccagcctgggcgacagaacgagactccatctcaaaaaaacaaacaaacaaaaagccagccgggtgtggtgaggcaggtggatcgccagaggtcaggatttcgagaccagcctgaatggtgaaaccctgtctctactaaaaatacaaaaattagccggggcgtggtggtacgtgcctgtaatcccagatacttgggagactgaggcaggaaaattgcttgaactcgggaggcggaggtcgcagtgagccaagatagtgtcgctccactccagcctgggcgacagagcaagggtccgtctcaaaagaaaaagaaaaacctcacatgggtaaaactgttaggaaggctcttatctcttcactggtcatgaaatcaacttagtggattatgactagtattttttaaaaagtgatgtagaatagggctgggcgtggtgtctcacgctggaaatcccagcacttcgggaggccaaggcaggtggatcaatcacttgacgtcaggaatttgagaccagcctggccaacatggtgaaacccgtctctaccaaaaaatacaaaaattagctgggtgtggtggcagctactccggaggctgagatgagagaatcgctgaaactgggaggcagaggttacagtgaactgagatcgcaccactgcactctagcctgggtgacagagtgagaccctaatctcagaaaaaaaaaaaaaaaatgatgtagaatagatacaatcagcgggcatttatatagggatggtaagtagttccatcaactttattttatttatgtatgcagatatttatatacacgtgtactaggtcataatgtaaaatgtatcattgtggtctctgtttttgtttttgtttttttcagatggagtctcactctgttgcccaggctggagtgcagtggtgcgatctcagcttactgcaacctcctcccgggttcaagcgattctcatgcctcagcctcctgagtagctgggactacaggagtgcatcaccacgcccagctcatttttgtatttttagtagagatggggtttcaccatgttggccaggttggtctcgaactcctgacctcaagtaatcggcctgccttggcctcccaaagtgctgggattacaagtgtgagccaccaagcccagcttatatcactgtggtctctggtcagaaaggtctggaaaataccaccttagtacaaacacattacatcaacttttatatgtaagatgtaatttagaaaaaatgtcaataatggttttatgacgagactgaaattgcagacatgttcataagcacaatgcttcttttctctttcttgtctttctgtacgtaagcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcaggtaatgtttctgtctgggtatgtgtctttttatttggccgttctcggattgctataaagaaatacctgagaccaggtattttataaagaaaagagggttggctcacggttccatagactgtacaggaagcatggtgctggcatctgtttagcttctggggaggcctcgggaaacagagtcacggtgaaggcagagtgggagcaggcgcctcatatggccacagcaggaacaaggggcagggggaggtaccacacactcatttattttttttgagatggatcctcgctctgtcatccaggctggagcacagtggcctgatcttggctcactgcaacctccgcctccccagttcaagtgattctcctgcctcagcctcgcaagtagctgggattacaggcgcccaccaccacgcctggctaatttttgtatttttggtagagacagggtttcaccatgttggccaggctggtcttgaactcctgacctcaggtgatctgcctgcctcagcctcccaaaatgctgagagtacaggtgtgagccaccacgcctggccaccacacacttttaaacaaccagatatcatgagaactcactcactgtcatgctaaaccagccatgagggttctgcccccatgatccagcagtcacctcccaccaggtcccacctctaactttggagattgcacttcaacatgagatttggtggggacacagattcaaaccaaatcagtcccagttcctgcccctgcctgctcatcatccttacattgacccttatggtgtctgatctgatggggattcaggcgaaggctgtagcgggaccagaatcactctagtggaggatctgagacccccacgttgtctgcactgctgccaaacaggccaggaaatgtgtgtcttctgtgtgctaggatgatttagtgagcacatctcatgggaatgcatccgtcagctctaggtttggtcagtaaaaccaatggcagtgcgctcttggctgatgttgccattacagagggtgttgagaaaaggagtccctgggggtgcttctggagtgtcaacagctcctggctgcttagcgtgtcctctcccccttctgctgcttctgcaactcctgataaagtaggtgtgagtcgctatgaatttgcattatcacatcaaaaaatttttttctaaaatattttattgagccgggtgcagtggctcacacctgtaatcccagcactttgggaggccgaggtgggcggatcacctcaggtgacgagttcgagaccagcctggccaacatggtgaaaccccatctctattaaaaatacaaaataagctgggtatggtagcacatgcctgtaatcccaactacttgagaggctgaggcaggagatttgcttgaacttgtgaggtggaggttgcagtgagccgagatcatgccattgcactccagcctgggcaacaagagtgaaactccatctcaaaaaaaaaaaaaaaaaaaaaatatatatatatatatatatatatatatatatatatgtatacacacacacacatatagtagtaaaaaaacacatagcatgacatgtaccatcttaaccatatttaagtgtgtggttcaggggtattaaacacattcacagtgttgtgcagccatcacccccacacatctccagaactcttttcatcttctaaaactaaaactccgagcttcacgttgggctaagtgaaaaagaaacaaaaaaactaaaactctgtccctgtaaacaccaactctccattcccttttcccccaaccttcgactttctgtcttctatgatcttgactactctaatttccgtatagaagtggagtcacagggtatttgtctttctgtggctggcttatttcactttgcacgatatccaaggtttatgttgtagtaagtgtcagaatgtcctccctctgtaagactgagtaatatctcactgtgtgtacatatcacacgttgcttgttcatctgtcagtggacacttgggttgctttcaccttctggctattgtgaacgatgctgctatgaacacagatgttcaattacatctttgagaccctgctttcttctttttttttttttttgagatggagtcttgctctgtcgccaggctggagtgcagtggcgcgatctcagttcactgcaacctctacctcccgggttcaagtcgttctcctgcctcagcctcccgagtagctgggactacaggcacgagccaccacgcccagctaagtttttgtatttttagtagagatggggtttcaccatgttagccaagatggtctcgatcgcttgaccttgtgatccaccgccttggccacccaaagtgctgggattacaggcgtgagccaccacgcccggcccaatttctttgggtatatatccagaagtggaattgctagattttaagtggaattattttctttattttcttttcaaattgttcattgctagtgtttagaaatgcagctgattttgtgtatttatttatttatttattttttcagtctgactctgttgcccaggctggagtgcagtggtgtgatctcagctcactgcaacctctgccccctcgtttcaagcaattctcctgcctcagcctttttagtcgctggaattacaggcgtgtgctaccatgcctggctaatttttgtacttttagtagagacggggtttcgccatattcgccaggctggtgtccaatttctggcctcaagtgatctgcccacctcagcctcccaaaatgctgggattataggcatgagccactgcaccttgcctcatttattaattctaatatttgtgtgtgtgtgtgtgtgtgtatgtgtgtgtgtaatctttaggcatttctacatataagatcatatctgcaaatagagataaccttttttttttttttttttttttgagacgaagttttgctctgtcacccaggctggagtgtaatggcgtaatatcagctcactgcaacctccatctcctgggttcaggcgattctcctgcctcagcctcccgagtaggtgggattacaggtgcccaccatcatgcccagctaattttttgtatttttagtagagacagggttttaccatgttggccaggctggtcttgaactcctgacctcaggtgatctgcccgccttggcctcccaaagtgctaggattacaggcgtgagccattgcgcccggcctcagattttctacttctttgtgatttagttttggcaggttttgtgtatgtaggaatttgtccatttcatttaggttattcatgttgttcagtgttgtagtatttagtattctattataattctctctctttttttaatttttattattattttttgagacggaggtttgctcttgttgcccagtctggagtgcaatggcatgatctcagctcactgcaacttctgcctcctgggttcaagggattctcctgcctcagcctctctagtagctgagattacaggcatctgccactatgcccagctaattttttgtatttttagtagagacggggttttactatgttggccaggctagtctcaaactcctgacctcaggcaatccacctgcctcagtccccgaaagtgctggcattacaggcatgagccactgctccccgctctttttttttttttttttggcgatagagtctcactgtgttgccctggctggagtgcagtggtgcgatttcagctcactgcaacctccacctcctgggttccagtgattcttctgcctcagccttcaggtgtgcaccatcacacctggccaatttttgtaattttagtagagacagggtttcaccgtgttgtctaggctggtctcaaactcctgacctcaggtgatccacccgcctcggcctcccaaagtgctgggattacaggcatgagccaccgggcacgcctggcctttattttatttttctacgttattattcctgttttcagaggagggaattgtcagggaatgaggaaacaggacatgaggacaaggccagatctagggttctcttcaaaagccatgcagatgcatggagacagaaagtagaccggtggttaccaggacctgtcgggagggaggaggaggagtgactgctaatgggtacagtttctttctgagctgatgaaactgtgttggaattagatagtggttatggttacacaatttcgcgaatattttgtatccactgaattatgtactttcaaaggatgaattttatggtattttaaatctatccagtaaaataatttaaaagtttaaaaagtcatggatacgtaatgaattaggaacaaaattcaggtcaggttttaaaatgacagtcacatcagagaaatctttttttttcttttttttgagacagagtttccctcttgtcacccaggctggagtgcagtggcaccatcttggctcactgcaacctctgcctcccaggttcaggtgattctcctgcttcaacctcccgagtagccaggactacaggcgcgcgccaccgcgcctggctaattttttgtattcttagtagagatggggtttcaccatgctggccaggtcggtctcaaactcctaacctcaaatgatccacccgccttgggctcccaaagtgctgggatttcaggtgtgagccacggcgcccggccactaaaaggtttttatggggtatataaagcatgattgttttattttacttttgggtgtgcaacactgtctagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggaggtacctcactcttaaaccctgtgcttgaaacccgtgtctttagcatggatgtggcaatcactatcagtttctgaatcacctaagcagttcacctgaaatgtcattgcattaagtgtgtgatgatgccaaggacagtaatatctgaactaattcgtactcttacctgtttaaagtgactgtacagcctttggtgcagctccaaaagctgcttgacttgataagttttggaataattataacctgtgtttatatggaagcagtttagaaaacaacggaagtggttttcaaaaccattctttttttttagacggagtctcacactgtcatccaggctggagtgcagtggtgccatcccggctcactgtgcttctccacctcccaggttcaagcgattctccttccttagcctcctgggtagcttggattacaagcgcctgccaaccacacccagctaatttttgtatttttagtagaaatagggtctcaccttgttggtcaggctggtctcaaactcccgacctcgtgatccacccgccttggcttcccaaagtgttgggattacaggcatgagccaccatgcccggccttcagaaccattcttgacttacagatgataatttctccagaaatggatattaatttatacatttactgggtgtccatcaagtatcagtccctgttctagggatggaggggacagtgtgcacaagatagacagggctcggctcttaggggagaaacaggacagtcaaaccagtcatctgacaaaactgtcagttgaggccgggcacggtggctcacacctgtaatcccagcactttgggaggccgaggtgggcggatcacctgaagtcaggagttcgagaccagcctgaccaacatagtgaaaccctgtctctactaaaaatacaaaaattagctgggcatggtggcaggcgcctgtaatcccagccacttgggagactgagggaggagaatcgcttgaacccaggaggcggaggttgcagtgagccaagatcgtgccattgcactccagcctgggggacaagaacgagacttcgtctcaaaaacaaaaacaaaaacaaaaaaaactgtcagttgaacctaagtgttaagcagaaaattgtggagtttccctgtctgctgttattaagctcatacagaatttaggtcaggccatggcaaggtaatatcccatattcccaccttctcccacttcctgtggagttgaaagtcagctggccacttctttcaaaagatttttgaaagtcttaattaaacatttttgtcttataatgaaaagatttttctgtagcttttctgcttgttttgcgagcatctgtggccctcctctgaagcccttccagccctttgcagctcctactcaatctcttgctctctctctaaatgccaatctttttttttttttttttttgagagagggtctcattctgtcacccaggagcgtagtggctcaatcatggctcactgcagcctccacctcccaggctcaattgatcttcctgcatcagcctcccgagtagctggacccacagcacaggcgcacacccccacacccagctgatttttaattttttttagagacagggtctcattatgttgtccaagctggtctcgaactcctaccctgaagtaatcctcctggcttggcctcccaaattgcagggattacaggcgtgagccactgcgtctggccttctaagcactgatcttgtgatctccctggacctcagaagacttcctgtttctaggacttcctcagcttccctctcactttattgcttccctggggatctcaccgtcctcctggtttcccaggccttcttccctctacagactcccacgcttcccgttcagacctctctctggtgcctcagatctcttcattgaaacatctccacctggctgtcctgtgaacccctctgcctttcatgtctgagcagagcccacaagctggctttctgtccacccctgcattgtcaggggccgtttcgcctaccccaggctcaagctgggaacccagagccattcttgactttctccttcactcactcctccccatgtcctgtggtcgctaagcctggagggctatgctctcccctcatctccctcccctgccacccacatccctctccttacctgagtcctcatcttttcctgactgtactgtgggggtagtcttgactgcctgccaggcttccagccctgccccatcctctgcaccaccacccaaggcaccttcctaaaacctccctccacagctgcctggagaaggaaatccaaaccttggcccctctcagcctgggcctgggttgcctttcagcccttctggcctgcccgtctccaggcgccgcctccagctgtgccaccccctcacctgagtatgcggcgcagcctgggtgagtcctggagggcaggacacacatctccttatcaccgtgtccttattccagggccttgcccaggacagtgcccagagcttgtcatgggggacccagaatggatcatagtacttcattaaggagcaaacaggtgaaatagttaataaagcagaatgtttagagttacttggtcactgaaatttttggagaactttctgttttttatgttgtatattgcaccaacttgttggctattgggaaattcttacgggacattcaaaggcatgaaatgctttcccttggtagttcctccagcagtgtgaccgggaggatctggtggaattggctctgcctcagctggctcaggttgtgaccgtgtatgagtttcttctgatgaaggtgagtactcttagtgtttctaaatgatagcgggatgattagaagttatttagaaataatattattatttattaattatttttcaatagcctgcatagttgttaattttatttttgagacagggtcttgctctgtcgcccagctagagtgcagtggcaccatcgtagctcactgcagcctcaaactgctggtctctagcaatccttccacctcagccttccaagtagctgggactacaggcatgcaccatcatacccggctaatttttaatttatttaaaaaaattttttttgtagagatgggatctagctttgttgcccaggctggtctcaaactcctggcctcaagtaatcctcctgcctcggcctcccaaagtgatgggattataggtgtgagctaccgtgcccagctcatagttgttttggaaagagccaggccatttggaatcgttttccttttgcaggacagctgaagtgagcctgctggtcacacaccgtgcctggtgtgggggccgctgcctgggtagctgggtgtctcgggcaggtgcccgtttactcccttgacttttaacttggtacaggaggaatggaagtggcagccacaaataatggctatcctgggctctcctagaacccactcgccccagctggcctcttctgcccgcggctctgctccttctgagcccactctgaggctgcagcccaggctgcctgtgccccacactccctctggagctgacagtccagccggggctcagggcctttctgccttcccttcccaccctgtccaggagctcacccatgccctacatggcccccacccagggcttgtttgtttcttggcctgctcctcccatgcccatcctggcttctctgcaccatgcggggcacacagtaggtgctcactggggactgaaggaaacgcacaccactgagggctgctgaggggttaaggaaccgaaactttgtttagattttcttctgtattttccatatcagtgccttgagtttaaactttttttttggtctttatcttcacgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggtaacaatctcccatggcagaaagagttttgctcatagagttagccagaagaaagaagggccacgtgcagtggcttatgcttgtagtcccagtgctttgggagactgaggcaggtggatcacttgaggtcaggagtttgagaccagcctggccaacatgacaaaactcagtctctactaaaaatacaaaaattagctgggcgtggtggcacatgcctctaattccagttattcaggaagctgaggcacaagaatcatttgaacctaggaggcagaggttgcagtaagctgagattgcaccattgcactccagcctgggtgacagagactctgtctcaaaaaacaaaacaaaaccaaaaaaaaaaaaaactccatgtatgaaggagaatgtttttagtaatgacattttcctgttcgacctcattttagctttttcccatcaagtgaaaatttttttttctttttgtttttttgggagatggagtcttgctctgtcacccaggctagagtgcagtggtgtgatctcagctcactgtaactgccgcctcccaggttcaagcaattctcctgcctctgcctcccaagtagctgggattagaggcgcacaccaccatgcccagctgattttttgtattttagtagagacagggtttcaccgtgttgcccaggctggtctcgaactcctgagctcaggcagtctgcctgcctcagcctcccaaagtgctaggattacaggtgtgagccaccacatccggtccccagttttttttttcttaaagcaataaatgctcttccagaaaactcaaaaatgaagataagctagaagaaaatggaaaacaccataatcttcccactcactgatgatcagagttaaaacctcaggtatcattttcttctttttttttttttgttttgaaacagggtttccctctgtctcccagactggagtgcagtggcacaatcacagctcaccgcagcctcaaccttctggtcccaaacaatcctcccacataagcctcctgagtagctgggactaccgccgtgtgtcaccatgcccagctaatttttaaatttttcgtagagaaggggtctcgctgtgttgtccactctggtcttgaactccagggctcaactgatcctcccttataggcctcccaaagtgctgggattacaggcatgaaccaccatgcctagccctgttttcttccttatgtgggtttttggggatggattatataggggccattcatttttgtttgtggtggttccgacacaattctcatttcagtgtcattgttattatcaaattgcctttagctacattggattttttggggtgtttttgtttttttgagacagagtctcgctgtcagccaggcttgagtgcaatggtgccatcttggctcactgcaacctcccctcctgggttcaagcgattctcccacctcagcctcctgagtagctgggactacaggtgtgcaccaccatgcccagctaatttttgtatttttagtagagacagggtttcaccgtattggccaggctggtcttgaactcctgacctcaagtgatccgcccgcctcagccttccgaagtgctgggattacaggcataagccaccatgccctgccttattttcttaaattacatatgatgaaaatgtaaaaggtttttgctaagcctcatgtagatgccctccacagcagtcacctgtgtgttttttaaactcttgagtttagcaagtgtgggtatcatcctgctttgaggcggaactcggcacacacacactgtgcctgccctacagaatccggctttttcagcagctcagactgtgccatcgcctcttgggagcatgacagtggctccgtttgtgaggggacaccatccaggttggtccgcgcagaacccacatggcccgttttctcctttaaccttgttctgccgcccttcctgccgtgcccacccccatctcatgctctgtggggttctctttataacatccatgtataaatgataccagctgtctcttagcactttcacatctggtgtttacgtaggcattgcatatggagtcaaatctcatcttcacaaaagcctttccaggtagctgtaacctcttgtctggataagtcagggagatggacaagggagactcaggagatggtggctcaccaagatcacccaggccatgggcagagaagctgggatccagctcaggcccccaagcccatgcctttttaccagctgggaagggagatctgggtgtgggataggcaggatcgtttttctcaagagaccagtgagaagtcagtaaaggagggatagtgggaaagaaagttactatggtatcagctaacattattaagctcgtgatagcattaaagagagtgttttaaatgttttgtaaagactgttctgggctgagcacagtggctcacgcctgtaatcccaacactttgggaggctgaggcgggtggatcacttgaggccagaagttcaagaccagcctggcaaacatggtgaaactccatctttactaaaaatacaaaaattagccaggcatggtggtgcatgcctgtaatcccagctactcaggaggctgaagcaggagaatcacttgaatctgggaagcggaggttgtggtaagccaagatcatgccactgcactccagcctgagcgacagagccagactctgtctcagaaaaaaaaaaaaaaaaaaaaaaaaaagattggtctcctcctctaaattgtgctcacatagaaccttctagtttttataatccatttttatcatcagctagtccatctaacattatattgatcttcatctttctcattgttgagatggcatctcacagtaggtgaggaactttgtagatttaattctatgaagtcgtttaattcttgcatgtgaatgtgcttctgggggtgtgtgctgtttgggtgaagtttattctcttggcccatttcttttcaggttgctgagtcattaggaatcacagaattcctacggaagaaagaaatacacccagacaaccttggacccaagcacctcagccgagacatggatggggagcagctagagggagctagcagcgagaagagggaacgtgaggtgggcatggctgaagtgggtgccaggtgactgtgcacggtgaattagcgtggtttggcttcttctgttcacaccaggaagaggaggtagcggtttgcctattccttcctattctagctgattgggtcttctcttcacaggctgcggaggagggactggcctcagtgaaaaggcccagaagagaagccctgtccaacgataccactgaatctcttgctgccaacagcagaggccgggagaagcccaggcccttgcatgctttggccgctggtgagggtaaaatgctgtttgtggggtgtatccatggcctggcagccctgctgacatgcacagatgtacccaggattgccatttttcaggttgggtgacctgtgctggatttaaggggaccctctggtttctcaagtttcattccagcctcccagtgttctgtcattccagattcattccctgcgagtcttgaggtcttcagggttttctagagtgccttgttaaaatggagagccacaggccaggtgcagtggctcacgcctataatcccagcactttgggaggccgaggtgggcggatcacctgacgtcgggaattcgagaccagcctggccaacatggcaaaaccccgtctctactaaaaatacaaaaaaaactagctgggtgtggtggcgtgtgcctgtaatcccagctacttcggaggctgaggcaggagaattgcttgaacctgggaggcaggaggttgcagtgagccgagattgcaccactgcactccagcctgggtaacagagtgagactccatctcaaaaaaaaaaggagagccaccaaatggtagtaaacaggctataccaggagggtcccaagaggttaggctgagacgggtcccaggacacatccatctatggcttggctttcatgagacttcgctgtacatgccagctgagatttaacatttgaaaacaagacaggtcctggcttttattctggctctagccagaacctatcaactaggcacttaaaaaattatatatataaattttttttttgagacgggagtcgcactttgtcacccaggctggagtgcagtggcacaatctcggctcactgcaacctctgcctcctgggttcaagcaattctactgactcagcctccccagtagctgggattacaggcacccgccatcatgcccggctaatttttttttgtatttttgtagagatggggttttaccattttggtcaggctggtctgaaactcctgactgcaggtgatctgcccacctcggcctcccaaagtgctgggattacaggcatgagccactacgccagcctttttttttttttttgagatggagtcttgctctgtcacccaggctggagtgcaatggcatgatctctgctcactgcaacctctgcctcccaggctcaagcaattctcctgcctcagcctcctgagtagctgggattacaggcgcccaccaccacatctggctaatttttgtatttttagtagagatagggtttccccatgttggccaggctggtcttgaactcctgacctcaaatgatctgcccgcctcagcctcccatagtgctaggattacaggcgtgagcagccaccgtgcccagcctgatggtgattcttaattggggcatgtgttggaaccacctggggaggttattgtgaaatacaggggcctggacctctgggaattccaggtctgcaggtagggttgttgggagggtgtggatgtgagtatttggaaaggcctctttgggtgattctccagctcactctgatgaagaatcaccaatcattcattcagtattggcataaaatcactgttgctgggtgtggtggctcatgcctgtaatcccagcactttgggaggctgagtcgggtggctcacaaggtgaggagtttgagaccagcctgacctacatggtgaaaccttgtctctactaaaaatacaaaaattagctgggcatggtggcgcatgcctgtaatcccagctatcaggaggctaaggcaggagaattgcttgaacccaggaggtggaggctgcagtgagctgaaatcgtgccactgcactccagcctgggtgacagagcgagactccatctcaaaaaaaaaaaaaaaaaaaaagcacactgtcgattggctcttagagcatatttttaatacaaaatctgtctttgtgaatagagaatagggacgtattttttaaaattgctaccaatcccaaggagcaaggagcatcgatgctttgacttttctgcagggcaggtgacttggcctagctggttttgggtggtgagtgcagtgagtgggccatgacacagtacacgccatgttcacctgtttcccaaaatgtttaggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgccctgctgtctacatttttctatggagcttgtcataataatagcagatattacctgatcaggaatccctgtggcgcgtctgacgctcatgagtttttcatgatggtgatgagtagcactgcactgtcacctgatgattggccctgctccgtttcccttctctcctgggagatatgctgcttttccaccagacttgctccatactagaagcttcttttgggttcaattaaaaagaaaataagctagtcattctgggcagcattttattgatagaagggggaaaaagtcatttctacttgcatgattttttaaattaaattaaattaaattaatttaattatttttgagaccaagtcttactctgtagcccaagctggagtgcagtggcgcgatcttggctcactgcaacctctgccgcctgggctcaagcgattctcgtgcctcagcctcctgagtagctgtgactacaggagcatgccaccatgcccagctaattttttttttttgtattttagtagatacggggtttcaccatgttgcccagggtggtctcaaactcttgagctcaggcaatccgcccacctcagcttcccaaagtgctgggattacagtacaggcatgagccactgcacctggccaatgatttttttttttttttttgagatggagttttggtcttgttgcccaagctggagtgcaatggctcgatcttggctcaccgcaacctccaccacagggttcaagcaattctcctgcctcagcctcccaagtagctgggattacaggcatgtgccatcacacctggatca

SEQ ID NO: 657 - DNA, 14433 bp, Homo sapiens
ttctgctcagaaactcattgattttactctgaagcacccacgaatgacagattcccaggaggggcagagaaggctgagcagcaccacgtggggctggccgcgggttgtgggcatgagcacgcctggagaggccatggggctggtgacaagctctggccagaagaccccaaggtctgatcctggggtctgatccaggcctgcggcactgggtcctaggcagactgtctgcctggtgagacgtggaaggagccagtgtccgcagccgtctcaggacgtcagagagctcggtggcctgtctccagcagcatgctctccagatgcagcctgctgtcgctctccacatagggctggtgcagccacatggacaggtagctcagggtgaggtcgggatccccggtgtgggcaagctccttggccaccgtgcgcttcaggagcagctccttcctgtacatctccaagagcttatgcgaaacctcatctgaaagaaacgtgaatctcccttaatggcagtgattcaagaacatagtgtcgacttgggaagaactacattttaacagctcttgattaaaaaccagaatcagcaacagcactgaggggaagaagggcccgatggagtttactactctagctggtgcagattagtacaatttgataacatggtcagcagagtgaaataaaaagtgtatacaagccgggcgtggtggcccacacctgtaatcccagcactttgggaggcccaagtgggtggatcacctgagttcaggagtttgagaacagcctagccatcgtggcgaaaacctgtctctactaaaaaatacaaaaactagccaggtgtggtggcacgcacctgtaatctcagctacttgggaggctgaggcacgagaatcgcttgtgcctgggaggcggaggctgtagtgagccaagattgcaccactacactccagcaggcgtgacagagcgagactctgtctcaaaaaaagtatatataaccttttctacttgactcttaggtgacctacagtgattatcagtaggagattcccctcaaactgacaatatttcactaaacacattccactaggtgattttaccctttcctgccttatttaaaaagtctcaggtcaacatcaaatagcttacccttgtcttgaactaataaaagctaaaagtaaccctttaagaagcgcctcatagagtttactgaagccatgggtttcatttttcccagtcatcttccatgaggttggctgcagtgaccctcaatttgttttttaattaaaacaaaaaacaaaagaaaaacctcaacaaaccaaaaaaactcctttcttcctttccccccctcaaaatgagagatatctgcttccacagaggaggtggaattcactctgcccattggttttagaggcctaataacagcagcttgcttcacgggtctctatgtttcatatactctgctgataaccaggtaattaaagccaagaagaaatgtttaagatgcctctgtctcctttcctcccgatacttttgcattgaatttgaaagccttgtcagcttcttaaagtaccagatgtaaacgatactaaatgcccttaataacctttaccctcctgaaaatcaactgagaaggaactacttacagaaatgggttgtaggccacgtgtggaacagagggggtcgtttactctcctccccataatggtagttttctagttcacaaattcccttggtagttgaagacagcttttccattttcacctgtattttggtctgaaagatatccatttggaatatgataatattatttgaaatctccagtctcagatttaataactctaagatttcaaagctaagaagtgtaagtctattatgataaaaattccaataactaaacactgttaactctacgtacagcaaattcccagggagatgaaggtggacagttgctatgatttcattaatttgaatgactttggtaataaaccccagatttccagtcctagagcaagaaaggtttccgagtgccatttcactaggatttccaaacagcattaatgtcttagacccaaagacctggaggaatcccaaggcaggctcttgctgcctttttttttttttctttttttttttgcgacagggtctcattctgtgtggcatgatcatgccttatgcagcctcaaccgctggcacctcagcctcccaagtagctgggatcacaggtgtgcaccaccacacccagctaattttttttaatttgtggagacagggtctcgttatgttgcccaggctggtctctaactcctgggctccagcaatcctcccgcctcagcctcccaaagtgctgggattatacaggcatgcgccaccgcgcctggctggctcttgctgcttttaagaagtgagagagaaaggcatcaaatgagctcgtttctgatgctctctctctctctcttttatcaaatgagctcgtttctgaggctctctgtctctctatcaaatgagctcgtttctgatgttctctctctctctcttttttttttttttttttgagacggagtcttgctctgttgccaagctggagtgcagtgccaggctggagtgcagtggcgagatctcggttcactacaacctctgattccctggttcaagcgattctcctgcctcagcctcccaagtagctgggattgcaggcatgtgccaccacgcccagctaatttgtgtatttttagtagagacggggtttcaccatgttggccaggctggtcttgatctcctgaactcgtgatccgcccacctcggccgcccaaagtgctgggattctaggcatgagacaccgcaccaggcctgactctctcttattaactgcctttatttacggaaacctccttgacttccttgtttataaaatggcaacacagaaagggagccctacacacttcacgcagaaaggaaggaaacgtggcaagctgccattgacggtccctcagtgtggaccaggctctgtcctaagccctgtaactgcatgatgtgtatggctacttgtgggagacactaaaccaaccccactgcacacaccaggcagcacagaataggggcaatggcgggcttactttcacagcttggtgaagaggattaagtgagttagtatttgtgaagcacctacttggagatatataagggttggataaagaaaattaatgggtgaagtaactaggatttcagatttaagtagcataggtctataaagaccaaattttgaactcctaagtatagttgactttacatacataaatatgaaaaaggggaaataagaaaagatatataaattgtcaaatatcttaattcctttacttggtccttccaaccaccctccaattacattggaagtggcaagcactaaattcagctaacgttaatttttaaaggactttacttaagtagtttcccaaatcttttaaggtttgatattttatttggcccaaccccaagaggcaggacttgtcatttccgtttcacagctgggaaattgcttaaggttgagctgaggaaggatgaggccagaactcgataccatgccttctgacaccaagtttttttgtttttgtttttgtttttgttttttttgagacagagtctcgctttgtcacccaggctggagtgcagtggcgcgatctccgctcactgcaacctccgcctcccgggttcatgccattctcctgcctcagcctcccaagtagctgggactacaggcgcccgccactgtgcctggctaatttttttggtacttttagcagagctggggtttcactgtgttagccaggatggtctcgatctcctgaccttgtgatccgcccacctcagcctcccaaagtgttgggattccaggcgtgagccaccgcgcccagccgacaccaagttttaacacccaatcctctgctctttcctgtgagtcctgcagcagctccctggtgccacctgattctaagaaaagctgataacaggagactaaggaaaattctggagccttgaccccaggcaagaagtcatgctcaatcctgcagctcagccatcaataaagaattcaagtcacataggcacgtgcagccctgaatgaacagtgcataaacagcaggcccttacatttcaacatcggtggcttcttcccacagcaaacacagaccacagtgaaatgttagcccagcttaggaagaacggtgcatgaaacccccagaaggtcaaagttatgaaagacacagaccaggtctggaaaccattctctataacggatagaggaaaataggaaaaataataataccctataaaatcaacttttggttttgaacatagaatgagaacttattcccaaaccacttttctttttctttttttcttttttttgacacggagtctcactctgtggcccagactggagtgcagtggcttgatctcggctaactgcaacctccgaaagtgattctcccgcctcagcctcccaagtagctgggattgcaggcacctgccaccacccccagctaattttttgtatttttagtagagatggggtttcactatgttggccatgctggtctcaaactcttgacctcaggtgatccacctgcctcggcctcctagagtgctgggattacaggcatgagccactgcgcctggccaaaacaaaaattaaaaaaaaacaaataaaaatacaacaattagctgggtgtggtggcaggcacctgtaatcccagctacttgggaagctgagacaggagaatcacttgaacccaggaggcagaggttgcagtgggcagagatcaccccactgcactccagcctgggcaacaagagtgaaactccatctcaaaaaaaaaaaaaattaacaaatgggagggagggaacaaatctcccacgcagaataattccaaataatttatgtagatactgcaccctcaagcaggtggtgaatacgtccctacccccaggtgtgggctatgcatagtgacttcctgccaaagagcacagcgtgggaggaggagaaagagcaacgtcacagcagaggaacctggaaacactgcccagccaggtgatcaaggtcaacttcagcagtggaaagtcctggctgtgcacagtggctcacgcctggaatcccagcactttgggaggctgaggtgggagcactgcttgagcccaggagtttgagaccagcccgggcaataggtgggacccaaagaaaagtcctgatgacagtatatccagtacgtgcccttgatatgacatgatagaaatggcactttacttctgtggtcctcctctgaacaaaacccgtaacctcagtctaattaggagaaaaacatcagataaatctcatgatgttctacaaaatacctgaccagtatccctcaacattgtcaaagtcatcaaaaacagggaagtctgagaaactgtcacggccaaaaggagcctgaggaaacaaggggactcgatgtcatacaggatcctgaagccaaaacaagacatgacggaaaagctaaggcagggcgccagggctcacacctgtgatcccagcactttgggaggccaaggtgggaagatcacttcatgtcaggagttcgagaccagcctggccaacatgagaaccccgtctgtacaaacgaattttaaaaattagccgggcatgatggttcatgcttgtagtcccagctactcgggaggctgaggcaagaagatcacttaagcccaggaagtaaaggctgcagtgagctgtgatcatactactgcattccacagcgagaccttgtctccaaacaaacaaaaaggtgaaaatataaagatcttaaatgtttatgggtaagcttcagttatccaagttcaaatatgtgtaaaacctgatttcctgtgcctagcaaagaaataaggtggtgttatcttcacatctggtggccagtatggtaggtattgaaatttagttattagttcattaaacaaacactttagtctcttacgtgctgtatcagggatgggcaaactatccctggaacacaggtcaattctggcccatagcctatttctgtatggcccataagctaagatggtttttacatttttaaatggttgaaaataaccaaaaggacaatagtgattgtgactcataaaaattatacaaaattctaatttcggtgtccaaagataaagatttcctggacgaacatggtggctcacgcctgtaatcccaacactttgggaggctgaggtgggtggatcacttgaggccaggacttcgagaccagcctggccaacatggtgaaaccccatctctactaaaaatacaacaattagctgggcatggtggcgcacacctgcgatcccagctatgtggaaggttgaggcacaagaattgcttgaacccaggaggcggaggttgcagtgagccaagatctcgccactgcactccatccagcctcagtggcagagtgaggccctgtctcaaaaaaaacaaaaacaaaaacaaaaaaggccaggtgcggtgactcacgcctgtaatcccagcagtttgggaggccaaggcaggctgatcacttgaggtcaggagttcgagaccagcctggtcaacatggtgaaatgctgtctctactaaaaatacaaaaattagctcatgtggtggcacgagcctgtaatcccagctacctgggaggctaaggcagcagaatcacttgtacctgggaggcggagtttgcagtgagccaagatcatgctactgtactccaccctgggtatcagaatgagactccatctcaaaaaaaaaaaaaaagaaaatccaaaaaacaaagataaagttttcatggaatgcagccacatccatttacgcatatattatctatggctgtttagtcctatgtggcagagatgagtagctgagatagagactggctggccctggaagcctaaaatatttactctgtggctgggcgtggtagctcatgcctgtaatcccagccctttgggaggccagcaggtggatcacctgaggtcaggagtttgagatcagcctgaccaatatggtgaaaccctgtctcaactaaaaatgcaaaaattagccaggcatggtggcggacgcctgtagtcccagctactctggaggctgagacaggagaatcgcttgagcccaggaggcggagtttgcggtgagccaagatcacgccattgcactccagcctgggcgacaaagcaagactccatatcatggaaaaaaaaaaaaaatttactatgtgatgagccctgaaagtgggtgacatttccccggatgacgcacaggaggagtgagtgtctaagacagcatcttggggaacattaaggtttacgcagcaggcagaggaagagaacatcagaggagactgagaaggagtaagtgatggccaatggtcaagcaaaccccaaatacgtccatcggattcagtgacagtgaccacaagtggcctgcgtctttatgtcttaccaacccatccaaggtggcctgcagttcctcacacagcttctccagttcctcgttatattccagacacaccttttcttcattttccttcgaggctgggctgctgctgtctagttctatcttgtctttattcctaaacaaaatagaaaataatgtgtacaaaatatactctttaagcttgccttatttccttataataaattctacaaacctctatatccacatagttacgtgggacattttgcataagcattgttctttcatatcattatgatacaaatgcagttattatttatatgtgcaatgaatatgtccattggtcactcaattttgcaccaaaataagtcagttaaattcagccatgtgacagccggttttggtggctcatgcctgtaatcccaacactttgagggatggacgcgggaggactgcttgagtccaggagtctgagtccagcctgggcaacacagtgagacctcatctccacaaaaattaaaagtaaaaattagctgggcatggtgggacacgtatgtggtcccagctacttaggaggctcaggtgggaggatcacttaagcccaggaagtcaaggctgcagtgagccattatagcaccactgcactcagcctgcacaaaagagcaagactgtctcaaaaaaaaaaaaaacaccattcagcggtgtggcatccttggcatagggcatggtgctggatgtacaaagatgaataagacatggatcatttcctcaaagagttcacaatccaggaatataggcacgcctcattttattgtgcttcaccttattcagtttcatagataatgcattttttacaaattgaaggtttgtggcaaccctctgtatgtagagcaagtcaatcagcaccattttgccaacagcatgtgcttacttcatgtctctctatcatattttggtaattcttacaatatttcaaactttttcattattatgtctatgatctgtgattggtaatctttgatattgctagtttaattgttttgaggtgccatgaaccatgtgcatatataacggcaagcttaatgaatggatgttgtgtgttctgactgctccactgaccggctgctcccctttctccccatctccttgggcctccctgttccctgaaataggaggatactgaaatcaacccaattaatagccctacattggcctctaagtgtacaagtgaaaggaagagttgcatatctctcattttaaatcaaaagctatactttggccaatttaagaaacaaaaaaattaaaagctagaaatgattaagcttagtgaggaaggcatgtcaaaagctcagataaggggccaggtgcggtggctcacgcctgtaatcctagcactttgggaggccaaggcgggcagattgcctgagctcaggaattcaagaccagcctgggcaacatgtgaaactccgtctctactaaaatacaaaagaaattagctgggcgtggcggtgtgcacctgtagtcccagctacttgggaggcaaaggcaggagaattgcttgaacccgggaggcagaggttgcagtgagccaagattgcaccattgcactccagcctgagcgacagagcgagactccatctctacaaaaaaaaaaaaaaaaaagctaagataagctgaaaaccaggcctcttgtgccaaacagttggccaagttgtgaaggcaaaggaaaagttactgaagaaaattaaaggtgctactccagtgaacatgtgaatgatgagtgaaacagccttagtgtggatatggagaaagtttgagtggtctggatagaagatcaaaccagacacagcattcccttaagtcaaagcctaatccacagcaggaccctaactctcttcaattctgtgaaggctgagagatatgaggaagttacagaagaaaagtttgagatagcaggatttggttcatgaggtttaaggacaaaagccatctccataacataaaagtgcaaggtgaagctgcaagcgctaatgtagaagctggagcaagttatccagaagatctacttaagatcagtgatgaaggtggctacatgatacaacagattttcagtgtagatgaaacagccttctattagaagaacatgccatccaagacattcacaactacagagaagtcaatgacaggcttcaaagcttcaagagacaggctcaccctcttattaggggatattgcagttagtgactttaagttgaatccaatgctcatttaccattctcaaattcctagggcccttaagaatgatgttaaatctactctgccagtggaaaaagcaagagaaccagaactggaagtggggtctgaagatggaactgaattgctgcaatctcatgagaaaacttgaacagataaggaattgtttcttatggatgagcaaagaaggtggtttcttgagatggaatctattcctgggaaagacactgtgcacactgttgaaatgacaacaaaagattgagaatattatataacttagttgataaaccagtgtgagaggtctaatgtgggtaaacactattaaacagcaatgagaaagaacagaaccagaatagtggctctacattacacgcatggcttccatgttgaaagacagtgagacatggctgggcgcagtggctcatgcctgtaataccggcatttagggaggccaaggtgggcagatcacttgaggtcaggagtttgagactagcctggccaacatggtgaaactctgtctctactaaacatacaaaaattagccgggcatggtggcaggtatctgtaattctagctactcaggaggctgagacaggagaaccacttgaacctgacaggcagaagttagagtgagccaagatcacgccattgcactccagcctgggggatagagtgagactcgtctccaaaaataaaaaataaaaaatagaaaaagaaagtgagatataaaggaaacaataacatatgttttttgtttacgtaaaatccaaaaatggatgaaaagaattcatggtagttttttccatatcagctaggtaatgtgccaacatcatagcaaagtttgaggaaggcacaggtcatacatgagcatgaaaacccaatcattatgcctatgaactacaaaagaatcaaagaatctgtggttttaaaaatcagaatagccaggcacggtggctcacacagcactttgggaggctgaggcaggtggatcacgtaaggtcaggagttcgagaccagcctaacatggtgaaagcccgtctctactaaaaatacaaaaattatctgggtgtggtgacgggcgcctgtaatcccagctactccggaggctgaggtaggagaattgcttgaacccaggcggtagaggttgcagtgagctgagatcgcgccatcacactccagcctaggcaacagagtgagacttcatctccaaaaaaataaataaataaataactaaatatatatatatatatatatatatatggaatataattttgtatttaaaatgtacaatacaatttatacttacacgtatcatcttaccacttgctttttttgcttaatattttattttaaaatttattcacattatttccccagttattaagggtgaaaaacttagagcatgaaaaaccaatatgtacttacaataaactgattttcaagttggcaatattatttgcagtggtaaaacctgcatcattgagggtttcccacttcaggattaaattgtgccaatcagccgcattgtccttaatttttcttgcactgacagataagacaggttttctgggcgttacagttccaagagtctttgctgatagggtataaaagaaacaaaattattatcatggaatatacaatcatagttggagggcaaatgtccttataattttcaacagtaaaactatctgaaatgctgtatcaactggacaaataaatgtggaaactacaaagtctgaatgaatgtgaaagttcctggaagaagacaatatagaatatttttaacattttaaaattcaccagatagagctgaatcctcttccagcttaatggctccacaaagtttttaccttaagccctttgttttccaaagattggaaataaggtaaagttgtgactgtctgctaaaactcttcaatggctcacgttcccttccctacaggataatctagccctgactcccgagtacttccactatctagtctcaggcactctgatactttaaatttgctcagagtagcgtggcccatgagtgctaatcatttcaagacactgagacaacagagatgcagagttgatcacgatgctgccactgcccttcttggtaatcaggaggaagtccaaaatccttccagacctagctacccctccacatcatcacgtacatcaacccacaccttggccccccgtcaatatccagcgaaaatgaactactggcagctcttgaaaagctgaggtgcctgcaggcctttacacgtgttctctctgcaggaaagctccttccttcctcaggctcacgatgcccatcctccaagatgcacccggatcccactgcctgtaggaagcaacccccagaccaccaagagccaactcaggttgtttgttctccccgaaccctcctgtgccctcttgccttctctactttgaaccccacaaaggcttctcactgcccacaggataaagtcctcttgaggaatccaggacacacaacagctggatggtttgatgcctcaagtcagaagaccacactgcctgcgtctgaaccccagctcgccagctgtgagatcttgggcaacttaatgtacctttcagagcctcaacattttcatctgtaaaatgggaataaaaatagtatctatttcataggattgctgagattagataatatatgtgaagctgtgaggcctcgcacaaggcaaaaacccagtatctcacctgttagctcaagggcctctactatccaagctctgcccaccacttcagcttctaccctttcccacttgccctctgtgcatcagagctggctctgtacaagttctgactttgacctggaatatttttcctatctgtgtgtgtccccactcccctgcctcatacttagtatcctcactttaaaatatcatcttgatttatcattcattctttacttaaacaacaaatatttgcttactgcctacaatacgccaggcatgggggaatgaagtgattgaatgagacggaccaggaccgttttcatggaacttactttccaaaggggaggcagataataaacaaatgaccacgatcagttcagatcatgattaagtgtgtgtggaaaataaaacagggtcttgtgttagtgtgatcccctgagaaggtgtcgtttaggctgagatttgaatgatgaaaagccagaaatagggtaggtcagtagtatgtgccctaattatgataatgaggttggtgagttcaaaaaacagaaaacaaaacaaaacaaacaagcaaacaaaaaaaccagtgtgctggaatgaaatagacagaaaaggactagtgcgtgagtaggtgatcagacaactagaacctaataggccaagataagaagttggaccgagggcagtggctcacgcctgtaatcccagcacttcaggaggccaaggcgggcggatcacgaggtcaggagatcgagaccatcctggctaacacagtgaaacctcatctctactaaaaaaatacaaaaaatcagccgggcgtggtggcgggcgcctgtagtcccagctactcaggaggctgaggcaggagaatggcgtgaacccgggaggcggaacttgcagtgagcccagatcgcgccactgcactccagcctgggtgacagagcgagactccgtctcaaaaacaaaacaaaacaaaacaaaacaaaacaaaataaaaaaatgaagtttggacttctaagtattagcttggtgcaaaagtaacagattttgccattacttttaacagccaaaattgccattacttttgcaccaacctaatacaatggggagtgagcaatgagctctggatagggcagtgaaattatctgatttaggtttttagaaagtcatttccacagagaagtattcctggatcccccaggttgggttacgactcaccactagatatgtggtacaccctataattctgctatcatgatattcaccagtggagtgtatttgcttgtttaatgtctatattccctgctaaactggaaattcgactagggtaggaactatgtctcgttctctttcaaaccttccacacataggaggctttgcataaaatgaggtaaatggaggaatagctcttaccacctgttctataattgtctaagggttttccccccaacaggagattctgagggcaggatcacatctgattcatggtcagcctgactcatacggggcacatatttaggaaccaaaaacataactgacttcaagaaactcaagggctggtaaagacagaccagtcatcagcgtcacaggacagggtagggtgagggcacagtggctaagttacttatcccctctgagcctcgattccccatctgcaaaatggggttgacattacttcatgggaccactgtgaggttcaaatgagatgatccacttaaagtgcttggagcagtactcagcaaactgagcactaggcgaaagccagctttcattacaagcagaatgttctgactgagggcagttcagagaggagtttctggacgagatgagcatgcaaggcttggtacccagtgaactctgttagtactaatttatagtgacaataattacaatttggatgtcggatctgctgacactcatttgcgtatatcgtcccgttcatctgtcactgcacatgtgaaaaaacggaggctcggcaaaactgtctcccgagcagctcgcagaggctgcgaggggcctgcgggctaggct

SEQ ID NO: 658 - DNA, 14635 bp, Homo sapiens
ttctgctcagaaactcattgattttactctgaagcacccacgaatgacagattcccaggaggggcagagaaggctgagcagcaccacgtggggctggccgcgggttgtgggcatgagcacgcctggagaggccatggggctggtgacaagctctggccagaagaccccaaggtctgatcctggggtctgatccaggcctgcggcactgggtcctaggcagactgtctgcctggtgagacgtggaaggagccagtgtccgcagccgtctcaggacgtcagagagctcggtggcctgtctccagcagcatgctctccagatgcagcctgctgtcgctctccacatagggctggtgcagccacatggacaggtagctcagggtgaggtcgggatccccggtgtgggcaagctccttggccaccgtgcgcttcaggagcagctccttcctgtacatctccaagagcttatgcgaaacctcatctgaaagaaacgtgaatctcccttaatggcagtgattcaagaacatagtgtcgacttgggaagaactacattttaacagctcttgattaaaaaccagaatcagcaacagcactgaggggaagaagggcccgatggagtttactactctagctggtgcagattagtacaatttgataacatggtcagcagagtgaaataaaaagtgtatacaagccgggcgtggtggcccacacctgtaatcccagcactttgggaggcccaagtgggtggatcacctgagttcaggagtttgagaacagcctagccatcgtggcgaaaacctgtctctactaaaaaatacaaaaactagccaggtgtggtggcacgcacctgtaatctcagctacttgggaggctgaggcacgagaatcgcttgtgcctgggaggcggaggctgtagtgagccaagattgcaccactacactccagcaggcgtgacagagcgagactctgtctcaaaaaaagtatatataaccttttctacttgactcttaggtgacctacagtgattatcagtaggagattcccctcaaactgacaatatttcactaaacacattccactaggtgattttaccctttcctgccttatttaaaaagtctcaggtcaacatcaaatagcttacccttgtcttgaactaataaaagctaaaagtaaccctttaagaagcgcctcatagagtttactgaagccatgggtttcatttttcccagtcatcttccatgaggttggctgcagtgaccctcaatttgttttttaattaaaacaaaaaacaaaagaaaaacctcaacaaaccaaaaaaactcctttcttcctttccccccctcaaaatgagagatatctgcttccacagaggaggtggaattcactctgcccattggttttagaggcctaataacagcagcttgcttcacgggtctctatgtttcatatactctgctgataaccaggtaattaaagccaagaagaaatgtttaagatgcctctgtctcctttcctcccgatacttttgcattgaatttgaaagccttgtcagcttcttaaagtaccagatgtaaacgatactaaatgcccttaataacctttaccctcctgaaaatcaactgagaaggaactacttacagaaatgggttgtaggccacgtgtggaacagagggggtcgtttactctcctccccataatggtagttttctagttcacaaattcccttggtagttgaagacagcttttccattttcacctgtattttggtctgaaagatatccatttggaatatgataatattatttgaaatctccagtctcagatttaataactctaagatttcaaagctaagaagtgtaagtctattatgataaaaattccaataactaaacactgttaactctacgtacagcaaattcccagggagatgaaggtggacagttgctatgatttcattaatttgaatgactttggtaataaaccccagatttccagtcctagagcaagaaaggtttccgagtgccatttcactaggatttccaaacagcattaatgtcttagacccaaagacctggaggaatcccaaggcaggctcttgctgcctttttttttttttctttttttttttgcgacagggtctcattctgtgtggcatgatcatgccttatgcagcctcaaccgctggcacctcagcctcccaagtagctgggatcacaggtgtgcaccaccacacccagctaattttttttaatttgtggagacagggtctcgttatgttgcccaggctggtctctaactcctgggctccagcaatcctcccgcctcagcctcccaaagtgctgggattatacaggcatgcgccaccgcgcctggctggctcttgctgcttttaagaagtgagagagaaaggcatcaaatgagctcgtttctgatgctctctctctctctcttttatcaaatgagctcgtttctgaggctctctgtctctctatcaaatgagctcgtttctgatgttctctctctctctcttttttttttttttttttgagacggagtcttgctctgttgccaagctggagtgcagtgccaggctggagtgcagtggcgagatctcggttcactacaacctctgattccctggttcaagcgattctcctgcctcagcctcccaagtagctgggattgcaggcatgtgccaccacgcccagctaatttgtgtatttttagtagagacggggtttcaccatgttggccaggctggtcttgatctcctgaactcgtgatccgcccacctcggccgcccaaagtgctgggattctaggcatgagacaccgcaccaggcctgactctctcttattaactgcctttatttacggaaacctccttgacttccttgtttataaaatggcaacacagaaagggagccctacacacttcacgcagaaaggaaggaaacgtggcaagctgccattgacggtccctcagtgtggaccaggctctgtcctaagccctgtaactgcatgatgtgtatggctacttgtgggagacactaaaccaaccccactgcacacaccaggcagcacagaataggggcaatggcgggcttactttcacagcttggtgaagaggattaagtgagttagtatttgtgaagcacctacttggagatatataagggttggataaagaaaattaatgggtgaagtaactaggatttcagatttaagtagcataggtctataaagaccaaattttgaactcctaagtatagttgactttacatacataaatatgaaaaaggggaaataagaaaagatatataaattgtcaaatatcttaattcctttacttggtccttccaaccaccctccaattacattggaagtggcaagcactaaattcagctaacgttaatttttaaaggactttacttaagtagtttcccaaatcttttaaggtttgatattttatttggcccaaccccaagaggcaggacttgtcatttccgtttcacagctgggaaattgcttaaggttgagctgaggaaggatgaggccagaactcgataccatgccttctgacaccaagtttttttgtttttgtttttgtttttgttttttttgagacagagtctcgctttgtcacccaggctggagtgcagtggcgcgatctccgctcactgcaacctccgcctcccgggttcatgccattctcctgcctcagcctcccaagtagctgggactacaggcgcccgccactgtgcctggctaatttttttggtacttttagcagagctggggtttcactgtgttagccaggatggtctcgatctcctgaccttgtgatccgcccacctcagcctcccaaagtgttgggattccaggcgtgagccaccgcgcccagccgacaccaagttttaacacccaatcctctgctctttcctgtgagtcctgcagcagctccctggtgccacctgattctaagaaaagctgataacaggagactaaggaaaattctggagccttgaccccaggcaagaagtcatgctcaatcctgcagctcagccatcaataaagaattcaagtcacataggcacgtgcagccctgaatgaacagtgcataaacagcaggcccttacatttcaacatcggtggcttcttcccacagcaaacacagaccacagtgaaatgttagcccagcttaggaagaacggtgcatgaaacccccagaaggtcaaagttatgaaagacacagaccaggtctggaaaccattctctataacggatagaggaaaataggaaaaataataataccctataaaatcaacttttggttttgaacatagaatgagaacttattcccaaaccacttttctttttctttttttcttttttttgacacggagtctcactctgtggcccagactggagtgcagtggcttgatctcggctaactgcaacctccgaaagtgattctcccgcctcagcctcccaagtagctgggattgcaggcacctgccaccacccccagctaattttttgtatttttagtagagatggggtttcactatgttggccatgctggtctcaaactcttgacctcaggtgatccacctgcctcggcctcctagagtgctgggattacaggcatgagccactgcgcctggccaaaacaaaaattaaaaaaaaacaaataaaaatacaacaattagctgggtgtggtggcaggcacctgtaatcccagctacttgggaagctgagacaggagaatcacttgaacccaggaggcagaggttgcagtgggcagagatcaccccactgcactccagcctgggcaacaagagtgaaactccatctcaaaaaaaaaaaaaattaacaaatgggagggagggaacaaatctcccacgcagaataattccaaataatttatgtagatactgcaccctcaagcaggtggtgaatacgtccctacccccaggtgtgggctatgcatagtgacttcctgccaaagagcacagcgtgggaggaggagaaagagcaacgtcacagcagaggaacctggaaacactgcccagccaggtgatcaaggtcaacttcagcagtggaaagtcctggctgtgcacagtggctcacgcctggaatcccagcactttgggaggctgaggtgggagcactgcttgagcccaggagtttgagaccagcccgggcaataggtgggacccaaagaaaagtcctgatgacagtatatccagtacgtgcccttgatatgacatgatagaaatggcactttacttctgtggtcctcctctgaacaaaacccgtaacctcagtctaattaggagaaaaacatcagataaatctcatgatgttctacaaaatacctgaccagtatccctcaacattgtcaaagtcatcaaaaacagggaagtctgagaaactgtcacggccaaaaggagcctgaggaaacaaggggactcgatgtcatacaggatcctgaagccaaaacaagacatgacggaaaagctaaggcagggcgccagggctcacacctgtgatcccagcactttgggaggccaaggtgggaagatcacttcatgtcaggagttcgagaccagcctggccaacatgagaaccccgtctgtacaaacgaattttaaaaattagccgggcatgatggttcatgcttgtagtcccagctactcgggaggctgaggcaagaagatcacttaagcccaggaagtaaaggctgcagtgagctgtgatcatactactgcattccacagcgagaccttgtctccaaacaaacaaaaaggtgaaaatataaagatcttaaatgtttatgggtaagcttcagttatccaagttcaaatatgtgtaaaacctgatttcctgtgcctagcaaagaaataaggtggtgttatcttcacatctggtggccagtatggtaggtattgaaatttagttattagttcattaaacaaacactttagtctcttacgtgctgtatcagggatgggcaaactatccctggaacacaggtcaattctggcccatagcctatttctgtatggcccataagctaagatggtttttacatttttaaatggttgaaaataaccaaaaggacaatagtgattgtgactcataaaaattatacaaaattctaatttcggtgtccaaagataaagatttcctggacgaacatggtggctcacgcctgtaatcccaacactttgggaggctgaggtgggtggatcacttgaggccaggacttcgagaccagcctggccaacatggtgaaaccccatctctactaaaaatacaacaattagctgggcatggtggcgcacacctgcgatcccagctatgtggaaggttgaggcacaagaattgcttgaacccaggaggcggaggttgcagtgagccaagatctcgccactgcactccatccagcctcagtggcagagtgaggccctgtctcaaaaaaaacaaaaacaaaaacaaaaaaggccaggtgcggtgactcacgcctgtaatcccagcagtttgggaggccaaggcaggctgatcacttgaggtcaggagttcgagaccagcctggtcaacatggtgaaatgctgtctctactaaaaatacaaaaattagctcatgtggtggcacgagcctgtaatcccagctacctgggaggctaaggcagcagaatcacttgtacctgggaggcggagtttgcagtgagccaagatcatgctactgtactccaccctgggtatcagaatgagactccatctcaaaaaaaaaaaaaaagaaaatccaaaaaacaaagataaagttttcatggaatgcagccacatccatttacgcatatattatctatggctgtttagtcctatgtggcagagatgagtagctgagatagagactggctggccctggaagcctaaaatatttactctgtggctgggcgtggtagctcatgcctgtaatcccagccctttgggaggccagcaggtggatcacctgaggtcaggagtttgagatcagcctgaccaatatggtgaaaccctgtctcaactaaaaatgcaaaaattagccaggcatggtggcggacgcctgtagtcccagctactctggaggctgagacaggagaatcgcttgagcccaggaggcggagtttgcggtgagccaagatcacgccattgcactccagcctgggcgacaaagcaagactccatatcatggaaaaaaaaaaaaaatttactatgtgatgagccctgaaagtgggtgacatttccccggatgacgcacaggaggagtgagtgtctaagacagcatcttggggaacattaaggtttacgcagcaggcagaggaagagaacatcagaggagactgagaaggagtaagtgatggccaatggtcaagcaaaccccaaatacgtccatcggattcagtgacagtgaccacaagtggcctgcgtctttatgtcttaccaacccatccaaggtggcctgcagttcctcacacagcttctccagttcctcgttatattccagacacaccttttcttcattttccttcgaggctgggctgctgctgtctagttctatcttgtctttattcctaaacaaaatagaaaataatgtgtacaaaatatactctttaagcttgccttatttccttataataaattctacaaacctctatatccacatagttacgtgggacattttgcataagcattgttctttcatatcattatgatacaaatgcagttattatttatatgtgcaatgaatatgtccattggtcactcaattttgcaccaaaataagtcagttaaattcagccatgtgacagccggttttggtggctcatgcctgtaatcccaacactttgagggatggacgcgggaggactgcttgagtccaggagtctgagtccagcctgggcaacacagtgagacctcatctccacaaaaattaaaagtaaaaattagctgggcatggtgggacacgtatgtggtcccagctacttaggaggctcaggtgggaggatcacttaagcccaggaagtcaaggctgcagtgagccattatagcaccactgcactcagcctgcacaaaagagcaagactgtctcaaaaaaaaaaaaaacaccattcagcggtgtggcatccttggcatagggcatggtgctggatgtacaaagatgaataagacatggatcatttcctcaaagagttcacaatccaggaatataggcacgcctcattttattgtgcttcaccttattcagtttcatagataatgcattttttacaaattgaaggtttgtggcaaccctctgtatgtagagcaagtcaatcagcaccattttgccaacagcatgtgcttacttcatgtctctctatcatattttggtaattcttacaatatttcaaactttttcattattatgtctatgatctgtgattggtaatctttgatattgctagtttaattgttttgaggtgccatgaaccatgtgcatatataacggcaagcttaatgaatggatgttgtgtgttctgactgctccactgaccggctgctcccctttctccccatctccttgggcctccctgttccctgaaataggaggatactgaaatcaacccaattaatagccctacattggcctctaagtgtacaagtgaaaggaagagttgcatatctctcattttaaatcaaaagctatactttggccaatttaagaaacaaaaaaattaaaagctagaaatgattaagcttagtgaggaaggcatgtcaaaagctcagataaggggccaggtgcggtggctcacgcctgtaatcctagcactttgggaggccaaggcgggcagattgcctgagctcaggaattcaagaccagcctgggcaacatgtgaaactccgtctctactaaaatacaaaagaaattagctgggcgtggcggtgtgcacctgtagtcccagctacttgggaggcaaaggcaggagaattgcttgaacccgggaggcagaggttgcagtgagccaagattgcaccattgcactccagcctgagcgacagagcgagactccatctctacaaaaaaaaaaaaaaaaaagctaagataagctgaaaaccaggcctcttgtgccaaacagttggccaagttgtgaaggcaaaggaaaagttactgaagaaaattaaaggtgctactccagtgaacatgtgaatgatgagtgaaacagccttagtgtggatatggagaaagtttgagtggtctggatagaagatcaaaccagacacagcattcccttaagtcaaagcctaatccacagcaggaccctaactctcttcaattctgtgaaggctgagagatatgaggaagttacagaagaaaagtttgagatagcaggatttggttcatgaggtttaaggacaaaagccatctccataacataaaagtgcaaggtgaagctgcaagcgctaatgtagaagctggagcaagttatccagaagatctacttaagatcagtgatgaaggtggctacatgatacaacagattttcagtgtagatgaaacagccttctattagaagaacatgccatccaagacattcacaactacagagaagtcaatgacaggcttcaaagcttcaagagacaggctcaccctcttattaggggatattgcagttagtgactttaagttgaatccaatgctcatttaccattctcaaattcctagggcccttaagaatgatgttaaatctactctgccagtggaaaaagcaagagaaccagaactggaagtggggtctgaagatggaactgaattgctgcaatctcatgagaaaacttgaacagataaggaattgtttcttatggatgagcaaagaaggtggtttcttgagatggaatctattcctgggaaagacactgtgcacactgttgaaatgacaacaaaagattgagaatattatataacttagttgataaaccagtgtgagaggtctaatgtgggtaaacactattaaacagcaatgagaaagaacagaaccagaatagtggctctacattacacgcatggcttccatgttgaaagacagtgagacatggctgggcgcagtggctcatgcctgtaataccggcatttagggaggccaaggtgggcagatcacttgaggtcaggagtttgagactagcctggccaacatggtgaaactctgtctctactaaacatacaaaaattagccgggcatggtggcaggtatctgtaattctagctactcaggaggctgagacaggagaaccacttgaacctgacaggcagaagttagagtgagccaagatcacgccattgcactccagcctgggggatagagtgagactcgtctccaaaaataaaaaataaaaaatagaaaaagaaagtgagatataaaggaaacaataacatatgttttttgtttacgtaaaatccaaaaatggatgaaaagaattcatggtagttttttccatatcagctaggtaatgtgccaacatcatagcaaagtttgaggaaggcacaggtcatacatgagcatgaaaacccaatcattatgcctatgaactacaaaagaatcaaagaatctgtggttttaaaaatcagaatagccaggcacggtggctcacacagcactttgggaggctgaggcaggtggatcacgtaaggtcaggagttcgagaccagcctaacatggtgaaagcccgtctctactaaaaatacaaaaattatctgggtgtggtgacgggcgcctgtaatcccagctactccggaggctgaggtaggagaattgcttgaacccaggcggtagaggttgcagtgagctgagatcgcgccatcacactccagcctaggcaacagagtgagacttcatctccaaaaaaataaataaataaataactaaatatatatatatatatatatatatatggaatataattttgtatttaaaatgtacaatacaatttatacttacacgtatcatcttaccacttgctttttttgcttaatattttattttaaaatttattcacattatttccccagttattaagggtgaaaaacttagagcatgaaaaaccaatatgtacttacaataaactgattttcaagttggcaatattatttgcagtggtaaaacctgcatcattgagggtttcccacttcaggattaaattgtgccaatcagccgcattgtccttaatttttcttgcactgacagataagacaggttttctgggcgttacagttccaagagtctttgctgatagggtataaaagaaacaaaattattatcatggaatatacaatcatagttggagggcaaatgtccttataattttcaacagtaaaactatctgaaatgctgtatcaactggacaaataaatgtggaaactacaaagtctgaatgaatgtgaaagttcctggaagaagacaatatagaatatttttaacattttaaaattcaccagatagagctgaatcctcttccagcttaatggctccacaaagtttttaccttaagccctttgttttccaaagattggaaataaggtaaagttgtgactgtctgctaaaactcttcaatggctcacgttcccttccctacaggataatctagccctgactcccgagtacttccactatctagtctcaggcactctgatactttaaatttgctcagagtagcgtggcccatgagtgctaatcatttcaagacactgagacaacagagatgcagagttgatcacgatgctgccactgcccttcttggtaatcaggaggaagtccaaaatccttccagacctagctacccctccacatcatcacgtacatcaacccacaccttggccccccgtcaatatccagcgaaaatgaactactggcagctcttgaaaagctgaggtgcctgcaggcctttacacgtgttctctctgcaggaaagctccttccttcctcaggctcacgatgcccatcctccaagatgcacccggatcccactgcctgtaggaagcaacccccagaccaccaagagccaactcaggttgtttgttctccccgaaccctcctgtgccctcttgccttctctactttgaaccccacaaaggcttctcactgcccacaggataaagtcctcttgaggaatccaggacacacaacagctggatggtttgatgcctcaagtcagaagaccacactgcctgcgtctgaaccccagctcgccagctgtgagatcttgggcaacttaatgtacctttcagagcctcaacattttcatctgtaaaatgggaataaaaatagtatctatttcataggattgctgagattagataatatatgtgaagctgtgaggcctcgcacaaggcaaaaacccagtatctcacctgttagctcaagggcctctactatccaagctctgcccaccacttcagcttctaccctttcccacttgccctctgtgcatcagagctggctctgtacaagttctgactttgacctggaatatttttcctatctgtgtgtgtccccactcccctgcctcatacttagtatcctcactttaaaatatcatcttgatttatcattcattctttacttaaacaacaaatatttgcttactgcctacaatacgccaggcatgggggaatgaagtgattgaatgagacggaccaggaccgttttcatggaacttactttccaaaggggaggcagataataaacaaatgaccacgatcagttcagatcatgattaagtgtgtgtggaaaataaaacagggtcttgtgttagtgtgatcccctgagaaggtgtcgtttaggctgagatttgaatgatgaaaagccagaaatagggtaggtcagtagtatgtgccctaattatgataatgaggttggtgagttcaaaaaacagaaaacaaaacaaaacaaacaagcaaacaaaaaaaccagtgtgctggaatgaaatagacagaaaaggactagtgcgtgagtaggtgatcagacaactagaacctaataggccaagataagaagttggaccgagggcagtggctcacgcctgtaatcccagcacttcaggaggccaaggcgggcggatcacgaggtcaggagatcgagaccatcctggctaacacagtgaaacctcatctctactaaaaaaatacaaaaaatcagccgggcgtggtggcgggcgcctgtagtcccagctactcaggaggctgaggcaggagaatggcgtgaacccgggaggcggaacttgcagtgagcccagatcgcgccactgcactccagcctgggtgacagagcgagactccgtctcaaaaacaaaacaaaacaaaacaaaacaaaacaaaataaaaaaatgaagtttggacttctaagtattagcttggtgcaaaagtaacagattttgccattacttttaacagccaaaattgccattacttttgcaccaacctaatacaatggggagtgagcaatgagctctggatagggcagtgaaattatctgatttaggtttttagaaagtcatttccacagagaagtattcctggatcccccaggttgggttacgactcaccactagatatgtggtacaccctataattctgctatcatgatattcaccagtggagtgtatttgcttgtttaatgtctatattccctgctaaactggaaattcgactagggtaggaactatgtctcgttctctttcaaaccttccacacataggaggctttgcataaaatgaggtaaatggaggaatagctcttaccacctgttctataattgtctaagggttttccccccaacaggagattctgagggcaggatcacatctgattcatggtcagcctgactcatacggggcacatatttaggaaccaaaaacataactgacttcaagaaactcaagggctggtaaagacagaccagtcatcagcgtcacaggacagggtagggtgagggcacagtggctaagttacttatcccctctgagcctcgattccccatctgcaaaatggggttgacattacttcatgggaccactgtgaggttcaaatgagatgatccacttaaagtgcttggagcagtactcagcaaactgagcactaggcgaaagccagctttcattacaagcagaatgttctgactgagggcagttcagagaggagtttctggacgagatgagcatgcaaggcttggtacccagtgaactctgttagtactaatttatagtgacaataattacaatttggatgtcggatctgctgacactcatttgcgtatatcgtcccgttcatctgtcactgcacatgtgaaaaaacggaggctcggcaaaactgtctcccgagcagctcgcagaggctgcgaggggcctgcgggctaggctggggtaagacagaggacctccatttaacctcatgtaatccggggagctcctgagcttctggtccaacctgcggcctaagcagtaacattcacagccaccccaccccgggaaaggaaccgatctcacgcaccttccataaggtccacagatatccgtagaaggagacgcgaagccccgcccaccccaccggaaacgcatttgc

SEQ ID NO: 659 - DNA, 14635 bp, Homo sapiens; identical to SEQ ID NO: 658

SEQ ID NO: 660 - DNA, 102709 bp, Homo sapiens
cccccggcggagccagctgctgctcttcggtgctggccccggtgccggccccgttgcccagggaacaggctcccggcagcccccgcggcccggagtccatcccgcctcctccggcccggcggggccgacgagtccggaggggctgccgcgggaggtgagtccggcgacgccgcaagcggccccgacgcccccgacgcccccgacgcctggccccgagcccctcctcggcctcccccgggccactcttcccttgcctcagccccgcagggtctccatgcccgtccgccccgtctccctcgcccgcggtctcgcccgcgcggagtggcggacactaaatgccacaacacacggagcgcctggctcgccgcccgcagaatccggcggtccgcagcggggaacaggggccgcccgcccctcctcaggcctccgctgcgcgtcccgcgccctcggcccccggccccaccctgcatcccggctgccggtctggccgcgggctctgctccttcgccttaagattgacgtcgtgttctgtcccccactcgcagcccgcgtcccttacatccgcccaccggcgcctggccccaggccttgacactcatccagttggtgttcagtgttcgatgagtggataagtgaatgactcctttcccaatcctatttgaaggcatgggaggcagaataggtagtaagtgttaaaggatggggtgtcctggagtcagagccgggcaggtcccagcggccccttcctagctctgtgctggggcaagtgccctacctcactccgctccagtttcatcaccagtggaatggagatgagaatagtttctacctctggcttggtaagaggattaaatgggtcagtgcatgtaaagttaagcacggtgcctgccgctgtacatttcagtaaaggggagcccctgctgtcatctgtgctagcctgcgttctcgccctctagtcccttctgatatgtctctgacttctcatgactttagtttctccttctctacctccatttctcttccctgcacttttttcttcctctcttattgggattcaggaattttattctgttctgtgacttatgttccatgtgttggcagaatgtgggataccagcctgggtgcatccttttctcatctattggagtgaccagttgcacttgtggactgcctccttgcagccaaggtcttgtagacagagttctgggaaatctcaaaacgcaaatcccaggcataggtagaatctgggaatgaagccactgtagctccttgtgatcaccagcgattcctggtcttttaggctgcaggactttgtgttttctcacacccagctataatgtaccttgataaacctctgaccttatttttgttgttgttgttgttaacctgacttacgtcccatattggtggttatttggccatcgtgtgccagcactgtgccaggctggctctagggatgctgtggtgaaccagacagacccttcctgaggtcactgcctcagaaagatcatggtctggcccatgaactttaaaagggagaactaagtgcaggtgtaggggacacacaaattgaattttcaggactgccttggaaaaccagtggtggggaagatggaatgaggataaccctcttctgaaggagtgactaggaagtagcttttgttaggcatcagctatattatacccacgtgtctttttcaatagaagactggcatctactggatttttttttccaattttttcttaaagaagttacacttaagtttggggagaatttcatttcatattagccgctgtaggagttgaaaaaaatggctactggaacttagtgggaagaaaaggaaggaaacaggcatcaggcagaggcagttgattgaacttgggaagatgaggaatagatcaggaaagggttataatgaaaagctttggtgtcaagcacgaagagatttctagattcagtaatgcacagagagatcagtaaaattagaagggagtagttgatggctttgcgaattgctaaggtagaagggagctgttactcaagatgcatgttcaatttaaaatgaatgtattctttggacctggacataagagttctattgactttttgccactattttatatttagggctgtcatacttgggtgaatctagcacagtgctttgagagagagattcattcaacaaacgtgtattgagcattgattgtaccatactctttattggtcttttaaagcaccacaaagtatacagactagaagaacataggtgaagatgagaaagagtccattgaaggggagagaaaacagataatgatggtgctgtgcgataactgccatcatggagttctgtgaaagcagagaaagaccaaccaagtatctgagggaatttatgaaggcttcctggtggcggaggactagttcttacagggcacatgtgggggaatagggaagagtggaaagggactttgttctgcagagacatacaggttatggtgtgtgcagggactgtgatggaaagctgatggatgcacaaacaaaacgtggcctgtctacacaatggaaggctgttcagcaataaaaaggaacgaagtactgatttgtgctacaacatggaggaaccttgagaacattaggctaagtgaaagcaaccagacacaaaataccacatattatatgattcaattttgatgaaatctccagaataggcgaactgtagacagagaggagatcagtggttgcccagggctgagagaagaagcgtgtagaggggtgattgctaaagggtagggagtgcacagtgtgtggatggaagagtggcctgagatgaagttagatatagactgttttgtcatagtgtctaatttccatgcttgtgttaggctttagcttgtgaccattgggtagccaatggggatgggagcaaggaagtgacaaaattttgtctggaagataaatgactgcctcagtctcattacgttcctccttaataatttaatactcaaataattaatagatgtcgtagccagatttcaaacatagattctacaatagggatacaaattgttgcttcctagggattttggagagaatcctgaaaccattagtgtacccagagcactctgataacatggttattgtacagcgaagtggatgacttagactctatattagtcctagctccagtttgagaaatcatccatctgggtggcagttgggtgttagtagtcagcagtgaaggctagctgccaccttccagggttatgagattgacagggctagtggggaaaggaagcatcgtaacttgaaggatgccatagggtggtgttttgtatttttttaactgaaatagtcatgactaaggaagcattattcattatatttttatttatttatttatttttgagatgaaatatcactctgtcacccaggctggagtgcagtggcacgatcttggttcactgcagcctccacctcccaggttcaagtgattctcctgcctcagcctcccaagtagctgggattacaggtgtgcgccaccacacctggctaatttttgtattttttagtagagatgggtttcgccatgttggccagactggtctcgaactcctggcctcaagcaatcctcccacctcggcctcccaaagtgctgggattacaggcgtgagccatcatgcccagcccaattttaaaaattggattgagactattgttttgcagtaagacctgaagttaacaaatctttactgagcatctactctgtgccaaagctattattagatactaggatttaccttggtaagcaagagagaattcatgttgcttacattcttgtaggagagatgatttttaaatggtttagcaaataaagcaattagaggttgtaatgaggattatgaagcacatatgatagaggaaagaagggacagttgggtactcttgagtgatctggtcagagaaggcctttctgtggtggtgatatttaagctgagaccccacagttgagaagaagccagataaatggagtgagatcatttattctgcatagaggaaataattatgacacctgagtgggacagagtgggtcagtggagctagaacttggaggacaagtggagacgggtagagaggtgacaggggagctgcaaagggcttagaccacacggggcatttggtttttattcttagagcactgggcaaccagtgaggagttttgagtagaatgggtagtatggtctgatttctctttgaaggagctgatattttcctttgttttttggggggtaacagctttattgagatataatttacatgccacacagttcacccatttatatacaattcaatggtttttactgtattcacagctatgcaaccgtcactacgtcaattttagaactttctcatcaccctaaaaggaaactccgtacccttcagcaatacaccctaaccccttcttctcccagccctgggcaaccactgacctactctgcctacagcttgcctattctagacattttgtatacatggaatcatataatatatggtgttttgtgcctggttgctttcacttagcataatattctcaggattcctccgtgttgtagcatgaatcagtacttcattcctttttattgctgaacaggcttccattgtgtggatagatcacattttgtttgtccattcatcagttgatggacagttaggttgttttgacattttggctattatgagtggtgatattatgaacatttatctacaaattctttgtagatatgttatcatttctattgggcataaacctaggaatagaacttctgggtcacatggtaactctgtaaccttttgaagaactgcccactggtggctgcaccattttatttttcaccagcaatgtatacagttttttccacatccttgctaacacttgttcataccctagtgggtatgaagtggtatctccttgtggtttcgatttgcatttccctgatgagtaatggtgctgaacatctttttatgtgcttattggccttttttttttttttttttttttttttttttggaaataaagtctcgctctgttgcccaggctggagtgcagtggtgcgatcttggctcactacaacctccacctctcgggttcaggtgattcttgttccttcggcctcctgagtagctgggattacagatgtgcgccactatgcccacctaatttttgtgtttttggtagagacagggtttcaccatgttggccaggctggtcttgaactcccaacctcaggtgatccacctgcgttggcctcccaaagtgctgggattacagatgtgagccaccgtgcctggccttactgggcatttgtgtgtcttctttggagaaatgtttcttagactttgcccattgtaaaattgtcttttgttgttgttttgagatgaagtcttgctgtgttgatcaggctggtctcaaattcctgggttcaatcgatcttcccaccccagcctcccaagtagctgagactatagccacgtgccactgcacccagcttttaaaattgtctttttattattgagttataagagctctttatatattctgggtaaaatctctttatcagatatataaccaggagatattttcttccattttgtgggttttttttttttatttttgtcggtggtgtggattagatgtatttttactttcttgatggtgccctttggagcacaagcgtttttcatttcagtgaagtcaaagagctaattttgatggctgaatgagcctggcttctgggggcaggtgtggaagaccatggcagcagtgtaggcgagggatatgatagcttgtactgtggcatggccacagagttggtgaggaggcgccaggcttgagggaggcttggagatagggctgatggactgagttgagagattgttgtacgggtgagggaaacagaggaattgagggtgaatactaggatttcagcttgaacaacacttttgattcaaaatgtgattatgctgttacctgccggacaattgtgacagtttctaatacctgctggagcctagcaagggcagccctgcgctccctccctgggttctgaagttgcttttggtaggattatcactgagtgtgccaaggagatggtcagggattctgaccttttgtaatacccactaagacctcctaagccaccacaaataaacatattatctgagtagaatagtgcacttgctctgcaaatgcacttttgaggcaaatctcttgactcccttctagctagactgcagtctcaaagcccttcttgtgtagagcctgcgagctgtcagtggatagcatcaaatcaagcggatggattcttgaaagctaaatgtcatcatttgacagagctactatgaggaaaaatatttttatttttaaaaaagttttattgatcgattgatttgagatggggtcttgctctgtcacctaggctggagtgcagtggcttgatcatggctcactgcagcctcgaactcccgggctcaatggatcctccaggttcagtcgatcctccgggctcaattgattcttgtgcctcagcctcctgagtagatggtactacaggcacgcaccaccacacctggctacttttttgtattttttgtagagacagagttttgtcatgttgcccaggctgatgtcaaacccctgggctcggccaagtgcagtggctcacgcctgtaatcccagcactttgggaggccgaggcgggtggatcacaagatcaggagattgagaccatcctggctaacacggtgaaaccccgtctctactaaaaaaaacaaaaaaacaaaaaaacaaaaaattagccaggcgtggtggcaggtgcctgtagtcccagctactcaggaggctgaggcagaatggcatgaacccgggaggcggagcttgcagtgagccgagatcgcatcactgtactccagcctgggcgacagagtgagactctgtctcaaaaaaataaataaacaaacaagcaaacaaacaaacccttgggctcaagtgatctgcccacctcaacctcccaaagtactgggattacagatgtgagccactgtgcctggctgaggaataacttttttttttttgagacagagtttcgctcttgttgcccaggctggagtgcaatggcacaatcttggttcactggaacctctgcctcctgggttcaagcgattctcctgcctcagcctcctgagtagctgagattacgggcacctcccaccatgcccagctaatttttgtgttttaatagagatgaggtttcaccaagttggtcatgctggtctcaaactcctgacctcaggtgatccacccacctcaggctcccaaagtgctgggattacacgcgtgaaccaccacacccggccggtaataagatttttaaaggaggaaataacattaggcaatacttactggtgaagagctcagtacttccgcttgcttgctaggagatctcatgagctaaagcagatacgaaagtgcctgccagagatagggagtagaaggtgtgaaggccaggacgtgagaggccaggcctgttgtaattagaagcaattcagtgtggctggaggacaagtgagagatcctcgggtggcagaggccagatcaccaaggttcttgtaagccagcaacacttgggctttagcaggaggaagatggggaccactgcagagtgttaagcaagggagtgatgacatcagctttgcacatcaggaaaatccctctgtttgccacgtggatgacggggagggagaggcgggcagatgagctgggcaccagagagagctgcaggtgagaggtaatggtggcccgagctaggggtgacacactgaggtgtgtgggagatgtactgaatggagaatcggggacatggagaggagaggaggagggatcagggatgatgctccttttctggcttggtcagcatggcccaggcaactggtagaagatacaagataggtaagtgtctttgacattgttcatttactctgtgtttatagctaggatgtaagttttactaatcccatttcagatggtaattggagatctagagaggttgagcagttattccagggtgcctcaggtagttttaggagcattgggatttgaacttgggtctttttcacttcagtatcattagccactcattgtgcagttcttcctcggtggaaagagggtcagttctgtggctgtgggtctgagacctgggggttgggtgaggtggaacatggagttgggtgaacattgggtaaggaggaggagcagaaagtcttagcagaaatgtttgctgtgtctgcattgtttttcccaaacctagcgcaggacagtgagacagcggctctatgccttttcctcagcccgtcctagacactgtttctgccaggaggacagttttgctgggagttggcctcaacctgctcctcctatctgaatggtgggtgaaggacagacaagcctggtgctaagctcatccagaggcccccagatagggaaatagcatggattctcttctgcccgctggggacttcttgggcacctggcccccaggcatggctgtcctgactcatctgggtgctatggcttacgggcctctagatatcctttggaaaaacgtgtgaggcataaattgatatgaacattcttcaaggcagtttggcaatacatttttttttaattcaacatttccacctcttgcagtgtactccaagaatatacttggatatatttctgttgtttttgatggcaaaattaaaatcttttggttgagaaaattttggtttatccatacagtgtgttctctgcagtttttctgtatagtcactaaaaatcacattctaggggaatatttaatgacatggaaaatactcatgatttattaagtgaaaaagtctgtgtgtgtgcatatatgtttatatacatatatctgtagctatctgtgtacatggcatatctcagtatgatgagattgtgacttttctttacttctttgtccttttattttgagatagggtctcactctgtcacccaggctggagtacagtggtataatcagctcactgcagccttgatctcctgggctcaagcgattctctgtgtaccaccacacctggctaatttttgtattttttgcagagtcaggatcttgccatgtttcccaggctggtctcaaatttctggcctcaagtgatctacccaccttggcctcccaaagtgctaggattacaggtgtgacctactgcacccagctgcctttgtacttttcttttcttttttttttttgagattgagtttcactcttgttgcccaggctggagtgcaatggcacaatcttggctcaccacaacctctgccttctgggttcaagcgattctcctgcctcagcctcccaagtggctgggattacaggcatgcgccaccacgcccaggtaattttgtatttttagtagagatggggtttttccatgttggtcaggctggttttgaactcccaacctcaggtgatccgccctgactcagtctcctgaagtgctggggtttacaggtgtgagacaccgcgcccagccttctttgtgcttttctatattaacaaatttttgaggccgggcatggtggttcatacctgtaatcccagcaagtctgggcgtggtagctcaagcctgtaatcctagcactttgggaggccaaggtgggtggatcacctgagatcaggagttcaagaccagcatgatcaacatggtgaaaccccatctctattaaaaatacaaaaattagccaggcctggtggcaggcacctgtaatcccagctactcgggaggctgaggcacaagaatcacttgaacccaggaggcggaggttgcagtgagccaagatcatgccactgcactccagcatgggcgacggagcaagtctcaaaaaaaaaagcaactttttgatagtgagcatttataactgttataaaaagaaacctttatttttaaaaagttaaataaattatggcacatcaatgtgtgtatgagtatgtatgtatgcactctttaaggaaacaaagccttttactatttctgtgccttggaaagaagaataagaagtttctgcatccatgaagtggaggtaacattcatgtctaatgtttggggattgcaggaaaaaaaaatggaagtaactatgatgcctacttcatgtttgttttttttttctttctttttggtgaggatttaatgggtttgtgtgctaagaacagtttgtattaagtacagacggttttcaacttacagagtttcaacttactattttttgactttaagattgagcgaaaacgataccattcagtagaaactgtatttccagtaaccatacaaccattctgtttttcactttcaatatggtattaaataaattacatgagatatgcaacactttgtgataaaataggctttgattagatgattttgcccagctgtaggctaacataagtattctaagcacatttaagttaggctaggctaagctaagatgttcggcaggttaggtgtattaaatgtattgtgacttatcttttcagcttatgacggttttattgggacataaccccattgtaagttgaggagcatctgtaaaaacattagctattcccattattattactgcaaaagagggtggattgggttcttaagtatcacagaggaatgcaattattattattattgttatttacttacctttaagaaagttctcatacgtggatatgttctgcctgtattggctattgtgactgtcagatgaaatgggaatctaaggctgggcgcgatggctcacacctgtaatcccagcactttgggagactcagatgggcagatcatgaggtcaggagttcgagaccagcctggccaatatggggaaacccccatctctactaaaaaatataaaaattatccgggcttggtggcacacgcctgtagtcccacctactcgggaggctgaggcagaagaacccaggaggcgagtgttgcagtgagccgagatcgcaccaccgcactccagcttgggggacagagcgagattctgtctcaaaaaaaaaaaaaaaaaagaaaagaaatagaatctaaaaatgcttggaaaactggatatgctatacagatttagggaattattattccagcattgaattggggtcatattgaagaaaaaatgatactttgctgctcttccattccattttttagaattttatatttaatattttttcttttgctctacacattcagagaaacttctctagtaatgaactatagaaatgatcccagaaagcacagcctttgttcttctgttcttgtcactcattccttccttgcatattttccttttatttatttattcatttaagagacagtgtctcactctgtcactcgggctagagtgcagtgacacagtcatagctcactgcagcctcaaattcctaggctcaagtgatcttcctggctgagtgcagtggctcatacctgtaatcccagcacttggggaagctgaggaggaaggatcacttgagcccaggagttggagaccagcctaggcaacatagtgaaaccctctctattttttaaaatgaaatatttgttttaaaagcgtgatcttcccacctcagcctcatgagtagctaggactacaggcatgtagcaccatgcctgactaatttttaaaaatattttttgttgaggcgggagtcttgctatgttgcccaggctggttgtgaactcctggtctcaagcagttctcccaccttggcctcccaaagcactaggattacaggcataagccactgttcctgggccaaattttctgtttcatcattcattcatttatgcaacaaatacttgctgaatgcctctgatgtgcctagcccttttctccctgcggggggaagaggggtgagtgaggcagatatgggctctgctgttatgggccttacagactagtgtgtgtgtcagagtggcaggcaggcagataaccagtcagagaaaagaaaggagatgtgtggataggccggacacggtggctcacacctgtaatccaagcactttgggaggctgagatgggaggatctcttgagcccaggagcttgaggctgtagtaagccatgattgagaccagcctgggcaacacagcgagacctcatctctacaaaataatttaaaaattagccaggcatggtggcatattcctgtagtcccagctacgtgggaggtggaggcaggaggttcacttgagcccaggagtttgaggcgtcagtgagtcatgatcttgctactgctttccagcctgggtcacagagtgagactgtgtctcaaaaaaaaagaagaaaggggctgtgtagagaaagtaaaactgggagaggtgacagagagagaactcagtagggggaggagaaatcaagtacggcctcatgaaagagggcacaattgagaaggaggaagagctcagtagagaaagaacattccaagtggacggaacagccaatgcaagggccctggggtgagaacgagctggattaatttgatcagaagagggactggaagttggtcagtccactatgtagaaatagaaaacctacagttcaaagagaccataaatccatgatgcaagaagtttctgtgagaggagcttggaagtctccatagaacctgtagagctaaaatatccctccaggtgtaatcaggtacagagcatctacctggactgttacagcctgcctgtcagagctgtgactgtgctgttgtcaagagcctaggacttggagggaaaagacctagagtcaagtctcggctgtttgatcttgagtgagtctcatgaccctctggcccccagtcccttctaaaagttagggatgatgctacctgccttataaggtagggtcaggattaaatcagtgagtgagcactttgtgaaagatggcgtgcatggaagggttgcatatctttagtaagggaagctttgaagccaaagtgcaagtgggtgggtctccatgtggaacagagtaaggtgctgtgtggctggactcttgagcgctgaggaggctgtgggcatccaaccaggccagggcacctgttcttcaccatctcattaacacagccagcatatctgcatctgagattggcccactattctcctaatagagtgtctttcctgtttctcttttccatatcctgtccaacctggtgggcttcatagttcaggatgtgttcagtgaagccatgtctacactcactctaatccccactgatctctctctcctcatgaaaacccacaaattatcacctcattacttgtggatttgtgtcttttcactatttcatctgcctccctgtctagatcataagctacttgggagtaagaactgttttgttttttgtattctttccactcctccatggcattcactacaacataaatcatagaggtcagaacatactgaagtgcattttgagttaaaatgctcaaaagtgatcttagtgacacgtgtttactttccctgtttatttaagctccagctataatgtttacctgcctaaaagttccatgttgccagtattaaacatacttctttttgccatgactaggcattgaaaggattgtaatgctttgttctgtagcccccaggtttccctagatgacaaataaacattccttttcctgcgtgaagatagtctgtggaaaccttggccatggcatcgatatcagagcctgttacattcagagagttctgcccgttgtactatctcctcaatgccattccgacaaagatccagaagggtttccgctctatcgtggtctatctcacggccctcgacaccaacggggactacatcgcggtgggcagcagcatcggcatgctctatctgtactgccggcacctcaaccagatgaggaagtacaactttgaggtgagccttgctttgcttttcacctgagggggcacgagccatagctgacgcttaacatgcttgtgttctaggatgagataatttacttctgatttgccagaatatggccttaatacctcacccaaacaatactttaaaaccatctttagctgaagtggaatataactaaaaacattggtgtttttaactttttcctgcctccaaaaatctaacatcactttatttatttatttgagacagcgtctcgctctgttgtccagcctagagtgcagtgggacaatcatagctcattgtagcctcaaactcctggggtcaagtgatccttttgcttcaacttcctgagtagctaggaccacagggatgactgccacacccagctagtttttgttttgttttgtctgtagagacatggtttcactatgttgcccaggctggtcttgaactcctcggctcaagcagtcctcctgccttggcctcctaaagtactcggattacaggcatgagccaccacacctggcctaacatcactttaaaagagaatatcacctgaggtcaggagttcgagaccagccttgaccaatatggtgaaaccctgtctctactaaaaatacaaaaattagctgggcgtggtggcatgcacctgtactcccagctactcaggaggctgagacaggagaattgcttgaacctgggagatggaggttgcagtgagccaagatcacaccactgcactccagcctgggtgacagagtgagactccatcttaaaaaaaagaaagaaagaaaaaaagagaacattttagtatttaaaacttactacaacactttgaaagcagatatttttttcctaagtgtttacaggagcaggcacatgcctgtttttcaaagttttgaataatctctagttcttctcttgaaattatgatgaaaaaaggatgtatatgaatattggctcattgccagaatatgcacctcttagctgagctgaggtctcttctatagcattgggatcctgaccaatctgtttctgcagtgctgtggactcaggcatttctgtgtattgtagatattggtggagatgttatttgactgtgttgtggctggcaccaactattggtgaactgtaatgtaattcacccacttagtcaatatctgtagtttattgagtacgtcacttttgtgagagactcaaagttgactgagttgtggcttccaccacatgggactctattctgtctgtggttagggggcttttatggaccaagatacagcttttgtatctaagagaaatgtttacaaatacttgtgttttaatcagtattcaatatattaaagttttcatttaaaacgtaactaatttaagcctctgtgctcattttaaaataatcaaaatggttcatacacatacagccctttctatgtgtcagacattattctttaaaaatatattttttaaattttttaaaacattattttttccttctcactatgcttcttggacagacatatattaactcattttatcctcacaaaaactctctgaggcagatgttattatgatcttcctcatttactaaggagacagctggtgaagagagggtaggtgacttgcctgaggttggctggtagtaaatggcagcaccatcatgtgaacttgggcagactgtctctagggtctgtattaatatatatatatatttttgagacggagtttcactcttgtcgcccaggctggagtgcaatgacatgatctcggctcactgcaacctccacctcccaggttcaagcaattttcctgcctcagcctccagagcagctaggattacaggcacccgctatcacacccagctaatttttgtatttttagtagagacggtatttcaccatgttggccaggctggtcttgaactcctgacgtcaggtgatccatctgcctcagcctcccaaagtactgtgattacaggcgtgagccaccacacctgcccgtgtattaatattttttgtataaaaattagaactactgctatttcttctctttgagtaatagctcatggattcgactgatcaaattccccaaacatttaaaaccattacgtaatctttcaaactgtagttaggagtttaatagtctgaaatctctcaaatgcttcagacactttataaggaagactcgtgaatccaacgatgaaccccaacaagatctatcaaagaaatccatgcacagaggcaccctagtcacactgctaaagatcacaatcttaaaatccgtgcacagaggcgtcctagtcacactgctaaacatcacaatcttaaaatccatgcacagaggcgtcctagtcacactgctgaacatcacaatcttaaaatccatgcacagaggcgtcctagtcacactgctaaagatcgctgtcttaaaatccatgcacagaggcgtcctagtcacactgctaaagatcacagtcttaaaatccatgcacagaggcatcctagtcacactgctgaagatcaccatcttaaaatccatgcacagaggcgtcctggtcacactgctaaagatcaccatcttaaaatccatgcacagaggcgtcctggtcacactgctgaagatcacaatcttaaaatccatgcacagaggcaccctagtcacactgctgaagatcacagtcttaaaatccatgcacagaggcaccctagtcacactgctgaagatcaccatcttaaaatccatgcacagaggcatcttagtcacactgctgaagatcaccatcttaaaatccatgcacagaggcatcttagtcacactgctgaagatcaccatcttaaaatccatgcacagaggcgtcctagtcacactgctaaagatcaccatcttaaaatccatgcacagaggcgtcctagtcacactgctgaagatcacagtcttaaaatccatgcacagaggcgtcctagtcacactgctgaagatcaccatcttaaaatccatgcacagaggcaccctagtcacactgctgaagatcaccatcttaaaatccatgcacagaggcgtcctagtcacactgctgaagatcaccatcttaaaatccgtgcacagaggcgtcctagtcacactgctgaagatcacagtcttaaaatccatgcacagaggcaccctagtcacactgctgaagatcaccatcttaaaatccatgcacagaggcgtcctggtcacactgctgaagatcacagtcttaaaatccatgcacagaggcaccctagtcacactgctgaagatcaccatcttaaaatccatgcacagaggcgtcctagtcacactgctaaagatcacaatcttaaaaatagccagagaacaatgacgtattacctgtagaggaacaatgatttaaatgactgtggatttctcatcagaaactgtattagcccgttctcatgctgctatgaagaaatacccaagcctgtataatttataaaggaaagaggttttattgactcacagttacgcatggctgcggaggcctcaggaaacttacagtcatggtggaaggcacctcttcacagggctcactgtcacaagaacaggaggggggaaaccatgcccatgattcagttatctctacctggtccctcctacgacatgtggggattatgggaactacaattcaagatgaaatttgggtgaggacacagccaaaccatatcagaaacaatggaagctggaagacagtagcatttttttggttttttgtttttgttttgttttgagacggagtctcgctctgtcgcccaggctagagtgcagtggcgcgatctcggctcactgcaacctccgcctcccgggttcaagcgattctcatgcctcagcctcccaagtagctgggactacaggtgcccgccaccacaccggctaatttttttgtatttttagtagagacggggtttcaccatgttcaccaggatggtctcgatctcctgacctcgtgatctgcccgcctcggcctcccaaagtgctgggattacaggcgtgaaccactgcaccaagcttgtttttttttttttttggcagagtttcgctcttgttgcccaggctggagcgtagtgactgcaacctccacctcctgggttcaaacgattctcctgcctcagcctcccttgtagctaggattacaggcacacgccaccaagctcagctaatttttctatttttagtagagacggggtttcaccatgttgtccaggctggtgtcaaactcctgatgtcaggtgatccactcgcttcggcctcccaaaatgctgggattacagctgtgagccactgcgcctggccgatagtagcacatttttaaagtggctgagaggccgggcatggtggctcacacctgtaattccagaactttgggaggctgaggcaggtggatcacttgaggtcgggaattcgagaccaatctggccaacatggcgagagccccatctctactaaaaatacaaaaattagccgggaatagtggctcatgcctgtaatcccagctactgagaaagctgaggcatgagaatcgcttgaatctgggaggcagaggctgcagtaagctaagatcgtgccagtgcactccagcctaggcgacagagtgagactccatctgaaaaataaaatgaagttctgagagaattgtcaacccgaaattctttactcagtgaaaatacctatcaagaaaggtgaaatgaaagtattaccagatgaaggaaaacttaagagggttcgttgccaaccgacctgctctaaagtcattgctaaatgaagttctttagacagaagggaactttgtacatcaagaatgaagaatggtaaatacctgggtaataaatacaatagatgatttttcccctattgagttctttaaaatatatttgacagttgaaaacaaaaattataactgatcaagttttaacagatgtagatgtagtaatatctaagacgagtacaacataagtaagggagagtaaggtatcctatacatttgtacattcttcttgaagaggtacaatattgattctaagtagattttgaaaaattacgtataggccgggcacggtggctcacgcctgtaatcccagcactttgggaggccgaggcgggtggatcacgaggtcaggagatcgagaccatccaggctaacatggtgaaaccctgtctctactaaaaatacaaaaaatgagccaggtgtggtggcgggctcctgtaatcccagctactcaggagactgaagcaggagaattgcttgaacccaggaggcagaggttgcagtgagccaagatcgcgccattgcactccagcctgggcaatgagagtgaaactccgtcccaaaaaaaaaaaagaaagaaagttggagtggctgtattaatatcaaggttttcttctgtgcaaagaaataaccaggggtaaaaaagacattacataataacagattcgtatatgtcccttaacaacatagcttcacacaatacacgaagcagaaatggacaaatctgcaattacatgtggagacttcagtattcctctctcaataatagaagtagtagacagaaaaccaacaggatgtagaagaactgaacaacaccatcagccaacttggtctaattcacatttatagaacactcagctgaatatacattctttgcaagtgcacatggaacattcatcaatatagaccatgtcctgagttagaaaacatacctcaacacatttagagtagactaagctttccaggcccttgtgttttactttgttttttcacttttctttaaaatataatttacacaaagtttgcaaatctttttttttttcgagacggagttttgctcttgttgcccaggctggagtgcaatggtgcgatctcggctcactgcaacctccgtcccccgggttcaagtgattcttgcctcagcctcccaagtagctgggattacaggcgcctgccaccacgcccagctaattttttgtatttttagtagagatggggtttcaccacgttggccaggctggtctcgaacgccagacttcaggtgatccatccacctcggcctcccaaagtgctgggatgacaggcgtgagccactgtgcccagcctgcaaatcttaatagtaccatgtgatgaatttatatgtgtatgcctgtttaatcacccagttcaagatacagaacatttccagcaccccagaagattctcttgtgctacctcctaatcattacccctccccaaggtaactattctgacttctaacacagagtagttttgacttctacagagtagttttgctagctccttgggttttaattcactattaagtaacctctggcagtaaggtttatatgcgttagcggaatttggactccttactcaggttgcagttacaacccagttttcttttataaagcacatgtgtctcattgatcaccattgtattgtcttttttgttttttttgtttttttttttgaggcagagtctcactctgtctcccaggctggagtgcagtggagcgatctcagcccactgcaatctccgcctcctgggttcaagtgattctcctgcttcagcctcctgagtagctggaattacaggtgcccgccaccatgcctggctactttttgtatttttagtagagacagggttttaccatgttggccaggctggattcaaactcctgatcgcaagtgatccacttgcctcggcctcctaaagtgctgggattacaagcatgagccactgcgcccggtcccgtattgtcttttagaaaaactgtataactatttaaatattttcagtcaccaaactaaaaaacaaatactaaagttgaagtttattgctccccagaatgaaactacaaattacatctgatggccatttttacagtttaaccaataattagttctctatcatattatctttgtttcgttttcctttaacagaatacctaagactagtagttgttctttttttttttttttgagatggagtttcgctcttgttgcctagcctggagtgcagtggcgcaacctcggctcactgcaaactctgcctcccgattcaagcgattcttctgcctcaatctcctgagtagctgggattacaggcatgtgccaccccatctggctaattttgtatttttagtagagacagggtttctccgtgttggccaggctggtctcgaactcccgaccccaggtgatccacctgcctcggcctcccaaagtgctgggattacgggtgtgagccactgcatccggccggaagttgtttttatttttttactatttttaatttttttaaagaggtttatttggcccacaattctgtagctggaaagtccaagattgggcagctgcatctggtggggacctcatgctgcttccactcatggtgggaattggaaggggaccaggtgtgtatcaagagatcacatggtaggccgggcatggtggctcaggcctgtaatcccagcacttcaggaggccaagacaggcggatcacgaggtcaggagtttgagatcagcctggacaacatggtgaaaccccatctctactaaaaatagaaaaattagccaggcatggtggcccatgcctgtaatcccagctactcaggaggctaaggcaggagaatcacttgaacccgggaggcggagattgcagtgagccaagactgcaccactgcactccagcctgggtgatggagcaagacaccacctcaaaaaaaaatatatatatatatatgtgtgtgtgtgtgtatatatatatacacatatatatgtatatgtatgtgtgtgtatatatatatatctatatctcacatggtcacatggcaagagaggaagcaagacaggaaccaaggatgccagactcattttcttttcctttcctttttttttttttttttttttttttttgagacagagtttcactcttgttgccctggctggagtgcagtggtgcaatctcggctcactgcgacctctgcctcctaggttccagcaattctcctgcctcagccttccgagtggccaggactacaggtgtgcgccaccacatctggctaatttttgtatgtttagtagagacagggtttcaccatgttggccaggctggtctcaaactcctgacctcaggtgatccacatgcctcaccctcccaaagtgctggaattacaggcatgagccacggcacccggctctttttcttttagtatggagtgcttcacaaatttgtgtgccatcctcgtgcaaggaagccagactctttttaacaacctgctgtcttggaaactaatccagtccttggagagtgagcactcattcacccatgaggagggcattaatctattcatgagggatctacccccatggcccaaacacctcctactaggccccacctcccagcactgccactttggggatcagacttcaacataaattttggcaaagacaaaccacatctaaaccatagcagatatgataagtcacgtgagctttgaaggactgtgacatggtagaacagcatccacaggctctaccagagtttggtggaacagcatccacaggctctaccagagtttgagggagcagcatccacaggctgtaccagagattgagggaagctggtacaaattactggatccagcaccatagaaggggactctgggagaatcccatgtaaagattttagctagtccaggcatagtggcacacacctgtaatcccagcactttgggaggccgaggcggacagatagcttgagctcaggagttcgagactagccttggcaatacagcaagacccccatctctacgaaagaatacaaaaattattcaggcgtgatggcgtgtacctgtagtcccagctactcaggaggctcaggtgggaggatcatttgagcccaggaggtcgaggtcgtagtgagccgagatcgagccactgcaccctaacctgggcatcaaagtgagaccctgcctcaaaaaaaaaaaaaatttagctagttatcctttaaatgtatttcacccatacatgcatatgcctgctgtgtacctacaaaaactttttaaatctaaaatattaacatttggaaaaaaaatgtattttgctggggccaaaatccatacttggtagccctgagtatcaacagcattttttgagcgcccattatatataggatatcaaacttataattgtggagaatcacaagggaggtataaaataaatttcttgtccaggcacggtggctcacgcctataatcccagcactttggtaggccgaggcaggcagatcattttgagctcaggagtttgagagcagcctgagcaacatggcaaaaccccatctctactaaaaatataaaaattacccgggtgtggtggcgggcacctgtaatcccagctactcaggagactgaggctggagaattgcttgaacccaggaggtggaggttgcagtgagtagagattgcgccactgcactacagcctgggcgacagagcaagactctgtctcaaaaataaaataaagtgaaaattttttttttggcaagaatgtagaatttagaggtagaagatttagagcttggaaacaaagctgtatacctatatgtaaacacataggaaaaggtctgaaggaattttcacatgattacttaactctaggtagggattaagattgggatgggctgagggaggaagagtgaaagggaattacgtatttttttaactttactgaggaattactagaaatttttggtacatattacacgcataaacacagcaacacaaagatttgttttgagctttggctgccagttattagtggtttaaccccagagatgaattaaatatttatgttgttgttgttgtcattttcatcatgagagctggctgggtcttagaatcatttggtacaatccccactttttatagataaagaaattctaagattcctgcttcaaggcacgtatctctgattgcctaaccattgtgcttacttcttgtgagaggaggtaggccctctgtgcagtctgtggatttcaaggatatggaatacagatgcgtggtctctttggaatgtccaagtcgaaagttaaagatgcattaactagtttagggaaaatctaagattttatgggaagataaataaaaaagtttatgctcaaataaatccatgtatggcatgattgaaagattatgtttttaaatgaagttatgtttcctaaagaggaaagcagaccttttctgtggtaaatatagccttgcatgtgttttcaagaatggtgctttggaaaccatttttttctacagaagttagtgggagagggcagatggaaacacagattcttcctacctagtgccaaaagcactgagaaaatgttgcaaggagctaataacaagtacaaaaatgttagaaatgtgttaaatatataggtctgatatgtgtaagcatagaccaaaaagactacctgacctgagtttctaatgttctgttttgaagttaaacatatgatcccttttccttagcattcaacaagccaatgagatttcatggatttgccttcagagctgtctttttttttttttttgagacggagtcttgctctgtcccccaggctggagtgcagcggcgccatctcggctcactgcaagctctgcctcccggtttcacatcattctcctgcctcagactcccgagtagctgggaccacaggtgcctgccaccacgcctggctaattttttgtatttttaatagagacagggtttcactgtgttagccaggatggtcttgatctcctgacctcgtgatccactcgcctcagcctcccaaagtgctgggattacaggcgtgagccaccacacctggctgggtggttgcagttttaaatagcattccagggaaggtctgactgagaaggtgacagttgaacaaagacgtaaagagcatgaccaacacaccatactgacatgtctgtattccaagaaaacggaagggaaaggcactgagcctgaaacatgtcttggatatttcgcattgagaaaagtcatgcttcagaatgttacaagtatttcattggcttatactttatagacatattttaaagaggtgcagaaaggacagtttttgtctcaccatagcagccaaggtgcatttgcccagtgccttccattgtctttccctgtgggagtaacttttaggtccagtgatgaggagcctgtgatgtctgtgttctggtttgttgataacattaccatacagggcttcacgggtgtccttcttagcatggattgcttccattcattggttgctggaaaatttgctttcaaatgtttttaacagtgactcttagggaaaaaaaatacattttattagatgtccattctccctaaatttacctgagttcaactgaattccaataggtttttttttagtgttaatttaaaaaaacaagctggccaggtgtgatggctcatgcctgtaatcccagcactttgggaggccaaggtgggcggatcacttaaggtcaggagtttgagaccagcctggccagtatggtgaaaccccatctctactaaaaatacaaaaattggctgggcgcagtggctcacgcctgttaacccaacactttgggaggccgaggcaggaggatcacgaggtcaggagatcgagaccatcctggctaacatggtgaaaccctgtctctactaaaaatacaaaaaaaaggccgggtgcggtgcctcacacctgtaatcccagcactttgggaggctgaggcgggcggatcacgagatcaggagatggaggccattgggctaacatggtgaaatgctgtctctactaaaaatataaaaaattagccgggtgagatggcaggcacctgtagtcccagctactcgggaggctgaggcaggagaatggcgtgaatccaggaggcggagcttgcagtgagccgagattgcgccactgcactccagcctgggcgacagagcaagactccgtctcaaaaaaaaaaaaaaaaaaaattagctggatgtggtggcacgtgcctgtagtcccagctactcaggaggctgaggcaggagaattgcttgaacctgggaggtggaggttgcagtgagccgagattgtgccactgcactccagcctgggcaacaagagtgaaactccatctcaaaaaaataaaaataaataaataaataaataataaaaatacaaaaattagccaggtgtggtggcacacacctgtaatcccagctacttgggaggctgaggcaggagaatcatttgaacctgggaggcagaggttgcagtgagccgagattatggcactacactccagcctgggtgacagagcaagtctctgtcttaataaatacataaataaaaatgataagctgatttaaaaatgcatatgaaattgtagtgggtggaatagtcatactagtggaaaagaggaagcaaatgggagaagttgctattaggtaacaaaacttatagagctttagtaattaagggagtgtggtattagcacaagaaaagatacatagatcactggaacagattagagaagtcagaagaccaacatgtatatggatacttgagtaattgcaaaggtgatacgacaaagtctttttcagtaaatgatgtgggacagctggatatgaatgggaagaaaaatgaaactggatccctacctcacttcatatggtggttattttgagcactttaaagtattaatgccactgtctcttgactgctgagattctgctggcagtgtaattatttcctttaccgggaatttgccttgtctgtttctgctttagatcttctctaatgatagagtccctggctttaggcttcttccttcaactccagtggatattccctactttgttttgtcctatggagttaagaaaattattccagaaaagcagatatctttgtttaacttccagatcattaaaaagttgtgttagtattcaaacattaaacagatgttctttgttagtaaaaggaggaaaatagtgtaaccattcttaataattgaatgaattcatatttggtcttaaatatttcaaaatatttcagatcaattctttggtatgctagtggtttctactgaaggttaagctttgacctactaaaagcagctcataaagaaagctttgtcagacttcagttcccatgaacctgctcacaaagaacactttttcccaatgtagttttgtcttgtgtatgaaaggaaaactgcctgccaaggaggctaagaaggttagctgaatgctattgtaatggtgagatgtttgtccagaaaaccattcctgacacctttcaaatcaaaagccttttttttttccttaaactttttgattgctggatttctgtttgaggaagttatgttgctacaatgagggtagcaataaatgcctcctgggaagttggaaataaaggcaaaggagagttaaacacaatagatgagatcagaaatgggcaaagttatcttaaagagacagaatggctccctggctagaataagactgaattgtccctagatcaaaaaaagaagagaatgtgtgtggcagaaggaagaaagtggactctacactgtgttagttaggaaaaccagaaattgggccaaattgcctgtttagtgggagagatagcttttgagagctgtgatcccgctggtgtggctggctctgggcagatatttgtatctgaaatgactcatgctgtgggacccttcctgagatctaacacttacagtggtttgatcagaaattgcaccatgcttgccaagcaacttttggactaaaagttgctgcccacgtatatcaggggaagaatatatatatatatatatatagtacctatcttagcatctgatttgtatgaccattacttcaatgtaaaataataaattggctttccagcttaaacttcaatttcttgtatattatatgatcatgagacaacctccctgggctgatcaacagcaggacgctaaaaagattgagtatctgagtcaggaaggtagagggccagaccctacatgtagctaattcaccattgtgaatctgcatgttaggtaaaactatggatttgttttttgtcttttgagacagattctcaccctgttgcccaggctggagtgcagtggcatgatctcagctcactgcaacctttgcctctgggttcaagagattctcttgcctcagcctcccaaatagctgggattacaggtgtgcaccaccacgcccaaccaattttttgtatttttaatagagacgggagtttcaccatgttggcgaggctggtctcgaactcctgacctcaagtgatccgcccacctcggcctcccaaagtgctgggattacaggcatgagccactgtgccaggcctaaaactatggtttttaaagatatacacgcatgtggtaaagctatgaatcaaagcaagagaatatttcatctcaatgttaggagagtggttttggtggggtggggtatgtagtcaggcagaggcacacaagagcttcaaaggtgctgttaatggtccctttcccaagctagatggggattccatgggtgctcattttttagtaactctaatttaagctgtacatgttatatatagtcatggatatataatcattattttaaaaatgaaggcaaggaggataccataaaatgaggtacttcatatttaaccagctggcatcctaagcacctttcctgccctcccctctctgcacctggcagagttgatcacatcctccccattacccactatacatgggtgtcagtgccaatagtgctttgctcttgtattattgatgagtcttgctccttttcctaaattgtgaggcctcctgaaggcagcacccttgtcttatgaaaaagttgagcttctgaggatatgtctttggtgaattttggaaaacgtttagcctttatctctgaagataccacttttcattaccctctcttttcatttcctgctgaaacccctttttttgtttgttttttgttttgttttgttttgttttagacagagtttcactcttgttgcccaggctggagtgcaatggtgtgatcttggctcaccgcaacctctgcctcccacattcaagtgattctcctgcctcagcctcccaagtagcagggattacaggtgctcgccaccacacccagctgattttttttgtatttttagtagagacggggtttcactgtgttggccaggctggtcatgaactcctggacctcaggtgattcacctgcctcagcctcccaaagtgctgggattacaggcgtgagccactgcgcctggctgagaacccacttatgtgtagcttggacctttatgttctctcttctatgtctctaaacttctctttcatgttttgaatcttttcatctctttgttgcatggtaggtaatttcctcagatctgtcatctagttcaatacttttttttccagctgtgactaatttgctgttcattccacccagtgacattttaaattctcttggattttttcatttctatttccaatagtagttgttctttgcttacatttcagtttcctgttttatttttaaaacattttaatcatttttcttttatgttctgtgttcttcaatctaagtgaaatacttggggttgttcagtgctgttatggcttgttttacttgactcattcatgggcctgcttccctatcgtaatttctaattacgagcaatgtggctgatcctaatgtatgagaaccctgggggacctggatcgggactgctccacagatggggtttatgtttaccaatgccaggcaccttggagtgctaccaacatagaagcacttcagattaaccgtctgcatagagctttgcttggaaagagaataaattcaaactctgatgctgaatggggcaggcttatgatgacacattcttcggaaagattcttttttattcgttccaatcaatgcttgagataagacagatttccttgccagctccatttgccagcaaatcaatttttccctagcttactccttcacttagggttaggtccttgggattctggcttggcagagaatatcagctccagctccccatcatctactccgctctgaaaaccaaggctccagaggtgtgccagatagttacagggtagcctgtagcttcagggctagcttctgttttagtttgggggcattcttcttggttttggggtcctgtggattttccatactttcttgaaaattcagctgtgcatttgaaaggctttgttatatattgcactcagcattgccaggtgtttggagaggggtgttttgggatagctaggctattgtattgtgcaaaattaaagcctcatattctatttctatatgaactgtagttaagtgttaataatctgatgtctgggatgttttgattcttacatcaataactatgacatttattaataatcatattaaataacattaactcaagctcattggttacattacaaaggacactgatacattacaaagcacacatacaagcactgcacaccagtattgaggcttccagccccctctacatgatcatttatttatttatttatttttgagacggagtctcactctgttgcccagactggagtgcagtggcatgatcttggctcactgcaacctccgcctcccaggctcaagcgattctcctgcctcagcctcccaagtagctgagattacaggtgcgcaccactaccacctggctaatttttgtacttttagtagagatggggtttctccatgtgggccaggctggtatcgaactcctgacttcaaatgatccacccgcctcggcctcccaaagtgctgggattataggcatgagccaccgcgcctggtcatgatcatttttattttggaaccattcattcagaaaaatttcacagccattttgaacttgtgctatgacatggcaaaatctctagtaaatcattttaattcctgatgagttcatttttataatgataaatttctaaggaaaatattttgttttcaacttcttgccaccatgtcaagactgtacattttaaaacatattacatcacattttcccttcaaagcaatgccagtgaattctgttaatggtatcattcatctcatgttacccaactccagatcataaagtttccctcattctccttcctttccacaaacctaccaaatcctctatcgccaagtcctttgggttaattcacggagaaagtatcgagcacagaggcagaacagggcctctggagagtgtcacatttgtgtgtgaatcctgactcttgattttcactagctttgtaaccttagacaaattactaccaggcacggtggctcacacctgtaatcccagcactttgggaggctgaggcaggatcactggagtccaggagtttgagaccagcctaggcaacatagcaagatcctgtctctacaaaaaataaaaaattagctgggtgtggtggcacacacttgtattcccagctacttgtaggggctgaggtgggaggatcacttgagcctgagaggtcaaggctgcagtgagccatgatcgggccactgcactcagcctgggtgacagagcgagaccctgtctcaaaacaaaccaaaaaacaaattagttaacctgtctggagctcagtcccatatttgtaaaatgtggctaactacagcaccttcccttatagaaagctgtttgaggatccagttatgcatttaaagggcttaacacattacctggcacaggaaaacaaagacaagctgctgtcctgttttctttgttgctgccatccttctcacaaggtctcgacggagtctgtcttcatcacgatttcactgccctcatgcctgttctgtttaccccttttctagactgggcccttacttaccttagcctgagctattgtgaaacactcccagcggcttcctgacttgccccactccctccttccgccgtcctgtcctgctcctaatcgtgtttgtcagaaatgcctctgactgatacactggcaaaatcagaaatcttcaagggatccccctttttcttgctgtagcttaagatctaaatctcttaacctagatcacgatctgacactagatatatttatagtccatgaaaataccctgaaagctttcaagtaccagatgaaagtgagctccttcattaccacctcaactcactgtaggcggcttttcatgtgcaacagctaagctttaagagggctgggactgtgacctactttattttgtattgttatagcagctcacttggtacccagagcaaggaggtatatttgtttcttgcatatttggcaggttgattactatataaattactctattgaagattaaaatggtttactgaagatgtcgccatatatcttagcaaggtcaaaacagttgtgtaatttttctgaatgaatactttcaaaataaaaaagaccactcagaccagaagcctgaacatctgtgagcaatgcttatacatgtgctttttaataaaccaacatgttgggccgggcacggtggctcacgcctgtaatcccaacactttggaaggttgaggcaggtggatcacaaggtcaggagtttgagaccagcctgaccaacatggtgaaaccccgtctctactaaaaatacaaaaattagctgggcatggtggcgtctgcctgtaatcccatcgactcaggaggctgaggcaggagaattgcttgaacccgggaggcagaggttgcagtgagccgagatcacaccgtggcactccggcctgggcgacagagcgagactctgtctccaaaaaactaaactaaactaaactaaaataaaccaacatattaaactttaataggattattgatctgaaaaccaaaacatggtaggaattagtttataagtcatatttagacgcatcatcttataaccctctcagcaaaacctgtggggcaggtagattatggataacaagtgttcacttcatgaattgtccctgttgatcaggtgaagtagaacttggatctggggcagctcttgtgactccagattcttggtttttgagcaggtgttgggggaaatacctttcttgttgaagttctttagtactcttttttttttttttttgagatggagtcttgctctgttgcccaggctggagtgcagtggcgcgatctcagctcattgcaacctctgcctcatgggttcaagctgctctcctgcctcagcctcccgaacagctgggattacaggcacacaccaccacgccaggctagtttttgtatttttagtagagacggagtttcgccgtgttggccaggctggtcttgaactcctgacctcaggtgatctgcccaccttggcctcccaaaatgctgggattacaggcataagccactgcacccggcccatcttttaataagagctcagcatattcatacttgattgatcagcattttcgtcattagaaatgaggtggggtttttttgtttttgtttttttgtgttttcatttcaaagattaaaaacctagagaggaaggagagtatttggggaaaatggtggaagagggagcaccagtcatctgtctccacacctagacatcaattgtactggcaggatctgtctgatctaactattttggaactcggaagtctactgaggtttacacattcttgctgggatggcaaactgtggttaattttggtcagtttcaactcttagcacagtagcagctatgcactccccaaccccagttctgtggaaggcggctacgcgggtgttcctagagcttgcacacagcgtgggagccagaataggcaaaaagcatcttgtcctctaaatatttggggtctgtgctctgactgctgattgctgcttctgatcgtagaggtgcagacaaagagatgggtggccattgtcgttacacctcctcattattgcaagttcttccccctccaattaacaagacttccaggggatttaaagagctaatggtcctgctcccttgcttcacttttattttttcccatttgggagccagatgttagagaatatgacattgaaaagcaactgcatataagggggagaattaagaagtgactgtgcatgcctaggaaaaggtataggcacagtaaagacctgagaagaccctgagtttatacccaagactgatctttggcacagacggcctacagtaaacaaaaagaatcacacacacatccacacacagaataacaaaacccagtaaacttgaaaaggggaggatctgattttctgaattaccacagtattagattcaaatgttcagttttcaacaaaacaaatcacgaggcacacaaagaaacaggaaagtatgctcttccaaggaaaaaaaaaacaactgaaactgtgagaccacatagtagacctactagaaaaagattttaaaacaactgtcttaaagatatgcaaacaactaaagaagatgtggcgctgggggcggtagctcatgcctgtaaacccagcacttggggaggccaaggcaggtggatcacttgaggtcaggagtttgagaccagcctggccaacatggggataccctgtctctactaaaaatacaaaaactagctgggtgtggtggtgtgcactggtaatctcagctacttgggaggctgaggcaagagaatcgcttgaacctgggaggcagaggttgcagtgagccgagattgtgccattgcactccagcctgggtaacagagtgagactccttctctaaataaataaataaataagatgtggaaaaaggtaaaacagcgtatgaaggctgggtgtggtggcttacgcctgtaatcccagcattttgagaggcagatcagttgagtccaggagttcaagaccagcctggccaacatgttgaaacccgggtcatcgctagtaaataagacaaaaattagctgggcgtggtggcacaagcatgtagtctcagctactcaggaggctgaggcaggagaatcacttgtacccgggagatggaggttgcactgagccaagatcgtgccactgcactccagcctgggcaacagagacagattctgtctcaaaaaaaaaaaaaaaaaaagaaaaaagaaagaaaagaaaaaggaaaacagtgtacaaataaaatgtaaatataaataaagagatagaaaccctaaaaagaaactgaaaataattctggaactgaaaaatacaataactgaaatgagaaattcactggagggattcaaaggcagatttgagtaggcagatgaaagaatcagtgaatttgaagataagatattaaaattatcaagtctgacaaacagaaaaatgtttgaagaaacatgagcagagcctaagggtcatcatcaaagagactaacatgttttctgggagttatagaaagaaatgaaagggggagagagattatttgaagaaatagtatctggaagcttcccagatttgacgagagacatggatataaacatctaggaagttaaacgacctccaagtaagatgaactcaaggacacccacaccaagacacattacaatcaaactcccaaaagcgaaaaccaaagaacctttgggctggattcagtggctcacacctgtaatcccagcactttgggaggacaaggcaggaggatcacttgagttcaagctcagcctgggcaatatagtaagacctcatctctactaaaaatcaaaaaaattagccgggcgaggtggcatttgcctgtagtctcaggtcctcgggaggctaaggtgggaaaattgcttgagcctggaaggtcgaggctgcagtgagctatgattgaggcactgcactccagcctggcctaccgaatgagaccctgtctcaaaaaaggattcaacctgaggaagctgactaaaaaaacaaacttcagagaggagagaaatgcctcctcatatacaagggacccccaataagattataagcagatttctcatcaaaaactttggaggggtcaggtgcagtggctcacatccataatcccagcactttgggaggctgaggcaggtggatctcttgaggccaggagtttgagaccagcctggccaacatggcgaaactctgtctctaaaaatacaaaaattagccagggatggtggcgtatgtgcctgtaatcccagccatctgggtgcctgaggcacaagaatcgcttgaatctgggaggcagaggttgcagtgagctgagatcaggacactgcactccagcctggatgacagagtgagaatctgtctcaaaaaacaaaacaaaacaaaaaaacaaagtttggaggcaagaatacagtgggctgatatattcagagtgttaaaaagaaagaagacctgtcaactaaccatctaatacccagcaaaactgtccttcagaaatgaaaaagaaattaagatattcccaggtgaacaaaaatggagggagttcattagccacaagacctgccccgcaagaaatactcaagtgagtcctgcagagggaaattaaaggatattaaacagttactcaaagccatataaagaaatgaagatcttggccgggcacggtggctcatgcctgtaatcccatcactttgggaggccgaggtgggtggatcatgaggtcaagagatggagaccatcttggccaacatggtgaaaccccatctctactaaaaatacaagaattacctaagtgtggtggcttgtgcctgtagtccccagctactcaaggaggctgaggcaggagaatcgcttgaacccaggaggtggaggttgtagcgaactgagatctggccactgcgctccagcctggtgacagagcaagactccgtctcaaaaaaagaaatgaagaaaaaaaaaaaagaaaaagaaatgaagatctcaaaagtgaaggatatgtgcaattttaaaagctaatattactgtaacaatggtttataattgcatttttgtgttctacatgatttaagagactaaaatgcttttttaaaattagtctaaaagctagtagtattgtaatgttggtttgtgaatccacattttcttttcttttcttttttttttttttttagatggtgtcttgctctgtcacccaggctggagtacagtggtgtgatatgggctcactgcaacatctgcctcccgggttcaagtgattcttgtgcctcagcctcccaagtagctgggattacaggtgtgtgccaccacacccagctaatttttgtatttttagtagagacggggtttctccatgttggccgggctggtgttaaactccgacctcagttgatctgcccgccttggcctcccaaagtgctgggattataggcgtgagccaccgtgcccagcccacattttgttttctacataatttaaaataatttttttggtaaaataatttctaaagcatttaaaataattatttactttatggtttggggcacacagtttataaaggtataattttgtgatatcagtaagcaaaaaggttgaggacccagctgtaatggagtggagcttttctgtgttactgaaattaagctgatagaaatttaaattagtgttataactttaggatgttaaatgtaatcctcatggtaatgacagagaaaatcactgtagaatatacacaaaaggacatgagaaaggaatttaaatattttaatgtacccccaaaaatcaactaaacacaggagtagacagtaatgcaggaaactagggacaaaaaccttaaggcatatacaaaacaaaatgacaagccaggcgcggtggctcacgcctataaccccagcactttgggaggccgaggcgggtggatcacgaggtcaggagttcaagactagcctggccaagatggtgtaaccccgtctctactaaaaaaacagaaaaattagccaggcatggtggcggggacctgtaatcccagccacccgggaggctgaagcagagaattggttgaacccaggagacagaggttgcagtgagccaaggtcacaccattgcactccagcctgggcaacagagtgagactcgtcgcaaaaaaaaaggaacaaaatgatagaaataagtccctgtttattggttaattaccttaaatgtaaatggattaaactctccaatcaaaagacaaagattgtcaaaatggtttttaaaaccaatctgggctggacgcagtggctcacacctgtaatcccagcactttgggaggccaaggtgggtggatcacctgaggtcaggagttcgagaccagcctgggtaacatggtgaaacccaaactctactaaaaatacaaacattagctgggtgtagtggtgcatgcctgtaatcccagctacccaggaggctgaggcaggagaaatgcttgaacctgggtgacagaggttgtagtgagctgagattgcaccattgcactccagcctgggcaacaagagcaaaactccatctcaaaaaaaaaaaaaaaaacaaaaaacaatcctactatatgctatatataagagactcacggccaggtgcagtggctcaagcctgtaatcccagcagtttgggaggccgaggccagcagatgacaaggtcaggagatcgagaccatcctggttaatatgatggaaccctgtctctactgaaaagtggaaccctgtctctattaaaaaatacaaaaaaattagccatgcttggtggtgggtgcctgtagtcccagctactcaggaggctgaggcaggagaatggcgtgaacccgggaggcagagcttgcagtgagccgagatcgcaccactgtactccagcctgtgcaaaagagcgagactccgtctcaaaaaaaaaaaaaaaaaaaaaaagagagactcactttaaatccaaatgttgctggtgaaaggatagaaaaagatattccatgcaaatagtaatgaaaagggatcggggtggctattctactatcagacaaaaagagttacagaattgcaggaagaaatagacagttctacaataaaagttggaagctttaatatcccactatcaataatggatagaaaaataaagaaactttacatgataaaccaactagatttaacagacatttatagaacactctacccaataacaatagcatacattttctcaaatgtagatgggatgttttccaggatagactatatgttaagccacaaattagtgtcaatagattttaaaagatatacaaagtatgttcttattgcaaccacaacaggataaagttagaaatcagtaacagaaggaaaattggagaatccacaaatttgtgcaattaaccatatactcttagtcaaccaaagggtaaataaagaaattacaagagaaatttaaaaatacttaaagatgattgacaatgaaaacacacataccaaaatttatgggacagtgaaaacagtgctaaaggagaaatttatagctttaaatatatacattaaaaaataagaaaaatctcaaatcaacaacctaaactttaccatttaaggaactagaaaaggaagaaaaactaaactcaaaactagcagaaggaaggaaataataagattagaacagaggtaaaggaaatagagactagaaaacaatagagaaaatcagtgaaaccaaaagttgaatttttgtaaaggtaaacagaattgacaaacctttagccagatggatcaagaagaaatgagagaagacacaaatgattaaaaccagaaacaaagtagacccttactattgattcaacagaaacaaaaaggattatgacaggatggtgatctgttgaataccaacagattggataacctagatgaaatggacaaacccctagaaacacaaaacctactgagactaaaccgtgaaaaaatagaatacctgagtagatctataattagtaagaggatagaatcaataatcaaatatctccttgtaaagaaaagccctagacacgaagccttcaccagtgaatttaaccaagcatttaaagaagaactaacactatttcttctcaaatttttccaaacagttgaagaggagggaatacttctgaattcactctatgaggccagaattatgctgatatcaaaactagaaaagataaccacaagaaaaatacacatcagtatccctcatgaacattgatgcaaaaatcttcaagaaaatactagcaagtaaattcagcagcatattaaaaggattatacaccatgaccaaagtgggatatatttctggaatgcaaggatggttcaacatatgaaagtcagttacctaatatgctgttttaacaaaatgagggacaaaatcacatggtcactccactggtccataaaaagcacttgacaaaattcaacacccttttatggtaaaaacactcaacaaactgggaatagaaactaccccaacataataaaagccatatatgaaaaacagtgaacaattatacttaatggtaaaaaacggaaagcttttcctctaagatcagaaacaaggcaaaatgcctgcttttgtcacttcagttcaacacagtgctggaaattttagccagagtcattagccaagaaaaagaaattaagaggcatcaaaattgggaaggaagaagtaaaagtatctctgtttgcagatgacatgatcttgtatgtagaaaccctaaagattccacaaaaaattgtttgaactaatacatgaaactgacatagtagcagcatacaaagtcaatgcacaaaaatcagttgcatttctaaacaccaacaatgaataatatgaaaaagaaattaagaggaaaattccacttaaaatggcattaaaaagaataaggaggtgaaagactcatacaatgaaacatgaaacattgctgaaagaaattaaagacataggtaaatagaaacacattgtatgttgagaaattggaagacttaacattgtgtgtttggtttttggagacagggtcttgctctgtcacctaggctggagtgcagtggcacaatcacagctcactgcagcctcaatctcctaggctcaagtgatcctcccacctcagactcccaagtagctaggactacaggcatgcacaactatgcccggctttttttttttttttaattttttgtagagatggggtctcactatgttgctcaggctggtcttgaactcctgggctcaagtgatcctcctgccttggcctcccaaaattgtgggattacaggcatgaatcaccccgactagcctgacttaatattgttaagctgtccataccacccaaagtaatttataagttaattcaatacaatttctatcaaactcccaaggccattttttggcttgggagttttagaatataaaaatttattctaaaattcatatgggatctcaggagaacctgaaaagccccaacaaacctgaaaaagaacaaagctggagatctcaaacttcctgaacttaaaacttaactgcaaaaatgcagtcattgaaacagtgtattggacttggctgtggtatgaagaaataagaaaaagaagagaacagcatgatacataaaaatagacatagagaccgatgaaatcaatagcccagaaataaaccctcttatatagtcaagtgaaatttttttttttttttgagacagactgtcactctgttgcccaggctgcagtgcaatggcgtgatctcggctcactgcaacctccacctcctaggttcaaatgatgctcctgcctcagcctcccgagtagctgggactacaggcgtgtggcaccacacctggctaatttgtgtatttttagtagagacaggatttcgtgttagccaggctggtctggaactcttgacctcaagtgattcgcctgcatcagcctcccaaagtgctgggattacaggtgtgagccaccgtacctggcccagtcaagtgatttttgataaggacgtgaagattgttccacagggaaaggacagtcttttcaacaaatggtataggggaaactggatattcacatgcaaaagaatgaagttggacccttacctaatactacattcaaaaattaactcaaaatggccggggcctggtggctcacacctgtaatcccagcacttgggaggcccaggcaggcggatcacttgaggccaggagtttgagactagcggggccaacatggggaaactctgtctctactaaaaatataaaaaattagccaggtgtggtgatgcatgcctgtagtcccagctactctggaggctgaggcatgagaatcacttgaacccgggaggtggaggttgcagtgagccaaggttgcaccattgcactccagcctgggcaacagagcgaggctccatctcaaaaagaaacaaacagacaaaaaactcaacaatgaaaaaacccaattcaaaaatgggcaaaggacttgaatagatgtttccccagagaaggtaaacaaatgaccaataagcatatgaaaaatgaccatcactaattattagggcatgcatgtcaaaactataccccacacccattaggatggctactgtcaaaaaaaagaaaaaaaggaaataacaagggttggtaaggatgtgagaaatgggaaccctggtgcattgttcacaggaatgagatgatgcagccaatactagaaaacagtatggtggttgctcaaaaaaattaaaaatagaattaccatatgataccaaaattcagtcctgagtacagtatgtacccaagataattgaaagcagtatctcaaagagatgtttgtacactcatattcataggagccttattcacagtagttaaaatggggaagcaatccatgtgcgtctatcaacggatgaatggataaacaaaatgtagtatgtacatacaagagaatatgagtaagccttaaaaaggaaggagttctgatatgtgctataacacggatgaaccttgaagatactgtgttaaggagataagccagttagaaaaaaggcaaatactgtatggttccatttgtatgaggtatttagagtattcaaaatcacggtaaaaggaatctgaggagattaaaaaaaaaagagtagtcaaaatcataaagacggaaagtagaatggtagttgccaggggctggggggagggatgaatggggaattattgtttaatagagtttcagttttacaagattaaatattcgtggagatggataatggtgatgattgaagagcattatgaatgtattgaataccactgaaatgtatactttaaaaagggatactggtaattttacgttatgtgtattttaacattaaaaaattgggggatgagggctgggcatggtggcccacacctgtaatcccagcactttgggaggccaaggcgggcagatcacgaggtcaggagatcgagaccatcctgcctaacacggtgaaaccccgtctctactaaaaatacaaaaaaagcggggcgtggtggcgggcgcctgtggtcccagctactcagtaggctgaggcaggagaatcgcttgaacccaggaggtggaggttgcagtgagccaaggtggcgccactgcactccagcctggtgatagagtgagattccatctcaaaaaaaaattaaaattggggcatgagggcagggtgcagtggctcacatctgtaatcccagcactttgagaggcccaggcaggaagatcccttgtgcccaggagattgagaccagcctgggcaatatagtgagaccttgtctctacaaaaaaaaattaaaattacctgggtgtggggcacacgtctgtagtcccagctacttgggaggctgaggtgcgaggatcgcttgagcctgggaggttgaggctgcagtgaactgtgattgcaccactgccctcctacctaggtatatttgttttttggtttttttgttgttgttgtttcttgttttttgagacagagtcttgctctgtcgcccaggctggatgcaatggcacgatctcggctcactgcaacctccgcctcctgggttcaagtgattcttcctgcctcagcctcccaaatagctgggattacaggcatctgccaccacgcccagctaatttttgtgtttttagtagagacggggtttcgccatgttggccaggctggtctcgaactcctgacctcaggtgatctgcttgccttggcctcccaaagtgctgggattacaggcgtgatccaccacgcccagccctgtttttgtttttgttttttcaacagatgtaatttctgacttgtataccttttcaatcaagaatatgtatggactgcagcctgatgaagtttttcactcctttagtaatgtcctccttgttttacattttcaaagcctgcatagttacagattcatttgttttcaacgtttccccaggggaagacggaatctatcactgtggtgaagctgctgagctgctttgatgacctggtggcagcaggcacagcctctggcagggttgcagtttttcaacttgtatcttcattgccagggagaaataaacaggtgagtactcatgatcttaacacgtgttaacttcttggcacattcctcatggatttttaaaattagaaatcctcatctgcttagaaagtttatgctcagagaaagccgggcacgactttctctgcccaggctcatgcctgtaatcccagtactttggaaggccaaggcgggctgatcacgaggtcaagagatcaagaccatcctggccaacatggtgaaaccccatctctactaaaaatacaaaatttggccgggtgcagtggctcatgcctgtaatcccagcactttgggaggccgaggcaggcagatcacgaggtcaggagatcaagaccatcctgactaacacagtgaaactccatctctactaaaaaatacaaaaaattagccgggtgtggtggcgggtgcctgtagtcccagctactagggaggctgaggcaggagaatggcgtgaacccggaagacggagcttgcagtgagcggagatcacgccactgcactccagcctgggcgacagagggagactccatctaaaaaaagaaaaaaaatacaaaaattagctgggcgtggtggtgcgtgcctgtagtcccagctactcgggaggctgaggcaggagaatcacttgaacccgggaggcagaggtcacagtgagctgagattgtaccacgctactgcactccagcctgacggagcgagactctgtctcaaaaaaaaaaaaaatgctcagagaagcttaacactgtgctgtttataattggagaacatttttgtgctgggttggacacttggcataaagtacatgtgggtcatttcatttttgcttaatattctcaaggtatgctctctgtgggttttgaaggtgactagacagatggaactttgtgcagggttctgcttggaaaacgagattgggaaaaccagctcttccctaactaggagtgattgtataccttttccatgtagccccagctcacagcatttatcctttttttttcttgtgtatatttttatcccttgttcatagcttcggagatttgatgtcactggtattcacaaaaatagcattacagctctggcttggagccccaatggaatgaaattgttctctggagatgacaaaggcaaaattgtttattcttctctggatctagaccaggtaaaattattttcagaaatactgttggctcttaccttcttacatttggaaaaactatatttataacttgtatttttagtcaacttgtattcttgatcatcatccctttataatctcaattgttatttgtaacatttacttttatagacttatgttttataagcttccacttctatgactaaggagttggcctactggaacattcacttttttcattccactgttgtgtattacttttacttgaaaaagaagctattatcattcctacttccttgaaaggttagtaggagtgatgccaagcacttctgaatcctaactgtggacaagtcagtgatttcaatggatggaggactctgccagccacctggcctgtgtgagatgacctcatgtgacaggaagtggcagaggaggttaggtggcagtatggtgaagatgaagaaactggagtgccaagagatccaggaactagtccaggggtgcaggcttgcacctcacagagcttgctttcaaactgtgcttctgcttcgacgcccgtgccttttccactgcacgtatggcttgatgatctgctgggttttatttgttttgtcatgtgtctgcaaccaaactgaactccttggtggcacagtcctttctttttcttatttgtagccttcattcctagagcactataggaattcagcaattttttttttttttgagacagtctcgctcttgtcgcccaggctggagtgcagtggcccaatctcggcttgtgacaacctccatatcccgggttcaagcgattctgccacctcagcctcgcaagtagctgggattacagggacctgccatcatgcccgactaatttttgtatttttgtagagacggagttttaccatgttggtcaggctggtcttgaactcctgaccttagatgatctgcctgcctcggccttccaaagtgctgggattacaggcgtgagccaccacgcccagccaagaattcagcaattattagctgcatgactttcagtccctctgatccaagactgacctagtacaaatattctctagtagtagttctcaagctttgtagtcacaggatccctttacactcttagaaagaggaccccaaagcatttttgttcatatgggttatctctaccaagtacaccatgttagaagttacaactgagaaatttaaaaatatacatatttttttgagatggagtctcgctctgttgcccaggctggagtgcagtggcgcgatctcggctcactgcaacctccgcctcccgggttcaagggattctcatgcctcagcctcccgagtagctgggactacaggcacctgccaccacgtctgactacttttttgtattttttgtagagatagtgtttcaccgttttagccaggatggtttcaatctcctgaccctgtgattgaaatctcccacctcagcctcccaaagtgctgggattacaggcgtgagccactgcgcctggctgaaatttaaaaatattttactttgaaataataaatccataacatctgcacataagtgacatattttgtgaaaatatctctatagctctattttcaaaacaggtgagaagagtgagtggcattgatttatatttttacaaatttctttattatctggcttaatagaagatggctggattctccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaataaaaaataaaaaataaaaaaataaaaacacacctcaccaagctcagccaccaacttaaaaaggactggacaatacttttaccactttcccttctcagaattcaggcctgtcctcggaatgctacagggtacagcccatttgagctcctgtatggatactcctttttgttaggccccagtctcattccggacactagaccaacttagactgtgccccccctcaaaaaaaaaaaacttgtcatccctactatcttctgtctagtcatattcctattcaccattctcaactaactcatacatgccctgctctggtttacactgccggtttacactgtttttccaagccatcgcagctgatatctcctggtgctatccccaaactgccactcttaactcttgaagtaaataaataatctttgctggcaggactgtgctgaatctccttaggcactctctaatcagatatcctgagtcgtcccaattcttagaccttttatacctgtttttctccttctgttattccatttagtttctcaattcatccaaaaccatatccaggccatcatcaatcattctatatgacaaatgtttcttctaacatccccacgatatcaccccttaccacaagacctcccttcagcttaatctctcccactctatgttcccacgccgcccctaatcctgcttgaagcagccctgagaaacatcgcccattctctctccataccaccccccaaaaatttttgccgccccaacatttcaacaccattttgttttatttttcttattaatataagaaggcaggaatgtcaggcctctgagcccaagccaagccatcacatcccctgtgacttccacgtacgtatacgcccagatggcctgaagtaactgaagaatcacaaaagaagtgaatatgccctgccccgccttaactgatgacattccaccacaaaagaagtgtaaatggcctgtccttgctttaagtgatgacattaccttgtgaaagtccttttcctggctcatcctggctcaaaaagcacccccactgagcaccttgcgacccctgcccctgtccaccagagaacaaccccctttgactgtaattttccattaccttcccaaatcctataaaacggccccacccctatctccctctgctgactctcttttcggactcagcctgcctgcacccaggtgaaataaacagccatgttgctcaaaaaaaaaaaaaaaaaaaaaaaaaaaaaaaagaagatggctggattctgcattcaatctgttgccatacattgttttgattgaagtgtataaagaaaaactggctttacacagacatgtagttggaaatgggaggagtattttgatagccttttcagatagttgtggacattctttaataatatcctcatatgactacctcataaagcaaatggtagttgctttaaaggttacggtgacaaatgacaaatggtagtttctttaaaggttagtaaaaatgtggaatctgaaaccacatggatgaatttttcctactctgttacattaaaatctactttacccatgttggattttgtaacattatgtattggtcacttagaaaatactattcacagagtgatgcagatcttccaaatgttgacactttttttttttttttttttttttttgagacatggtcttactcctctcacccaggctggtgcacagtggtgcaatcacggctcactgcagctttgacttcccaggttcaggtgattcccccaccttggcctcccgagtagctgggactatgggtgcacaccaccatgcccagctgatttttttgtatttttatagagacagggcttcgccatgttgcacaggctggtcttgaacatctgggctcaagcaatctgctcaccacagtcttccaaagttcttggattacaggtttgagccaccgtgccagctgataaattttctaatacaatatcaaaaaaataccttcattaacatcaacatcattgtaatcgggaaagtctagctataaggaatcatgtcaagttcacagggacagatacaagttttcagattgctaatctttgtgtgagagcaacaaataccattacttgttttccttgaagtgacaggcttttttttttttttgagaaaatgtctgctaaatacccaaatttgaataattacagcatttcaaataaaaatggtgttttgtgaaaaaagcagctggctcagctcatagctgcaacagttgcacaagtggtttccttgagagaaccactgagtgtatttcagtgtgcagcagaagggagaatacaaaagtacctatcctctggccaggtgtggtggctcacacccgtaatcccagcactttgggaggccaaggcaggatgatcacttgagcccaggaatttgagaccagtctgggcaacatggcaaaaccccatttctaccaaaaaacataaaaattagccaggtatggtgatgcacacctgtaatcccagctactctggaggctgaggttggaggatcagttgagccttggaggtggagattgcagtgagctgagattgcaccactacactccagcctaggccaagagccagaacctgtctcaaaaaaaaggtttgcaacattttcatgtaatggaaatttctttatcttgattttggtgttggttacatgactataaatttgtcaaaattcatagaattgtatacccaaaaagggacgaaatttactgtaagttttaccaacaaatctgatcactgccccctacttccctcacaaaatgtcagtgatgttacagcagtatttctgaaataattgatgaaacttttcatatatatattggatttcatatatatgaaatatacatatatttcatatatatataatgtatatatatatatattttttgagacagagtctcactgtgttgcccaggctggagtgcagtggtgcgatcttggctcactgcaacccttgcctctgggttcaagtgattctcctgccgcagcctcccaagtagctgggattacaggcatgtgccacctcgcccagctaaattttgtatttttagtagagacgaggtttcaccatgttggccaggctggtctcgatctcctgacctcaaacgatccacccacctcggcctaccaaaatatagggattacaagtgtgagccactgcacccggcctgatgacacttttctgtaaaagtaacttacagaatcagattttttatacaatgaaatatgctttgtgttagcagtcgtatgccttctagaattttattttgtgtttatatataaaatatggtttttttttcttttttaaagacagagtctcactctgctacctgggctagagtgcagtggtgtgatcacaactcactgtaacctgaactcctgggctcaaatgatccttctgtctcagcctcccaagtagcggggaccataggcacgtgccaacatgcctggctaataaaaaaaatttttttgtagagacatgatctcacaatgttgcccaggctggtcttgtaaagtatcattttatgttaatagcattttatatatttaatatcatttaatttcttctaaccttctgttttctattaccctttcagttggcaaggatataatgtcctcaaagctgctttgaaccctttgtgaggggagactataatatgaacttacagagctgattattgtcgcaataattttatagaatgttccattccattgttttataatagaataagcaatacacacagtgcaacagatttctgtttagatctttatggattcttctttgaactctctgcatgtttactgcatcatccctgagcctgctatggtgcacagtaaagaatgtatctactgaggacatgtttttaaaaattatgcagattttaaaatgtttcctgtcaaactggatgcagcatgagggagatgttagtatggactcttttcccatccgtcaaataatctcgctatggtgggttgagagtgaatctgcagagagtgaaagcatgcgttaagtaaggtgcaagctgacctaagcacagctagcgggaaggacactgacttgtcctaagggaggtccattctttagcctggcgctgatgtgaggtgtaaccagactttctctgccaggggctctgtaactcccagctggtgttggaggagccatcttccattgtgcagctggattatagccagaaagtgctgctggtctctactctgcaaagaagtctgctcttttacactgaagaaaagtctgtaaggcaaattggaacacaaccaaggaaaaggtaagtttcacaagtttgccagtttggcctaaatgctgggccttgttgtagaaggtgctttagggtttcttaggtctcctgtttgccggagacctcctgtttgcaaacccacagcgcctctaagcctggggttcctggtggggccctgtgcctgcttaggatttctcctcccagaggcagacaagaagagtgtgttcttcttgtcgcagagctgtaggagcctgcacacacagccactctgcctctcagggtgccacagtcagcgcagagaagcctcaggggtggcctggtctatctgttccttgtggagccacctcctccacacagccctggtgaggggtcagggttgtggggctcactcgttattcagcacgtgtttaccatgcacccctgtgcactgtggcaggctcagcagtgacatggtaaacacggcagatctgagccctccgttgtggaaatggaaacacagatagaacacttgttgaccactgtgtcagctgctgtggaccaaaatacacaggatgctgtgtgagtttagacacacttttgtccaggtgaagggtcagggaagacatcctgaaggcatgggttccaggttgagagatcattcctcctttgaccagtgatgtggaggaagggcatcgagaagtccaccagccataccagccgtgtgggaaaagacaactggaacacctggggaacctgtaattcatcatcccaccctagcctgtaaagcactcttgtaggactctgcagcgagtttgcgtggggatggggtgaggaggggtaggtagagcagtggagctgacccctcctatgccaaggaggaggtagactggggccaacgtgggggtgggaagcagagggcggcattagtacagatcatgcgttgatgagtctacagtcatggattgtcgattggccgatgggagctggaagagttcccgtcttgtgtctcccaggaaagggcactgtttgcctgcatagaatcaggggcagggcagctgatggtcacggcatgtggggagggcttgaggctggccctgtggagagtgacagcagggactgggaaacatggtgagattggcaggcgttgatgaggccctgcggctggtggtgccgttggggacaggccgtcctggagagtcgggtgaggcggagccagcccctgtggtcgtagtcactgcccgttattctgtgttctgggctttgcggcaacacacaagtttattctcttttctgcatggcagccctccggctgttaaaagacgctctcaaacctcccctttcttctattttcgatgctgaacaccttcttttttctttttctttttcttttttgtttgagacagagttttgctcttcttgcccaggctggagtgcagtggtgcgatcttggctcactgcaacatctgcctcctgggttcaagcgattctcctgcctcagcctcctgagtagctgagattacaggcatgtgccaccacacccggctaattttgtatttttagtagagacagggtttcaccatgttggtcaggctggtctcaaactcccgacctcaggtgatccgcctgccttggcctcccaaagtgctgggattacaggtgtgagccaccacatgcggcctgctgaacaccttcttaatcccatcaacaatctggcctttttatatctgcagtctccctttcggtccctggagaactcagtggaatttatggccctgcagatcttagttctgctgctctctctgccagtatcctactcctctggcattttatcctggttcgtctgtcaatgttttactgcactgtcttggaaggaaggcagagtgtaaagagaggcattgaaaaccaattactttacatgtgggtcctattcccaacaatctctcttaaaacctggcccttggccggacacagtggctcacgcctgtaatcccaacactttgggaggccaaggtgggcgggtcacttgaggtcaggagttcaagaacagcctggccaacatggtgaaacctcctctctactaaaaacacaaaagtttgccaggcagggtagcaggcgcctgtaatcccagctactcaggaggctgaggcaggagaatcgcttgaaccggggagacaaaggttgcagtgagctgagactgcaccaccgcactccagcctgggtgacagagcgagacttcatctcaaaaaaatcgaaaacaaaaaaacaaaaaacaaacctggccctttaacctcttgtgtggagacccaggcagtttctgtaaacctctcctagtgcgtctgtgcagtcaagtctttagggaacattgattgaaagcgtgctctgctccccaggaacgttttaggatgcagaaacaaataaatgtgtccccttctcagaaggagagagattttactgagccttggggaaatgagggctaacagaataagaggaaatgtttttaacatctgtgtcttaaagacttgctttctgctgtagactattgtgtgcgtctatccctggaagcagtgcttccctcacaactgtttagtgagcggagctaggcatgtacacgtggaggcgtgacagcaagtacggaggcatccaaggagacaaggcctctgccctcaaacacaatgagagagactgtcggtcagcaggaggagagtagaggctgtcagtgctgtaaaggagcgggctaggtgaagcattagggagtgctaggcatggggcaggaagttgcatttggataggatggtcaggaaaggcctctacaagggcagtgatctttgagctgaagcctgggaagagctgctggaagagcattccaggctcagggaacagcatatgccaagacctcaattgggcaagagcttagatgttcaagaagccagaagtgactagggcactggctatggctggagtccaggggagccgtggggaggctgacacgggagtccaggggagccgtggggaggctgccatgggagtccaggggagctgcgaggaggctggcacgggagtccaggggagcctggcatgggagtccaggggagccgtggggaggctgccacgggagtccaggggagccgtggggaggctggcacgggagtccaggggagccacggggaggctgctgcaggagtccaggggagccgcagggaggcaggggagccgcagggaggctgccttgggagtccagggaaaccattgactgagatggagactggagactggggaaggctgggccagaggtcaggacatcaggacctctgctgtggacataaggggtttgacgggcctgtcaggtggctgcgtgggagtcgcagaagagagttctgtggaccggtctggagcccagggaagaagtcttgaccagaggggaaaatgaggtcaccagatacaggtgacactgacaccctgacattggatgaatccacgcagggaatgtctgttcattcagcgctggagctttgcgccaagcctctgccctgctccagtactcctcatcgggggatatctgtgaacaaggcagaacagatctctaatctcagggagctgtgtgcagagtagtgaacagataaacatgtcagagggtgcagagccagagagggaggagcaggagacacaggtgtctctttaataggatgacagggaaggctcctctgaggaggtagcatgggctgattcctgaaacaaagaggcaactagtgcgagaagaccttagagagaggctctggaggcagagggccctgcgcaccgaggatctgagcagccaggctggctgtgtggagcacggtgtggggagccccctcccgtcggctttgtgggccctgcccatggggctctttcagtccagtgctgtggtcagtcacagagggctgtggccaagccagggaggtcactctggctgctgcttggaatatgctggagggggcaggtgtggcagctcagcagggccagcaaggattctgggtgatccgggtaggagaagacaggatggggcggggttggtggtcggactgcttccaaggcagagctggcagatttgctgccacgttggttctgaggtgtgagagggatgagttggagatgattcctaggtctgtggtctatgcagctgggtgagtggacatgctgtggattgacgcagagaatcctggaggcacggggagaaggaggagatggaacagcctgctgtggccccgccatgtcctctccctgcagtggagagctggcgtgggaggcgggtggcgggtgtacctctcggggagctgtgcgctggcagccactggcatgcagacaggagctcgcctagggagatttgggcaggcttgtgttctgaagaggaaagggcatcaggagagaacaggagttggggggtcagaggagtcggaggccatatggagggacatagcagctgctgcgagaccgggggctgaggcagcttcgacgggcctgagtctgtagcatggaggctgtgcacagccctcctcatcagcagggccaagggattggaagggctgaaagaggagttgacggcgagtatggagagcttttaggaggagtgtttttgtagaagagaacaaagaaagacaaataggtggtgcccaggggggaaccatgtggcctggtgggagttttgggagaggggccgtgtggcagcacattggtgtgtgacgcgggtgcctgtggagggaacacagtgctggtggggacagagtgcaggcggtggcctcagttgggccctctcatgggcagcagtgtagggttgaccagaaaccgggacagagactctcttccagagaaagggcagggcactgagcacagggcaggtgcaggcaggtcaggaggcccagaggtagaagacgaggggtcctcttcccgtcgagtccgtgaacctcttcagaccggatgatgtgtgttacatccagaaaacctcagaggccctagccatctgcaaccgtgggtttgctgtcctgtgtatttatgttgcattgtttcatgtgtcagagccctctgcagacctgttactgtgtcccctgtgagtctagtactcagggaagccctccctggcagtagcactttgccctggggaaggagaaggagacgcagcaatctgtaggtgtggcgcccgcatgtgggtaagagccagcagccggttctggaaccccgcgactagcacatctgtttggatggccagtgggtgttagctgttgagatctctggcagggcttctgtggatccttcttctcactcagcttagactttcaggctcccattttgggtgctgtcagctttcagcgtatcagctctgtggcaccatacattatgcacaaaatcataaaacaccattttatagctagaatttgttagccagaacacactccttacatatcaacgtggtctataaagggaattaaaatttttttaggtaatcaatgaggtttttggaaatcatctctaccgaaattaagaaattatattaatttgtttatgattttagaatcctgcaatacttagaccttaaaagttggagcttcagtgtcaaattcagaaagcaccagcaagtactgcagaatcgcactgcaagtggatggtggctgagtcgggggcttaggacaatttgtacctggctctagctggttcttcacaacttcactgcctttgaccaacccactcatcagacatttccgttctttttattttttagagacagggtcttgctgtgtcaccaaggctggggtgcagtggtgtgatcacagctcactgcagccttgaacagctgggttcaggcgatcctcctccctcagcctcccgagtaactaggactacaggcacgcaccaccatgcctggctaaattttttaatttgtagagatggtgtctctctaggtcacccaggctgttgtcaaactcctgggctcaagcagtcctccctccttggcctccaaaagtgctgggattacaggtgtgagccaccatgcccagctattcagcagttttagaggcagccactcccaggaccttgctcagcagggctcctttcccttcctccagggtaagagtccacctggtgttcaggacctcgccttctcatgcccactcagatgcaccaccttgatctgagctctttgagcagctctttgagcctcagatggcgcttccagatgctgatgtgattgttcacacaggtcagcacagtgttatgagacaggctgaggacctcatcttatttattttttattttacccagagcatcaaacacgatgtcttacagaatgtaggaatcactaaatgtttgttaacatgagtgctttagttacataagatgaaccagtcaaaatggaaatgacaagagatttttcagaggtcctacaaatagaaggaaaacatttaaaaattggatcgccaagagaaattgattgacaggaaaggcagaggaagagattatgggctcccttgctggaattcctctggttcgctctatttagaggacatctccagaacaaacccaccaaaggcagtaatcagatacgatgctgttgatagagttgtccataaaagatccacgatgtcaaaacacccttggttcgtcctaacgatcattgtttcaaagctgaatttgatatataatatcctccttggaccctatccaaagggatttagttactgaggtgccagagggacctagtgagattctggtgtgcgaagaaaccccgcaaataactatctgtttgcctatgtgggtgggccctgggggtggcctctagggttgggtgtgctgctgtgtgcagggagtgtgggaacaggcacagcacaagttggccgaggtctggtggggaagcagtggcacggaggcagctctcaactgtgacctgcctgtagcctcgttcaggacaattgagcacttatggggacttagtgtcacaagcattgcttttgtgctgcatgtaagtaatctcattaattcctcacttcagcctttgagatgggagttactctgcctggtttacagaatgggaaacgggtccagaaaagttcaataattgcacgtaccacatacccactaggtgtcagggctggacatcgagcccagggctagctctaaaaccagtgctgtttctgcttttcacaatctgagaagtatttgggagaaggaatcagccaggcatagggctgaactgaaatgcttacatgtgaactctgttagcatcctgagaaataacgagaactcagattgccagtgggagtgtagattgtataatcacgtttaaaaagcttgaagttgtcttctaaacttgaatatgctctcagcaacccagcgattaccccacagcccaccaactgcatcctgagtgtccgtgacagactctgacacctgtgggctaaggggtatgcacagaaatgctcatagcacaattgctcaaaatagctttaaaaaataataattgaaatatccatcaacaagaaaatgaataaatgaattgtggaatacattaagtcctcgtttaatgtcattgataggttcttggaaactgcgacattagcaaaacaacgtataacaaaaccagtgtttttccctcaccaatgttgttgaaggagatggtgttatctgaggacctgctctatgtcatttcgcttacagttgtagtttctaagaacctgtggacgctgagtaggacgtactgtaccattcagcagtagaaatgaattagtgcgacagcttctttttatcaagaaggataaatctgagaaacatagtgttaagtgagaaaaagcaaaagagtacaattagcatcatacattttaataaaaatgaaagataaacaatactaaattatattgtctttagagatacatagatatgtgattaaaccaacaaaaaagtgaggaaatgataaaggcaaaatgcagtccagtggttccatctggggcacaagggggcaggaagtgttaggagcacaggagaacattggttgggtgactgatgatttctttcctaagtttggggatgggttcccaggtgtacctttccttgctaggcttcataactgcatggatatatgtacatatacacagtggtgcactgcataacaacatttcagtcattgacggactgcatgtatgacagtggtcgcagaagattataatggagctgaaaaaattcctatcagctggtgtcttagcgccacacattacgtgttctgtttttagatagacaaacagtcatcattatgttacaggtgcctacagtgttaagtacagtcatatggagtacaggtttgcagtccaggggcaataggctagactaagcttgtccaacccacggcccaacacaaatttgtaaactttcttaaaatgagattttttggccaggcgcagtggctcatgcctgtaatcccagcactttgggaagccaaggcaggtggatcacttgaggtcaggagttcgagaccagcctggccaacatggtaaaaccccatctctactaaaaatacacagttagctgggcatggcggtgcacacctataatcccagctacatgggaggctgaggcaggagaatcacttgaacccaagagggagaggttccattgcattgagcccagattgcgccattgcactgcatcctggacaacaagagcaaaactctgtctcaaaaaaaaaaaaagaggttttttttgtgactattattattattattattatttttagctcatcagctattgttagtgtattttatgtgtggcccaagacaattcttcttcttccaatgtggcccagggaagccaaaagattggacagccctgggctagactatgtgggtgtgtcataggctgtgccatctaggtttgtgtaagtacgctctatgatgttcacacaacgaagacatcgcctaatgacatatttctcaaacatccctgtcactaagtgacctgtgactctatatatagcatattcttttgtttgtgtcagatatttcataatttcagaaagaaaaaatatcaagcttgggggcaggaagggacattggtgcctctgatgggtttagagaaattctgaaaaggcaacaatatagatgggttgctgtgaagctcattcattcaggatgtggactgagcacagcaatcagacgtcagaagcaacagaatcagagcagggaaaggatgagcagacctggattcttcaccttctgcctcagtttcctctcctccaaaacgggagttgtaatacagtcatgtgtcacctaacaactggaatatattctgagaaatgcattgttaggtgacatctttgttgtatgaacagcattgagtgtactgacaagcgtaggtggtaggtacagcctacttccacctgggctaaatggtacagcatattgctcctgggctacagacttgcaccacatgtgactgtactgaatactttaggcagctgtagcacaacggtaagtaattgtatgtctaaacatagaaaaggtaccataaaaatatggtattataatcttatgggaccactgttgtatttgcggtccatcattgactaaaatggtttgttgttgttgtttttgaagcagagtcttgctctgtcacccaggttggagtacagtagtggcactatctcagctcactgcaaactctgcctcccaggttcaagcgattctcctgcctcagcctcccgagtagctgggactacaggcatgcgccaccatgcctggctaatttttgtatttttagtagaggcatggtttcaccatgttggccaggctagtctcaaactcttgacctcagatgatctgccgtcttggcctcccaaagtgctgagattgcaggcatgatgcatccagcctgaatacaatgttatgtgatgcgtgactgtatctgccactcatggttgttgtaaggattagacacgagagtgggatcaagtgccaggcacagtgcaggctgtgtgagtactcagtgaatggttccctgtgtgctaatggggcacacacctgtgagggtgtggtcgggcctctgttggtacagggatgacagtgtggtttgacaaaaaacaaacagtagaaagggtgaaaaatcaattattgtcttagccaaaaaattcttgttgtacttaatattaagggttgacaactgcattactttaaatcagtccatgtctgttttttgttctttctttctttcttctaattttagtactgggaaatttggtgcttgttttataccaggactctgtaagcaaagtgatctaaccttgtatgcgtcacggcccgggctccggctatggaaggctgatgtccacgggactgttcaagccacgtttatcttaaaagatgcttttgccgggggagtcaagccttttgaactgcacccgcgtctggaatcccccaacagtggaagttgcagcttacctgagaggcacctggggcttgtttcatgtttctttcaagaaggctgggtgctgagttggaatgaatatagtatctatctcctagacacagtcaaccaggtaagtgaagggacgccaccatatcttctgtgtctataggcaagagaatgtatctctataaactgttctactcagggacctcagaatgctaccaggagcagtattgacttacactttactttttcctttgggccagtcaaggaaatcaaatgaaggtttggtaatttttatagatttgaaaaaaaaaatttggttttgacatttaggtccaattttctgccgagaaatgatgtatgttttttgtatgtaaacacaaaattaaacttgttctttttgttgttgttgttgttgttgttgttgttgagaaagagtctcgctctgtcacccaggctggagtgcagtggcatgatctcggcttactgcaacctccacctcccaggttcaagcgattctcctgcctcagcctcctgagtagctgggattacagacgcatgccaccacgcctggctaatttttgtatttttagtagagacagggtttcacaatgttggtcaggctggtcttgaactcctgacctcgtgatctgcccgccttggcctcccaaattgctgggattacaggcgtgagccaccatgcctggtttttttttttgttttttttttttgagatggagtcctagtatgtcacccaggctggagtgcagtgtgcagtggtgcaatctgggctcactgcaacctccacctcccgagttcaagcgattctcctgcctcagcctcccaagtagctgggattacaggtgcgcaccaccacgcctggctaatttttttgtatttttagtagagacagggtttcaccatgttggccaggctggtctcgaactcctgactcaggtgatccgccagcctcggcctcccaaagtgctggggttacaggcgtgaaccgccgcgcccggccgccacttggttttttttttgttttttgttttttattttcagttttctttacttagcaatatatcttgggcaaatttccaacatcattaaaatcatggtaggaaataatttctgcttaaaccaagatgataacagattatcatcagagacagatttagaaactttaaacaaagctgtttagtttcagtttctccttgtcttaagagcagagcttttgctctttttaaaataaactccctgccttaccctcccgactcctcacccccagactctagaccaggccctgtcctgttcacgttcttccattctgagctcagcgggcctctgacaggcacccctttcttttataagcagagcctcactgtagaaaataaacagttttcagccaggcgcagtggcttacgcctgtaatcccagcactttgggcactttggaaggccgaggtaggtggataacctgaggtcaggagttcaaggccagcctggccaacatggtgaaactccgtctctactaaaaatacaaaaattagccaggcatggtggtgggcgcctgtagtcctggctactcgggaggctgaggcaggagaattgcttgaacctgggaggcggaggttgcaatgagccaagatcacaccactgcactccagcctgggtgacagagcaagacttcatttgaaaaaaagaaaagaaagggttttcttctttggtgtgtgtcagcagaacatgaagttcatcttctcctcattgaagttttatgaattattatcagccgtacctggtaacactggtttggcagaaagaaaactggcccggggtggggggcagaactagactcgactcttctagcctggttctgcctttaaccaagagtctcttatcggccggagcctggtttgttttcctgtaaaatggggtgggggtggaagaagcatcgacttaggggaatcaccaaggtgccttgagtttgttcattttataagggatattctgaaaggtatttttgcaccctttcctcagttacagagaacttctttccctggataccttttgaacttatgtgcacttattaattagtagcatcaagatgctttgtaactgtgcattggttctttcatctgagcatttacccgatgctttacccagtaggtataattaacttcattttataggtagagaaatggagacaggggaccgtctgggacagatgtcacagtcaccctcagagactggaccacccagtggcagcatgactggcagctttcggaaacaaatgttatgtttgcagcagtccatcagttatttaaaattagccaaaaacatagactctccttctacaacagactagtctctttatttgcactgtctacagcaaagcaaggacttgctttaagtcagtgtgggctcaggatgtcctgtgttttgttgccacccactttcagataatgctggaggaacctcccctcccttcatgtattcattcaaaacccatgagttgcagtgcgcactggcctctcctgcaggaatgcacacagtagggggactagacgtgtctgcacgttatttcagcccaggagtggggcgtcaagcggaagtttggatgaggtgctgcaagccctgagagccctgggtgttgcagcagagggcaagcttgtcagaggctgcttctcacagaggtggcgtctggagagaactggaacttccccagcaaacatggataggaaaggaatttgagcagaaagagaagcacgtgcattcaccatggaggaacagggctgggactgggctggcagggccggtgcacctgcagcagggacgagggcagggtggtacgtgggtcggagatgaccgaggccccaccatgccaggggacccctcagatcctgcttaccaatctgtgagatgttacctaactttggattgaattggaattttcagaaagttaccatagtaaagtgcagttatcatttgactgatttggactctcacacatgcatttttatgctttgagctgttaccgttgtttagttttgtgttttttgttttttttttttttttttttttgacaggccacagttgctggtttggaaggatccggtgatattgtgtctgtttcgtgcacagaaaatgaaatatttttcttgaaaggagataggaacattataagaatttcaagcaggcctgaaggattaacatcaacaggtttgtatttattataaaatgtaccatgtatatgatgggaagtactatactctgttgtttgtaattgcagttaataattgatcaaacttaccattgggccaggcatggtggctcacgcctgtaatcccagcactttgggaggctgaggtgggtggatcgcttaagctcaggactttaagaccagcctgggcaacatggtaaaaccctgtctctaccaaaaatacaaaaaactagccaggcgtggtggcatgcgcctgtggtctcaagtactcgggaggctgaggtgggaggatcgcttgagcctgggaggcagaggttgctgtaagctaagattgcaccactgcactccagcctggatgacagagtgagacctcatctcaaaaacaaaaccaaaaacttaccattattttgctaaactattgcaactttatttgaacttggaggatttggagggtttcctctgattctttttttttttttttgagatggagtttcgctcttgttgcccaggctagagtgcaatgaggcgatctcagctcaccgcaacctctgcctcccaggttcaagctattctcctgcctcagcctcctgagtagctgggattacaggcatgcgccattatgccaggctaattttgtatttttagtagagacagggtttctccatgttggtcaggcaggtctcaaactcccgacctcaggcgatccgcctgcctccgcctcccaaagtgctgggattaaaggcgtgagccactgtgcccggccgctcctctgattgttaaaatagcatttacagtacatttcttgaaagtcacctactttaaggcttacatcagatagtctcacatttagtggagttgctttcatggttgtggaagatggggagattgagaaaggaggaaggaaaaatcagaaaccactttactgatccctgctctccgtctgagacagtatgtgggattaatgctccaaaagacatagatttgcatagagttttagaatatttaaatctgtcatctgggacataccgtttacccttaactcagttcttccttgtaggatttatttttctctgtgcttttgacattttttggtaattcatacaagcccaaattttaatgagcaaagaatcctaatatgtgtcctcttgcggacatccacatgctttatatatttgggttcctcggggaacttgttcctcatggtggcaacaacagccatgtggaccccatcaccctcctcctcactaccattacctctgatgtcagagagggcaaattggggtgaatattccaaaacataatttgtataagaagtgaataagctctgactcttgagtttatgagctgggggcccctcagacagtgtcatcaaagggttagaatggctttcaggaagggtggtgacttggagccaccaggctaagctctggacctctgctgcccatagagctttctgcagtgatgaagatgctcccatctgccctgtctggtaggcagtccctgtccatgtgtggctgctgagtacttgcaatatagcaagtgcagctgagagatgaattttacattttgtttaatttttattttattttattttattttttgagacagagtcttgctctgtatcccaggctagagtgcagtggtgcagtctctggtcactgcaacctccacctcctgggttcaaacgattctcctgccttagcctcccgaatagctgggattacaggtgtgcaccaccacaccaggctaatattttgtattttagtagaaagggggtttcaccatgcaccatgttacccaggctggtctcgaactcctgagctcaggcagtcctcccaccttagcctcccaaagtgatgggattacaggcatgagccaccgcgcccagcctaaattttgttcaattttgatcaatttgaatttcaatacttacaagtagctggtggctgcctattggacagggagctctaggcaagatctgccattaagttatgtaatcttcagcaagtcgcttcacagcagagtcctcccctccagtctccagtgtacacttcattgcctgcagtctgcccctaacacatgccctcaatagaatgtgggtgcttcaagggcaggaattcctgtgtcttatggactgccatgtcccagcagctagccctgtgtctggcacacggaggatccccgataaagagaggatggcgaatggatcaaagtgggctgtggtcttgtgttgagggtactgtagctggaactgctctggccttgtgccctgtggtgtcgtgttgcagaaaagatgagtccactgcagtgggaagctcactggcccttgggcttggggacaggagacaggtactcacatgcctgttctcactctgcggtctactggccttgatgctgtgtggtaatggacttctctgtcttgagtttgttctaatggaaaattacctttccctcttccaggaaacttaattacaggtacacatgtatttttcaaatgccctttgagtaatcttaaagtatattcaaggcagagtcttagtatgaagtataactaagctgttttgttatacacaggcatctctcatttgtaaataatttgtaaattgaagcgagaaatgctgtattcttagtatttttttacttttttttttttttttttgagacaggtttcactctgtcgtgcaggctggagtgcagtggcatgatctcagctcactgcaacctccacctcccaggctcaaatgattctcccacctcagcctcccaagtagctgggactatgggcgtgcaccaccacaccctgctaaattttgagactccgtctcaaaaataaataaataaataaatataaaaagaaagctatggcaaattattttactgattttaatatatgagcttcttgaagaacaaaaactgtttcttagagtcttttgtatgattcttttagttttggtggattttttttttttttttttttgagacggagtctcactgtgttgcccaggctggagtgcagtggcgcaatctcggctcactgcaagctttgcctcccaggttcacaccattctcctgcctcagcctcccaagtagctgggacccccggcgcccgccaccatgcccggctaattttttgtatttttagtagagacggggtttcactgtgttagccaggatggtcttgatctcctgaccttgtgatccgcccgccttggcctcccaaagtgctgggattacaggcgtgagtcaccgtgcccatcctagttttgctggtttctatgaatttagaatcattcagttctttagctggctggtgcctctgtgacaactggtatttagggctagcaaacgtggataagtgcacatcagctctctcttggatcaccagtggtaaaaccagactcttctttcttagtgagagatggtctggagatgtctggatgctcagagcgtgtccacgtgcagcaagcggagaagctgccaggggccacagtttctgagacgaggctcagaggctcttccatggccagctccgtggccagcgagccaaggagcaggagcagctcgctcaactccaccgacagcggctccgggctcctgccccctgggctccaggccacccctgagctgggcaagggcagccagcccctgtcacagagattcaacgccatcagctcagaggactttgaccaggagcttgtcgtgaagcctatcaaagtgaaaaggaagaagaagaagaagaagacaggtaccctctgtagctggcacacacccatctggggttacagtctttccagattctctgggagtgctgctgctcactgagtgagcaatgctccatacatccaaaagcagagaacacatacatttcttccccaaaggagttttactgcaaaatacttcacattaacggaaaatacacacacacacacacacacacactgtaaggtctaaatgatgacagaacacctgtgtgtactcaccaccctgcttaaagggtctcagttttgtacttttcaatatttatttatgtatttatattatttatttattttttgcgacagagtttcgctcgtcgcccaggctggagtgcaatggcacgatctcggctcactgcaacctcacctcctgagttcaagcaattctcctgcctcagcctcccgagtatgcatgcccagcgaattttgtatttttagtagatacagggtttctccatgttggtcaggctggtcttgaactcccaaactcaggtgatctgcccgcctcggcctcccaaagtgctgggattacagcgtgagccaccgcgcctggcatagtttttagtatttaaattaaaatgtcggggccgggcgcagtggctcatgcctgtaatcccaacactttgggaggccgaggcaggcggatcacgaggtcaagagattgagaccatcctggccaacatggtgaaaccccgtctctactaaaaacacataaattagctgggcttggtggcatgtgcctgtaatctcagtcactcgggaggctgaggcaggagaatcacttgaacctgggaggcagaggatgcagtgagccgaggtcacgccactgcactccagcctcgcaacagagcaagactccgtctcaaaaaaaaaaaaaaaaaaagtgttggtttatccatgtataccattgattaaatcagagattctgtgagcctgggtggaaagttgtggaaaccagaagatctatgctggtaaatacttgggacattttatgtttagtgttgaatatgctaccaaatatgggatttaacattgaatttttttctttttttttttcaacttttattttaaatacagggggtccatgcgcaggtttgttacatgggtatacagcacccaggtagtgagcacagtatgcagtaggtggcttttgacccatgccgcctcctctcccgctctggaggtccacagtgtctgtccttcccatgtttatgtccatgcgtgctcagtgtttggctcccacttacaagtcagaacatgctgttggttttctgttcctgttgcattaatttgcttaggattacggccagcggttccatccatgttgctgtaaaggacaagatttcattctttatttttatttatttatttatttatttatttattttttaatttattggagacagagtttcactgttgtcacccaggctagagtgcaatggtgcgatctcggctcactgcaacttccgcctcccaagttcaagcaattctcctgcctcagcctcccgagtagctgggattacaggtgcccactaccacgcccagctaagtttttgtatttttagtagaggcaggggtttaccatgttggacaggctggtcttgaactcctgacctaaggtggcccacccgcctcggcctcccaaagtgctaggatggcttatgagcgtgaaccaccgtgcacagcccagatttcattctttgttatggctgtgtaacactgaatttttcaaaccttttactccttggttcctgttaatcctctctagctaagatgactgcaacactgaaggaaatgttattagatttctaagcattttaataattataaggaattggtttgtgacccaggtgaacatctcagtttgtcccctggtttttcttagctgccctcaaacccatggatttgttcagtacttgcatgcatagaaagcatctctttgttgggattatttgtacttaagaggtttattcttcattcaccaaatatcctttatttaaaattttttttcttgagccaaaaatatgtgtgcaagttagtctcttactaatcatatagaaccgtgccttattttgaatgttcttattctgaattagaaggtggaagcaggagcacctgtcacagctccctggaatcgacaccctgctccgaatttcctggggacagtccccagtccttgaacacagacttgctgtcgatgacctcaagtgtcctgggcagtagcgtggatcagttaagtgcagagtctccagaccaggaaagcagcttcaatggtgaagtgaacggtgtcccacaggaaaatactgaccccgaaacgtttaatgtcctggaggtgtcaggatcaatgcctgattctctggctgaggaagatgacattagaactgaaatgccacactgtcaccatgcacatgggcgggagctgctcaatggagcgagggaagatgtgggaggcagtgatgtcacgggactcggagatgagccgtgtcctgcagatgatggaccaaatagcacacagttacccttccaagaacaggacagctctcctggggcgcatgatggggaagacatccaacccattggcccccaaagcactttttgtgaagtccccctcctgaactcactcactgtgccttccagcctcagctgggccccaagtgctgaacagtggctgcctgggaccagagctgatgaaggcagccccgtggagcccagccaagagcaggacatcctaaccagcatggaggcctctggccacctcagcacaaatctctggcatgctgtcactgatgatgacacaggtcagaaagaaatacccatttctgaacgtgtcttggggagtgtgggaggacagctgactccggtctctgccttggcagccagcactcacaagccctggcttgagcagcctccacgggatcagacattgacgtccagcgatgaggaggacatctatgcccacgggcttccttcttcatcctcagagacgagtgtgacagagctcggacctagttgctcccagcaggacctgagccggctgggtgcagaggacgccgggctgctcaagccagatcaggtatgtgggttcgggtggtgggaaaagtagctgaggcttctttcttaagggtaataattgtcaagactgattattttccttctcatggaaagaaattctattcctactgcaaaatccgtaggccaactctgttttcaagtctgggtttcaggggatttccagcacagggactatgaatggcttgaactacttctgacctgttctaccctgctcagtaacctgcctccccaaccaaggtagcgtcttgctgtttcctctgaccccacaagtgcaggctggtgtaggcacttactgttagccatcgtagggcagggctgaattggcctggggccatctcagaaaaccagtgggcagaggactgtccacctgtggagtagagaaagctctgagcagtttggaggcagggagtctcctgtccttctcctcacacccctccaaggaaccatctgcaagagcacgaggccatttccagaactgctgtctcctcaacctccgaacagtggctccaaggctcccctgcgagctgtacaggaaccagtttggagtaaccagtctttgtaggtccacccagcacatgtaactaggagatgacttttaactgtccttgagcattttatattaaaagtgatttttttaaaagtgcctacttcccttagcaagtaattattactagatatatttgtttcaaaactgtgtcttgccctgtctcctactaactgtcgatgtgaggtatgaattatggctgcgcacttacagccacgtgtgctttccacagtctacgctggcttctgtcagtgctagcagtgtgacgctttgtcagtgctcaccatgtgcaggtatcccacaaagcactttagaggtttaactcttttacttctctaaacacgaactataaaataggcactcttcttgtccccattttacagaggagaaaatggaagcacagaacagctagacagcttgcacaaggtcacatagcaaatgaagggcgggccccaggaccccctcactcaccctctgtgctgtcatgcctcagaagtgaaacatgctgcttacttgttttgagacaaaacgccataagtctggcttttttttcttctttctttcttttttttttttttttctgagacagggtctcactctgtcacccaggatggagcgcagtggcgcaatcatggctcattgctgcctcgacctccccaagctcaagtgatccacctgcctcagcttcctgagtcactgggactacaggcatgtgccaccatgcccagctaatttttgtattttttgtagagaaggggttttgccatattgcccaagctggtctcgaactcctgagctcaagcaatctgcctgcctcggcttcccaaagtgctgggattacaggtgtgagctgctgtgcctggccaagggtggccttttattcagtcatccggcatttatcttttcaacccagtggttcttgagtggccttgactgtcagcctctgtgattatgctggggaccacagtgcagatggcagctagttgtggattccatcttcctgagcctcagagtcttgagggggagccaggtacatgttcacatcctcgcagttgagtgggactcaggtgagggtactgagcaaagtacagggctgcaggaagcgcaagcagcatggccccctaatgtctgggcgttagccaggcagactgtcggtggggtggggtattggaattctaggccagaaatttaggaaagccctcacttaggtgacagggatcctggccctttgagcccctgactctctaacttcctcccttcctcatcccactccaggtagctgggaagccaagaaattttatggtgtgtttttatttggaggttcggtgtggaagtaagacttgccatggtgagcagggctggattgagaagagttgggcaccattttctttgaagtagttaacttctatgtgggtatctgtacaaatacatttatcttctttgcatttattgaaaagtattaaagtacaaagactttatttagctttgatttttaaaagaattctagcaaggtcgggcacagtggctcacgcctgtaatcccagcactttgggaggccaaggtgggcgaatcacctgaggtcaggagttcgagaccagcctggccaacatggcgaaaccccgtctctactaaaaatacaaaaaatagccgggtgtggtggcagatgcctgtaatcccaagtactcaggagcctgaggcaggagaattgcgacttgcttgaacccaggaggcggaggttgcagtgagccgagattgtgcccctgtactccagcctgggcgacagagcgagtctctgtctcaaaaaggaaaaaaaaaagaaaatatggtggaaaaaagaaagacagtggtagtgccatatatccagtgcctctgtaatgattagactacaaaaaattgacttgcatccaaatgttgaagaacctggctctttgtgtaaggtgaggtatgcctgcagaataatagcagctccttcgtaacgtgatgtgatgctctaagcgttacatttgcaaaggtgttagaacaggagaaaatgtcatccagggactccagggagtctttgtagggagacagcagcacgcgtctcagaaggtttgtagtagaggggtgtccacagatagcaggggttgggagaagggttgacttggcgtcttgctgacccgttttaccgtctcgtgttaatgatatcctctcacctttcttactgagaacagtaagccaaatgtggctgtgtcctctgccacagaactcactggctcttcccttgttagtttgcagaaagctggatgggctactcgggtcccggctatggcatcctcagcttggtggtctccgagaagtatatctggtgcctggactacaaaggcggcctgttctgcagcgcgttgccgggcgccgggctgcgctggcagaagtttgaagatgctgtccagcaggtggcagtctcgccctcaggttcgcctccccgctccctgctcccgctccctgctcccgctcgccgctcctgctccccgcccccggggtgcagacatcttagtacagggctcccctgcagcagctctgggctcacgctgccgtgcgttcaccaggtttgcctcttcaggaacgtttgaggggttgtctccaaagaacgtgaattgcttcattggatgtcaattcgtagtgtaaatgggtgttcagtttgagtttttgttttctttattaattgcaatggtaagctctgatcgtatttttgtaagctagacaaaaagtttgaaaattgagggacttttttagggatattaatatactaactcttcataaaaataatacgtgtttctctttctcattgttgctttaaagcaaccgaactaacgaagacgggcctatggatatgttagatatattccaattatttggcttcctctttaggaattctgttttaatgagctctctgctgtgggtgaacagtctactccctgactctaaaaggaaagtccattcattctttcatgctgctgttaggccattgttagtgaactggagctggtgtttcctgaacgatgttctcctgagctggaagacctcccatatctgcatggaatcatttgcttgctttttctttctttctttcttttttttttttttttgagacagagtcttgctgtgttgcccaggctggagtgcagtggtacaatctcagctcactgcgagctccacctcccaggttcgcactattctcctgcctcagcctccccagtagctgggactacaggcacccgccaccacgcccagctaatttttttgtatttttttagtggacacggggtttcactgtggtagccaggatggtcttgatctcctgacctcatgatccgcccgcctcagcctcccaaaatgctgggattacaggtgagagccactacgcccggctttgcttgttttttcttaaggttgtgttggccacgtcggcacctacgccagtggggacacttttgccttgaagcagcctggtttactgtcaggacattggaatagaagtcagacgaagccgaagctgagtctgtggcttgggacctgtctgttctctgtaacttcactgtgtttcgggatgaatttcccttaattctccctggtctctgtcactgtttaaaatattagtttgttcagcgttgtttttcttgcttgctttcactgtttgtttgaaaaatatttttctttagagactggctaacaacccactccacaagctgtcattacacagttgtgtgttttaattcatttctcgttggtatcatttaccttcaggtttgtctccttagccttttagaactttggttctattcctgactatattagttacttgtattcccaggccccttggtccctcactgtgctagcgggaactctgtatctccatgagattcacctgctcagttgaggcgtccttcagggcccagtcccatgtccttggtgggcagcagagcccttgtgccgggggcaccacaggcagagatgctcgacaggccctctagtccagcccagctgacactcggtgatcactggtggccccttgccttgcctgcgtcggcctgctccaggcctccagctgcagcgctatcctgccttccctttcctctctcctcctccatctcttcatcaaagtcctcttcacagtgaaaacaggccaactcagtgcaagtgtgttccttctgtgcaccttttccattcagctcatccagaactgatccttctctttgaatccctaaaggactttttcagcctctcctagggcactagttgtgcttaggatgtttatttggagacttatcaaacctaataatgtcatcagtgtttctcctcccgtgtgaggagcgcctgtcatgtgcccagctctgtggccatgtggttgatctgcttccgtctgcagtctttagagcagccctgtaaggtggagatgatccccacggcccaggaggaaagtgaagcttggagacgggcggtgacatggagcctgaagctgcatagccactgggtggtggccaagggcccaaacctgggtctggtggcctctttccccacttggggggacagaacaggatgtgttttagaaatctttctcccctcaatgcccagcatgaagacttttgtatagaaatatattctagtatttattggacagtgaatagaatttttatttccataggagcccttctctggaagattgaacagaaatctaaccgggcttttgcttgtgggaaagtcaccatcaaggggaagcggcactggtacgaagccctgccccaggcagtgtttgtggccctgagcgatgacacggcctggatcatcaggaccagtggggacctatacttgcagacaggtaaccgcgggccacgcttagaggcctgccagctctgccgtcactgcctctgctgcaccctgctttgctagtaacatgcttaccacaatcgctatgattaagaggctaaatccattcgaattaagacacttctgggaagagagtatttgccatttggcatgtattagcagtttcctgcattgacacaaactcaacccaggacaaatttagggcaaaaatgaataggattatttggtgagatacagaaacagaatcttattctcctatggccaaccaccgcatatcacgtatcctacaatgttagatcttaagaggtaagaatacagaggaaggacataaaattcatttccccctttaagctaaagtttaagtggctgcattttttttttcagccatatcaaagcccggctcctatatacttacttacccgtgggccaggaaaaaaaaagaaataatttgctcttttttattttgagacggagtctcgctctcttgcccaggctggcatgcagtggtgccatcttgactcactgcaacctctgcctcctgggttcaagtgatcctcctgcctcagcttcctgatcacaggctgggattacaggtgcccatcaccacgcccagccaatttttttgtatttttagtagagatggagtttcactatgtcggccaggctggtcttgaacttctgacctcaagtgatctgcccgcctcagcctcccaaagtgctgggattacaggtgtgagccaccacaccaggccataatttgctctaaatagcagttcaggccaggtgtggtggctcatgcctgtaatcccaacactttgggaggcctagacgagcagatcacctgaggtcaggagttcaagaccaacctggccaacatggtgaaactctgtctctactaaaaaaaaaaaaaaaaatacaaaaaattagctgggcgtggtggcgcttgcctgtaatcccagctacttgggagcctgaggcacaagaatcacttgaacctgggaggcagagcttgcagtgagctgagatcgcgccactgcactctccagcctggtgacagggcgagactccgtctcaaaacaaaacaaaacaaaaatagcagttcagcaagtcacaggaagctgccctcagggaagtttttagctgatggaagggcacagtgggacttgcttattaaaaataagctgtaatgacagtcagtgtttactgtcagcagaatggggaaggatcttccaccagcaatgtgatttatcagtatctggaaggactgtggggcaggagttatcgtcagttgtccagaggccacgttggatttatgtaaagatcagtcttccaggcgtttaatgttgttgattccaggagaatgttgttgttgttgttttgagacggaatctcgctctgttgcccaggctggagtgtagtggcacaatctcggctcactgcaacctccacttcctgggttcaagcgattctcctacctcagcctcccgagtagctgggactacaggcacatgccaccatgtccagctcacttttgtatttttagtagaggcagggtttcactatgttggccagtctggtcttgaactcctgaccttgtgatccgcccgcctcagcctcccaaaatgctggcattataggcgtgagccaccggcctcaggagcatgttttaatcactgctgtgagtcgtcagctggggatgagtcttcaggttgaagctcttgcacagctggctctctcctagctgtgtaagaacctctggcctgggtgcacagccatgctggcttcataggccatatgctggcccaggtctctccagcctagttcctgtgtctttctttaaatgaaagtagctctgtcaaggcacatgcacatctaagctgccaggacatttgagctttggtcatggggaagacaggaggtgcttctggcctgggggtgaggagcgagtgacctctaaaccagtagtgccagaggaatcaccaggacagtgatttcacatgaggtggccccacccagacctgttggattaggtccaatccctctggagactgctcaggagtgtgtcgtgtaagaagtcctgccggtgattcccacctagtttagtggaaggaaatatcacccaaggactgcaatactataggtgcgtctgtgattagtcacggagcatatttgagtactgagacctaattgcaggcctaaggtcaaggaatacagggttgtaggcgacagttggtctgtctgctcccctgggaatagcctttgagctcatttagacatactttattgacagaacacaaggaggcaaggggagagccctggacagggagccagggaccctgagctttggcctgccactgccttgcagtttgacagacctcagatttcatctgggaaattcggggtttcattttattagtggaacctcgcacccagtcagagcagagaggagccgccgtgctggagctctctgcaggaacgactgcaggcctcaggtccctgccaactccagcagcgctgcagccctctgcctggaagagctgctctgccctgcagcctttgggcctccatctggccactctcctgctcttggcttttgtgttcttctcttagaacttcttaagctacattgggacaccagataattctgaattgttcagttttcaaagagtgtctaaaactgttttcagatagatgttacatttaggcagaatttaaccactttatgttgattaaacttgacaacaaaaaagcggccggacagggcagctcctgcctgtaatcccagcactttgggaggctgaggtgggaggatctcttgagcccaggagtttgagatcagcctgggcaacgtagaaaggccccgtctatatttttaattaattaattaattaaagtttttttttaaagcactcatcataaaagaatatagcaaaataccaaaaaaggaaaaataagccaataaccaagtcaaaatgaggtgtggagttctgactgtgtgtctttggggcttcttcccatcttcctggcaggtctgagcgtggatcgcccttgtgccagagccgtaaaggtggactgtccctacccgctgtcccagatcacagcccggaacaatgtggtgtgggcgctgacagagcagagggccctcctgtaccgggagggcgtgagcagcttctgtccggaaggcgagcagtggaagtgtgacattgtcaggtactggcgggccagagactcctttcacatcgtgcttgtcctacccttcgttcttgtccacttgacaccacaaggcaccatgaggccgttcctgggaggcagcacctgcagcctccatggctataggctaagcttgaatctctgcctaattctgaccggcaaactggacgttgagtcagagctcgctttttaaaaatgctgccgccctctgcgcagccctgagcatcacagcgtcatgagtctgtcatgacggtctctattcagaattgcccaccgtcaggtagttctggtttagtgtctgtgacggcttaggtccaaatatttttctttattttcatgctaatcgaagttgatctctgaactgtagcttttttttttttttttgatacaggttctcactctgtcacccaggctggggtgcagtgccacgatcacggctcactgcagccttgacctccgggctcaggtgatcctcctgcctcagcctcctgagtagctgggactacagatgcatgccaccatgcccagctaatttttgtattttttgtagagatgagttttgggttttcatcatgttgcccagactcatctcgaactcttgggctcaagcaattctcctgccttggcctcccaaagtgctgggattacagacatgagccactatgcctggcccgatctctgaactgtaatttattaagctatttttttttttaccattcaagatgttagttatagaattgccatcagatcattttactagtatggaagtattaatagtcctttgaaaaactagattaggatattcttggtttgaatttagcaagccaataaactttcagtgaatacctattaagagccagaatggtccaggtgtggtggctcacgcctgtaatcccaacactttggaaggccaaggcaggcggatcacgaggtcaagagttcgagaccagactgaccaacatagtgaaatcccgtctctattaaaaatacaaaaattaaccgggcatctcaggaggctgaggcaggagaatcacttgaacctgggaggcggaagttgcagagagctgagatcgcaccattgcactccagcctgggtgacagagcaagactccatctcaaaaaacagacagacaaaaaaaagcaacaacaacaaaaagccagaatggtgctaggggctgggtgcgccaagagggctgagactggccctgctctcatcagttccaagtctcatgggggccccgtgcatggatggacacccattagcacagatggccctaaacaggagtgtggagcatgcagcactgagggaaccatggactccatgcagagatcaggaaggcagcatgcagagtggaccaacagctaagccttgaagctgacgaggacttccccatatggaaggagggggagggcgtctccagcaaagagggcagtgtctgcctaggtccagctgcacagaatagcctggcacatcgggggagtttacagtcattcccttggtgagggagggagtagagagatggaggcgctcaggggccttggattggcgggggaaggagtagagagatggaggcactcaggggccttggattggcgggggaaggagtagagagatggaggcactcaggggccttggattggtaggggaaggagtagagagatggaggcgctcaggggccttggattccttttgtgcctactcgcttttttcttaggttattttctctcttaagagtgttcccagccattctgggtcatcagtgtgtctttcaaaagctgccacccacttgaaccatatctcttgcacagtaatttaactcagacccaaacttccttccctggcacctgctgatccgctccagggccacgtctcttctcccagccacgcctgccgggagaccctggatgtccgcagtccagacacactgggcactctgcctatgggtgctgacccccctgttctcctccttattttcagcgaaaggcaagctttagaacccgtctgcataacgctcggggatcagcagactctctgggccctggacatccatgggaacctgtggttcagaactggcattatttccaagaagccccaaggagatgacgaccattggtggcaagtaggtgttcagctctgcgccacgtgccgaggtctcccgaccttttctgcttccccttttcttacttctctcttttccttaacgatactagattaaatttaaaatactcacttttttattatttgtttgtttgttttgaaacaagatctccttccgtcatccaggcggaagggcagtggtgcagtcacggctcactgcagtcttgacttcctgggctcaggtgattctcccacctcagcctcccaggtagctgggactacaggcgtgtgccaccatgcctggctagttttttgtatttgtttgtagagacagggttttggcatgttgtgcaggctggtctcaaactcctgagctcaagagatccacccagactgggcagagtggctcacacctgtaatcccagcaatttgagaggccaaggcaggcagatcactcgagtccaggagttcaaagccagcctgggcaacatggtgaaaccctgtctctaccaaaaatacaaaaattagttggacatggtggcacacgccgttggtcccaactactcggaaggctgaggtgggagaatagtttgagcccaggagacaaaggtttcagccaagatcacaccaccacactccaacctgggcaacagagctagaccctgtctcaaaataaataaaaataaaaaagagagagagagagaaatccaccctctccgcctcccaaagtgctgggattacaagtggagccaccactcccagccaatagtattccttttttctatttgatggattagactttgctgtgtttgagtgcattagaaacataaaggacttttcatcataggaaataatttgcaaactctttgtgtaaataatgcacttaatttatttattttgatattgtttatatatttattattataggctaaataaacccagtgacatccatttgaagacctaggtaataatgatgtttaattatgaacaaatgtgctgagaaaagagcccagataataggtttgaaagcccaacccagaattaaaattgagctgtctctgcttattcagaaggcctctaagtagatggtatttcagcaaagacaggagaattttcccacgtgcttccagaaaaggaaacactataagaaacaggatgagggtataatcaagctcactgtgtgtgatttggtcccagcaagagcgcctagaatgaatttctcttttctttttcttttctttttttctggggcagagtctcactcttttgcccacactggagtgtggtggcaggatcacgacccacctcagcctcccaagtagctgggaccacaggcacatgccaccatgcctggctaattattttggtagagacaaggtcttgctgttacccaggctggtctcgaactccttggctcaagcaatcctcccaccttgacctcccaaagcgctgggattacaggtgtgaaccaccaccctcggccctagaatggattttcaaaggagtgtctactttccccttctttggtatagtttagtgttagtgttgctcccacagtctcccactgtggtaggtaagatttcactgatagtcgatggtcgtgaaatatttgatgtttcttttttttgagacggagtcttgctctgtcacccagtctggagtacaatggcgcaatctcggctcactgcaacctccgcctcctgggttcaagcgattctcctgcctcagcctcctgggtagctgggactacaggcacgcaccaccaggcccagctaatttgtgtatttttggtagagacagggtttcaccatgttggccaggttggtctcaatgtcttgaccttgtgatctgcctgcctcagcctcccaaagtgctgggattataggcgtgaaccaccgcgcccggccagtatttgatgtttctgaagtatcttgccccattggtttatgttttattgtcacctcagacttgctttgttgaaggcttgtcttgcattgactgctctgaggtctttcagatgagaatgtagaaaaatgagttgtgtttactctttgataaaatatgtattctatataatatgtacattatatacagatgtatctaatttatatactaggtaatatttgatagtcatgcaaatgattttaaaataccttttgtgtacttgtaaccatatatatacatatacatgtaaaaatatacatatatgtatttttgtagagacagggtttcaccatgttggcaggctggtctggaactcctgacctcaagtaatccacctgccttggcctcccaaagtgctgggattacaggcgtgagccactgtgcccgaccaggagtagggcatttatgccagtgatgttttatgtaatcaaacccagcagggcagaaatgtgagtgaacatcatggagaatcagattttcactcataaagaatttgccttatatcaagctgcccaagaagagaagagcttcctgcagggaggggtggttggagaaatgtctgaggtatatgaatgcttttcaggaatgttatagaagcaagctacccttctgagctagggttagagtctagatacccaggatggtcctagttgatgctcttgccctggagtaattattagtagtcccaattcagatcataaattagttcatcacagccttgcatggtggctcacacctgtaatcccagcactttgggaggcctgggcgggcggatcacctgaggtcaggagttcaagaccagcctggccaacatggtgaaaccccatctttactaaaaatataaaaaattagccggctgttgtggcgtgcgcctgtagtcccagctactcgggaggctgaggcacgagaatctcttgaacccaggaggcagaggttgcggtgagccaaaattgcaccactgcactccagcctgggtggcagggcaagactatgtctcaaaaaaaaaaaagttcatcactctacttgtgatacctttttagatgcatattatgtttctaagtaccgtatactgttgtccattggaaatacctgatttaaaagcaaaattaaagctgggcatagtggttcatgccagtaatcccaacactttgggaggccaaggcagggagatcacttgagcccagaagttcaagaccagccctgggcaacacagggagacctgtctctacaaaaaatttaaaaattggctacatgtagtagcattcgcctgtatttgggaggctgaggtgggaggattgcttgatcctggaagtcaaggctgagtatgattgtgccactgcattccagcctggatgccagagcaagactgtctcagaaaagatggcaaaattattctttctcactctgattagaatgaaagtcttcttagaaggggtgtgagggggtgataatcacaaaagtaatacatgcttgtaacagatccatgttgtataaaagtatataaaatgtgaatatattcttccatacctttaaatccaaccctacgaaggagctggagttagcattagcagtttgatggcatcctgccacatttttttggtcctttcacaagcgcacacgtgcacatttgtgtttggatggtcatcttgttactagaaatgcagaggtgtggacctgagctagaaccttccctcaaggcagagagtctacacttgtaactgctctgacagcagggcttttgcttgtctcctccttccaggtgagcatcacggactatgtggtgtttgaccagtgcagcttatttcagacgataatccatgccactcactcggtggccacagcagcccaagcccccgtagaaaaggtggcagataagctgcgcatggcgttttggtcccagcagcttcagtgccagccaagccttctcggggtcaataacagcggtgtctggatctcctcgggcaagaatgaattccacgtcgctaagggaagtctcataggtgggtgaattgctgtaattttcacactggctttataggcagcctcactttaaagccaacatttaaagaaaagctttaagatctcaacttgaaaagataatttagtgccagtggtatgaagtgtctagtggaggcactctatgctttgtgatcagtttctctcctttttaaaaaatctgtcattcctaaaactcgtatccctgtgtctggatagtgtttcccctggaaaccttttatgacataagaaaagcaaatggaggtcatttttatgttaacaatttcacattttaaatgaaaaaatccacccaaacctagtgagagagaatggtccacttcctggagggaaggtgatcgccactgttggaaatgcaaggctctggccaggtctgtgaatgtagatgccagtctacacatcctggggtttgtttctgtgagtgaaccccttgcttttctccagccctctccctgctgcatggcctccacgaccctggactgggtgtggctctgcctggcagtattcagagggagatgaatgttaggctgtgattgctcatgtcgctttatttagggacactctagaattatctggagaaagggtttgaaggccagctgtcgtccagaactaagatctgaagtggttttgtctatgctttctttctttaacacattcttcctatttactctttccaggcacctactggaatcatgtggttccccgtgggacagcttctgctacaaaatgggcctttgtgttggcttctgcagctcccacgaaggaaggtgggtcagtcttagcctcactgaagaatctagagcacagcttggccattggaaaggttcaaaccacagtcggactgtggccttgttggttatggggcatgcctcggagactgaccacgtgagggtgtcagaggccagtagcccttgttagctgagccgagggccctgaatcgggataggcctgaccaggagagcctctgagagggaccgagcgtggtgaagatgagggaaagtgtccttctgaaggaggggctcacacagtgcagccaccggggctggcagctggtgacttccagtggcacatggcaggggccacagcttctttgggcaccttcccatctcccctcgagaatccttctgtcacctcccagcaacttccttccgtcttgttcacagcctccggataacctaagtccgacatttgcaccgcattaggcagacctgccctgcagcggggtgctcctgccaaccacattctgggcagaactcagtgtccctgcggagtacagggtttgtgagggagccagggcaccagagggtgagggagctggcatctgcggccgggaggggcacttcccccacccgcttagctgggagccccggcagtcaggcgacctctctgggaagtagctgtacctcctcccaggattgcctgaggatgaaatgcaaagatgctgtgaaatctgtggtgaagagggaatcgtttgcttagttcaaaccattagtcccactaggatgcaggtgactgggtcagtacaataacttcttactcaccagattgttcggaccacagttctggaacccagaaatctctgaaaacaatgttatttcttgagtctggcataaattaatttggcagcaaaacctgaccggatctcacatagctgcctccagccttggttgatctgttggctgtgaccgcatccatgttgcagggatgttaccgcacttcaccggggagcgcctggcccctccgtggttgttttgtaaacctctggcatacccattagcttaggttttcaaaaatccagaaaaagtttgaattccaaaacgtggccacaagttgtagataatacttcatataacgtactgtgaccaagattttaactgccctaaggattatttgcattttaaacagaatctgttaaacctaaaggacttttttaaaatgctgtagggaatgaaaggacatgattttgaggcaagggtgggaagagaagcacttccagcttcctaagccttctccagcagctgccccaccccccggccccatccccagaaggtccgggagagcaccatggcgccatccttcctaggaactgccaaccctccctccctccagggcaccgagttgatagtcttctcctcttggtaaaattaactttctacattaaaaatgctttggtgcctttgttcaagtgaaaaacttctcagcccatgaaaaatgggaggtcaaagccactaagccaacattatggccttcataaaatctcctaagccttgccttctttccatttctttccaacatctcaggcgtgtttcttgttagtcacggtgtttccctctgccttctaccttaaagtgctacaccgctcctgcccgtgtgggaatgggcaggtgagtgagctggcatctgtggccaggtggctagcgtctgctgaaaggcaaaggctgccttgtgcatttagggcaggcggcttggtgcagacaacacctcgatgacaaacatgacccctttctgcaggaagcttcctgtggctgtgccagagcagcaaggacctgtgcagcgtcagcgcccagagcgcacagtcgcggccctccacggtgcagctgcctcccgaagccgagatgcgcgcctatgccgcctgccaggatgcgctgtgggcgctggacagcctcggccaggtgttcatcaggacgctctccaagagctgccccacgggcatgcactggaccaggctggacctctcccagctaggtacggccacctcgtgagtacacctgccggtgccctgactgccctaaaccggcatcacaacgtgatgtcggacaaaactgcccggcctgtgtccaacctgtgagagttctgagggggtgtttataagctgctgaatttcaggagctcagttggccactctttcagactagacaggctctgggttttgtcccttcccctgccccttagagtttgcagggctgtcagaacccgaggagggtgtgcgtcctcaggtcaaggggccactcgctgcgagcggcttgaaggatactggtgatgcagctgccccgtcagtctttctgaatatggaacatagctttatgacctgaaaagctgaaaagatgggtgttccctatgacaggatcagtgccacgtttgtctatctcctcaggacagtacctggcggaggagagtggctcagcacacaggtgctagctctccttcagctcagccagatataggaggacctgcatccactagctcctgcttttctctgaatcttctatcaaaagccgtggagtaggctaagaaatgtagtgctatttgtaggccgggcgcagtggctcacacttgtcatcccagcactttaggaggctgaggtgggtggatcacctgagatcaagagttcgagaccagcctggccaacatggtgacaccctgtctctactaaaaatacaaaaaaaaattaggtgggcgtggcagtgcacgcctgtagtctcagctactcaggaggctgaggcaggagaattgcttgaacccgggaggcgggggttgcagtgagccgagatcatgccattgcactccagcccaggcaacagagcgagattctgtttcaaaaaaaaaaaaagaagaagaaagaaagaaatgtagtgctgctatttgtaaataattcattcatgttccaagaaataataacataagcccacaacattagatttctctctgagtagattcttggtggatcaggcagcataggtgtggtttgcctgaaggtggagttgtgcagatggcccccagggcccggatgagccctgcacttgcagcaggactgacttaggaacttcctggctgcaaggcttcccagtttttttaacttagaaccagcatttggttatgtggtagacttgaattgtataagcatttaatgtttgaaaactcaatcacatgtactcaccaaaaaaaaaaaaaaaaaaaggatggggagaaagaaagcaagaagagggctgggcacagtggctaatgcctataatcccagcactttgggaggccaaggagggcggatcacctgaggtcaggagttcaagaccaacctggccaacatggtgaaaccccgtctttactaaaaatacaaaaattacctgggtgtggtggcacatgcctgtaatcccagctacttggttgggaggctgaggcacgagaatcacttgaacttggtaggcagaggttgcagtgagctgagatccatgccattgcactccagcctgggtgacagagcaagactctgtctcaaaagaaaaaaaaaaaaaagaaagcaggaagagaagggcttgttccccttctccccaagcccctggctgcattgcagtctgtatgctaccagctgatgagagcctcttgccattccgtaaagcaagcatcgtcctaggctgcctggcagtggttggtgtgctcagccccgggggctcctacagggtgctgagtagacatcacccattcttttgcctgaaaaggcccctgaacactaactcagctgaagaagcaagttctgttccaaggcttggggactgaaggtttgtccagggcaacttttgttctttatgctttgggcctccccacctgccttttggacccaccagtcaccatctagctttttgagaacacccgcctctccacatcactgacagtgactgatagacaaggctgaggctgagagtggcctgaacattggtgctgactgacctgccgcctgccctggaaagcctttcatttgttcagagaccctactggtcctgagccattctccagcagctcctacccagactaactggaaaatgccgctagttccctctgagggtaaaaagtccagggcttggtgtgtattctccctgctcctgaatcttgagcactgtgggaggctgtgttcacctgcaccatttgggtgagaagcagaactgcttcccttgcacgtccccttcccagcccctccaggaaggctgctgcaccgtggtgggattcagagtgaatgggcatcatgccaggttctgcactgctggagccagccctgcctgggcctcctgcctccagcacagctcatgcctccctcctggctcgatccagtcctcccagcaccggctagctggccaaagtggtgcaggtctctaaggtgtgtatttgggcttcactgggaggtttctctcggggagaaacctggcttgagtgggattgagtctcaagagtgtgagggaaacaggaacaagtccatcctgagtccaagatggccttgggccatctggtgttcagcagatactcattgaggggttgggtgtgtgaacagagggatggcctggggatcctggtcgctgtggatgggcaggttttcactgacctcctgtgttccgcctgcaaaatcattagcaaatcaatgtcagtatccggctgaccccgaaatgaatcagacagcagtgggtgcaaggaggtcacaggcagaggtgtggggactcatggcagaggcaggacagagctgggccccaggcgggctctggactctgggcaagctgctgtcaccttgaaccgcaatttcctctcctttcttttttttccaggtggggtctcactctgtcatccaggctagagtgcagtggcacgatcttggctcactgcaacctctgccttcccaggcttaagcaatcctcgcacctcagcctcccaagtagctgggaccacagacatgtgccaccatgcccacctaatttttttgttttttgagacggagtttcgctctgtcgcccaggctggagtgcagtggcacgatctcggctcactgcagcctctgcctcccaggttcaagcaattctccctgtctcaacctcccgagtagctgagattacaggcacccaccaccacacctggctaattttttgtatttttagtagagacagggtttcaccatgttggccagtctggtcctgaactcctgacctcaggtggtccgcctgcctccgcctcccaaagtgctgggattacaggcgtgagccaccacgtacagtccctgctaacttttgtattttgggtagagatggggttttatcatgttggccaggctagtcttgaactcctgacctcaaatgatccacctgccttgtcctcccaacgtgctgggattacaagtgtgagccaccatgcccggccttggtttcctctcctttctaatgggagcagcaacccccaagcccaaccccctggaggatgcacggggcatcccgtctaaatgttggccatctccgggcggtgtggtcatcctaaggctgtgacacgtcttgcttgggggtgctctctagtctttgttagctgctggtggtggggcttttgcttgtgttgccccagtttgtgccacagggaggacaaatccagcatctcttgttaaagcaccacctcgcttagtccttatcctgccctgaactttagattttgtttatttgagttatctggttgatcttgaaatgtcagattaagactcctttcctgtttcctacacatcctgagagaatgcagcaagtccagggttggcagctttgtgttggggcaagggaggtgaacaggcaaccgggactcccaggctgttcctctgcacacgcacctatcccctcaacgagtatctgctgaacactggagggctcgaggccatcttggactcagggtggacttgttcctgtttccctctcgctctttttttttttttttttgagacagagtctcgctctgttgcccaggctggagtgcagtggcgcaatctcggctccctgcaagctctgcctcctgggttcacgtcattctcctgcctcagcctcccgagtagctgggactacaggctcccaacaccacgcctggctaattttttgtatttttagtagagatggggtttcaccgtgttagccaggatggtcttgatctcctgacctcgtgatctgctcgcctcagcctcccaaagtgctgggattacaggtgtgagctaccgcacccagcctccctgtcactcttaagttgagactcaatctcactgaagctgagtttctcccctagaaagaacagccacctccccagccttcactatgccagggtaggggcagtgagcatcaggccaggggcaccaggtgttcagttattaggctctctccaggtatggtctgtgtcctgcaggaaaagcaggtaggtcaagagacttctctttttgtttgtttgagacagagtcttactctgttgcctaggctggagtgcagtgacacaatcttggctgactgcgacctccgcctcctgggttcaagtgattctcctgcctcagcctcccgagtagctgggatgacaggcatccacagccatgcccggctaatgtttgtgtttttagtagagacggggtttcaccatgttggccaagctggtctcgagctcctgacctcaactgatgcacccgtcttggcctcccaaagtgctgggattacaggtgtgagccactgcgcctgacccaagagaccttttaataattacttatttaagtgaaaattttgaatgcaggtgtgctgtctgcccaggagcccgtgtatgactgtgcatggcggctgtcatcaggtggcatgcattgaatggggattattgactgtaaaggagagtcatcaagctgacatggctgctgcctgtgttacttatctggaattaattggggtgcttcatttattttttacaagtcagcagtgggccgggtgcagtggcttacacctgtaatcctagcactttgggaggactgcttgaggccaggaatttaaaaccaacctggccaacatagcaagaccccatctctaaaaatatttgttaaagtcaacagtagggggtgcacacagcaatgaatggaaacacagtgactgcatttgaggatgttgttcaatatcaaatttagcctcccccaattgtgctcttcttcctaacttcgctcctctgctcccactaaattccctttttttttttttttttttttgagatagtgtctcaccatgttgcccaggctggagtgcaatggtctgatttttgactcactgcaacctccgtctcctaggttcaagcgattctcctgcctcagtctcccaagtagctgggattacaggcctgtgccaccccgcccagctaatttttgtatgtttagtagagacggtgtttcactgtgttggccaggctggtctctaactcctgacctcaggtgatccacccgcctcagcctcccaaagtgctgggattataggtgtgagccactgagccctgctgctcccagtaaattctgctggaaagaccagagtgctcttttggccagtcgctcagcagtgtcctggccatctacccgaggatctccctgcttctggacctctgcttccctcccaccactgtcagggtggagccccctcgtcaccaagttgctgtactgcagtagctgcctcctggcaccaggtgtgcccacctcccaccacggctaccagagctgtcttcctcaaacccagctcagatggtgttgccctccacgttacatggctccacgctgccactagaatacagctccagtctttggtgtggcacccagggtctcgcagccagacccggcctgctgttccgaggcctcgtgcgttggggactccagccactcctggcctttgtgttggggccctggctaactttcatattttgggtagagatggggtttcaccatgttggccaggctggtcttgaactcctgcccttccctaatgtgtggtgcatgttcatgccacccatttgcttctcttcctggggcctagcattccttccgtgggctgctttccttcaactcttcttccttcaggactcagttgagatcgcacctccccaccagacattcttcattgactgtccccatcatagcactgtgcttctacctgtcatttcagagccaagcacggtggcgcacacctgttgtcctagctacttgggaggctgaggcaggaggattgcttgagcctgggaagctgagcctaatctaggcaacagagcaagctcctgtttcttaaaaaaaaaaaaaatacacacatatatatatatatatatatatatgtaattttagtttgactcacattatttttgttgaaagtttacacacggagtgtgtagggactttacaggcagagaccaattgcttggtgacagtacgtacccaacaggatttttgttttaatttgggatggggtctcactatgttgcctaggctggtctcaaactcctgggctccagtgatgctcccacatcagcctcccaaagtgcggggattacaactgcatgcagctgcaccagcaggatttaaaatgtcagggaaagtcagtactgtttgcagctccatttctgagtaactctgggatgtgagttttgatcctatatttggccatgttactggtagtcaaagataaaactgccttccatgcaagtacaggatgtcatcacacacagtagcctggtggatgatgtgactcccaccctcccaggaaaattctcatctcttgctctaagttgccatcagccttcccagggcatgaggcagaagatgttaggttataaaaacttgtcggccaggcatggtggctcacacctgtaatcccagcactttgagaggccaaggtgcgtagatcacgagatcaagactatcctggccaacatggtgaaaccccgtctctactaaaaatacaaaaattagctgggcatggtggcttgcctgtagtcccagttactctggaggctgaggcaagggaatcgcttgaacccgggaggtggaggttacaaagatcatgccattgtactccagcctgggaacagagcgagactccgtctcaaaaaagcaaaccaaaaaatcttgttagagatacatttacatgtgttctcccttcagccctggtgttttctttacaagtgtcttcctggttgtatgagtagcaagcagccttggacagcatgacctctgctccctcggggacagtgttgaccttgggcagcactaactcattgttaggtcaggaccatcatcagtcttctctaaaaggcaagcagaaattttaatttcagactgggtgtggtggctcacgcttgtaatcctagcactttgggaggttgaggcaggaggatcacttaaggccaggagtttgagaccagcctgaccaacatagcaaaaccctgtctctacttaaaatacaaaaattagctgggtgtggtggtgggcgctgtagtctcagctactcaggaggctgaggcacaagaatcgcttgaacccgagaggcagaggctccagtgagccaagattatgccactgctgagccaagatggtgccactgcactccagcctgggcgacagaatgagactctgtctcaaaaaatactactaataataatcaattaattaaaaaacaaggccaggtacagtggctcatgcctgtaatctcagcacgttgggaggccaaggcaggcagatcacctaaggtcgggagtttgagactagcctggccaacatggtgaagccccgtctctactaacaatacaaaaattagccaggtgtggtggcacatgtctgtaatcccagctacttgggagcctgaggcacaagaatcccttgaacctgggaggcagaggttgtagtgagccgagatcacgccactacactccagcctgggtgacagagcaagactctgtctcaaaaaaaaaaaattaaattttaatttcaaggatgaggatgactttagcgaagtatcaaataatgaacatgatttctacctttaatttttttttttttttgagacggagtctcgctctgtcgcccaggctggagtgcagtggcacgatctccgctcactgcaagctccacctcccagcttcacgccatcctcctgcctcagcctcctgagtagctgggactacaggcacccactgccatgcccagctaatttttttgtatttttagtagagatggggcttcaccgtgttagccaggatggtctcgatctcctgatcttgtgatccacccgcctcagcctcccaaagtgctgggattacaggtgtgagccactgcgcccagcctcaattttttttttttaaatacagcttccctcttctttctacccctatacaaattaccagagcaattactgctataggattaaattaaaggaattcttaaattaaatggttggctgctgaaccaagttgtagcagttgaatatggaattttgtagtgatttattataatcctagtttttggaagaaaatttgcatcacttagcagatatttaagatgcttgtaacatttcatttcccagtacacataaatatgcattatgtcaggcattggaatgtttagcaaactaatgaaatttgtaatttaatttatcaggtcacagcatttaatgaagaactattcagtgtcagtttatgccgttaggtaacaaacaggattgtgttacgcagtaatttatacagaaaagtattttataaataaaatgtcaaataaatgccactttttgttttaaaatgatatgtttaagaaataatcctaaagggaaaatgtctgctttgtcgaataaagtaattaaagcatttttttaaaacaagagaaaaaaataaggacaaagcagggacagacaggaaaatgtcagtgtgtttgcatcagccaggctgggctgtgcttcggtagcaagccccagatatcagcgacttcacacagtgaaccgtggcccccgctccacgaagctggccctgcatctgtcctcttctagggcagtggtcctccaggtggtggcttcctgatcctgcctgctttgctctgcggctccaccatctcggttccttctgctcagagcctgttgccagtactggtcgtgggtcctgcctaactctaagggaatgtgagggagccatggagtgcttggggagggctgtggtctctgccaccgcgttcaccacatcctgaccacttcttccatggaacaggttcacaaacctcattcatccaggcggcctgggtgacactctggggtaaaagtctgcaggaaagccctcagttcaactttgtcatctttcacctgtctcttcaattcggaataagctggtttatgcactggaagtacatcatctagtagtcttttatatgtgttctgaaaggttgttcactgtgtaatgtgaactccgtgttctgtgagcagtgttgttgctgccaactctgagatgctggcctggtgtgtttttgtcaccatgtgactctgttagcatgatcactgctgcctgtagtttctcttagaggcaggttgaagactctaatgtaaaattgtcttttaattagcatttgtttctcagctatttctagagttactgttgaaggtactttattttgactggtacagatctttgcatatgtaatgttagagttccagggaattctgtttaaactccccggtaaaacattctgtacaagatcaaggaaggagaaaatacagttaatttttggaatagagaaattgtcatctttagaaaatgcaaagaggaataatgataattttttgtgtagcagtgaatgaatagctttaagttgatgtcataactgaagacacatgagattttcacatggcagagtcatgcctctgtgttttgctacactccgtgggctgtcatctgataccagtgacaactgtgcaagggtggtacctcccgattctgcacccagtgtggggcgtcctccacctgcccctctccagcagcaccaccagctaatggagctgcacaccttttattccccggttgaaagtcaaaataacccatcaaaattaaaaacttctcatccaaaaacactattaagaaaatgaaaaagcaaaccacagactagatttacaatgcacgtatctgacaaaagactagtacctacaatgtgcagagaactcctctaactcagcagtcaggagaaagttcattttaaaatgagcaagacttgaacaggcacttcacaaaagaagatatacagatgtccataagcatattaaaagattcccagcatcattccttagcaggaaatacaaattaaagccacgacatgatacaacttcacctctcctagaatggctgccgtggaaaaggttcaggggtgcgggcagccagaacccgcagacacggctgtgggtgtggagcacaggatctccattggggaaactggcggtttctttaaaaatgaaacaggccgggcgcagtggctcacacctgtaatcccagcactttgggaggccgagacggatcacctgaggtcaggagttcaagaccagcttggccaacatggcaaaaccctgtctctactaaaaatacaaaaattagctggacgtggtggcaggtgcctgtaatcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaaaaaacaaaaaaacaggaggcagaggttgcagtgagccaagatcacgccactgcactccagcctgggcaacagaacgagattctgtctcaaaaaaaataaaaaagcagtcagttcagcagttacctcagggtagagggcattggccagaagggagttgagggaactttttggggtgactaagttgtttaaaaccaattgggacaggcgtagtggctcacacctgtaatcccagcacttcgggaggctgaggtgggtggatcacttgaggtcaggagttcgagaccagcctggccgacatgattaaactccatctctactaaaaatacaaaaattagctgggcgtggtggcacgcgcctgtaatcccagctactcaggaggctgaggcacgagaatcacttgaacccaggaggcagaggttgcagtgagccaagattgcacccctgtacaccagcctggatgacagagcaagactccatctcaaaaacaaacagaacaaaaaacaaaaacaaacaattcaacttagccctgaagatctgtgcattgtgctgtaggtaaagtctcagaggtcagaggttgctgatgcagaggacccaggctgacccaggtccaaaccttagatcctcctttgcctcctggcctggccacctcctgccgtgtggccctcagcagatctctttctggctgagtcccgacggtctcatgggtgaagtgggatgatactaatcgtgtatcattgttgtgggtttgagatgagtatatgaagacctggctgacagcctgtccacagcagctgctcaggaactgttgactgctgttcttttagccagactattatcaaatgtaatttctatttttaaaaaactcttcccatttcctttcctcttgcaatcagtctcaatagcagtaagaaataaataaaaatgaagattctttgggagacttagttttgtttttttttgtttttttgagatggggcctcgctctgttgcccaggctggagtgcagtggcaccatcacaggtcactgcaacctcgacttcctgggcccaaccgatctcagcctcccgagtagctgggactacaggtgtgtgccaccacacccaactaatttctgtgtattttgtagagacaggatctcactatgctgcccaaactggtcttgaacttctgggctcaaccgatccacccgccatggcctctgaaagtgctaagattacaggtgtgtgccactgtgcccagtcagtttaattctaattaagatcaagattatctgtaaatacgagttccctctctccaaatctagaatttgctggcattagtcacatgtctgaggaagctgacgatgggacccacattgagatactaatcccagggctcggtggttcagggcactgtactgacagcatcttgactgctttgcctgttgcctggaaggggtgccgtgtggcgcctggcaggtggcagagtggccagaggccattattactctcttgagttacggtgttctcaagcccagctgagtccacacagccgatgtggatggactaggacagatccgatgacttagtgtccaagttcaattgcaaatgcagcctcatttctttctttgaagtagaaaatcaaagttcatagattagatgaaagaatagtcattgtacaaaagtaattatagtgtgtgtacttttctttatctacaggagctgtaaaattgacaagcttggcatgtggaaatcagcacatctgggcctgtgattccaggggtggagtttacttccgtgtagggactcagcctctcaatcccagtctcatgcttccagcctggataatgattgagccacctgtccaggtaagcagaagttagctggtggaactcactcttcagtaagacagaaactgtgaggatgctggtactgggaaaaaggatctgcacagcctctagaggcctcccagcaaatgcggggagccatgcccccagggtctacacactctcgttcatcaacatcacaactggaattcgggatttgtgaagtttagagctgaacagactgttacagattatgagtcaacacgtatattttctctttcaaaataataatatttcgtttttgactttttactaagtgaatattattttttaaatctgcctatatattggaacctctattttataataataatgataataaatcagtacccagaagtataaagaaggtaaaagttactttgaa

SEQ ID NO: 661 - DNA, 139519 bp, Homo sapiens
cccccggcggagccagctgctgctcttcggtgctggccccggtgccggccccgttgcccagggaacaggctcccggcagcccccgcggcccggagtccatcccgcctcctccggcccggcggggccgacgagtccggaggggctgccgcgggaggtgagtccggcgacgccgcaagcggccccgacgcccccgacgcccccgacgcctggccccgagcccctcctcggcctcccccgggccactcttcccttgcctcagccccgcagggtctccatgcccgtccgccccgtctccctcgcccgcggtctcgcccgcgcggagtggcggacactaaatgccacaacacacggagcgcctggctcgccgcccgcagaatccggcggtccgcagcggggaacaggggccgcccgcccctcctcaggcctccgctgcgcgtcccgcgccctcggcccccggccccaccctgcatcccggctgccggtctggccgcgggctctgctccttcgccttaagattgacgtcgtgttctgtcccccactcgcagcccgcgtcccttacatccgcccaccggcgcctggccccaggccttgacactcatccagttggtgttcagtgttcgatgagtggataagtgaatgactcctttcccaatcctatttgaaggcatgggaggcagaataggtagtaagtgttaaaggatggggtgtcctggagtcagagccgggcaggtcccagcggccccttcctagctctgtgctggggcaagtgccctacctcactccgctccagtttcatcaccagtggaatggagatgagaatagtttctacctctggcttggtaagaggattaaatgggtcagtgcatgtaaagttaagcacggtgcctgccgctgtacatttcagtaaaggggagcccctgctgtcatctgtgctagcctgcgttctcgccctctagtcccttctgatatgtctctgacttctcatgactttagtttctccttctctacctccatttctcttccctgcacttttttcttcctctcttattgggattcaggaattttattctgttctgtgacttatgttccatgtgttggcagaatgtgggataccagcctgggtgcatccttttctcatctattggagtgaccagttgcacttgtggactgcctccttgcagccaaggtcttgtagacagagttctgggaaatctcaaaacgcaaatcccaggcataggtagaatctgggaatgaagccactgtagctccttgtgatcaccagcgattcctggtcttttaggctgcaggactttgtgttttctcacacccagctataatgtaccttgataaacctctgaccttatttttgttgttgttgttgttaacctgacttacgtcccatattggtggttatttggccatcgtgtgccagcactgtgccaggctggctctagggatgctgtggtgaaccagacagacccttcctgaggtcactgcctcagaaagatcatggtctggcccatgaactttaaaagggagaactaagtgcaggtgtaggggacacacaaattgaattttcaggactgccttggaaaaccagtggtggggaagatggaatgaggataaccctcttctgaaggagtgactaggaagtagcttttgttaggcatcagctatattatacccacgtgtctttttcaatagaagactggcatctactggatttttttttccaattttttcttaaagaagttacacttaagtttggggagaatttcatttcatattagccgctgtaggagttgaaaaaaatggctactggaacttagtgggaagaaaaggaaggaaacaggcatcaggcagaggcagttgattgaacttgggaagatgaggaatagatcaggaaagggttataatgaaaagctttggtgtcaagcacgaagagatttctagattcagtaatgcacagagagatcagtaaaattagaagggagtagttgatggctttgcgaattgctaaggtagaagggagctgttactcaagatgcatgttcaatttaaaatgaatgtattctttggacctggacataagagttctattgactttttgccactattttatatttagggctgtcatacttgggtgaatctagcacagtgctttgagagagagattcattcaacaaacgtgtattgagcattgattgtaccatactctttattggtcttttaaagcaccacaaagtatacagactagaagaacataggtgaagatgagaaagagtccattgaaggggagagaaaacagataatgatggtgctgtgcgataactgccatcatggagttctgtgaaagcagagaaagaccaaccaagtatctgagggaatttatgaaggcttcctggtggcggaggactagttcttacagggcacatgtgggggaatagggaagagtggaaagggactttgttctgcagagacatacaggttatggtgtgtgcagggactgtgatggaaagctgatggatgcacaaacaaaacgtggcctgtctacacaatggaaggctgttcagcaataaaaaggaacgaagtactgatttgtgctacaacatggaggaaccttgagaacattaggctaagtgaaagcaaccagacacaaaataccacatattatatgattcaattttgatgaaatctccagaataggcgaactgtagacagagaggagatcagtggttgcccagggctgagagaagaagcgtgtagaggggtgattgctaaagggtagggagtgcacagtgtgtggatggaagagtggcctgagatgaagttagatatagactgttttgtcatagtgtctaatttccatgcttgtgttaggctttagcttgtgaccattgggtagccaatggggatgggagcaaggaagtgacaaaattttgtctggaagataaatgactgcctcagtctcattacgttcctccttaataatttaatactcaaataattaatagatgtcgtagccagatttcaaacatagattctacaatagggatacaaattgttgcttcctagggattttggagagaatcctgaaaccattagtgtacccagagcactctgataacatggttattgtacagcgaagtggatgacttagactctatattagtcctagctccagtttgagaaatcatccatctgggtggcagttgggtgttagtagtcagcagtgaaggctagctgccaccttccagggttatgagattgacagggctagtggggaaaggaagcatcgtaacttgaaggatgccatagggtggtgttttgtatttttttaactgaaatagtcatgactaaggaagcattattcattatatttttatttatttatttatttttgagatgaaatatcactctgtcacccaggctggagtgcagtggcacgatcttggttcactgcagcctccacctcccaggttcaagtgattctcctgcctcagcctcccaagtagctgggattacaggtgtgcgccaccacacctggctaatttttgtattttttagtagagatgggtttcgccatgttggccagactggtctcgaactcctggcctcaagcaatcctcccacctcggcctcccaaagtgctgggattacaggcgtgagccatcatgcccagcccaattttaaaaattggattgagactattgttttgcagtaagacctgaagttaacaaatctttactgagcatctactctgtgccaaagctattattagatactaggatttaccttggtaagcaagagagaattcatgttgcttacattcttgtaggagagatgatttttaaatggtttagcaaataaagcaattagaggttgtaatgaggattatgaagcacatatgatagaggaaagaagggacagttgggtactcttgagtgatctggtcagagaaggcctttctgtggtggtgatatttaagctgagaccccacagttgagaagaagccagataaatggagtgagatcatttattctgcatagaggaaataattatgacacctgagtgggacagagtgggtcagtggagctagaacttggaggacaagtggagacgggtagagaggtgacaggggagctgcaaagggcttagaccacacggggcatttggtttttattcttagagcactgggcaaccagtgaggagttttgagtagaatgggtagtatggtctgatttctctttgaaggagctgatattttcctttgttttttggggggtaacagctttattgagatataatttacatgccacacagttcacccatttatatacaattcaatggtttttactgtattcacagctatgcaaccgtcactacgtcaattttagaactttctcatcaccctaaaaggaaactccgtacccttcagcaatacaccctaaccccttcttctcccagccctgggcaaccactgacctactctgcctacagcttgcctattctagacattttgtatacatggaatcatataatatatggtgttttgtgcctggttgctttcacttagcataatattctcaggattcctccgtgttgtagcatgaatcagtacttcattcctttttattgctgaacaggcttccattgtgtggatagatcacattttgtttgtccattcatcagttgatggacagttaggttgttttgacattttggctattatgagtggtgatattatgaacatttatctacaaattctttgtagatatgttatcatttctattgggcataaacctaggaatagaacttctgggtcacatggtaactctgtaaccttttgaagaactgcccactggtggctgcaccattttatttttcaccagcaatgtatacagttttttccacatccttgctaacacttgttcataccctagtgggtatgaagtggtatctccttgtggtttcgatttgcatttccctgatgagtaatggtgctgaacatctttttatgtgcttattggccttttttttttttttttttttttttttttttggaaataaagtctcgctctgttgcccaggctggagtgcagtggtgcgatcttggctcactacaacctccacctctcgggttcaggtgattcttgttccttcggcctcctgagtagctgggattacagatgtgcgccactatgcccacctaatttttgtgtttttggtagagacagggtttcaccatgttggccaggctggtcttgaactcccaacctcaggtgatccacctgcgttggcctcccaaagtgctgggattacagatgtgagccaccgtgcctggccttactgggcatttgtgtgtcttctttggagaaatgtttcttagactttgcccattgtaaaattgtcttttgttgttgttttgagatgaagtcttgctgtgttgatcaggctggtctcaaattcctgggttcaatcgatcttcccaccccagcctcccaagtagctgagactatagccacgtgccactgcacccagcttttaaaattgtctttttattattgagttataagagctctttatatattctgggtaaaatctctttatcagatatataaccaggagatattttcttccattttgtgggttttttttttttatttttgtcggtggtgtggattagatgtatttttactttcttgatggtgccctttggagcacaagcgtttttcatttcagtgaagtcaaagagctaattttgatggctgaatgagcctggcttctgggggcaggtgtggaagaccatggcagcagtgtaggcgagggatatgatagcttgtactgtggcatggccacagagttggtgaggaggcgccaggcttgagggaggcttggagatagggctgatggactgagttgagagattgttgtacgggtgagggaaacagaggaattgagggtgaatactaggatttcagcttgaacaacacttttgattcaaaatgtgattatgctgttacctgccggacaattgtgacagtttctaatacctgctggagcctagcaagggcagccctgcgctccctccctgggttctgaagttgcttttggtaggattatcactgagtgtgccaaggagatggtcagggattctgaccttttgtaatacccactaagacctcctaagccaccacaaataaacatattatctgagtagaatagtgcacttgctctgcaaatgcacttttgaggcaaatctcttgactcccttctagctagactgcagtctcaaagcccttcttgtgtagagcctgcgagctgtcagtggatagcatcaaatcaagcggatggattcttgaaagctaaatgtcatcatttgacagagctactatgaggaaaaatatttttatttttaaaaaagttttattgatcgattgatttgagatggggtcttgctctgtcacctaggctggagtgcagtggcttgatcatggctcactgcagcctcgaactcccgggctcaatggatcctccaggttcagtcgatcctccgggctcaattgattcttgtgcctcagcctcctgagtagatggtactacaggcacgcaccaccacacctggctacttttttgtattttttgtagagacagagttttgtcatgttgcccaggctgatgtcaaacccctgggctcggccaagtgcagtggctcacgcctgtaatcccagcactttgggaggccgaggcgggtggatcacaagatcaggagattgagaccatcctggctaacacggtgaaaccccgtctctactaaaaaaaacaaaaaaacaaaaaaacaaaaaattagccaggcgtggtggcaggtgcctgtagtcccagctactcaggaggctgaggcagaatggcatgaacccgggaggcggagcttgcagtgagccgagatcgcatcactgtactccagcctgggcgacagagtgagactctgtctcaaaaaaataaataaacaaacaagcaaacaaacaaacccttgggctcaagtgatctgcccacctcaacctcccaaagtactgggattacagatgtgagccactgtgcctggctgaggaataacttttttttttttgagacagagtttcgctcttgttgcccaggctggagtgcaatggcacaatcttggttcactggaacctctgcctcctgggttcaagcgattctcctgcctcagcctcctgagtagctgagattacgggcacctcccaccatgcccagctaatttttgtgttttaatagagatgaggtttcaccaagttggtcatgctggtctcaaactcctgacctcaggtgatccacccacctcaggctcccaaagtgctgggattacacgcgtgaaccaccacacccggccggtaataagatttttaaaggaggaaataacattaggcaatacttactggtgaagagctcagtacttccgcttgcttgctaggagatctcatgagctaaagcagatacgaaagtgcctgccagagatagggagtagaaggtgtgaaggccaggacgtgagaggccaggcctgttgtaattagaagcaattcagtgtggctggaggacaagtgagagatcctcgggtggcagaggccagatcaccaaggttcttgtaagccagcaacacttgggctttagcaggaggaagatggggaccactgcagagtgttaagcaagggagtgatgacatcagctttgcacatcaggaaaatccctctgtttgccacgtggatgacggggagggagaggcgggcagatgagctgggcaccagagagagctgcaggtgagaggtaatggtggcccgagctaggggtgacacactgaggtgtgtgggagatgtactgaatggagaatcggggacatggagaggagaggaggagggatcagggatgatgctccttttctggcttggtcagcatggcccaggcaactggtagaagatacaagataggtaagtgtctttgacattgttcatttactctgtgtttatagctaggatgtaagttttactaatcccatttcagatggtaattggagatctagagaggttgagcagttattccagggtgcctcaggtagttttaggagcattgggatttgaacttgggtctttttcacttcagtatcattagccactcattgtgcagttcttcctcggtggaaagagggtcagttctgtggctgtgggtctgagacctgggggttgggtgaggtggaacatggagttgggtgaacattgggtaaggaggaggagcagaaagtcttagcagaaatgtttgctgtgtctgcattgtttttcccaaacctagcgcaggacagtgagacagcggctctatgccttttcctcagcccgtcctagacactgtttctgccaggaggacagttttgctgggagttggcctcaacctgctcctcctatctgaatggtgggtgaaggacagacaagcctggtgctaagctcatccagaggcccccagatagggaaatagcatggattctcttctgcccgctggggacttcttgggcacctggcccccaggcatggctgtcctgactcatctgggtgctatggcttacgggcctctagatatcctttggaaaaacgtgtgaggcataaattgatatgaacattcttcaaggcagtttggcaatacatttttttttaattcaacatttccacctcttgcagtgtactccaagaatatacttggatatatttctgttgtttttgatggcaaaattaaaatcttttggttgagaaaattttggtttatccatacagtgtgttctctgcagtttttctgtatagtcactaaaaatcacattctaggggaatatttaatgacatggaaaatactcatgatttattaagtgaaaaagtctgtgtgtgtgcatatatgtttatatacatatatctgtagctatctgtgtacatggcatatctcagtatgatgagattgtgacttttctttacttctttgtccttttattttgagatagggtctcactctgtcacccaggctggagtacagtggtataatcagctcactgcagccttgatctcctgggctcaagcgattctctgtgtaccaccacacctggctaatttttgtattttttgcagagtcaggatcttgccatgtttcccaggctggtctcaaatttctggcctcaagtgatctacccaccttggcctcccaaagtgctaggattacaggtgtgacctactgcacccagctgcctttgtacttttcttttcttttttttttttgagattgagtttcactcttgttgcccaggctggagtgcaatggcacaatcttggctcaccacaacctctgccttctgggttcaagcgattctcctgcctcagcctcccaagtggctgggattacaggcatgcgccaccacgcccaggtaattttgtatttttagtagagatggggtttttccatgttggtcaggctggttttgaactcccaacctcaggtgatccgccctgactcagtctcctgaagtgctggggtttacaggtgtgagacaccgcgcccagccttctttgtgcttttctatattaacaaatttttgaggccgggcatggtggttcatacctgtaatcccagcaagtctgggcgtggtagctcaagcctgtaatcctagcactttgggaggccaaggtgggtggatcacctgagatcaggagttcaagaccagcatgatcaacatggtgaaaccccatctctattaaaaatacaaaaattagccaggcctggtggcaggcacctgtaatcccagctactcgggaggctgaggcacaagaatcacttgaacccaggaggcggaggttgcagtgagccaagatcatgccactgcactccagcatgggcgacggagcaagtctcaaaaaaaaaagcaactttttgatagtgagcatttataactgttataaaaagaaacctttatttttaaaaagttaaataaattatggcacatcaatgtgtgtatgagtatgtatgtatgcactctttaaggaaacaaagccttttactatttctgtgccttggaaagaagaataagaagtttctgcatccatgaagtggaggtaacattcatgtctaatgtttggggattgcaggaaaaaaaaatggaagtaactatgatgcctacttcatgtttgttttttttttctttctttttggtgaggatttaatgggtttgtgtgctaagaacagtttgtattaagtacagacggttttcaacttacagagtttcaacttactattttttgactttaagattgagcgaaaacgataccattcagtagaaactgtatttccagtaaccatacaaccattctgtttttcactttcaatatggtattaaataaattacatgagatatgcaacactttgtgataaaataggctttgattagatgattttgcccagctgtaggctaacataagtattctaagcacatttaagttaggctaggctaagctaagatgttcggcaggttaggtgtattaaatgtattgtgacttatcttttcagcttatgacggttttattgggacataaccccattgtaagttgaggagcatctgtaaaaacattagctattcccattattattactgcaaaagagggtggattgggttcttaagtatcacagaggaatgcaattattattattattgttatttacttacctttaagaaagttctcatacgtggatatgttctgcctgtattggctattgtgactgtcagatgaaatgggaatctaaggctgggcgcgatggctcacacctgtaatcccagcactttgggagactcagatgggcagatcatgaggtcaggagttcgagaccagcctggccaatatggggaaacccccatctctactaaaaaatataaaaattatccgggcttggtggcacacgcctgtagtcccacctactcgggaggctgaggcagaagaacccaggaggcgagtgttgcagtgagccgagatcgcaccaccgcactccagcttgggggacagagcgagattctgtctcaaaaaaaaaaaaaaaaaagaaaagaaatagaatctaaaaatgcttggaaaactggatatgctatacagatttagggaattattattccagcattgaattggggtcatattgaagaaaaaatgatactttgctgctcttccattccattttttagaattttatatttaatattttttcttttgctctacacattcagagaaacttctctagtaatgaactatagaaatgatcccagaaagcacagcctttgttcttctgttcttgtcactcattccttccttgcatattttccttttatttatttattcatttaagagacagtgtctcactctgtcactcgggctagagtgcagtgacacagtcatagctcactgcagcctcaaattcctaggctcaagtgatcttcctggctgagtgcagtggctcatacctgtaatcccagcacttggggaagctgaggaggaaggatcacttgagcccaggagttggagaccagcctaggcaacatagtgaaaccctctctattttttaaaatgaaatatttgttttaaaagcgtgatcttcccacctcagcctcatgagtagctaggactacaggcatgtagcaccatgcctgactaatttttaaaaatattttttgttgaggcgggagtcttgctatgttgcccaggctggttgtgaactcctggtctcaagcagttctcccaccttggcctcccaaagcactaggattacaggcataagccactgttcctgggccaaattttctgtttcatcattcattcatttatgcaacaaatacttgctgaatgcctctgatgtgcctagcccttttctccctgcggggggaagaggggtgagtgaggcagatatgggctctgctgttatgggccttacagactagtgtgtgtgtcagagtggcaggcaggcagataaccagtcagagaaaagaaaggagatgtgtggataggccggacacggtggctcacacctgtaatccaagcactttgggaggctgagatgggaggatctcttgagcccaggagcttgaggctgtagtaagccatgattgagaccagcctgggcaacacagcgagacctcatctctacaaaataatttaaaaattagccaggcatggtggcatattcctgtagtcccagctacgtgggaggtggaggcaggaggttcacttgagcccaggagtttgaggcgtcagtgagtcatgatcttgctactgctttccagcctgggtcacagagtgagactgtgtctcaaaaaaaaagaagaaaggggctgtgtagagaaagtaaaactgggagaggtgacagagagagaactcagtagggggaggagaaatcaagtacggcctcatgaaagagggcacaattgagaaggaggaagagctcagtagagaaagaacattccaagtggacggaacagccaatgcaagggccctggggtgagaacgagctggattaatttgatcagaagagggactggaagttggtcagtccactatgtagaaatagaaaacctacagttcaaagagaccataaatccatgatgcaagaagtttctgtgagaggagcttggaagtctccatagaacctgtagagctaaaatatccctccaggtgtaatcaggtacagagcatctacctggactgttacagcctgcctgtcagagctgtgactgtgctgttgtcaagagcctaggacttggagggaaaagacctagagtcaagtctcggctgtttgatcttgagtgagtctcatgaccctctggcccccagtcccttctaaaagttagggatgatgctacctgccttataaggtagggtcaggattaaatcagtgagtgagcactttgtgaaagatggcgtgcatggaagggttgcatatctttagtaagggaagctttgaagccaaagtgcaagtgggtgggtctccatgtggaacagagtaaggtgctgtgtggctggactcttgagcgctgaggaggctgtgggcatccaaccaggccagggcacctgttcttcaccatctcattaacacagccagcatatctgcatctgagattggcccactattctcctaatagagtgtctttcctgtttctcttttccatatcctgtccaacctggtgggcttcatagttcaggatgtgttcagtgaagccatgtctacactcactctaatccccactgatctctctctcctcatgaaaacccacaaattatcacctcattacttgtggatttgtgtcttttcactatttcatctgcctccctgtctagatcataagctacttgggagtaagaactgttttgttttttgtattctttccactcctccatggcattcactacaacataaatcatagaggtcagaacatactgaagtgcattttgagttaaaatgctcaaaagtgatcttagtgacacgtgtttactttccctgtttatttaagctccagctataatgtttacctgcctaaaagttccatgttgccagtattaaacatacttctttttgccatgactaggcattgaaaggattgtaatgctttgttctgtagcccccaggtttccctagatgacaaataaacattccttttcctgcgtgaagatagtctgtggaaaccttggccatggcatcgatatcagagcctgttacattcagagagttctgcccgttgtactatctcctcaatgccattccgacaaagatccagaagggtttccgctctatcgtggtctatctcacggccctcgacaccaacggggactacatcgcggtgggcagcagcatcggcatgctctatctgtactgccggcacctcaaccagatgaggaagtacaactttgaggtgagccttgctttgcttttcacctgagggggcacgagccatagctgacgcttaacatgcttgtgttctaggatgagataatttacttctgatttgccagaatatggccttaatacctcacccaaacaatactttaaaaccatctttagctgaagtggaatataactaaaaacattggtgtttttaactttttcctgcctccaaaaatctaacatcactttatttatttatttgagacagcgtctcgctctgttgtccagcctagagtgcagtgggacaatcatagctcattgtagcctcaaactcctggggtcaagtgatccttttgcttcaacttcctgagtagctaggaccacagggatgactgccacacccagctagtttttgttttgttttgtctgtagagacatggtttcactatgttgcccaggctggtcttgaactcctcggctcaagcagtcctcctgccttggcctcctaaagtactcggattacaggcatgagccaccacacctggcctaacatcactttaaaagagaatatcacctgaggtcaggagttcgagaccagccttgaccaatatggtgaaaccctgtctctactaaaaatacaaaaattagctgggcgtggtggcatgcacctgtactcccagctactcaggaggctgagacaggagaattgcttgaacctgggagatggaggttgcagtgagccaagatcacaccactgcactccagcctgggtgacagagtgagactccatcttaaaaaaaagaaagaaagaaaaaaagagaacattttagtatttaaaacttactacaacactttgaaagcagatatttttttcctaagtgtttacaggagcaggcacatgcctgtttttcaaagttttgaataatctctagttcttctcttgaaattatgatgaaaaaaggatgtatatgaatattggctcattgccagaatatgcacctcttagctgagctgaggtctcttctatagcattgggatcctgaccaatctgtttctgcagtgctgtggactcaggcatttctgtgtattgtagatattggtggagatgttatttgactgtgttgtggctggcaccaactattggtgaactgtaatgtaattcacccacttagtcaatatctgtagtttattgagtacgtcacttttgtgagagactcaaagttgactgagttgtggcttccaccacatgggactctattctgtctgtggttagggggcttttatggaccaagatacagcttttgtatctaagagaaatgtttacaaatacttgtgttttaatcagtattcaatatattaaagttttcatttaaaacgtaactaatttaagcctctgtgctcattttaaaataatcaaaatggttcatacacatacagccctttctatgtgtcagacattattctttaaaaatatattttttaaattttttaaaacattattttttccttctcactatgcttcttggacagacatatattaactcattttatcctcacaaaaactctctgaggcagatgttattatgatcttcctcatttactaaggagacagctggtgaagagagggtaggtgacttgcctgaggttggctggtagtaaatggcagcaccatcatgtgaacttgggcagactgtctctagggtctgtattaatatatatatatatttttgagacggagtttcactcttgtcgcccaggctggagtgcaatgacatgatctcggctcactgcaacctccacctcccaggttcaagcaattttcctgcctcagcctccagagcagctaggattacaggcacccgctatcacacccagctaatttttgtatttttagtagagacggtatttcaccatgttggccaggctggtcttgaactcctgacgtcaggtgatccatctgcctcagcctcccaaagtactgtgattacaggcgtgagccaccacacctgcccgtgtattaatattttttgtataaaaattagaactactgctatttcttctctttgagtaatagctcatggattcgactgatcaaattccccaaacatttaaaaccattacgtaatctttcaaactgtagttaggagtttaatagtctgaaatctctcaaatgcttcagacactttataaggaagactcgtgaatccaacgatgaaccccaacaagatctatcaaagaaatccatgcacagaggcaccctagtcacactgctaaagatcacaatcttaaaatccgtgcacagaggcgtcctagtcacactgctaaacatcacaatcttaaaatccatgcacagaggcgtcctagtcacactgctgaacatcacaatcttaaaatccatgcacagaggcgtcctagtcacactgctaaagatcgctgtcttaaaatccatgcacagaggcgtcctagtcacactgctaaagatcacagtcttaaaatccatgcacagaggcatcctagtcacactgctgaagatcaccatcttaaaatccatgcacagaggcgtcctggtcacactgctaaagatcaccatcttaaaatccatgcacagaggcgtcctggtcacactgctgaagatcacaatcttaaaatccatgcacagaggcaccctagtcacactgctgaagatcacagtcttaaaatccatgcacagaggcaccctagtcacactgctgaagatcaccatcttaaaatccatgcacagaggcatcttagtcacactgctgaagatcaccatcttaaaatccatgcacagaggcatcttagtcacactgctgaagatcaccatcttaaaatccatgcacagaggcgtcctagtcacactgctaaagatcaccatcttaaaatccatgcacagaggcgtcctagtcacactgctgaagatcacagtcttaaaatccatgcacagaggcgtcctagtcacactgctgaagatcaccatcttaaaatccatgcacagaggcaccctagtcacactgctgaagatcaccatcttaaaatccatgcacagaggcgtcctagtcacactgctgaagatcaccatcttaaaatccgtgcacagaggcgtcctagtcacactgctgaagatcacagtcttaaaatccatgcacagaggcaccctagtcacactgctgaagatcaccatcttaaaatccatgcacagaggcgtcctggtcacactgctgaagatcacagtcttaaaatccatgcacagaggcaccctagtcacactgctgaagatcaccatcttaaaatccatgcacagaggcgtcctagtcacactgctaaagatcacaatcttaaaaatagccagagaacaatgacgtattacctgtagaggaacaatgatttaaatgactgtggatttctcatcagaaactgtattagcccgttctcatgctgctatgaagaaatacccaagcctgtataatttataaaggaaagaggttttattgactcacagttacgcatggctgcggaggcctcaggaaacttacagtcatggtggaaggcacctcttcacagggctcactgtcacaagaacaggaggggggaaaccatgcccatgattcagttatctctacctggtccctcctacgacatgtggggattatgggaactacaattcaagatgaaatttgggtgaggacacagccaaaccatatcagaaacaatggaagctggaagacagtagcatttttttggttttttgtttttgttttgttttgagacggagtctcgctctgtcgcccaggctagagtgcagtggcgcgatctcggctcactgcaacctccgcctcccgggttcaagcgattctcatgcctcagcctcccaagtagctgggactacaggtgcccgccaccacaccggctaatttttttgtatttttagtagagacggggtttcaccatgttcaccaggatggtctcgatctcctgacctcgtgatctgcccgcctcggcctcccaaagtgctgggattacaggcgtgaaccactgcaccaagcttgtttttttttttttttggcagagtttcgctcttgttgcccaggctggagcgtagtgactgcaacctccacctcctgggttcaaacgattctcctgcctcagcctcccttgtagctaggattacaggcacacgccaccaagctcagctaatttttctatttttagtagagacggggtttcaccatgttgtccaggctggtgtcaaactcctgatgtcaggtgatccactcgcttcggcctcccaaaatgctgggattacagctgtgagccactgcgcctggccgatagtagcacatttttaaagtggctgagaggccgggcatggtggctcacacctgtaattccagaactttgggaggctgaggcaggtggatcacttgaggtcgggaattcgagaccaatctggccaacatggcgagagccccatctctactaaaaatacaaaaattagccgggaatagtggctcatgcctgtaatcccagctactgagaaagctgaggcatgagaatcgcttgaatctgggaggcagaggctgcagtaagctaagatcgtgccagtgcactccagcctaggcgacagagtgagactccatctgaaaaataaaatgaagttctgagagaattgtcaacccgaaattctttactcagtgaaaatacctatcaagaaaggtgaaatgaaagtattaccagatgaaggaaaacttaagagggttcgttgccaaccgacctgctctaaagtcattgctaaatgaagttctttagacagaagggaactttgtacatcaagaatgaagaatggtaaatacctgggtaataaatacaatagatgatttttcccctattgagttctttaaaatatatttgacagttgaaaacaaaaattataactgatcaagttttaacagatgtagatgtagtaatatctaagacgagtacaacataagtaagggagagtaaggtatcctatacatttgtacattcttcttgaagaggtacaatattgattctaagtagattttgaaaaattacgtataggccgggcacggtggctcacgcctgtaatcccagcactttgggaggccgaggcgggtggatcacgaggtcaggagatcgagaccatccaggctaacatggtgaaaccctgtctctactaaaaatacaaaaaatgagccaggtgtggtggcgggctcctgtaatcccagctactcaggagactgaagcaggagaattgcttgaacccaggaggcagaggttgcagtgagccaagatcgcgccattgcactccagcctgggcaatgagagtgaaactccgtcccaaaaaaaaaaaagaaagaaagttggagtggctgtattaatatcaaggttttcttctgtgcaaagaaataaccaggggtaaaaaagacattacataataacagattcgtatatgtcccttaacaacatagcttcacacaatacacgaagcagaaatggacaaatctgcaattacatgtggagacttcagtattcctctctcaataatagaagtagtagacagaaaaccaacaggatgtagaagaactgaacaacaccatcagccaacttggtctaattcacatttatagaacactcagctgaatatacattctttgcaagtgcacatggaacattcatcaatatagaccatgtcctgagttagaaaacatacctcaacacatttagagtagactaagctttccaggcccttgtgttttactttgttttttcacttttctttaaaatataatttacacaaagtttgcaaatctttttttttttcgagacggagttttgctcttgttgcccaggctggagtgcaatggtgcgatctcggctcactgcaacctccgtcccccgggttcaagtgattcttgcctcagcctcccaagtagctgggattacaggcgcctgccaccacgcccagctaattttttgtatttttagtagagatggggtttcaccacgttggccaggctggtctcgaacgccagacttcaggtgatccatccacctcggcctcccaaagtgctgggatgacaggcgtgagccactgtgcccagcctgcaaatcttaatagtaccatgtgatgaatttatatgtgtatgcctgtttaatcacccagttcaagatacagaacatttccagcaccccagaagattctcttgtgctacctcctaatcattacccctccccaaggtaactattctgacttctaacacagagtagttttgacttctacagagtagttttgctagctccttgggttttaattcactattaagtaacctctggcagtaaggtttatatgcgttagcggaatttggactccttactcaggttgcagttacaacccagttttcttttataaagcacatgtgtctcattgatcaccattgtattgtcttttttgttttttttgtttttttttttgaggcagagtctcactctgtctcccaggctggagtgcagtggagcgatctcagcccactgcaatctccgcctcctgggttcaagtgattctcctgcttcagcctcctgagtagctggaattacaggtgcccgccaccatgcctggctactttttgtatttttagtagagacagggttttaccatgttggccaggctggattcaaactcctgatcgcaagtgatccacttgcctcggcctcctaaagtgctgggattacaagcatgagccactgcgcccggtcccgtattgtcttttagaaaaactgtataactatttaaatattttcagtcaccaaactaaaaaacaaatactaaagttgaagtttattgctccccagaatgaaactacaaattacatctgatggccatttttacagtttaaccaataattagttctctatcatattatctttgtttcgttttcctttaacagaatacctaagactagtagttgttctttttttttttttttgagatggagtttcgctcttgttgcctagcctggagtgcagtggcgcaacctcggctcactgcaaactctgcctcccgattcaagcgattcttctgcctcaatctcctgagtagctgggattacaggcatgtgccaccccatctggctaattttgtatttttagtagagacagggtttctccgtgttggccaggctggtctcgaactcccgaccccaggtgatccacctgcctcggcctcccaaagtgctgggattacgggtgtgagccactgcatccggccggaagttgtttttatttttttactatttttaatttttttaaagaggtttatttggcccacaattctgtagctggaaagtccaagattgggcagctgcatctggtggggacctcatgctgcttccactcatggtgggaattggaaggggaccaggtgtgtatcaagagatcacatggtaggccgggcatggtggctcaggcctgtaatcccagcacttcaggaggccaagacaggcggatcacgaggtcaggagtttgagatcagcctggacaacatggtgaaaccccatctctactaaaaatagaaaaattagccaggcatggtggcccatgcctgtaatcccagctactcaggaggctaaggcaggagaatcacttgaacccgggaggcggagattgcagtgagccaagactgcaccactgcactccagcctgggtgatggagcaagacaccacctcaaaaaaaaatatatatatatatatgtgtgtgtgtgtgtatatatatatacacatatatatgtatatgtatgtgtgtgtatatatatatatctatatctcacatggtcacatggcaagagaggaagcaagacaggaaccaaggatgccagactcattttcttttcctttcctttttttttttttttttttttttttttgagacagagtttcactcttgttgccctggctggagtgcagtggtgcaatctcggctcactgcgacctctgcctcctaggttccagcaattctcctgcctcagccttccgagtggccaggactacaggtgtgcgccaccacatctggctaatttttgtatgtttagtagagacagggtttcaccatgttggccaggctggtctcaaactcctgacctcaggtgatccacatgcctcaccctcccaaagtgctggaattacaggcatgagccacggcacccggctctttttcttttagtatggagtgcttcacaaatttgtgtgccatcctcgtgcaaggaagccagactctttttaacaacctgctgtcttggaaactaatccagtccttggagagtgagcactcattcacccatgaggagggcattaatctattcatgagggatctacccccatggcccaaacacctcctactaggccccacctcccagcactgccactttggggatcagacttcaacataaattttggcaaagacaaaccacatctaaaccatagcagatatgataagtcacgtgagctttgaaggactgtgacatggtagaacagcatccacaggctctaccagagtttggtggaacagcatccacaggctctaccagagtttgagggagcagcatccacaggctgtaccagagattgagggaagctggtacaaattactggatccagcaccatagaaggggactctgggagaatcccatgtaaagattttagctagtccaggcatagtggcacacacctgtaatcccagcactttgggaggccgaggcggacagatagcttgagctcaggagttcgagactagccttggcaatacagcaagacccccatctctacgaaagaatacaaaaattattcaggcgtgatggcgtgtacctgtagtcccagctactcaggaggctcaggtgggaggatcatttgagcccaggaggtcgaggtcgtagtgagccgagatcgagccactgcaccctaacctgggcatcaaagtgagaccctgcctcaaaaaaaaaaaaaatttagctagttatcctttaaatgtatttcacccatacatgcatatgcctgctgtgtacctacaaaaactttttaaatctaaaatattaacatttggaaaaaaaatgtattttgctggggccaaaatccatacttggtagccctgagtatcaacagcattttttgagcgcccattatatataggatatcaaacttataattgtggagaatcacaagggaggtataaaataaatttcttgtccaggcacggtggctcacgcctataatcccagcactttggtaggccgaggcaggcagatcattttgagctcaggagtttgagagcagcctgagcaacatggcaaaaccccatctctactaaaaatataaaaattacccgggtgtggtggcgggcacctgtaatcccagctactcaggagactgaggctggagaattgcttgaacccaggaggtggaggttgcagtgagtagagattgcgccactgcactacagcctgggcgacagagcaagactctgtctcaaaaataaaataaagtgaaaattttttttttggcaagaatgtagaatttagaggtagaagatttagagcttggaaacaaagctgtatacctatatgtaaacacataggaaaaggtctgaaggaattttcacatgattacttaactctaggtagggattaagattgggatgggctgagggaggaagagtgaaagggaattacgtatttttttaactttactgaggaattactagaaatttttggtacatattacacgcataaacacagcaacacaaagatttgttttgagctttggctgccagttattagtggtttaaccccagagatgaattaaatatttatgttgttgttgttgtcattttcatcatgagagctggctgggtcttagaatcatttggtacaatccccactttttatagataaagaaattctaagattcctgcttcaaggcacgtatctctgattgcctaaccattgtgcttacttcttgtgagaggaggtaggccctctgtgcagtctgtggatttcaaggatatggaatacagatgcgtggtctctttggaatgtccaagtcgaaagttaaagatgcattaactagtttagggaaaatctaagattttatgggaagataaataaaaaagtttatgctcaaataaatccatgtatggcatgattgaaagattatgtttttaaatgaagttatgtttcctaaagaggaaagcagaccttttctgtggtaaatatagccttgcatgtgttttcaagaatggtgctttggaaaccatttttttctacagaagttagtgggagagggcagatggaaacacagattcttcctacctagtgccaaaagcactgagaaaatgttgcaaggagctaataacaagtacaaaaatgttagaaatgtgttaaatatataggtctgatatgtgtaagcatagaccaaaaagactacctgacctgagtttctaatgttctgttttgaagttaaacatatgatcccttttccttagcattcaacaagccaatgagatttcatggatttgccttcagagctgtctttttttttttttttgagacggagtcttgctctgtcccccaggctggagtgcagcggcgccatctcggctcactgcaagctctgcctcccggtttcacatcattctcctgcctcagactcccgagtagctgggaccacaggtgcctgccaccacgcctggctaattttttgtatttttaatagagacagggtttcactgtgttagccaggatggtcttgatctcctgacctcgtgatccactcgcctcagcctcccaaagtgctgggattacaggcgtgagccaccacacctggctgggtggttgcagttttaaatagcattccagggaaggtctgactgagaaggtgacagttgaacaaagacgtaaagagcatgaccaacacaccatactgacatgtctgtattccaagaaaacggaagggaaaggcactgagcctgaaacatgtcttggatatttcgcattgagaaaagtcatgcttcagaatgttacaagtatttcattggcttatactttatagacatattttaaagaggtgcagaaaggacagtttttgtctcaccatagcagccaaggtgcatttgcccagtgccttccattgtctttccctgtgggagtaacttttaggtccagtgatgaggagcctgtgatgtctgtgttctggtttgttgataacattaccatacagggcttcacgggtgtccttcttagcatggattgcttccattcattggttgctggaaaatttgctttcaaatgtttttaacagtgactcttagggaaaaaaaatacattttattagatgtccattctccctaaatttacctgagttcaactgaattccaataggtttttttttagtgttaatttaaaaaaacaagctggccaggtgtgatggctcatgcctgtaatcccagcactttgggaggccaaggtgggcggatcacttaaggtcaggagtttgagaccagcctggccagtatggtgaaaccccatctctactaaaaatacaaaaattggctgggcgcagtggctcacgcctgttaacccaacactttgggaggccgaggcaggaggatcacgaggtcaggagatcgagaccatcctggctaacatggtgaaaccctgtctctactaaaaatacaaaaaaaaggccgggtgcggtgcctcacacctgtaatcccagcactttgggaggctgaggcgggcggatcacgagatcaggagatggaggccattgggctaacatggtgaaatgctgtctctactaaaaatataaaaaattagccgggtgagatggcaggcacctgtagtcccagctactcgggaggctgaggcaggagaatggcgtgaatccaggaggcggagcttgcagtgagccgagattgcgccactgcactccagcctgggcgacagagcaagactccgtctcaaaaaaaaaaaaaaaaaaaattagctggatgtggtggcacgtgcctgtagtcccagctactcaggaggctgaggcaggagaattgcttgaacctgggaggtggaggttgcagtgagccgagattgtgccactgcactccagcctgggcaacaagagtgaaactccatctcaaaaaaataaaaataaataaataaataaataataaaaatacaaaaattagccaggtgtggtggcacacacctgtaatcccagctacttgggaggctgaggcaggagaatcatttgaacctgggaggcagaggttgcagtgagccgagattatggcactacactccagcctgggtgacagagcaagtctctgtcttaataaatacataaataaaaatgataagctgatttaaaaatgcatatgaaattgtagtgggtggaatagtcatactagtggaaaagaggaagcaaatgggagaagttgctattaggtaacaaaacttatagagctttagtaattaagggagtgtggtattagcacaagaaaagatacatagatcactggaacagattagagaagtcagaagaccaacatgtatatggatacttgagtaattgcaaaggtgatacgacaaagtctttttcagtaaatgatgtgggacagctggatatgaatgggaagaaaaatgaaactggatccctacctcacttcatatggtggttattttgagcactttaaagtattaatgccactgtctcttgactgctgagattctgctggcagtgtaattatttcctttaccgggaatttgccttgtctgtttctgctttagatcttctctaatgatagagtccctggctttaggcttcttccttcaactccagtggatattccctactttgttttgtcctatggagttaagaaaattattccagaaaagcagatatctttgtttaacttccagatcattaaaaagttgtgttagtattcaaacattaaacagatgttctttgttagtaaaaggaggaaaatagtgtaaccattcttaataattgaatgaattcatatttggtcttaaatatttcaaaatatttcagatcaattctttggtatgctagtggtttctactgaaggttaagctttgacctactaaaagcagctcataaagaaagctttgtcagacttcagttcccatgaacctgctcacaaagaacactttttcccaatgtagttttgtcttgtgtatgaaaggaaaactgcctgccaaggaggctaagaaggttagctgaatgctattgtaatggtgagatgtttgtccagaaaaccattcctgacacctttcaaatcaaaagccttttttttttccttaaactttttgattgctggatttctgtttgaggaagttatgttgctacaatgagggtagcaataaatgcctcctgggaagttggaaataaaggcaaaggagagttaaacacaatagatgagatcagaaatgggcaaagttatcttaaagagacagaatggctccctggctagaataagactgaattgtccctagatcaaaaaaagaagagaatgtgtgtggcagaaggaagaaagtggactctacactgtgttagttaggaaaaccagaaattgggccaaattgcctgtttagtgggagagatagcttttgagagctgtgatcccgctggtgtggctggctctgggcagatatttgtatctgaaatgactcatgctgtgggacccttcctgagatctaacacttacagtggtttgatcagaaattgcaccatgcttgccaagcaacttttggactaaaagttgctgcccacgtatatcaggggaagaatatatatatatatatatatagtacctatcttagcatctgatttgtatgaccattacttcaatgtaaaataataaattggctttccagcttaaacttcaatttcttgtatattatatgatcatgagacaacctccctgggctgatcaacagcaggacgctaaaaagattgagtatctgagtcaggaaggtagagggccagaccctacatgtagctaattcaccattgtgaatctgcatgttaggtaaaactatggatttgttttttgtcttttgagacagattctcaccctgttgcccaggctggagtgcagtggcatgatctcagctcactgcaacctttgcctctgggttcaagagattctcttgcctcagcctcccaaatagctgggattacaggtgtgcaccaccacgcccaaccaattttttgtatttttaatagagacgggagtttcaccatgttggcgaggctggtctcgaactcctgacctcaagtgatccgcccacctcggcctcccaaagtgctgggattacaggcatgagccactgtgccaggcctaaaactatggtttttaaagatatacacgcatgtggtaaagctatgaatcaaagcaagagaatatttcatctcaatgttaggagagtggttttggtggggtggggtatgtagtcaggcagaggcacacaagagcttcaaaggtgctgttaatggtccctttcccaagctagatggggattccatgggtgctcattttttagtaactctaatttaagctgtacatgttatatatagtcatggatatataatcattattttaaaaatgaaggcaaggaggataccataaaatgaggtacttcatatttaaccagctggcatcctaagcacctttcctgccctcccctctctgcacctggcagagttgatcacatcctccccattacccactatacatgggtgtcagtgccaatagtgctttgctcttgtattattgatgagtcttgctccttttcctaaattgtgaggcctcctgaaggcagcacccttgtcttatgaaaaagttgagcttctgaggatatgtctttggtgaattttggaaaacgtttagcctttatctctgaagataccacttttcattaccctctcttttcatttcctgctgaaacccctttttttgtttgttttttgttttgttttgttttgttttagacagagtttcactcttgttgcccaggctggagtgcaatggtgtgatcttggctcaccgcaacctctgcctcccacattcaagtgattctcctgcctcagcctcccaagtagcagggattacaggtgctcgccaccacacccagctgattttttttgtatttttagtagagacggggtttcactgtgttggccaggctggtcatgaactcctggacctcaggtgattcacctgcctcagcctcccaaagtgctgggattacaggcgtgagccactgcgcctggctgagaacccacttatgtgtagcttggacctttatgttctctcttctatgtctctaaacttctctttcatgttttgaatcttttcatctctttgttgcatggtaggtaatttcctcagatctgtcatctagttcaatacttttttttccagctgtgactaatttgctgttcattccacccagtgacattttaaattctcttggattttttcatttctatttccaatagtagttgttctttgcttacatttcagtttcctgttttatttttaaaacattttaatcatttttcttttatgttctgtgttcttcaatctaagtgaaatacttggggttgttcagtgctgttatggcttgttttacttgactcattcatgggcctgcttccctatcgtaatttctaattacgagcaatgtggctgatcctaatgtatgagaaccctgggggacctggatcgggactgctccacagatggggtttatgtttaccaatgccaggcaccttggagtgctaccaacatagaagcacttcagattaaccgtctgcatagagctttgcttggaaagagaataaattcaaactctgatgctgaatggggcaggcttatgatgacacattcttcggaaagattcttttttattcgttccaatcaatgcttgagataagacagatttccttgccagctccatttgccagcaaatcaatttttccctagcttactccttcacttagggttaggtccttgggattctggcttggcagagaatatcagctccagctccccatcatctactccgctctgaaaaccaaggctccagaggtgtgccagatagttacagggtagcctgtagcttcagggctagcttctgttttagtttgggggcattcttcttggttttggggtcctgtggattttccatactttcttgaaaattcagctgtgcatttgaaaggctttgttatatattgcactcagcattgccaggtgtttggagaggggtgttttgggatagctaggctattgtattgtgcaaaattaaagcctcatattctatttctatatgaactgtagttaagtgttaataatctgatgtctgggatgttttgattcttacatcaataactatgacatttattaataatcatattaaataacattaactcaagctcattggttacattacaaaggacactgatacattacaaagcacacatacaagcactgcacaccagtattgaggcttccagccccctctacatgatcatttatttatttatttatttttgagacggagtctcactctgttgcccagactggagtgcagtggcatgatcttggctcactgcaacctccgcctcccaggctcaagcgattctcctgcctcagcctcccaagtagctgagattacaggtgcgcaccactaccacctggctaatttttgtacttttagtagagatggggtttctccatgtgggccaggctggtatcgaactcctgacttcaaatgatccacccgcctcggcctcccaaagtgctgggattataggcatgagccaccgcgcctggtcatgatcatttttattttggaaccattcattcagaaaaatttcacagccattttgaacttgtgctatgacatggcaaaatctctagtaaatcattttaattcctgatgagttcatttttataatgataaatttctaaggaaaatattttgttttcaacttcttgccaccatgtcaagactgtacattttaaaacatattacatcacattttcccttcaaagcaatgccagtgaattctgttaatggtatcattcatctcatgttacccaactccagatcataaagtttccctcattctccttcctttccacaaacctaccaaatcctctatcgccaagtcctttgggttaattcacggagaaagtatcgagcacagaggcagaacagggcctctggagagtgtcacatttgtgtgtgaatcctgactcttgattttcactagctttgtaaccttagacaaattactaccaggcacggtggctcacacctgtaatcccagcactttgggaggctgaggcaggatcactggagtccaggagtttgagaccagcctaggcaacatagcaagatcctgtctctacaaaaaataaaaaattagctgggtgtggtggcacacacttgtattcccagctacttgtaggggctgaggtgggaggatcacttgagcctgagaggtcaaggctgcagtgagccatgatcgggccactgcactcagcctgggtgacagagcgagaccctgtctcaaaacaaaccaaaaaacaaattagttaacctgtctggagctcagtcccatatttgtaaaatgtggctaactacagcaccttcccttatagaaagctgtttgaggatccagttatgcatttaaagggcttaacacattacctggcacaggaaaacaaagacaagctgctgtcctgttttctttgttgctgccatccttctcacaaggtctcgacggagtctgtcttcatcacgatttcactgccctcatgcctgttctgtttaccccttttctagactgggcccttacttaccttagcctgagctattgtgaaacactcccagcggcttcctgacttgccccactccctccttccgccgtcctgtcctgctcctaatcgtgtttgtcagaaatgcctctgactgatacactggcaaaatcagaaatcttcaagggatccccctttttcttgctgtagcttaagatctaaatctcttaacctagatcacgatctgacactagatatatttatagtccatgaaaataccctgaaagctttcaagtaccagatgaaagtgagctccttcattaccacctcaactcactgtaggcggcttttcatgtgcaacagctaagctttaagagggctgggactgtgacctactttattttgtattgttatagcagctcacttggtacccagagcaaggaggtatatttgtttcttgcatatttggcaggttgattactatataaattactctattgaagattaaaatggtttactgaagatgtcgccatatatcttagcaaggtcaaaacagttgtgtaatttttctgaatgaatactttcaaaataaaaaagaccactcagaccagaagcctgaacatctgtgagcaatgcttatacatgtgctttttaataaaccaacatgttgggccgggcacggtggctcacgcctgtaatcccaacactttggaaggttgaggcaggtggatcacaaggtcaggagtttgagaccagcctgaccaacatggtgaaaccccgtctctactaaaaatacaaaaattagctgggcatggtggcgtctgcctgtaatcccatcgactcaggaggctgaggcaggagaattgcttgaacccgggaggcagaggttgcagtgagccgagatcacaccgtggcactccggcctgggcgacagagcgagactctgtctccaaaaaactaaactaaactaaactaaaataaaccaacatattaaactttaataggattattgatctgaaaaccaaaacatggtaggaattagtttataagtcatatttagacgcatcatcttataaccctctcagcaaaacctgtggggcaggtagattatggataacaagtgttcacttcatgaattgtccctgttgatcaggtgaagtagaacttggatctggggcagctcttgtgactccagattcttggtttttgagcaggtgttgggggaaatacctttcttgttgaagttctttagtactcttttttttttttttttgagatggagtcttgctctgttgcccaggctggagtgcagtggcgcgatctcagctcattgcaacctctgcctcatgggttcaagctgctctcctgcctcagcctcccgaacagctgggattacaggcacacaccaccacgccaggctagtttttgtatttttagtagagacggagtttcgccgtgttggccaggctggtcttgaactcctgacctcaggtgatctgcccaccttggcctcccaaaatgctgggattacaggcataagccactgcacccggcccatcttttaataagagctcagcatattcatacttgattgatcagcattttcgtcattagaaatgaggtggggtttttttgtttttgtttttttgtgttttcatttcaaagattaaaaacctagagaggaaggagagtatttggggaaaatggtggaagagggagcaccagtcatctgtctccacacctagacatcaattgtactggcaggatctgtctgatctaactattttggaactcggaagtctactgaggtttacacattcttgctgggatggcaaactgtggttaattttggtcagtttcaactcttagcacagtagcagctatgcactccccaaccccagttctgtggaaggcggctacgcgggtgttcctagagcttgcacacagcgtgggagccagaataggcaaaaagcatcttgtcctctaaatatttggggtctgtgctctgactgctgattgctgcttctgatcgtagaggtgcagacaaagagatgggtggccattgtcgttacacctcctcattattgcaagttcttccccctccaattaacaagacttccaggggatttaaagagctaatggtcctgctcccttgcttcacttttattttttcccatttgggagccagatgttagagaatatgacattgaaaagcaactgcatataagggggagaattaagaagtgactgtgcatgcctaggaaaaggtataggcacagtaaagacctgagaagaccctgagtttatacccaagactgatctttggcacagacggcctacagtaaacaaaaagaatcacacacacatccacacacagaataacaaaacccagtaaacttgaaaaggggaggatctgattttctgaattaccacagtattagattcaaatgttcagttttcaacaaaacaaatcacgaggcacacaaagaaacaggaaagtatgctcttccaaggaaaaaaaaaacaactgaaactgtgagaccacatagtagacctactagaaaaagattttaaaacaactgtcttaaagatatgcaaacaactaaagaagatgtggcgctgggggcggtagctcatgcctgtaaacccagcacttggggaggccaaggcaggtggatcacttgaggtcaggagtttgagaccagcctggccaacatggggataccctgtctctactaaaaatacaaaaactagctgggtgtggtggtgtgcactggtaatctcagctacttgggaggctgaggcaagagaatcgcttgaacctgggaggcagaggttgcagtgagccgagattgtgccattgcactccagcctgggtaacagagtgagactccttctctaaataaataaataaataagatgtggaaaaaggtaaaacagcgtatgaaggctgggtgtggtggcttacgcctgtaatcccagcattttgagaggcagatcagttgagtccaggagttcaagaccagcctggccaacatgttgaaacccgggtcatcgctagtaaataagacaaaaattagctgggcgtggtggcacaagcatgtagtctcagctactcaggaggctgaggcaggagaatcacttgtacccgggagatggaggttgcactgagccaagatcgtgccactgcactccagcctgggcaacagagacagattctgtctcaaaaaaaaaaaaaaaaaaagaaaaaagaaagaaaagaaaaaggaaaacagtgtacaaataaaatgtaaatataaataaagagatagaaaccctaaaaagaaactgaaaataattctggaactgaaaaatacaataactgaaatgagaaattcactggagggattcaaaggcagatttgagtaggcagatgaaagaatcagtgaatttgaagataagatattaaaattatcaagtctgacaaacagaaaaatgtttgaagaaacatgagcagagcctaagggtcatcatcaaagagactaacatgttttctgggagttatagaaagaaatgaaagggggagagagattatttgaagaaatagtatctggaagcttcccagatttgacgagagacatggatataaacatctaggaagttaaacgacctccaagtaagatgaactcaaggacacccacaccaagacacattacaatcaaactcccaaaagcgaaaaccaaagaacctttgggctggattcagtggctcacacctgtaatcccagcactttgggaggacaaggcaggaggatcacttgagttcaagctcagcctgggcaatatagtaagacctcatctctactaaaaatcaaaaaaattagccgggcgaggtggcatttgcctgtagtctcaggtcctcgggaggctaaggtgggaaaattgcttgagcctggaaggtcgaggctgcagtgagctatgattgaggcactgcactccagcctggcctaccgaatgagaccctgtctcaaaaaaggattcaacctgaggaagctgactaaaaaaacaaacttcagagaggagagaaatgcctcctcatatacaagggacccccaataagattataagcagatttctcatcaaaaactttggaggggtcaggtgcagtggctcacatccataatcccagcactttgggaggctgaggcaggtggatctcttgaggccaggagtttgagaccagcctggccaacatggcgaaactctgtctctaaaaatacaaaaattagccagggatggtggcgtatgtgcctgtaatcccagccatctgggtgcctgaggcacaagaatcgcttgaatctgggaggcagaggttgcagtgagctgagatcaggacactgcactccagcctggatgacagagtgagaatctgtctcaaaaaacaaaacaaaacaaaaaaacaaagtttggaggcaagaatacagtgggctgatatattcagagtgttaaaaagaaagaagacctgtcaactaaccatctaatacccagcaaaactgtccttcagaaatgaaaaagaaattaagatattcccaggtgaacaaaaatggagggagttcattagccacaagacctgccccgcaagaaatactcaagtgagtcctgcagagggaaattaaaggatattaaacagttactcaaagccatataaagaaatgaagatcttggccgggcacggtggctcatgcctgtaatcccatcactttgggaggccgaggtgggtggatcatgaggtcaagagatggagaccatcttggccaacatggtgaaaccccatctctactaaaaatacaagaattacctaagtgtggtggcttgtgcctgtagtccccagctactcaaggaggctgaggcaggagaatcgcttgaacccaggaggtggaggttgtagcgaactgagatctggccactgcgctccagcctggtgacagagcaagactccgtctcaaaaaaagaaatgaagaaaaaaaaaaaagaaaaagaaatgaagatctcaaaagtgaaggatatgtgcaattttaaaagctaatattactgtaacaatggtttataattgcatttttgtgttctacatgatttaagagactaaaatgcttttttaaaattagtctaaaagctagtagtattgtaatgttggtttgtgaatccacattttcttttcttttcttttttttttttttttagatggtgtcttgctctgtcacccaggctggagtacagtggtgtgatatgggctcactgcaacatctgcctcccgggttcaagtgattcttgtgcctcagcctcccaagtagctgggattacaggtgtgtgccaccacacccagctaatttttgtatttttagtagagacggggtttctccatgttggccgggctggtgttaaactccgacctcagttgatctgcccgccttggcctcccaaagtgctgggattataggcgtgagccaccgtgcccagcccacattttgttttctacataatttaaaataatttttttggtaaaataatttctaaagcatttaaaataattatttactttatggtttggggcacacagtttataaaggtataattttgtgatatcagtaagcaaaaaggttgaggacccagctgtaatggagtggagcttttctgtgttactgaaattaagctgatagaaatttaaattagtgttataactttaggatgttaaatgtaatcctcatggtaatgacagagaaaatcactgtagaatatacacaaaaggacatgagaaaggaatttaaatattttaatgtacccccaaaaatcaactaaacacaggagtagacagtaatgcaggaaactagggacaaaaaccttaaggcatatacaaaacaaaatgacaagccaggcgcggtggctcacgcctataaccccagcactttgggaggccgaggcgggtggatcacgaggtcaggagttcaagactagcctggccaagatggtgtaaccccgtctctactaaaaaaacagaaaaattagccaggcatggtggcggggacctgtaatcccagccacccgggaggctgaagcagagaattggttgaacccaggagacagaggttgcagtgagccaaggtcacaccattgcactccagcctgggcaacagagtgagactcgtcgcaaaaaaaaaggaacaaaatgatagaaataagtccctgtttattggttaattaccttaaatgtaaatggattaaactctccaatcaaaagacaaagattgtcaaaatggtttttaaaaccaatctgggctggacgcagtggctcacacctgtaatcccagcactttgggaggccaaggtgggtggatcacctgaggtcaggagttcgagaccagcctgggtaacatggtgaaacccaaactctactaaaaatacaaacattagctgggtgtagtggtgcatgcctgtaatcccagctacccaggaggctgaggcaggagaaatgcttgaacctgggtgacagaggttgtagtgagctgagattgcaccattgcactccagcctgggcaacaagagcaaaactccatctcaaaaaaaaaaaaaaaaacaaaaaacaatcctactatatgctatatataagagactcacggccaggtgcagtggctcaagcctgtaatcccagcagtttgggaggccgaggccagcagatgacaaggtcaggagatcgagaccatcctggttaatatgatggaaccctgtctctactgaaaagtggaaccctgtctctattaaaaaatacaaaaaaattagccatgcttggtggtgggtgcctgtagtcccagctactcaggaggctgaggcaggagaatggcgtgaacccgggaggcagagcttgcagtgagccgagatcgcaccactgtactccagcctgtgcaaaagagcgagactccgtctcaaaaaaaaaaaaaaaaaaaaaaagagagactcactttaaatccaaatgttgctggtgaaaggatagaaaaagatattccatgcaaatagtaatgaaaagggatcggggtggctattctactatcagacaaaaagagttacagaattgcaggaagaaatagacagttctacaataaaagttggaagctttaatatcccactatcaataatggatagaaaaataaagaaactttacatgataaaccaactagatttaacagacatttatagaacactctacccaataacaatagcatacattttctcaaatgtagatgggatgttttccaggatagactatatgttaagccacaaattagtgtcaatagattttaaaagatatacaaagtatgttcttattgcaaccacaacaggataaagttagaaatcagtaacagaaggaaaattggagaatccacaaatttgtgcaattaaccatatactcttagtcaaccaaagggtaaataaagaaattacaagagaaatttaaaaatacttaaagatgattgacaatgaaaacacacataccaaaatttatgggacagtgaaaacagtgctaaaggagaaatttatagctttaaatatatacattaaaaaataagaaaaatctcaaatcaacaacctaaactttaccatttaaggaactagaaaaggaagaaaaactaaactcaaaactagcagaaggaaggaaataataagattagaacagaggtaaaggaaatagagactagaaaacaatagagaaaatcagtgaaaccaaaagttgaatttttgtaaaggtaaacagaattgacaaacctttagccagatggatcaagaagaaatgagagaagacacaaatgattaaaaccagaaacaaagtagacccttactattgattcaacagaaacaaaaaggattatgacaggatggtgatctgttgaataccaacagattggataacctagatgaaatggacaaacccctagaaacacaaaacctactgagactaaaccgtgaaaaaatagaatacctgagtagatctataattagtaagaggatagaatcaataatcaaatatctccttgtaaagaaaagccctagacacgaagccttcaccagtgaatttaaccaagcatttaaagaagaactaacactatttcttctcaaatttttccaaacagttgaagaggagggaatacttctgaattcactctatgaggccagaattatgctgatatcaaaactagaaaagataaccacaagaaaaatacacatcagtatccctcatgaacattgatgcaaaaatcttcaagaaaatactagcaagtaaattcagcagcatattaaaaggattatacaccatgaccaaagtgggatatatttctggaatgcaaggatggttcaacatatgaaagtcagttacctaatatgctgttttaacaaaatgagggacaaaatcacatggtcactccactggtccataaaaagcacttgacaaaattcaacacccttttatggtaaaaacactcaacaaactgggaatagaaactaccccaacataataaaagccatatatgaaaaacagtgaacaattatacttaatggtaaaaaacggaaagcttttcctctaagatcagaaacaaggcaaaatgcctgcttttgtcacttcagttcaacacagtgctggaaattttagccagagtcattagccaagaaaaagaaattaagaggcatcaaaattgggaaggaagaagtaaaagtatctctgtttgcagatgacatgatcttgtatgtagaaaccctaaagattccacaaaaaattgtttgaactaatacatgaaactgacatagtagcagcatacaaagtcaatgcacaaaaatcagttgcatttctaaacaccaacaatgaataatatgaaaaagaaattaagaggaaaattccacttaaaatggcattaaaaagaataaggaggtgaaagactcatacaatgaaacatgaaacattgctgaaagaaattaaagacataggtaaatagaaacacattgtatgttgagaaattggaagacttaacattgtgtgtttggtttttggagacagggtcttgctctgtcacctaggctggagtgcagtggcacaatcacagctcactgcagcctcaatctcctaggctcaagtgatcctcccacctcagactcccaagtagctaggactacaggcatgcacaactatgcccggctttttttttttttttaattttttgtagagatggggtctcactatgttgctcaggctggtcttgaactcctgggctcaagtgatcctcctgccttggcctcccaaaattgtgggattacaggcatgaatcaccccgactagcctgacttaatattgttaagctgtccataccacccaaagtaatttataagttaattcaatacaatttctatcaaactcccaaggccattttttggcttgggagttttagaatataaaaatttattctaaaattcatatgggatctcaggagaacctgaaaagccccaacaaacctgaaaaagaacaaagctggagatctcaaacttcctgaacttaaaacttaactgcaaaaatgcagtcattgaaacagtgtattggacttggctgtggtatgaagaaataagaaaaagaagagaacagcatgatacataaaaatagacatagagaccgatgaaatcaatagcccagaaataaaccctcttatatagtcaagtgaaatttttttttttttttgagacagactgtcactctgttgcccaggctgcagtgcaatggcgtgatctcggctcactgcaacctccacctcctaggttcaaatgatgctcctgcctcagcctcccgagtagctgggactacaggcgtgtggcaccacacctggctaatttgtgtatttttagtagagacaggatttcgtgttagccaggctggtctggaactcttgacctcaagtgattcgcctgcatcagcctcccaaagtgctgggattacaggtgtgagccaccgtacctggcccagtcaagtgatttttgataaggacgtgaagattgttccacagggaaaggacagtcttttcaacaaatggtataggggaaactggatattcacatgcaaaagaatgaagttggacccttacctaatactacattcaaaaattaactcaaaatggccggggcctggtggctcacacctgtaatcccagcacttgggaggcccaggcaggcggatcacttgaggccaggagtttgagactagcggggccaacatggggaaactctgtctctactaaaaatataaaaaattagccaggtgtggtgatgcatgcctgtagtcccagctactctggaggctgaggcatgagaatcacttgaacccgggaggtggaggttgcagtgagccaaggttgcaccattgcactccagcctgggcaacagagcgaggctccatctcaaaaagaaacaaacagacaaaaaactcaacaatgaaaaaacccaattcaaaaatgggcaaaggacttgaatagatgtttccccagagaaggtaaacaaatgaccaataagcatatgaaaaatgaccatcactaattattagggcatgcatgtcaaaactataccccacacccattaggatggctactgtcaaaaaaaagaaaaaaaggaaataacaagggttggtaaggatgtgagaaatgggaaccctggtgcattgttcacaggaatgagatgatgcagccaatactagaaaacagtatggtggttgctcaaaaaaattaaaaatagaattaccatatgataccaaaattcagtcctgagtacagtatgtacccaagataattgaaagcagtatctcaaagagatgtttgtacactcatattcataggagccttattcacagtagttaaaatggggaagcaatccatgtgcgtctatcaacggatgaatggataaacaaaatgtagtatgtacatacaagagaatatgagtaagccttaaaaaggaaggagttctgatatgtgctataacacggatgaaccttgaagatactgtgttaaggagataagccagttagaaaaaaggcaaatactgtatggttccatttgtatgaggtatttagagtattcaaaatcacggtaaaaggaatctgaggagattaaaaaaaaaagagtagtcaaaatcataaagacggaaagtagaatggtagttgccaggggctggggggagggatgaatggggaattattgtttaatagagtttcagttttacaagattaaatattcgtggagatggataatggtgatgattgaagagcattatgaatgtattgaataccactgaaatgtatactttaaaaagggatactggtaattttacgttatgtgtattttaacattaaaaaattgggggatgagggctgggcatggtggcccacacctgtaatcccagcactttgggaggccaaggcgggcagatcacgaggtcaggagatcgagaccatcctgcctaacacggtgaaaccccgtctctactaaaaatacaaaaaaagcggggcgtggtggcgggcgcctgtggtcccagctactcagtaggctgaggcaggagaatcgcttgaacccaggaggtggaggttgcagtgagccaaggtggcgccactgcactccagcctggtgatagagtgagattccatctcaaaaaaaaattaaaattggggcatgagggcagggtgcagtggctcacatctgtaatcccagcactttgagaggcccaggcaggaagatcccttgtgcccaggagattgagaccagcctgggcaatatagtgagaccttgtctctacaaaaaaaaattaaaattacctgggtgtggggcacacgtctgtagtcccagctacttgggaggctgaggtgcgaggatcgcttgagcctgggaggttgaggctgcagtgaactgtgattgcaccactgccctcctacctaggtatatttgttttttggtttttttgttgttgttgtttcttgttttttgagacagagtcttgctctgtcgcccaggctggatgcaatggcacgatctcggctcactgcaacctccgcctcctgggttcaagtgattcttcctgcctcagcctcccaaatagctgggattacaggcatctgccaccacgcccagctaatttttgtgtttttagtagagacggggtttcgccatgttggccaggctggtctcgaactcctgacctcaggtgatctgcttgccttggcctcccaaagtgctgggattacaggcgtgatccaccacgcccagccctgtttttgtttttgttttttcaacagatgtaatttctgacttgtataccttttcaatcaagaatatgtatggactgcagcctgatgaagtttttcactcctttagtaatgtcctccttgttttacattttcaaagcctgcatagttacagattcatttgttttcaacgtttccccaggggaagacggaatctatcactgtggtgaagctgctgagctgctttgatgacctggtggcagcaggcacagcctctggcagggttgcagtttttcaacttgtatcttcattgccagggagaaataaacaggtgagtactcatgatcttaacacgtgttaacttcttggcacattcctcatggatttttaaaattagaaatcctcatctgcttagaaagtttatgctcagagaaagccgggcacgactttctctgcccaggctcatgcctgtaatcccagtactttggaaggccaaggcgggctgatcacgaggtcaagagatcaagaccatcctggccaacatggtgaaaccccatctctactaaaaatacaaaatttggccgggtgcagtggctcatgcctgtaatcccagcactttgggaggccgaggcaggcagatcacgaggtcaggagatcaagaccatcctgactaacacagtgaaactccatctctactaaaaaatacaaaaaattagccgggtgtggtggcgggtgcctgtagtcccagctactagggaggctgaggcaggagaatggcgtgaacccggaagacggagcttgcagtgagcggagatcacgccactgcactccagcctgggcgacagagggagactccatctaaaaaaagaaaaaaaatacaaaaattagctgggcgtggtggtgcgtgcctgtagtcccagctactcgggaggctgaggcaggagaatcacttgaacccgggaggcagaggtcacagtgagctgagattgtaccacgctactgcactccagcctgacggagcgagactctgtctcaaaaaaaaaaaaaatgctcagagaagcttaacactgtgctgtttataattggagaacatttttgtgctgggttggacacttggcataaagtacatgtgggtcatttcatttttgcttaatattctcaaggtatgctctctgtgggttttgaaggtgactagacagatggaactttgtgcagggttctgcttggaaaacgagattgggaaaaccagctcttccctaactaggagtgattgtataccttttccatgtagccccagctcacagcatttatcctttttttttcttgtgtatatttttatcccttgttcatagcttcggagatttgatgtcactggtattcacaaaaatagcattacagctctggcttggagccccaatggaatgaaattgttctctggagatgacaaaggcaaaattgtttattcttctctggatctagaccaggtaaaattattttcagaaatactgttggctcttaccttcttacatttggaaaaactatatttataacttgtatttttagtcaacttgtattcttgatcatcatccctttataatctcaattgttatttgtaacatttacttttatagacttatgttttataagcttccacttctatgactaaggagttggcctactggaacattcacttttttcattccactgttgtgtattacttttacttgaaaaagaagctattatcattcctacttccttgaaaggttagtaggagtgatgccaagcacttctgaatcctaactgtggacaagtcagtgatttcaatggatggaggactctgccagccacctggcctgtgtgagatgacctcatgtgacaggaagtggcagaggaggttaggtggcagtatggtgaagatgaagaaactggagtgccaagagatccaggaactagtccaggggtgcaggcttgcacctcacagagcttgctttcaaactgtgcttctgcttcgacgcccgtgccttttccactgcacgtatggcttgatgatctgctgggttttatttgttttgtcatgtgtctgcaaccaaactgaactccttggtggcacagtcctttctttttcttatttgtagccttcattcctagagcactataggaattcagcaattttttttttttttgagacagtctcgctcttgtcgcccaggctggagtgcagtggcccaatctcggcttgtgacaacctccatatcccgggttcaagcgattctgccacctcagcctcgcaagtagctgggattacagggacctgccatcatgcccgactaatttttgtatttttgtagagacggagttttaccatgttggtcaggctggtcttgaactcctgaccttagatgatctgcctgcctcggccttccaaagtgctgggattacaggcgtgagccaccacgcccagccaagaattcagcaattattagctgcatgactttcagtccctctgatccaagactgacctagtacaaatattctctagtagtagttctcaagctttgtagtcacaggatccctttacactcttagaaagaggaccccaaagcatttttgttcatatgggttatctctaccaagtacaccatgttagaagttacaactgagaaatttaaaaatatacatatttttttgagatggagtctcgctctgttgcccaggctggagtgcagtggcgcgatctcggctcactgcaacctccgcctcccgggttcaagggattctcatgcctcagcctcccgagtagctgggactacaggcacctgccaccacgtctgactacttttttgtattttttgtagagatagtgtttcaccgttttagccaggatggtttcaatctcctgaccctgtgattgaaatctcccacctcagcctcccaaagtgctgggattacaggcgtgagccactgcgcctggctgaaatttaaaaatattttactttgaaataataaatccataacatctgcacataagtgacatattttgtgaaaatatctctatagctctattttcaaaacaggtgagaagagtgagtggcattgatttatatttttacaaatttctttattatctggcttaatagaagatggctggattctccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaataaaaaataaaaaataaaaaaataaaaacacacctcaccaagctcagccaccaacttaaaaaggactggacaatacttttaccactttcccttctcagaattcaggcctgtcctcggaatgctacagggtacagcccatttgagctcctgtatggatactcctttttgttaggccccagtctcattccggacactagaccaacttagactgtgccccccctcaaaaaaaaaaaacttgtcatccctactatcttctgtctagtcatattcctattcaccattctcaactaactcatacatgccctgctctggtttacactgccggtttacactgtttttccaagccatcgcagctgatatctcctggtgctatccccaaactgccactcttaactcttgaagtaaataaataatctttgctggcaggactgtgctgaatctccttaggcactctctaatcagatatcctgagtcgtcccaattcttagaccttttatacctgtttttctccttctgttattccatttagtttctcaattcatccaaaaccatatccaggccatcatcaatcattctatatgacaaatgtttcttctaacatccccacgatatcaccccttaccacaagacctcccttcagcttaatctctcccactctatgttcccacgccgcccctaatcctgcttgaagcagccctgagaaacatcgcccattctctctccataccaccccccaaaaatttttgccgccccaacatttcaacaccattttgttttatttttcttattaatataagaaggcaggaatgtcaggcctctgagcccaagccaagccatcacatcccctgtgacttccacgtacgtatacgcccagatggcctgaagtaactgaagaatcacaaaagaagtgaatatgccctgccccgccttaactgatgacattccaccacaaaagaagtgtaaatggcctgtccttgctttaagtgatgacattaccttgtgaaagtccttttcctggctcatcctggctcaaaaagcacccccactgagcaccttgcgacccctgcccctgtccaccagagaacaaccccctttgactgtaattttccattaccttcccaaatcctataaaacggccccacccctatctccctctgctgactctcttttcggactcagcctgcctgcacccaggtgaaataaacagccatgttgctcaaaaaaaaaaaaaaaaaaaaaaaaaaaaaaaagaagatggctggattctgcattcaatctgttgccatacattgttttgattgaagtgtataaagaaaaactggctttacacagacatgtagttggaaatgggaggagtattttgatagccttttcagatagttgtggacattctttaataatatcctcatatgactacctcataaagcaaatggtagttgctttaaaggttacggtgacaaatgacaaatggtagtttctttaaaggttagtaaaaatgtggaatctgaaaccacatggatgaatttttcctactctgttacattaaaatctactttacccatgttggattttgtaacattatgtattggtcacttagaaaatactattcacagagtgatgcagatcttccaaatgttgacactttttttttttttttttttttttttgagacatggtcttactcctctcacccaggctggtgcacagtggtgcaatcacggctcactgcagctttgacttcccaggttcaggtgattcccccaccttggcctcccgagtagctgggactatgggtgcacaccaccatgcccagctgatttttttgtatttttatagagacagggcttcgccatgttgcacaggctggtcttgaacatctgggctcaagcaatctgctcaccacagtcttccaaagttcttggattacaggtttgagccaccgtgccagctgataaattttctaatacaatatcaaaaaaataccttcattaacatcaacatcattgtaatcgggaaagtctagctataaggaatcatgtcaagttcacagggacagatacaagttttcagattgctaatctttgtgtgagagcaacaaataccattacttgttttccttgaagtgacaggcttttttttttttttgagaaaatgtctgctaaatacccaaatttgaataattacagcatttcaaataaaaatggtgttttgtgaaaaaagcagctggctcagctcatagctgcaacagttgcacaagtggtttccttgagagaaccactgagtgtatttcagtgtgcagcagaagggagaatacaaaagtacctatcctctggccaggtgtggtggctcacacccgtaatcccagcactttgggaggccaaggcaggatgatcacttgagcccaggaatttgagaccagtctgggcaacatggcaaaaccccatttctaccaaaaaacataaaaattagccaggtatggtgatgcacacctgtaatcccagctactctggaggctgaggttggaggatcagttgagccttggaggtggagattgcagtgagctgagattgcaccactacactccagcctaggccaagagccagaacctgtctcaaaaaaaaggtttgcaacattttcatgtaatggaaatttctttatcttgattttggtgttggttacatgactataaatttgtcaaaattcatagaattgtatacccaaaaagggacgaaatttactgtaagttttaccaacaaatctgatcactgccccctacttccctcacaaaatgtcagtgatgttacagcagtatttctgaaataattgatgaaacttttcatatatatattggatttcatatatatgaaatatacatatatttcatatatatataatgtatatatatatatattttttgagacagagtctcactgtgttgcccaggctggagtgcagtggtgcgatcttggctcactgcaacccttgcctctgggttcaagtgattctcctgccgcagcctcccaagtagctgggattacaggcatgtgccacctcgcccagctaaattttgtatttttagtagagacgaggtttcaccatgttggccaggctggtctcgatctcctgacctcaaacgatccacccacctcggcctaccaaaatatagggattacaagtgtgagccactgcacccggcctgatgacacttttctgtaaaagtaacttacagaatcagattttttatacaatgaaatatgctttgtgttagcagtcgtatgccttctagaattttattttgtgtttatatataaaatatggtttttttttcttttttaaagacagagtctcactctgctacctgggctagagtgcagtggtgtgatcacaactcactgtaacctgaactcctgggctcaaatgatccttctgtctcagcctcccaagtagcggggaccataggcacgtgccaacatgcctggctaataaaaaaaatttttttgtagagacatgatctcacaatgttgcccaggctggtcttgtaaagtatcattttatgttaatagcattttatatatttaatatcatttaatttcttctaaccttctgttttctattaccctttcagttggcaaggatataatgtcctcaaagctgctttgaaccctttgtgaggggagactataatatgaacttacagagctgattattgtcgcaataattttatagaatgttccattccattgttttataatagaataagcaatacacacagtgcaacagatttctgtttagatctttatggattcttctttgaactctctgcatgtttactgcatcatccctgagcctgctatggtgcacagtaaagaatgtatctactgaggacatgtttttaaaaattatgcagattttaaaatgtttcctgtcaaactggatgcagcatgagggagatgttagtatggactcttttcccatccgtcaaataatctcgctatggtgggttgagagtgaatctgcagagagtgaaagcatgcgttaagtaaggtgcaagctgacctaagcacagctagcgggaaggacactgacttgtcctaagggaggtccattctttagcctggcgctgatgtgaggtgtaaccagactttctctgccaggggctctgtaactcccagctggtgttggaggagccatcttccattgtgcagctggattatagccagaaagtgctgctggtctctactctgcaaagaagtctgctcttttacactgaagaaaagtctgtaaggcaaattggaacacaaccaaggaaaaggtaagtttcacaagtttgccagtttggcctaaatgctgggccttgttgtagaaggtgctttagggtttcttaggtctcctgtttgccggagacctcctgtttgcaaacccacagcgcctctaagcctggggttcctggtggggccctgtgcctgcttaggatttctcctcccagaggcagacaagaagagtgtgttcttcttgtcgcagagctgtaggagcctgcacacacagccactctgcctctcagggtgccacagtcagcgcagagaagcctcaggggtggcctggtctatctgttccttgtggagccacctcctccacacagccctggtgaggggtcagggttgtggggctcactcgttattcagcacgtgtttaccatgcacccctgtgcactgtggcaggctcagcagtgacatggtaaacacggcagatctgagccctccgttgtggaaatggaaacacagatagaacacttgttgaccactgtgtcagctgctgtggaccaaaatacacaggatgctgtgtgagtttagacacacttttgtccaggtgaagggtcagggaagacatcctgaaggcatgggttccaggttgagagatcattcctcctttgaccagtgatgtggaggaagggcatcgagaagtccaccagccataccagccgtgtgggaaaagacaactggaacacctggggaacctgtaattcatcatcccaccctagcctgtaaagcactcttgtaggactctgcagcgagtttgcgtggggatggggtgaggaggggtaggtagagcagtggagctgacccctcctatgccaaggaggaggtagactggggccaacgtgggggtgggaagcagagggcggcattagtacagatcatgcgttgatgagtctacagtcatggattgtcgattggccgatgggagctggaagagttcccgtcttgtgtctcccaggaaagggcactgtttgcctgcatagaatcaggggcagggcagctgatggtcacggcatgtggggagggcttgaggctggccctgtggagagtgacagcagggactgggaaacatggtgagattggcaggcgttgatgaggccctgcggctggtggtgccgttggggacaggccgtcctggagagtcgggtgaggcggagccagcccctgtggtcgtagtcactgcccgttattctgtgttctgggctttgcggcaacacacaagtttattctcttttctgcatggcagccctccggctgttaaaagacgctctcaaacctcccctttcttctattttcgatgctgaacaccttcttttttctttttctttttcttttttgtttgagacagagttttgctcttcttgcccaggctggagtgcagtggtgcgatcttggctcactgcaacatctgcctcctgggttcaagcgattctcctgcctcagcctcctgagtagctgagattacaggcatgtgccaccacacccggctaattttgtatttttagtagagacagggtttcaccatgttggtcaggctggtctcaaactcccgacctcaggtgatccgcctgccttggcctcccaaagtgctgggattacaggtgtgagccaccacatgcggcctgctgaacaccttcttaatcccatcaacaatctggcctttttatatctgcagtctccctttcggtccctggagaactcagtggaatttatggccctgcagatcttagttctgctgctctctctgccagtatcctactcctctggcattttatcctggttcgtctgtcaatgttttactgcactgtcttggaaggaaggcagagtgtaaagagaggcattgaaaaccaattactttacatgtgggtcctattcccaacaatctctcttaaaacctggcccttggccggacacagtggctcacgcctgtaatcccaacactttgggaggccaaggtgggcgggtcacttgaggtcaggagttcaagaacagcctggccaacatggtgaaacctcctctctactaaaaacacaaaagtttgccaggcagggtagcaggcgcctgtaatcccagctactcaggaggctgaggcaggagaatcgcttgaaccggggagacaaaggttgcagtgagctgagactgcaccaccgcactccagcctgggtgacagagcgagacttcatctcaaaaaaatcgaaaacaaaaaaacaaaaaacaaacctggccctttaacctcttgtgtggagacccaggcagtttctgtaaacctctcctagtgcgtctgtgcagtcaagtctttagggaacattgattgaaagcgtgctctgctccccaggaacgttttaggatgcagaaacaaataaatgtgtccccttctcagaaggagagagattttactgagccttggggaaatgagggctaacagaataagaggaaatgtttttaacatctgtgtcttaaagacttgctttctgctgtagactattgtgtgcgtctatccctggaagcagtgcttccctcacaactgtttagtgagcggagctaggcatgtacacgtggaggcgtgacagcaagtacggaggcatccaaggagacaaggcctctgccctcaaacacaatgagagagactgtcggtcagcaggaggagagtagaggctgtcagtgctgtaaaggagcgggctaggtgaagcattagggagtgctaggcatggggcaggaagttgcatttggataggatggtcaggaaaggcctctacaagggcagtgatctttgagctgaagcctgggaagagctgctggaagagcattccaggctcagggaacagcatatgccaagacctcaattgggcaagagcttagatgttcaagaagccagaagtgactagggcactggctatggctggagtccaggggagccgtggggaggctgacacgggagtccaggggagccgtggggaggctgccatgggagtccaggggagctgcgaggaggctggcacgggagtccaggggagcctggcatgggagtccaggggagccgtggggaggctgccacgggagtccaggggagccgtggggaggctggcacgggagtccaggggagccacggggaggctgctgcaggagtccaggggagccgcagggaggcaggggagccgcagggaggctgccttgggagtccagggaaaccattgactgagatggagactggagactggggaaggctgggccagaggtcaggacatcaggacctctgctgtggacataaggggtttgacgggcctgtcaggtggctgcgtgggagtcgcagaagagagttctgtggaccggtctggagcccagggaagaagtcttgaccagaggggaaaatgaggtcaccagatacaggtgacactgacaccctgacattggatgaatccacgcagggaatgtctgttcattcagcgctggagctttgcgccaagcctctgccctgctccagtactcctcatcgggggatatctgtgaacaaggcagaacagatctctaatctcagggagctgtgtgcagagtagtgaacagataaacatgtcagagggtgcagagccagagagggaggagcaggagacacaggtgtctctttaataggatgacagggaaggctcctctgaggaggtagcatgggctgattcctgaaacaaagaggcaactagtgcgagaagaccttagagagaggctctggaggcagagggccctgcgcaccgaggatctgagcagccaggctggctgtgtggagcacggtgtggggagccccctcccgtcggctttgtgggccctgcccatggggctctttcagtccagtgctgtggtcagtcacagagggctgtggccaagccagggaggtcactctggctgctgcttggaatatgctggagggggcaggtgtggcagctcagcagggccagcaaggattctgggtgatccgggtaggagaagacaggatggggcggggttggtggtcggactgcttccaaggcagagctggcagatttgctgccacgttggttctgaggtgtgagagggatgagttggagatgattcctaggtctgtggtctatgcagctgggtgagtggacatgctgtggattgacgcagagaatcctggaggcacggggagaaggaggagatggaacagcctgctgtggccccgccatgtcctctccctgcagtggagagctggcgtgggaggcgggtggcgggtgtacctctcggggagctgtgcgctggcagccactggcatgcagacaggagctcgcctagggagatttgggcaggcttgtgttctgaagaggaaagggcatcaggagagaacaggagttggggggtcagaggagtcggaggccatatggagggacatagcagctgctgcgagaccgggggctgaggcagcttcgacgggcctgagtctgtagcatggaggctgtgcacagccctcctcatcagcagggccaagggattggaagggctgaaagaggagttgacggcgagtatggagagcttttaggaggagtgtttttgtagaagagaacaaagaaagacaaataggtggtgcccaggggggaaccatgtggcctggtgggagttttgggagaggggccgtgtggcagcacattggtgtgtgacgcgggtgcctgtggagggaacacagtgctggtggggacagagtgcaggcggtggcctcagttgggccctctcatgggcagcagtgtagggttgaccagaaaccgggacagagactctcttccagagaaagggcagggcactgagcacagggcaggtgcaggcaggtcaggaggcccagaggtagaagacgaggggtcctcttcccgtcgagtccgtgaacctcttcagaccggatgatgtgtgttacatccagaaaacctcagaggccctagccatctgcaaccgtgggtttgctgtcctgtgtatttatgttgcattgtttcatgtgtcagagccctctgcagacctgttactgtgtcccctgtgagtctagtactcagggaagccctccctggcagtagcactttgccctggggaaggagaaggagacgcagcaatctgtaggtgtggcgcccgcatgtgggtaagagccagcagccggttctggaaccccgcgactagcacatctgtttggatggccagtgggtgttagctgttgagatctctggcagggcttctgtggatccttcttctcactcagcttagactttcaggctcccattttgggtgctgtcagctttcagcgtatcagctctgtggcaccatacattatgcacaaaatcataaaacaccattttatagctagaatttgttagccagaacacactccttacatatcaacgtggtctataaagggaattaaaatttttttaggtaatcaatgaggtttttggaaatcatctctaccgaaattaagaaattatattaatttgtttatgattttagaatcctgcaatacttagaccttaaaagttggagcttcagtgtcaaattcagaaagcaccagcaagtactgcagaatcgcactgcaagtggatggtggctgagtcgggggcttaggacaatttgtacctggctctagctggttcttcacaacttcactgcctttgaccaacccactcatcagacatttccgttctttttattttttagagacagggtcttgctgtgtcaccaaggctggggtgcagtggtgtgatcacagctcactgcagccttgaacagctgggttcaggcgatcctcctccctcagcctcccgagtaactaggactacaggcacgcaccaccatgcctggctaaattttttaatttgtagagatggtgtctctctaggtcacccaggctgttgtcaaactcctgggctcaagcagtcctccctccttggcctccaaaagtgctgggattacaggtgtgagccaccatgcccagctattcagcagttttagaggcagccactcccaggaccttgctcagcagggctcctttcccttcctccagggtaagagtccacctggtgttcaggacctcgccttctcatgcccactcagatgcaccaccttgatctgagctctttgagcagctctttgagcctcagatggcgcttccagatgctgatgtgattgttcacacaggtcagcacagtgttatgagacaggctgaggacctcatcttatttattttttattttacccagagcatcaaacacgatgtcttacagaatgtaggaatcactaaatgtttgttaacatgagtgctttagttacataagatgaaccagtcaaaatggaaatgacaagagatttttcagaggtcctacaaatagaaggaaaacatttaaaaattggatcgccaagagaaattgattgacaggaaaggcagaggaagagattatgggctcccttgctggaattcctctggttcgctctatttagaggacatctccagaacaaacccaccaaaggcagtaatcagatacgatgctgttgatagagttgtccataaaagatccacgatgtcaaaacacccttggttcgtcctaacgatcattgtttcaaagctgaatttgatatataatatcctccttggaccctatccaaagggatttagttactgaggtgccagagggacctagtgagattctggtgtgcgaagaaaccccgcaaataactatctgtttgcctatgtgggtgggccctgggggtggcctctagggttgggtgtgctgctgtgtgcagggagtgtgggaacaggcacagcacaagttggccgaggtctggtggggaagcagtggcacggaggcagctctcaactgtgacctgcctgtagcctcgttcaggacaattgagcacttatggggacttagtgtcacaagcattgcttttgtgctgcatgtaagtaatctcattaattcctcacttcagcctttgagatgggagttactctgcctggtttacagaatgggaaacgggtccagaaaagttcaataattgcacgtaccacatacccactaggtgtcagggctggacatcgagcccagggctagctctaaaaccagtgctgtttctgcttttcacaatctgagaagtatttgggagaaggaatcagccaggcatagggctgaactgaaatgcttacatgtgaactctgttagcatcctgagaaataacgagaactcagattgccagtgggagtgtagattgtataatcacgtttaaaaagcttgaagttgtcttctaaacttgaatatgctctcagcaacccagcgattaccccacagcccaccaactgcatcctgagtgtccgtgacagactctgacacctgtgggctaaggggtatgcacagaaatgctcatagcacaattgctcaaaatagctttaaaaaataataattgaaatatccatcaacaagaaaatgaataaatgaattgtggaatacattaagtcctcgtttaatgtcattgataggttcttggaaactgcgacattagcaaaacaacgtataacaaaaccagtgtttttccctcaccaatgttgttgaaggagatggtgttatctgaggacctgctctatgtcatttcgcttacagttgtagtttctaagaacctgtggacgctgagtaggacgtactgtaccattcagcagtagaaatgaattagtgcgacagcttctttttatcaagaaggataaatctgagaaacatagtgttaagtgagaaaaagcaaaagagtacaattagcatcatacattttaataaaaatgaaagataaacaatactaaattatattgtctttagagatacatagatatgtgattaaaccaacaaaaaagtgaggaaatgataaaggcaaaatgcagtccagtggttccatctggggcacaagggggcaggaagtgttaggagcacaggagaacattggttgggtgactgatgatttctttcctaagtttggggatgggttcccaggtgtacctttccttgctaggcttcataactgcatggatatatgtacatatacacagtggtgcactgcataacaacatttcagtcattgacggactgcatgtatgacagtggtcgcagaagattataatggagctgaaaaaattcctatcagctggtgtcttagcgccacacattacgtgttctgtttttagatagacaaacagtcatcattatgttacaggtgcctacagtgttaagtacagtcatatggagtacaggtttgcagtccaggggcaataggctagactaagcttgtccaacccacggcccaacacaaatttgtaaactttcttaaaatgagattttttggccaggcgcagtggctcatgcctgtaatcccagcactttgggaagccaaggcaggtggatcacttgaggtcaggagttcgagaccagcctggccaacatggtaaaaccccatctctactaaaaatacacagttagctgggcatggcggtgcacacctataatcccagctacatgggaggctgaggcaggagaatcacttgaacccaagagggagaggttccattgcattgagcccagattgcgccattgcactgcatcctggacaacaagagcaaaactctgtctcaaaaaaaaaaaaagaggttttttttgtgactattattattattattattatttttagctcatcagctattgttagtgtattttatgtgtggcccaagacaattcttcttcttccaatgtggcccagggaagccaaaagattggacagccctgggctagactatgtgggtgtgtcataggctgtgccatctaggtttgtgtaagtacgctctatgatgttcacacaacgaagacatcgcctaatgacatatttctcaaacatccctgtcactaagtgacctgtgactctatatatagcatattcttttgtttgtgtcagatatttcataatttcagaaagaaaaaatatcaagcttgggggcaggaagggacattggtgcctctgatgggtttagagaaattctgaaaaggcaacaatatagatgggttgctgtgaagctcattcattcaggatgtggactgagcacagcaatcagacgtcagaagcaacagaatcagagcagggaaaggatgagcagacctggattcttcaccttctgcctcagtttcctctcctccaaaacgggagttgtaatacagtcatgtgtcacctaacaactggaatatattctgagaaatgcattgttaggtgacatctttgttgtatgaacagcattgagtgtactgacaagcgtaggtggtaggtacagcctacttccacctgggctaaatggtacagcatattgctcctgggctacagacttgcaccacatgtgactgtactgaatactttaggcagctgtagcacaacggtaagtaattgtatgtctaaacatagaaaaggtaccataaaaatatggtattataatcttatgggaccactgttgtatttgcggtccatcattgactaaaatggtttgttgttgttgtttttgaagcagagtcttgctctgtcacccaggttggagtacagtagtggcactatctcagctcactgcaaactctgcctcccaggttcaagcgattctcctgcctcagcctcccgagtagctgggactacaggcatgcgccaccatgcctggctaatttttgtatttttagtagaggcatggtttcaccatgttggccaggctagtctcaaactcttgacctcagatgatctgccgtcttggcctcccaaagtgctgagattgcaggcatgatgcatccagcctgaatacaatgttatgtgatgcgtgactgtatctgccactcatggttgttgtaaggattagacacgagagtgggatcaagtgccaggcacagtgcaggctgtgtgagtactcagtgaatggttccctgtgtgctaatggggcacacacctgtgagggtgtggtcgggcctctgttggtacagggatgacagtgtggtttgacaaaaaacaaacagtagaaagggtgaaaaatcaattattgtcttagccaaaaaattcttgttgtacttaatattaagggttgacaactgcattactttaaatcagtccatgtctgttttttgttctttctttctttcttctaattttagtactgggaaatttggtgcttgttttataccaggactctgtaagcaaagtgatctaaccttgtatgcgtcacggcccgggctccggctatggaaggctgatgtccacgggactgttcaagccacgtttatcttaaaagatgcttttgccgggggagtcaagccttttgaactgcacccgcgtctggaatcccccaacagtggaagttgcagcttacctgagaggcacctggggcttgtttcatgtttctttcaagaaggctgggtgctgagttggaatgaatatagtatctatctcctagacacagtcaaccaggtaagtgaagggacgccaccatatcttctgtgtctataggcaagagaatgtatctctataaactgttctactcagggacctcagaatgctaccaggagcagtattgacttacactttactttttcctttgggccagtcaaggaaatcaaatgaaggtttggtaatttttatagatttgaaaaaaaaaatttggttttgacatttaggtccaattttctgccgagaaatgatgtatgttttttgtatgtaaacacaaaattaaacttgttctttttgttgttgttgttgttgttgttgttgttgagaaagagtctcgctctgtcacccaggctggagtgcagtggcatgatctcggcttactgcaacctccacctcccaggttcaagcgattctcctgcctcagcctcctgagtagctgggattacagacgcatgccaccacgcctggctaatttttgtatttttagtagagacagggtttcacaatgttggtcaggctggtcttgaactcctgacctcgtgatctgcccgccttggcctcccaaattgctgggattacaggcgtgagccaccatgcctggtttttttttttgttttttttttttgagatggagtcctagtatgtcacccaggctggagtgcagtgtgcagtggtgcaatctgggctcactgcaacctccacctcccgagttcaagcgattctcctgcctcagcctcccaagtagctgggattacaggtgcgcaccaccacgcctggctaatttttttgtatttttagtagagacagggtttcaccatgttggccaggctggtctcgaactcctgactcaggtgatccgccagcctcggcctcccaaagtgctggggttacaggcgtgaaccgccgcgcccggccgccacttggttttttttttgttttttgttttttattttcagttttctttacttagcaatatatcttgggcaaatttccaacatcattaaaatcatggtaggaaataatttctgcttaaaccaagatgataacagattatcatcagagacagatttagaaactttaaacaaagctgtttagtttcagtttctccttgtcttaagagcagagcttttgctctttttaaaataaactccctgccttaccctcccgactcctcacccccagactctagaccaggccctgtcctgttcacgttcttccattctgagctcagcgggcctctgacaggcacccctttcttttataagcagagcctcactgtagaaaataaacagttttcagccaggcgcagtggcttacgcctgtaatcccagcactttgggcactttggaaggccgaggtaggtggataacctgaggtcaggagttcaaggccagcctggccaacatggtgaaactccgtctctactaaaaatacaaaaattagccaggcatggtggtgggcgcctgtagtcctggctactcgggaggctgaggcaggagaattgcttgaacctgggaggcggaggttgcaatgagccaagatcacaccactgcactccagcctgggtgacagagcaagacttcatttgaaaaaaagaaaagaaagggttttcttctttggtgtgtgtcagcagaacatgaagttcatcttctcctcattgaagttttatgaattattatcagccgtacctggtaacactggtttggcagaaagaaaactggcccggggtggggggcagaactagactcgactcttctagcctggttctgcctttaaccaagagtctcttatcggccggagcctggtttgttttcctgtaaaatggggtgggggtggaagaagcatcgacttaggggaatcaccaaggtgccttgagtttgttcattttataagggatattctgaaaggtatttttgcaccctttcctcagttacagagaacttctttccctggataccttttgaacttatgtgcacttattaattagtagcatcaagatgctttgtaactgtgcattggttctttcatctgagcatttacccgatgctttacccagtaggtataattaacttcattttataggtagagaaatggagacaggggaccgtctgggacagatgtcacagtcaccctcagagactggaccacccagtggcagcatgactggcagctttcggaaacaaatgttatgtttgcagcagtccatcagttatttaaaattagccaaaaacatagactctccttctacaacagactagtctctttatttgcactgtctacagcaaagcaaggacttgctttaagtcagtgtgggctcaggatgtcctgtgttttgttgccacccactttcagataatgctggaggaacctcccctcccttcatgtattcattcaaaacccatgagttgcagtgcgcactggcctctcctgcaggaatgcacacagtagggggactagacgtgtctgcacgttatttcagcccaggagtggggcgtcaagcggaagtttggatgaggtgctgcaagccctgagagccctgggtgttgcagcagagggcaagcttgtcagaggctgcttctcacagaggtggcgtctggagagaactggaacttccccagcaaacatggataggaaaggaatttgagcagaaagagaagcacgtgcattcaccatggaggaacagggctgggactgggctggcagggccggtgcacctgcagcagggacgagggcagggtggtacgtgggtcggagatgaccgaggccccaccatgccaggggacccctcagatcctgcttaccaatctgtgagatgttacctaactttggattgaattggaattttcagaaagttaccatagtaaagtgcagttatcatttgactgatttggactctcacacatgcatttttatgctttgagctgttaccgttgtttagttttgtgttttttgttttttttttttttttttttttgacaggccacagttgctggtttggaaggatccggtgatattgtgtctgtttcgtgcacagaaaatgaaatatttttcttgaaaggagataggaacattataagaatttcaagcaggcctgaaggattaacatcaacaggtttgtatttattataaaatgtaccatgtatatgatgggaagtactatactctgttgtttgtaattgcagttaataattgatcaaacttaccattgggccaggcatggtggctcacgcctgtaatcccagcactttgggaggctgaggtgggtggatcgcttaagctcaggactttaagaccagcctgggcaacatggtaaaaccctgtctctaccaaaaatacaaaaaactagccaggcgtggtggcatgcgcctgtggtctcaagtactcgggaggctgaggtgggaggatcgcttgagcctgggaggcagaggttgctgtaagctaagattgcaccactgcactccagcctggatgacagagtgagacctcatctcaaaaacaaaaccaaaaacttaccattattttgctaaactattgcaactttatttgaacttggaggatttggagggtttcctctgattctttttttttttttttgagatggagtttcgctcttgttgcccaggctagagtgcaatgaggcgatctcagctcaccgcaacctctgcctcccaggttcaagctattctcctgcctcagcctcctgagtagctgggattacaggcatgcgccattatgccaggctaattttgtatttttagtagagacagggtttctccatgttggtcaggcaggtctcaaactcccgacctcaggcgatccgcctgcctccgcctcccaaagtgctgggattaaaggcgtgagccactgtgcccggccgctcctctgattgttaaaatagcatttacagtacatttcttgaaagtcacctactttaaggcttacatcagatagtctcacatttagtggagttgctttcatggttgtggaagatggggagattgagaaaggaggaaggaaaaatcagaaaccactttactgatccctgctctccgtctgagacagtatgtgggattaatgctccaaaagacatagatttgcatagagttttagaatatttaaatctgtcatctgggacataccgtttacccttaactcagttcttccttgtaggatttatttttctctgtgcttttgacattttttggtaattcatacaagcccaaattttaatgagcaaagaatcctaatatgtgtcctcttgcggacatccacatgctttatatatttgggttcctcggggaacttgttcctcatggtggcaacaacagccatgtggaccccatcaccctcctcctcactaccattacctctgatgtcagagagggcaaattggggtgaatattccaaaacataatttgtataagaagtgaataagctctgactcttgagtttatgagctgggggcccctcagacagtgtcatcaaagggttagaatggctttcaggaagggtggtgacttggagccaccaggctaagctctggacctctgctgcccatagagctttctgcagtgatgaagatgctcccatctgccctgtctggtaggcagtccctgtccatgtgtggctgctgagtacttgcaatatagcaagtgcagctgagagatgaattttacattttgtttaatttttattttattttattttattttttgagacagagtcttgctctgtatcccaggctagagtgcagtggtgcagtctctggtcactgcaacctccacctcctgggttcaaacgattctcctgccttagcctcccgaatagctgggattacaggtgtgcaccaccacaccaggctaatattttgtattttagtagaaagggggtttcaccatgcaccatgttacccaggctggtctcgaactcctgagctcaggcagtcctcccaccttagcctcccaaagtgatgggattacaggcatgagccaccgcgcccagcctaaattttgttcaattttgatcaatttgaatttcaatacttacaagtagctggtggctgcctattggacagggagctctaggcaagatctgccattaagttatgtaatcttcagcaagtcgcttcacagcagagtcctcccctccagtctccagtgtacacttcattgcctgcagtctgcccctaacacatgccctcaatagaatgtgggtgcttcaagggcaggaattcctgtgtcttatggactgccatgtcccagcagctagccctgtgtctggcacacggaggatccccgataaagagaggatggcgaatggatcaaagtgggctgtggtcttgtgttgagggtactgtagctggaactgctctggccttgtgccctgtggtgtcgtgttgcagaaaagatgagtccactgcagtgggaagctcactggcccttgggcttggggacaggagacaggtactcacatgcctgttctcactctgcggtctactggccttgatgctgtgtggtaatggacttctctgtcttgagtttgttctaatggaaaattacctttccctcttccaggaaacttaattacaggtacacatgtatttttcaaatgccctttgagtaatcttaaagtatattcaaggcagagtcttagtatgaagtataactaagctgttttgttatacacaggcatctctcatttgtaaataatttgtaaattgaagcgagaaatgctgtattcttagtatttttttacttttttttttttttttttgagacaggtttcactctgtcgtgcaggctggagtgcagtggcatgatctcagctcactgcaacctccacctcccaggctcaaatgattctcccacctcagcctcccaagtagctgggactatgggcgtgcaccaccacaccctgctaaattttgagactccgtctcaaaaataaataaataaataaatataaaaagaaagctatggcaaattattttactgattttaatatatgagcttcttgaagaacaaaaactgtttcttagagtcttttgtatgattcttttagttttggtggattttttttttttttttttttgagacggagtctcactgtgttgcccaggctggagtgcagtggcgcaatctcggctcactgcaagctttgcctcccaggttcacaccattctcctgcctcagcctcccaagtagctgggacccccggcgcccgccaccatgcccggctaattttttgtatttttagtagagacggggtttcactgtgttagccaggatggtcttgatctcctgaccttgtgatccgcccgccttggcctcccaaagtgctgggattacaggcgtgagtcaccgtgcccatcctagttttgctggtttctatgaatttagaatcattcagttctttagctggctggtgcctctgtgacaactggtatttagggctagcaaacgtggataagtgcacatcagctctctcttggatcaccagtggtaaaaccagactcttctttcttagtgagagatggtctggagatgtctggatgctcagagcgtgtccacgtgcagcaagcggagaagctgccaggggccacagtttctgagacgaggctcagaggctcttccatggccagctccgtggccagcgagccaaggagcaggagcagctcgctcaactccaccgacagcggctccgggctcctgccccctgggctccaggccacccctgagctgggcaagggcagccagcccctgtcacagagattcaacgccatcagctcagaggactttgaccaggagcttgtcgtgaagcctatcaaagtgaaaaggaagaagaagaagaagaagacaggtaccctctgtagctggcacacacccatctggggttacagtctttccagattctctgggagtgctgctgctcactgagtgagcaatgctccatacatccaaaagcagagaacacatacatttcttccccaaaggagttttactgcaaaatacttcacattaacggaaaatacacacacacacacacacacacactgtaaggtctaaatgatgacagaacacctgtgtgtactcaccaccctgcttaaagggtctcagttttgtacttttcaatatttatttatgtatttatattatttatttattttttgcgacagagtttcgctcgtcgcccaggctggagtgcaatggcacgatctcggctcactgcaacctcacctcctgagttcaagcaattctcctgcctcagcctcccgagtatgcatgcccagcgaattttgtatttttagtagatacagggtttctccatgttggtcaggctggtcttgaactcccaaactcaggtgatctgcccgcctcggcctcccaaagtgctgggattacagcgtgagccaccgcgcctggcatagtttttagtatttaaattaaaatgtcggggccgggcgcagtggctcatgcctgtaatcccaacactttgggaggccgaggcaggcggatcacgaggtcaagagattgagaccatcctggccaacatggtgaaaccccgtctctactaaaaacacataaattagctgggcttggtggcatgtgcctgtaatctcagtcactcgggaggctgaggcaggagaatcacttgaacctgggaggcagaggatgcagtgagccgaggtcacgccactgcactccagcctcgcaacagagcaagactccgtctcaaaaaaaaaaaaaaaaaaagtgttggtttatccatgtataccattgattaaatcagagattctgtgagcctgggtggaaagttgtggaaaccagaagatctatgctggtaaatacttgggacattttatgtttagtgttgaatatgctaccaaatatgggatttaacattgaatttttttctttttttttttcaacttttattttaaatacagggggtccatgcgcaggtttgttacatgggtatacagcacccaggtagtgagcacagtatgcagtaggtggcttttgacccatgccgcctcctctcccgctctggaggtccacagtgtctgtccttcccatgtttatgtccatgcgtgctcagtgtttggctcccacttacaagtcagaacatgctgttggttttctgttcctgttgcattaatttgcttaggattacggccagcggttccatccatgttgctgtaaaggacaagatttcattctttatttttatttatttatttatttatttatttattttttaatttattggagacagagtttcactgttgtcacccaggctagagtgcaatggtgcgatctcggctcactgcaacttccgcctcccaagttcaagcaattctcctgcctcagcctcccgagtagctgggattacaggtgcccactaccacgcccagctaagtttttgtatttttagtagaggcaggggtttaccatgttggacaggctggtcttgaactcctgacctaaggtggcccacccgcctcggcctcccaaagtgctaggatggcttatgagcgtgaaccaccgtgcacagcccagatttcattctttgttatggctgtgtaacactgaatttttcaaaccttttactccttggttcctgttaatcctctctagctaagatgactgcaacactgaaggaaatgttattagatttctaagcattttaataattataaggaattggtttgtgacccaggtgaacatctcagtttgtcccctggtttttcttagctgccctcaaacccatggatttgttcagtacttgcatgcatagaaagcatctctttgttgggattatttgtacttaagaggtttattcttcattcaccaaatatcctttatttaaaattttttttcttgagccaaaaatatgtgtgcaagttagtctcttactaatcatatagaaccgtgccttattttgaatgttcttattctgaattagaaggtggaagcaggagcacctgtcacagctccctggaatcgacaccctgctccgaatttcctggggacagtccccagtccttgaacacagacttgctgtcgatgacctcaagtgtcctgggcagtagcgtggatcagttaagtgcagagtctccagaccaggaaagcagcttcaatggtgaagtgaacggtgtcccacaggaaaatactgaccccgaaacgtttaatgtcctggaggtgtcaggatcaatgcctgattctctggctgaggaagatgacattagaactgaaatgccacactgtcaccatgcacatgggcgggagctgctcaatggagcgagggaagatgtgggaggcagtgatgtcacgggactcggagatgagccgtgtcctgcagatgatggaccaaatagcacacagttacccttccaagaacaggacagctctcctggggcgcatgatggggaagacatccaacccattggcccccaaagcactttttgtgaagtccccctcctgaactcactcactgtgccttccagcctcagctgggccccaagtgctgaacagtggctgcctgggaccagagctgatgaaggcagccccgtggagcccagccaagagcaggacatcctaaccagcatggaggcctctggccacctcagcacaaatctctggcatgctgtcactgatgatgacacaggtcagaaagaaatacccatttctgaacgtgtcttggggagtgtgggaggacagctgactccggtctctgccttggcagccagcactcacaagccctggcttgagcagcctccacgggatcagacattgacgtccagcgatgaggaggacatctatgcccacgggcttccttcttcatcctcagagacgagtgtgacagagctcggacctagttgctcccagcaggacctgagccggctgggtgcagaggacgccgggctgctcaagccagatcaggtatgtgggttcgggtggtgggaaaagtagctgaggcttctttcttaagggtaataattgtcaagactgattattttccttctcatggaaagaaattctattcctactgcaaaatccgtaggccaactctgttttcaagtctgggtttcaggggatttccagcacagggactatgaatggcttgaactacttctgacctgttctaccctgctcagtaacctgcctccccaaccaaggtagcgtcttgctgtttcctctgaccccacaagtgcaggctggtgtaggcacttactgttagccatcgtagggcagggctgaattggcctggggccatctcagaaaaccagtgggcagaggactgtccacctgtggagtagagaaagctctgagcagtttggaggcagggagtctcctgtccttctcctcacacccctccaaggaaccatctgcaagagcacgaggccatttccagaactgctgtctcctcaacctccgaacagtggctccaaggctcccctgcgagctgtacaggaaccagtttggagtaaccagtctttgtaggtccacccagcacatgtaactaggagatgacttttaactgtccttgagcattttatattaaaagtgatttttttaaaagtgcctacttcccttagcaagtaattattactagatatatttgtttcaaaactgtgtcttgccctgtctcctactaactgtcgatgtgaggtatgaattatggctgcgcacttacagccacgtgtgctttccacagtctacgctggcttctgtcagtgctagcagtgtgacgctttgtcagtgctcaccatgtgcaggtatcccacaaagcactttagaggtttaactcttttacttctctaaacacgaactataaaataggcactcttcttgtccccattttacagaggagaaaatggaagcacagaacagctagacagcttgcacaaggtcacatagcaaatgaagggcgggccccaggaccccctcactcaccctctgtgctgtcatgcctcagaagtgaaacatgctgcttacttgttttgagacaaaacgccataagtctggcttttttttcttctttctttcttttttttttttttttctgagacagggtctcactctgtcacccaggatggagcgcagtggcgcaatcatggctcattgctgcctcgacctccccaagctcaagtgatccacctgcctcagcttcctgagtcactgggactacaggcatgtgccaccatgcccagctaatttttgtattttttgtagagaaggggttttgccatattgcccaagctggtctcgaactcctgagctcaagcaatctgcctgcctcggcttcccaaagtgctgggattacaggtgtgagctgctgtgcctggccaagggtggccttttattcagtcatccggcatttatcttttcaacccagtggttcttgagtggccttgactgtcagcctctgtgattatgctggggaccacagtgcagatggcagctagttgtggattccatcttcctgagcctcagagtcttgagggggagccaggtacatgttcacatcctcgcagttgagtgggactcaggtgagggtactgagcaaagtacagggctgcaggaagcgcaagcagcatggccccctaatgtctgggcgttagccaggcagactgtcggtggggtggggtattggaattctaggccagaaatttaggaaagccctcacttaggtgacagggatcctggccctttgagcccctgactctctaacttcctcccttcctcatcccactccaggtagctgggaagccaagaaattttatggtgtgtttttatttggaggttcggtgtggaagtaagacttgccatggtgagcagggctggattgagaagagttgggcaccattttctttgaagtagttaacttctatgtgggtatctgtacaaatacatttatcttctttgcatttattgaaaagtattaaagtacaaagactttatttagctttgatttttaaaagaattctagcaaggtcgggcacagtggctcacgcctgtaatcccagcactttgggaggccaaggtgggcgaatcacctgaggtcaggagttcgagaccagcctggccaacatggcgaaaccccgtctctactaaaaatacaaaaaatagccgggtgtggtggcagatgcctgtaatcccaagtactcaggagcctgaggcaggagaattgcgacttgcttgaacccaggaggcggaggttgcagtgagccgagattgtgcccctgtactccagcctgggcgacagagcgagtctctgtctcaaaaaggaaaaaaaaaagaaaatatggtggaaaaaagaaagacagtggtagtgccatatatccagtgcctctgtaatgattagactacaaaaaattgacttgcatccaaatgttgaagaacctggctctttgtgtaaggtgaggtatgcctgcagaataatagcagctccttcgtaacgtgatgtgatgctctaagcgttacatttgcaaaggtgttagaacaggagaaaatgtcatccagggactccagggagtctttgtagggagacagcagcacgcgtctcagaaggtttgtagtagaggggtgtccacagatagcaggggttgggagaagggttgacttggcgtcttgctgacccgttttaccgtctcgtgttaatgatatcctctcacctttcttactgagaacagtaagccaaatgtggctgtgtcctctgccacagaactcactggctcttcccttgttagtttgcagaaagctggatgggctactcgggtcccggctatggcatcctcagcttggtggtctccgagaagtatatctggtgcctggactacaaaggcggcctgttctgcagcgcgttgccgggcgccgggctgcgctggcagaagtttgaagatgctgtccagcaggtggcagtctcgccctcaggttcgcctccccgctccctgctcccgctccctgctcccgctcgccgctcctgctccccgcccccggggtgcagacatcttagtacagggctcccctgcagcagctctgggctcacgctgccgtgcgttcaccaggtttgcctcttcaggaacgtttgaggggttgtctccaaagaacgtgaattgcttcattggatgtcaattcgtagtgtaaatgggtgttcagtttgagtttttgttttctttattaattgcaatggtaagctctgatcgtatttttgtaagctagacaaaaagtttgaaaattgagggacttttttagggatattaatatactaactcttcataaaaataatacgtgtttctctttctcattgttgctttaaagcaaccgaactaacgaagacgggcctatggatatgttagatatattccaattatttggcttcctctttaggaattctgttttaatgagctctctgctgtgggtgaacagtctactccctgactctaaaaggaaagtccattcattctttcatgctgctgttaggccattgttagtgaactggagctggtgtttcctgaacgatgttctcctgagctggaagacctcccatatctgcatggaatcatttgcttgctttttctttctttctttcttttttttttttttttgagacagagtcttgctgtgttgcccaggctggagtgcagtggtacaatctcagctcactgcgagctccacctcccaggttcgcactattctcctgcctcagcctccccagtagctgggactacaggcacccgccaccacgcccagctaatttttttgtatttttttagtggacacggggtttcactgtggtagccaggatggtcttgatctcctgacctcatgatccgcccgcctcagcctcccaaaatgctgggattacaggtgagagccactacgcccggctttgcttgttttttcttaaggttgtgttggccacgtcggcacctacgccagtggggacacttttgccttgaagcagcctggtttactgtcaggacattggaatagaagtcagacgaagccgaagctgagtctgtggcttgggacctgtctgttctctgtaacttcactgtgtttcgggatgaatttcccttaattctccctggtctctgtcactgtttaaaatattagtttgttcagcgttgtttttcttgcttgctttcactgtttgtttgaaaaatatttttctttagagactggctaacaacccactccacaagctgtcattacacagttgtgtgttttaattcatttctcgttggtatcatttaccttcaggtttgtctccttagccttttagaactttggttctattcctgactatattagttacttgtattcccaggccccttggtccctcactgtgctagcgggaactctgtatctccatgagattcacctgctcagttgaggcgtccttcagggcccagtcccatgtccttggtgggcagcagagcccttgtgccgggggcaccacaggcagagatgctcgacaggccctctagtccagcccagctgacactcggtgatcactggtggccccttgccttgcctgcgtcggcctgctccaggcctccagctgcagcgctatcctgccttccctttcctctctcctcctccatctcttcatcaaagtcctcttcacagtgaaaacaggccaactcagtgcaagtgtgttccttctgtgcaccttttccattcagctcatccagaactgatccttctctttgaatccctaaaggactttttcagcctctcctagggcactagttgtgcttaggatgtttatttggagacttatcaaacctaataatgtcatcagtgtttctcctcccgtgtgaggagcgcctgtcatgtgcccagctctgtggccatgtggttgatctgcttccgtctgcagtctttagagcagccctgtaaggtggagatgatccccacggcccaggaggaaagtgaagcttggagacgggcggtgacatggagcctgaagctgcatagccactgggtggtggccaagggcccaaacctgggtctggtggcctctttccccacttggggggacagaacaggatgtgttttagaaatctttctcccctcaatgcccagcatgaagacttttgtatagaaatatattctagtatttattggacagtgaatagaatttttatttccataggagcccttctctggaagattgaacagaaatctaaccgggcttttgcttgtgggaaagtcaccatcaaggggaagcggcactggtacgaagccctgccccaggcagtgtttgtggccctgagcgatgacacggcctggatcatcaggaccagtggggacctatacttgcagacaggtaaccgcgggccacgcttagaggcctgccagctctgccgtcactgcctctgctgcaccctgctttgctagtaacatgcttaccacaatcgctatgattaagaggctaaatccattcgaattaagacacttctgggaagagagtatttgccatttggcatgtattagcagtttcctgcattgacacaaactcaacccaggacaaatttagggcaaaaatgaataggattatttggtgagatacagaaacagaatcttattctcctatggccaaccaccgcatatcacgtatcctacaatgttagatcttaagaggtaagaatacagaggaaggacataaaattcatttccccctttaagctaaagtttaagtggctgcattttttttttcagccatatcaaagcccggctcctatatacttacttacccgtgggccaggaaaaaaaaagaaataatttgctcttttttattttgagacggagtctcgctctcttgcccaggctggcatgcagtggtgccatcttgactcactgcaacctctgcctcctgggttcaagtgatcctcctgcctcagcttcctgatcacaggctgggattacaggtgcccatcaccacgcccagccaatttttttgtatttttagtagagatggagtttcactatgtcggccaggctggtcttgaacttctgacctcaagtgatctgcccgcctcagcctcccaaagtgctgggattacaggtgtgagccaccacaccaggccataatttgctctaaatagcagttcaggccaggtgtggtggctcatgcctgtaatcccaacactttgggaggcctagacgagcagatcacctgaggtcaggagttcaagaccaacctggccaacatggtgaaactctgtctctactaaaaaaaaaaaaaaaaatacaaaaaattagctgggcgtggtggcgcttgcctgtaatcccagctacttgggagcctgaggcacaagaatcacttgaacctgggaggcagagcttgcagtgagctgagatcgcgccactgcactctccagcctggtgacagggcgagactccgtctcaaaacaaaacaaaacaaaaatagcagttcagcaagtcacaggaagctgccctcagggaagtttttagctgatggaagggcacagtgggacttgcttattaaaaataagctgtaatgacagtcagtgtttactgtcagcagaatggggaaggatcttccaccagcaatgtgatttatcagtatctggaaggactgtggggcaggagttatcgtcagttgtccagaggccacgttggatttatgtaaagatcagtcttccaggcgtttaatgttgttgattccaggagaatgttgttgttgttgttttgagacggaatctcgctctgttgcccaggctggagtgtagtggcacaatctcggctcactgcaacctccacttcctgggttcaagcgattctcctacctcagcctcccgagtagctgggactacaggcacatgccaccatgtccagctcacttttgtatttttagtagaggcagggtttcactatgttggccagtctggtcttgaactcctgaccttgtgatccgcccgcctcagcctcccaaaatgctggcattataggcgtgagccaccggcctcaggagcatgttttaatcactgctgtgagtcgtcagctggggatgagtcttcaggttgaagctcttgcacagctggctctctcctagctgtgtaagaacctctggcctgggtgcacagccatgctggcttcataggccatatgctggcccaggtctctccagcctagttcctgtgtctttctttaaatgaaagtagctctgtcaaggcacatgcacatctaagctgccaggacatttgagctttggtcatggggaagacaggaggtgcttctggcctgggggtgaggagcgagtgacctctaaaccagtagtgccagaggaatcaccaggacagtgatttcacatgaggtggccccacccagacctgttggattaggtccaatccctctggagactgctcaggagtgtgtcgtgtaagaagtcctgccggtgattcccacctagtttagtggaaggaaatatcacccaaggactgcaatactataggtgcgtctgtgattagtcacggagcatatttgagtactgagacctaattgcaggcctaaggtcaaggaatacagggttgtaggcgacagttggtctgtctgctcccctgggaatagcctttgagctcatttagacatactttattgacagaacacaaggaggcaaggggagagccctggacagggagccagggaccctgagctttggcctgccactgccttgcagtttgacagacctcagatttcatctgggaaattcggggtttcattttattagtggaacctcgcacccagtcagagcagagaggagccgccgtgctggagctctctgcaggaacgactgcaggcctcaggtccctgccaactccagcagcgctgcagccctctgcctggaagagctgctctgccctgcagcctttgggcctccatctggccactctcctgctcttggcttttgtgttcttctcttagaacttcttaagctacattgggacaccagataattctgaattgttcagttttcaaagagtgtctaaaactgttttcagatagatgttacatttaggcagaatttaaccactttatgttgattaaacttgacaacaaaaaagcggccggacagggcagctcctgcctgtaatcccagcactttgggaggctgaggtgggaggatctcttgagcccaggagtttgagatcagcctgggcaacgtagaaaggccccgtctatatttttaattaattaattaattaaagtttttttttaaagcactcatcataaaagaatatagcaaaataccaaaaaaggaaaaataagccaataaccaagtcaaaatgaggtgtggagttctgactgtgtgtctttggggcttcttcccatcttcctggcaggtctgagcgtggatcgcccttgtgccagagccgtaaaggtggactgtccctacccgctgtcccagatcacagcccggaacaatgtggtgtgggcgctgacagagcagagggccctcctgtaccgggagggcgtgagcagcttctgtccggaaggcgagcagtggaagtgtgacattgtcaggtactggcgggccagagactcctttcacatcgtgcttgtcctacccttcgttcttgtccacttgacaccacaaggcaccatgaggccgttcctgggaggcagcacctgcagcctccatggctataggctaagcttgaatctctgcctaattctgaccggcaaactggacgttgagtcagagctcgctttttaaaaatgctgccgccctctgcgcagccctgagcatcacagcgtcatgagtctgtcatgacggtctctattcagaattgcccaccgtcaggtagttctggtttagtgtctgtgacggcttaggtccaaatatttttctttattttcatgctaatcgaagttgatctctgaactgtagcttttttttttttttttgatacaggttctcactctgtcacccaggctggggtgcagtgccacgatcacggctcactgcagccttgacctccgggctcaggtgatcctcctgcctcagcctcctgagtagctgggactacagatgcatgccaccatgcccagctaatttttgtattttttgtagagatgagttttgggttttcatcatgttgcccagactcatctcgaactcttgggctcaagcaattctcctgccttggcctcccaaagtgctgggattacagacatgagccactatgcctggcccgatctctgaactgtaatttattaagctatttttttttttaccattcaagatgttagttatagaattgccatcagatcattttactagtatggaagtattaatagtcctttgaaaaactagattaggatattcttggtttgaatttagcaagccaataaactttcagtgaatacctattaagagccagaatggtccaggtgtggtggctcacgcctgtaatcccaacactttggaaggccaaggcaggcggatcacgaggtcaagagttcgagaccagactgaccaacatagtgaaatcccgtctctattaaaaatacaaaaattaaccgggcatctcaggaggctgaggcaggagaatcacttgaacctgggaggcggaagttgcagagagctgagatcgcaccattgcactccagcctgggtgacagagcaagactccatctcaaaaaacagacagacaaaaaaaagcaacaacaacaaaaagccagaatggtgctaggggctgggtgcgccaagagggctgagactggccctgctctcatcagttccaagtctcatgggggccccgtgcatggatggacacccattagcacagatggccctaaacaggagtgtggagcatgcagcactgagggaaccatggactccatgcagagatcaggaaggcagcatgcagagtggaccaacagctaagccttgaagctgacgaggacttccccatatggaaggagggggagggcgtctccagcaaagagggcagtgtctgcctaggtccagctgcacagaatagcctggcacatcgggggagtttacagtcattcccttggtgagggagggagtagagagatggaggcgctcaggggccttggattggcgggggaaggagtagagagatggaggcactcaggggccttggattggcgggggaaggagtagagagatggaggcactcaggggccttggattggtaggggaaggagtagagagatggaggcgctcaggggccttggattccttttgtgcctactcgcttttttcttaggttattttctctcttaagagtgttcccagccattctgggtcatcagtgtgtctttcaaaagctgccacccacttgaaccatatctcttgcacagtaatttaactcagacccaaacttccttccctggcacctgctgatccgctccagggccacgtctcttctcccagccacgcctgccgggagaccctggatgtccgcagtccagacacactgggcactctgcctatgggtgctgacccccctgttctcctccttattttcagcgaaaggcaagctttagaacccgtctgcataacgctcggggatcagcagactctctgggccctggacatccatgggaacctgtggttcagaactggcattatttccaagaagccccaaggagatgacgaccattggtggcaagtaggtgttcagctctgcgccacgtgccgaggtctcccgaccttttctgcttccccttttcttacttctctcttttccttaacgatactagattaaatttaaaatactcacttttttattatttgtttgtttgttttgaaacaagatctccttccgtcatccaggcggaagggcagtggtgcagtcacggctcactgcagtcttgacttcctgggctcaggtgattctcccacctcagcctcccaggtagctgggactacaggcgtgtgccaccatgcctggctagttttttgtatttgtttgtagagacagggttttggcatgttgtgcaggctggtctcaaactcctgagctcaagagatccacccagactgggcagagtggctcacacctgtaatcccagcaatttgagaggccaaggcaggcagatcactcgagtccaggagttcaaagccagcctgggcaacatggtgaaaccctgtctctaccaaaaatacaaaaattagttggacatggtggcacacgccgttggtcccaactactcggaaggctgaggtgggagaatagtttgagcccaggagacaaaggtttcagccaagatcacaccaccacactccaacctgggcaacagagctagaccctgtctcaaaataaataaaaataaaaaagagagagagagagaaatccaccctctccgcctcccaaagtgctgggattacaagtggagccaccactcccagccaatagtattccttttttctatttgatggattagactttgctgtgtttgagtgcattagaaacataaaggacttttcatcataggaaataatttgcaaactctttgtgtaaataatgcacttaatttatttattttgatattgtttatatatttattattataggctaaataaacccagtgacatccatttgaagacctaggtaataatgatgtttaattatgaacaaatgtgctgagaaaagagcccagataataggtttgaaagcccaacccagaattaaaattgagctgtctctgcttattcagaaggcctctaagtagatggtatttcagcaaagacaggagaattttcccacgtgcttccagaaaaggaaacactataagaaacaggatgagggtataatcaagctcactgtgtgtgatttggtcccagcaagagcgcctagaatgaatttctcttttctttttcttttctttttttctggggcagagtctcactcttttgcccacactggagtgtggtggcaggatcacgacccacctcagcctcccaagtagctgggaccacaggcacatgccaccatgcctggctaattattttggtagagacaaggtcttgctgttacccaggctggtctcgaactccttggctcaagcaatcctcccaccttgacctcccaaagcgctgggattacaggtgtgaaccaccaccctcggccctagaatggattttcaaaggagtgtctactttccccttctttggtatagtttagtgttagtgttgctcccacagtctcccactgtggtaggtaagatttcactgatagtcgatggtcgtgaaatatttgatgtttcttttttttgagacggagtcttgctctgtcacccagtctggagtacaatggcgcaatctcggctcactgcaacctccgcctcctgggttcaagcgattctcctgcctcagcctcctgggtagctgggactacaggcacgcaccaccaggcccagctaatttgtgtatttttggtagagacagggtttcaccatgttggccaggttggtctcaatgtcttgaccttgtgatctgcctgcctcagcctcccaaagtgctgggattataggcgtgaaccaccgcgcccggccagtatttgatgtttctgaagtatcttgccccattggtttatgttttattgtcacctcagacttgctttgttgaaggcttgtcttgcattgactgctctgaggtctttcagatgagaatgtagaaaaatgagttgtgtttactctttgataaaatatgtattctatataatatgtacattatatacagatgtatctaatttatatactaggtaatatttgatagtcatgcaaatgattttaaaataccttttgtgtacttgtaaccatatatatacatatacatgtaaaaatatacatatatgtatttttgtagagacagggtttcaccatgttggcaggctggtctggaactcctgacctcaagtaatccacctgccttggcctcccaaagtgctgggattacaggcgtgagccactgtgcccgaccaggagtagggcatttatgccagtgatgttttatgtaatcaaacccagcagggcagaaatgtgagtgaacatcatggagaatcagattttcactcataaagaatttgccttatatcaagctgcccaagaagagaagagcttcctgcagggaggggtggttggagaaatgtctgaggtatatgaatgcttttcaggaatgttatagaagcaagctacccttctgagctagggttagagtctagatacccaggatggtcctagttgatgctcttgccctggagtaattattagtagtcccaattcagatcataaattagttcatcacagccttgcatggtggctcacacctgtaatcccagcactttgggaggcctgggcgggcggatcacctgaggtcaggagttcaagaccagcctggccaacatggtgaaaccccatctttactaaaaatataaaaaattagccggctgttgtggcgtgcgcctgtagtcccagctactcgggaggctgaggcacgagaatctcttgaacccaggaggcagaggttgcggtgagccaaaattgcaccactgcactccagcctgggtggcagggcaagactatgtctcaaaaaaaaaaaagttcatcactctacttgtgatacctttttagatgcatattatgtttctaagtaccgtatactgttgtccattggaaatacctgatttaaaagcaaaattaaagctgggcatagtggttcatgccagtaatcccaacactttgggaggccaaggcagggagatcacttgagcccagaagttcaagaccagccctgggcaacacagggagacctgtctctacaaaaaatttaaaaattggctacatgtagtagcattcgcctgtatttgggaggctgaggtgggaggattgcttgatcctggaagtcaaggctgagtatgattgtgccactgcattccagcctggatgccagagcaagactgtctcagaaaagatggcaaaattattctttctcactctgattagaatgaaagtcttcttagaaggggtgtgagggggtgataatcacaaaagtaatacatgcttgtaacagatccatgttgtataaaagtatataaaatgtgaatatattcttccatacctttaaatccaaccctacgaaggagctggagttagcattagcagtttgatggcatcctgccacatttttttggtcctttcacaagcgcacacgtgcacatttgtgtttggatggtcatcttgttactagaaatgcagaggtgtggacctgagctagaaccttccctcaaggcagagagtctacacttgtaactgctctgacagcagggcttttgcttgtctcctccttccaggtgagcatcacggactatgtggtgtttgaccagtgcagcttatttcagacgataatccatgccactcactcggtggccacagcagcccaagcccccgtagaaaaggtggcagataagctgcgcatggcgttttggtcccagcagcttcagtgccagccaagccttctcggggtcaataacagcggtgtctggatctcctcgggcaagaatgaattccacgtcgctaagggaagtctcataggtgggtgaattgctgtaattttcacactggctttataggcagcctcactttaaagccaacatttaaagaaaagctttaagatctcaacttgaaaagataatttagtgccagtggtatgaagtgtctagtggaggcactctatgctttgtgatcagtttctctcctttttaaaaaatctgtcattcctaaaactcgtatccctgtgtctggatagtgtttcccctggaaaccttttatgacataagaaaagcaaatggaggtcatttttatgttaacaatttcacattttaaatgaaaaaatccacccaaacctagtgagagagaatggtccacttcctggagggaaggtgatcgccactgttggaaatgcaaggctctggccaggtctgtgaatgtagatgccagtctacacatcctggggtttgtttctgtgagtgaaccccttgcttttctccagccctctccctgctgcatggcctccacgaccctggactgggtgtggctctgcctggcagtattcagagggagatgaatgttaggctgtgattgctcatgtcgctttatttagggacactctagaattatctggagaaagggtttgaaggccagctgtcgtccagaactaagatctgaagtggttttgtctatgctttctttctttaacacattcttcctatttactctttccaggcacctactggaatcatgtggttccccgtgggacagcttctgctacaaaatgggcctttgtgttggcttctgcagctcccacgaaggaaggtgggtcagtcttagcctcactgaagaatctagagcacagcttggccattggaaaggttcaaaccacagtcggactgtggccttgttggttatggggcatgcctcggagactgaccacgtgagggtgtcagaggccagtagcccttgttagctgagccgagggccctgaatcgggataggcctgaccaggagagcctctgagagggaccgagcgtggtgaagatgagggaaagtgtccttctgaaggaggggctcacacagtgcagccaccggggctggcagctggtgacttccagtggcacatggcaggggccacagcttctttgggcaccttcccatctcccctcgagaatccttctgtcacctcccagcaacttccttccgtcttgttcacagcctccggataacctaagtccgacatttgcaccgcattaggcagacctgccctgcagcggggtgctcctgccaaccacattctgggcagaactcagtgtccctgcggagtacagggtttgtgagggagccagggcaccagagggtgagggagctggcatctgcggccgggaggggcacttcccccacccgcttagctgggagccccggcagtcaggcgacctctctgggaagtagctgtacctcctcccaggattgcctgaggatgaaatgcaaagatgctgtgaaatctgtggtgaagagggaatcgtttgcttagttcaaaccattagtcccactaggatgcaggtgactgggtcagtacaataacttcttactcaccagattgttcggaccacagttctggaacccagaaatctctgaaaacaatgttatttcttgagtctggcataaattaatttggcagcaaaacctgaccggatctcacatagctgcctccagccttggttgatctgttggctgtgaccgcatccatgttgcagggatgttaccgcacttcaccggggagcgcctggcccctccgtggttgttttgtaaacctctggcatacccattagcttaggttttcaaaaatccagaaaaagtttgaattccaaaacgtggccacaagttgtagataatacttcatataacgtactgtgaccaagattttaactgccctaaggattatttgcattttaaacagaatctgttaaacctaaaggacttttttaaaatgctgtagggaatgaaaggacatgattttgaggcaagggtgggaagagaagcacttccagcttcctaagccttctccagcagctgccccaccccccggccccatccccagaaggtccgggagagcaccatggcgccatccttcctaggaactgccaaccctccctccctccagggcaccgagttgatagtcttctcctcttggtaaaattaactttctacattaaaaatgctttggtgcctttgttcaagtgaaaaacttctcagcccatgaaaaatgggaggtcaaagccactaagccaacattatggccttcataaaatctcctaagccttgccttctttccatttctttccaacatctcaggcgtgtttcttgttagtcacggtgtttccctctgccttctaccttaaagtgctacaccgctcctgcccgtgtgggaatgggcaggtgagtgagctggcatctgtggccaggtggctagcgtctgctgaaaggcaaaggctgccttgtgcatttagggcaggcggcttggtgcagacaacacctcgatgacaaacatgacccctttctgcaggaagcttcctgtggctgtgccagagcagcaaggacctgtgcagcgtcagcgcccagagcgcacagtcgcggccctccacggtgcagctgcctcccgaagccgagatgcgcgcctatgccgcctgccaggatgcgctgtgggcgctggacagcctcggccaggtgttcatcaggacgctctccaagagctgccccacgggcatgcactggaccaggctggacctctcccagctaggtacggccacctcgtgagtacacctgccggtgccctgactgccctaaaccggcatcacaacgtgatgtcggacaaaactgcccggcctgtgtccaacctgtgagagttctgagggggtgtttataagctgctgaatttcaggagctcagttggccactctttcagactagacaggctctgggttttgtcccttcccctgccccttagagtttgcagggctgtcagaacccgaggagggtgtgcgtcctcaggtcaaggggccactcgctgcgagcggcttgaaggatactggtgatgcagctgccccgtcagtctttctgaatatggaacatagctttatgacctgaaaagctgaaaagatgggtgttccctatgacaggatcagtgccacgtttgtctatctcctcaggacagtacctggcggaggagagtggctcagcacacaggtgctagctctccttcagctcagccagatataggaggacctgcatccactagctcctgcttttctctgaatcttctatcaaaagccgtggagtaggctaagaaatgtagtgctatttgtaggccgggcgcagtggctcacacttgtcatcccagcactttaggaggctgaggtgggtggatcacctgagatcaagagttcgagaccagcctggccaacatggtgacaccctgtctctactaaaaatacaaaaaaaaattaggtgggcgtggcagtgcacgcctgtagtctcagctactcaggaggctgaggcaggagaattgcttgaacccgggaggcgggggttgcagtgagccgagatcatgccattgcactccagcccaggcaacagagcgagattctgtttcaaaaaaaaaaaaagaagaagaaagaaagaaatgtagtgctgctatttgtaaataattcattcatgttccaagaaataataacataagcccacaacattagatttctctctgagtagattcttggtggatcaggcagcataggtgtggtttgcctgaaggtggagttgtgcagatggcccccagggcccggatgagccctgcacttgcagcaggactgacttaggaacttcctggctgcaaggcttcccagtttttttaacttagaaccagcatttggttatgtggtagacttgaattgtataagcatttaatgtttgaaaactcaatcacatgtactcaccaaaaaaaaaaaaaaaaaaaggatggggagaaagaaagcaagaagagggctgggcacagtggctaatgcctataatcccagcactttgggaggccaaggagggcggatcacctgaggtcaggagttcaagaccaacctggccaacatggtgaaaccccgtctttactaaaaatacaaaaattacctgggtgtggtggcacatgcctgtaatcccagctacttggttgggaggctgaggcacgagaatcacttgaacttggtaggcagaggttgcagtgagctgagatccatgccattgcactccagcctgggtgacagagcaagactctgtctcaaaagaaaaaaaaaaaaaagaaagcaggaagagaagggcttgttccccttctccccaagcccctggctgcattgcagtctgtatgctaccagctgatgagagcctcttgccattccgtaaagcaagcatcgtcctaggctgcctggcagtggttggtgtgctcagccccgggggctcctacagggtgctgagtagacatcacccattcttttgcctgaaaaggcccctgaacactaactcagctgaagaagcaagttctgttccaaggcttggggactgaaggtttgtccagggcaacttttgttctttatgctttgggcctccccacctgccttttggacccaccagtcaccatctagctttttgagaacacccgcctctccacatcactgacagtgactgatagacaaggctgaggctgagagtggcctgaacattggtgctgactgacctgccgcctgccctggaaagcctttcatttgttcagagaccctactggtcctgagccattctccagcagctcctacccagactaactggaaaatgccgctagttccctctgagggtaaaaagtccagggcttggtgtgtattctccctgctcctgaatcttgagcactgtgggaggctgtgttcacctgcaccatttgggtgagaagcagaactgcttcccttgcacgtccccttcccagcccctccaggaaggctgctgcaccgtggtgggattcagagtgaatgggcatcatgccaggttctgcactgctggagccagccctgcctgggcctcctgcctccagcacagctcatgcctccctcctggctcgatccagtcctcccagcaccggctagctggccaaagtggtgcaggtctctaaggtgtgtatttgggcttcactgggaggtttctctcggggagaaacctggcttgagtgggattgagtctcaagagtgtgagggaaacaggaacaagtccatcctgagtccaagatggccttgggccatctggtgttcagcagatactcattgaggggttgggtgtgtgaacagagggatggcctggggatcctggtcgctgtggatgggcaggttttcactgacctcctgtgttccgcctgcaaaatcattagcaaatcaatgtcagtatccggctgaccccgaaatgaatcagacagcagtgggtgcaaggaggtcacaggcagaggtgtggggactcatggcagaggcaggacagagctgggccccaggcgggctctggactctgggcaagctgctgtcaccttgaaccgcaatttcctctcctttcttttttttccaggtggggtctcactctgtcatccaggctagagtgcagtggcacgatcttggctcactgcaacctctgccttcccaggcttaagcaatcctcgcacctcagcctcccaagtagctgggaccacagacatgtgccaccatgcccacctaatttttttgttttttgagacggagtttcgctctgtcgcccaggctggagtgcagtggcacgatctcggctcactgcagcctctgcctcccaggttcaagcaattctccctgtctcaacctcccgagtagctgagattacaggcacccaccaccacacctggctaattttttgtatttttagtagagacagggtttcaccatgttggccagtctggtcctgaactcctgacctcaggtggtccgcctgcctccgcctcccaaagtgctgggattacaggcgtgagccaccacgtacagtccctgctaacttttgtattttgggtagagatggggttttatcatgttggccaggctagtcttgaactcctgacctcaaatgatccacctgccttgtcctcccaacgtgctgggattacaagtgtgagccaccatgcccggccttggtttcctctcctttctaatgggagcagcaacccccaagcccaaccccctggaggatgcacggggcatcccgtctaaatgttggccatctccgggcggtgtggtcatcctaaggctgtgacacgtcttgcttgggggtgctctctagtctttgttagctgctggtggtggggcttttgcttgtgttgccccagtttgtgccacagggaggacaaatccagcatctcttgttaaagcaccacctcgcttagtccttatcctgccctgaactttagattttgtttatttgagttatctggttgatcttgaaatgtcagattaagactcctttcctgtttcctacacatcctgagagaatgcagcaagtccagggttggcagctttgtgttggggcaagggaggtgaacaggcaaccgggactcccaggctgttcctctgcacacgcacctatcccctcaacgagtatctgctgaacactggagggctcgaggccatcttggactcagggtggacttgttcctgtttccctctcgctctttttttttttttttttgagacagagtctcgctctgttgcccaggctggagtgcagtggcgcaatctcggctccctgcaagctctgcctcctgggttcacgtcattctcctgcctcagcctcccgagtagctgggactacaggctcccaacaccacgcctggctaattttttgtatttttagtagagatggggtttcaccgtgttagccaggatggtcttgatctcctgacctcgtgatctgctcgcctcagcctcccaaagtgctgggattacaggtgtgagctaccgcacccagcctccctgtcactcttaagttgagactcaatctcactgaagctgagtttctcccctagaaagaacagccacctccccagccttcactatgccagggtaggggcagtgagcatcaggccaggggcaccaggtgttcagttattaggctctctccaggtatggtctgtgtcctgcaggaaaagcaggtaggtcaagagacttctctttttgtttgtttgagacagagtcttactctgttgcctaggctggagtgcagtgacacaatcttggctgactgcgacctccgcctcctgggttcaagtgattctcctgcctcagcctcccgagtagctgggatgacaggcatccacagccatgcccggctaatgtttgtgtttttagtagagacggggtttcaccatgttggccaagctggtctcgagctcctgacctcaactgatgcacccgtcttggcctcccaaagtgctgggattacaggtgtgagccactgcgcctgacccaagagaccttttaataattacttatttaagtgaaaattttgaatgcaggtgtgctgtctgcccaggagcccgtgtatgactgtgcatggcggctgtcatcaggtggcatgcattgaatggggattattgactgtaaaggagagtcatcaagctgacatggctgctgcctgtgttacttatctggaattaattggggtgcttcatttattttttacaagtcagcagtgggccgggtgcagtggcttacacctgtaatcctagcactttgggaggactgcttgaggccaggaatttaaaaccaacctggccaacatagcaagaccccatctctaaaaatatttgttaaagtcaacagtagggggtgcacacagcaatgaatggaaacacagtgactgcatttgaggatgttgttcaatatcaaatttagcctcccccaattgtgctcttcttcctaacttcgctcctctgctcccactaaattccctttttttttttttttttttttgagatagtgtctcaccatgttgcccaggctggagtgcaatggtctgatttttgactcactgcaacctccgtctcctaggttcaagcgattctcctgcctcagtctcccaagtagctgggattacaggcctgtgccaccccgcccagctaatttttgtatgtttagtagagacggtgtttcactgtgttggccaggctggtctctaactcctgacctcaggtgatccacccgcctcagcctcccaaagtgctgggattataggtgtgagccactgagccctgctgctcccagtaaattctgctggaaagaccagagtgctcttttggccagtcgctcagcagtgtcctggccatctacccgaggatctccctgcttctggacctctgcttccctcccaccactgtcagggtggagccccctcgtcaccaagttgctgtactgcagtagctgcctcctggcaccaggtgtgcccacctcccaccacggctaccagagctgtcttcctcaaacccagctcagatggtgttgccctccacgttacatggctccacgctgccactagaatacagctccagtctttggtgtggcacccagggtctcgcagccagacccggcctgctgttccgaggcctcgtgcgttggggactccagccactcctggcctttgtgttggggccctggctaactttcatattttgggtagagatggggtttcaccatgttggccaggctggtcttgaactcctgcccttccctaatgtgtggtgcatgttcatgccacccatttgcttctcttcctggggcctagcattccttccgtgggctgctttccttcaactcttcttccttcaggactcagttgagatcgcacctccccaccagacattcttcattgactgtccccatcatagcactgtgcttctacctgtcatttcagagccaagcacggtggcgcacacctgttgtcctagctacttgggaggctgaggcaggaggattgcttgagcctgggaagctgagcctaatctaggcaacagagcaagctcctgtttcttaaaaaaaaaaaaaatacacacatatatatatatatatatatatatgtaattttagtttgactcacattatttttgttgaaagtttacacacggagtgtgtagggactttacaggcagagaccaattgcttggtgacagtacgtacccaacaggatttttgttttaatttgggatggggtctcactatgttgcctaggctggtctcaaactcctgggctccagtgatgctcccacatcagcctcccaaagtgcggggattacaactgcatgcagctgcaccagcaggatttaaaatgtcagggaaagtcagtactgtttgcagctccatttctgagtaactctgggatgtgagttttgatcctatatttggccatgttactggtagtcaaagataaaactgccttccatgcaagtacaggatgtcatcacacacagtagcctggtggatgatgtgactcccaccctcccaggaaaattctcatctcttgctctaagttgccatcagccttcccagggcatgaggcagaagatgttaggttataaaaacttgtcggccaggcatggtggctcacacctgtaatcccagcactttgagaggccaaggtgcgtagatcacgagatcaagactatcctggccaacatggtgaaaccccgtctctactaaaaatacaaaaattagctgggcatggtggcttgcctgtagtcccagttactctggaggctgaggcaagggaatcgcttgaacccgggaggtggaggttacaaagatcatgccattgtactccagcctgggaacagagcgagactccgtctcaaaaaagcaaaccaaaaaatcttgttagagatacatttacatgtgttctcccttcagccctggtgttttctttacaagtgtcttcctggttgtatgagtagcaagcagccttggacagcatgacctctgctccctcggggacagtgttgaccttgggcagcactaactcattgttaggtcaggaccatcatcagtcttctctaaaaggcaagcagaaattttaatttcagactgggtgtggtggctcacgcttgtaatcctagcactttgggaggttgaggcaggaggatcacttaaggccaggagtttgagaccagcctgaccaacatagcaaaaccctgtctctacttaaaatacaaaaattagctgggtgtggtggtgggcgctgtagtctcagctactcaggaggctgaggcacaagaatcgcttgaacccgagaggcagaggctccagtgagccaagattatgccactgctgagccaagatggtgccactgcactccagcctgggcgacagaatgagactctgtctcaaaaaatactactaataataatcaattaattaaaaaacaaggccaggtacagtggctcatgcctgtaatctcagcacgttgggaggccaaggcaggcagatcacctaaggtcgggagtttgagactagcctggccaacatggtgaagccccgtctctactaacaatacaaaaattagccaggtgtggtggcacatgtctgtaatcccagctacttgggagcctgaggcacaagaatcccttgaacctgggaggcagaggttgtagtgagccgagatcacgccactacactccagcctgggtgacagagcaagactctgtctcaaaaaaaaaaaattaaattttaatttcaaggatgaggatgactttagcgaagtatcaaataatgaacatgatttctacctttaatttttttttttttttgagacggagtctcgctctgtcgcccaggctggagtgcagtggcacgatctccgctcactgcaagctccacctcccagcttcacgccatcctcctgcctcagcctcctgagtagctgggactacaggcacccactgccatgcccagctaatttttttgtatttttagtagagatggggcttcaccgtgttagccaggatggtctcgatctcctgatcttgtgatccacccgcctcagcctcccaaagtgctgggattacaggtgtgagccactgcgcccagcctcaattttttttttttaaatacagcttccctcttctttctacccctatacaaattaccagagcaattactgctataggattaaattaaaggaattcttaaattaaatggttggctgctgaaccaagttgtagcagttgaatatggaattttgtagtgatttattataatcctagtttttggaagaaaatttgcatcacttagcagatatttaagatgcttgtaacatttcatttcccagtacacataaatatgcattatgtcaggcattggaatgtttagcaaactaatgaaatttgtaatttaatttatcaggtcacagcatttaatgaagaactattcagtgtcagtttatgccgttaggtaacaaacaggattgtgttacgcagtaatttatacagaaaagtattttataaataaaatgtcaaataaatgccactttttgttttaaaatgatatgtttaagaaataatcctaaagggaaaatgtctgctttgtcgaataaagtaattaaagcatttttttaaaacaagagaaaaaaataaggacaaagcagggacagacaggaaaatgtcagtgtgtttgcatcagccaggctgggctgtgcttcggtagcaagccccagatatcagcgacttcacacagtgaaccgtggcccccgctccacgaagctggccctgcatctgtcctcttctagggcagtggtcctccaggtggtggcttcctgatcctgcctgctttgctctgcggctccaccatctcggttccttctgctcagagcctgttgccagtactggtcgtgggtcctgcctaactctaagggaatgtgagggagccatggagtgcttggggagggctgtggtctctgccaccgcgttcaccacatcctgaccacttcttccatggaacaggttcacaaacctcattcatccaggcggcctgggtgacactctggggtaaaagtctgcaggaaagccctcagttcaactttgtcatctttcacctgtctcttcaattcggaataagctggtttatgcactggaagtacatcatctagtagtcttttatatgtgttctgaaaggttgttcactgtgtaatgtgaactccgtgttctgtgagcagtgttgttgctgccaactctgagatgctggcctggtgtgtttttgtcaccatgtgactctgttagcatgatcactgctgcctgtagtttctcttagaggcaggttgaagactctaatgtaaaattgtcttttaattagcatttgtttctcagctatttctagagttactgttgaaggtactttattttgactggtacagatctttgcatatgtaatgttagagttccagggaattctgtttaaactccccggtaaaacattctgtacaagatcaaggaaggagaaaatacagttaatttttggaatagagaaattgtcatctttagaaaatgcaaagaggaataatgataattttttgtgtagcagtgaatgaatagctttaagttgatgtcataactgaagacacatgagattttcacatggcagagtcatgcctctgtgttttgctacactccgtgggctgtcatctgataccagtgacaactgtgcaagggtggtacctcccgattctgcacccagtgtggggcgtcctccacctgcccctctccagcagcaccaccagctaatggagctgcacaccttttattccccggttgaaagtcaaaataacccatcaaaattaaaaacttctcatccaaaaacactattaagaaaatgaaaaagcaaaccacagactagatttacaatgcacgtatctgacaaaagactagtacctacaatgtgcagagaactcctctaactcagcagtcaggagaaagttcattttaaaatgagcaagacttgaacaggcacttcacaaaagaagatatacagatgtccataagcatattaaaagattcccagcatcattccttagcaggaaatacaaattaaagccacgacatgatacaacttcacctctcctagaatggctgccgtggaaaaggttcaggggtgcgggcagccagaacccgcagacacggctgtgggtgtggagcacaggatctccattggggaaactggcggtttctttaaaaatgaaacaggccgggcgcagtggctcacacctgtaatcccagcactttgggaggccgagacggatcacctgaggtcaggagttcaagaccagcttggccaacatggcaaaaccctgtctctactaaaaatacaaaaattagctggacgtggtggcaggtgcctgtaatcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaaaaaacaaaaaaacaggaggcagaggttgcagtgagccaagatcacgccactgcactccagcctgggcaacagaacgagattctgtctcaaaaaaaataaaaaagcagtcagttcagcagttacctcagggtagagggcattggccagaagggagttgagggaactttttggggtgactaagttgtttaaaaccaattgggacaggcgtagtggctcacacctgtaatcccagcacttcgggaggctgaggtgggtggatcacttgaggtcaggagttcgagaccagcctggccgacatgattaaactccatctctactaaaaatacaaaaattagctgggcgtggtggcacgcgcctgtaatcccagctactcaggaggctgaggcacgagaatcacttgaacccaggaggcagaggttgcagtgagccaagattgcacccctgtacaccagcctggatgacagagcaagactccatctcaaaaacaaacagaacaaaaaacaaaaacaaacaattcaacttagccctgaagatctgtgcattgtgctgtaggtaaagtctcagaggtcagaggttgctgatgcagaggacccaggctgacccaggtccaaaccttagatcctcctttgcctcctggcctggccacctcctgccgtgtggccctcagcagatctctttctggctgagtcccgacggtctcatgggtgaagtgggatgatactaatcgtgtatcattgttgtgggtttgagatgagtatatgaagacctggctgacagcctgtccacagcagctgctcaggaactgttgactgctgttcttttagccagactattatcaaatgtaatttctatttttaaaaaactcttcccatttcctttcctcttgcaatcagtctcaatagcagtaagaaataaataaaaatgaagattctttgggagacttagttttgtttttttttgtttttttgagatggggcctcgctctgttgcccaggctggagtgcagtggcaccatcacaggtcactgcaacctcgacttcctgggcccaaccgatctcagcctcccgagtagctgggactacaggtgtgtgccaccacacccaactaatttctgtgtattttgtagagacaggatctcactatgctgcccaaactggtcttgaacttctgggctcaaccgatccacccgccatggcctctgaaagtgctaagattacaggtgtgtgccactgtgcccagtcagtttaattctaattaagatcaagattatctgtaaatacgagttccctctctccaaatctagaatttgctggcattagtcacatgtctgaggaagctgacgatgggacccacattgagatactaatcccagggctcggtggttcagggcactgtactgacagcatcttgactgctttgcctgttgcctggaaggggtgccgtgtggcgcctggcaggtggcagagtggccagaggccattattactctcttgagttacggtgttctcaagcccagctgagtccacacagccgatgtggatggactaggacagatccgatgacttagtgtccaagttcaattgcaaatgcagcctcatttctttctttgaagtagaaaatcaaagttcatagattagatgaaagaatagtcattgtacaaaagtaattatagtgtgtgtacttttctttatctacaggagctgtaaaattgacaagcttggcatgtggaaatcagcacatctgggcctgtgattccaggggtggagtttacttccgtgtagggactcagcctctcaatcccagtctcatgcttccagcctggataatgattgagccacctgtccaggtaagcagaagttagctggtggaactcactcttcagtaagacagaaactgtgaggatgctggtactgggaaaaaggatctgcacagcctctagaggcctcccagcaaatgcggggagccatgcccccagggtctacacactctcgttcatcaacatcacaactggaattcgggatttgtgaagtttagagctgaacagactgttacagattatgagtcaacacgtatattttctctttcaaaataataatatttcgtttttgactttttactaagtgaatattattttttaaatctgcctatatattggaacctctattttataataataatgataataaatcagtacccagaagtataaagaaggtaaaagttactttgaatcttgtcatggagaaaatgctgagtgcctctcctggtttgttgaagaaattccgtttcctgtccagcccactgctggccagctcctgccatgtttcagctgaccgtgcatcccaacacagagtctgtgttctcctgacctccagcactcagctcacaaggagaagtctgatttgaatgtactatctagttacccttaaagatcccacaggcttggttcctgtgctgaatagatttctgttgaagtttataactgggggctgtggttttttgagacttatttgcccagactcctgccagcccccatttggtgactctgttgggaaacaggtgaagttgccaattgtggaggcagcagtggggcaggggggatggttcgttgttgggcagagaaaccttcagtggagtcaggaaagaggtaaagagtagggtaaatgcctttgtgcataactgtctacattttggtcatggtgaggcctcagggatgaggacaccagtggtgtccaccagccctggggagtgtggtggtgggagaacctttactgaaatcagcattcggctccagagctctgtggaggccaccactagcggtcatggccacagggaggcttctcgtcctccttggtgggtcttcctcctccagagggtgatggggatgatattgtctatgacaacactttgtgaatgatacggcactgtcaaacatgaggttgtacataatgaattataacacatgctctgttttccctctgcacacggtgacgtactcatagtggcacagagggagagtccaccctgcagagaggagccttcctcactgccatgtttagcactgctggggcacagtgattatgaaaagcaagccgcctgtcgttagtttcattattgtccttaaattctctggttgcccgcacccaggtggactcctttgacacaccactgtcaatacgttcctttttttccttctaacaactttatatttttccttttaagttacaacccgcataacataaaatttcagccttctacagtgtgcagctcagtggctttagcatcagttagcagcagttagcaccatccaattccagagggttcccatcactccaaaacagagagaacacccttacccattagcagtcacttcctgttctcacagaaccagcccctccgcccatggcagccactcatctgctttctgtttctatggctttgcctattctggacattttatataaattggatcatataatatgtggccttttttatctgacatctttcactttgtatcatgtttcggagttcatccacgttgtaggtgtatcagttcttaattcctttttatgactacatcacagctctgttgtatggataggccacattggtttatcatttcaccagtggatggacatttggattgtttctgcttattggctactgtgaataatgctgctgtcaacatatgtgtgcaagtctttagggaggatgtatgttcccagttctattgggtatctgtctgtaagtggaattgcaggtcatgtggcgattctgtgttgaactttttaaggatgtcaaagtgtttttcacagtggctgcaccatttgtgttccaccagcaagatatgagagttctagtttttcccatcctcaccaattttttttttttttttttttttgagccagagtttcgctcttattgcctagtctggagtgcaatggcgccatcttggctcactacaacctccgcctaccgggttcaagcaattatcctgcctcagcctcctgagtagctgagattacaggcatgcaccaccatgcccaggtgatttttgtatttttaggagagacggggtttcaccatattggtcaggctggtctcgaactcctgacctcaggtaatccaccctcccccggcctcccaaagtgctgggattacaggcatgagccactgcgcctggcctttccaattttttgttgttattttatttttctggtctcagaaactgcctcatatgtctaattttttaatactagtcatcatagtagttggaaagtggtatctcattgtgggtttgatttgcattgacctaacaactaatgatattgaacatccctcttttcatgtgtttattggttatttgtgtatcttctttcaagaactgtgtgttccttttttcttttttttttttatgatggagtctcactctgttgcccaggctggagtgcagtggcgcaatctctgctcactgcaatctctgcctcctgggttcaagcgattctcttgcctcagcctgctgagtagctgggattacagacatgtgcctccacgcctggctatttttttttttccatatttttttagtagaggcagggtttcaccatgttggccaggctggtctcaaactcctggcctcaggtgatccgcccacctcggcctcccaaagtgcttggattacaggcgtgtgccaccacgcccagcctcaaatcttttgctcatttttaaattgtgttatcttttactgagtttgtttgtttgttttgagatggagtcttgctctgtcgcccaggctggagtgcagtggcatgatctcagctcactgcaacttctgcctcctggattcaagtgattctactgcctcagtctcctgagtagctaggattacaggcatgcaccgccatgcctggctaatttttgtatttttagtagagatgggggtttcaccatgttggccaggctggtcttgaactcctgaccttgtgatccgcctacctgggtctcccaaagtgctgagattacaggtgtgagccaccgtgcccagcctgttgagttttatatatgagttctttatgtattctgggtactagacctttatcagacacatgatttacaagtattttcttccattctgtgcattgtcttttacttttttatgatgttctttgatgcacaaatatttttattttgatgaagtccagtttattaattttttcttcatttgcttctgcttttagttgcctaatccaaggtcacaaagatttacctctatgttttcttctagcagttttgtagttttagctcttacattaagtgcttcatccattttgagttgatttttgaatatggtatgagataggtgtccaaatgcattcttttacatgtgggtatcgaattgtaccagcaccatttattgaaaagactattctgtccacattaaattatttcaacacccttgtcaaaatcaattgattgtaaatataaaggtttgctactggactcttagttatatcccagtgatctgtgtatctatccttaaactacactgtcctgattacttagctttgtcgtaaattttgaaatcaggaagtatgaatcctctaactttttctttttcaagattttttcagctacatggagcccctcctacatccatgtgaattttgggataagtatgtcaatttctgcaaaaaaaaatactaactggaattttgaaaggaattgtgtcgaatcagtagataaatttggaaaatcttccagtctgtgaacatgggatgtcttcccatttatttagatcttctttactttccttcaccaatgttttgtagttttcagagtatatgttttatactgcttttgttaggtttatttctaagttctgtattccctttgatactattgtaaatggagctgttttcttcattttcagattgcccattgctagtatagatttttgtatattgatcttgtgtctggcaaccttgctaaacttgtttattgggtctaacaggtttttgtagattcttttgcattttctatagatgagatcatggcttctgacatggtctgccaatagagataattttacttcttcctttctatctgtatgtcttttattttactgtcttgcctgattgccctggctggaacttctagtaaaatgttgagtagaagtggcgagaatgggcctcctagtcttgtttctgatcttaaggggaaggcattcagtcttttaccattaaatatgatgtgagctttgtgttttcttaggctccctttattaggttgaacttcccttctactcctagaaggaattctaggagttctttctgttcctagtttgttcagtgtttgttatgatgaaagggtgttgggttttgtcaaatgctttttctatgcctattgagatggtcatctggtttttttcctttattaatatgatatattatactgatggagttttatatgttgaaacacagtttcattcctgggttaaatcccagttggtcatgatgtgaaatcctttgtatgtatatgttgctggatttggtttgctaaagttttgttgaggatttttgtgtctatattcatgagagatattggtctttggttttcttgccatgtgtttgtctggatttggtatcaaggtaatgctgctggcctcatagaatgcactgggaagtgttttcttcttttctactttttggaagagtttttgaaagattggttttattttttacaccccatttgttagaattcgtcatcccatccatgaattcatgtagccatgtaggcctgaactttttttgtgggaagtttttttgactactggttcaatctctttattcattataggtctattcagaattttttttttttttttctgacatggagtctcgctctgtcacccaggctagaggatgttggcgcgatctcggcccactgcaacctccgtctcctgggttcttgcaattctcctgccttggcctccctagtagctgggactacaggcatgtaccaccacacgcagctaatttttctatttttagtagagacgaggtttcaccatgttggccaggcttgtcttgaactcctgacctcaaatgatccaccctccacagcctcccaaagtgctaggattacaggcatgagccactgcacccagcctattcagaattttctatttcttcttcttcttctttttttttttttttttgagatggagttttgctcttgttgcccagactggagggcaatggcacaatctcagctcactgaaacctccacctcccaggttcaagcaattctcctgcctcagcctcccaagtaactggggttacaggcgtgcaccaccatgcccggctaattttgtttcttgtgttttttttttttttttgagacggagtctcgctctgtcgcccaggctggagtgcagtggcacgatctcagctcactgcagcctccgcctcctgggttcaagcagttctcctgcctcagcctcacgagtagctgggattacaggcatgcaccgccacacccagctaatttttgtatttttagtagagatggggtttcactatgttgaataggatggttttgatctcctgacctcatgatccacctgcctcggcctcccaaagtgctgggattacagacgtgagtcactgtgcccagcctaattttatatttttagtagagatagggtttcactatgttggccaggctggtctcgaactcctgacctcaagtgatcttcccacctcggcctcccaaagtgctgggattacaggtgtgagccactgcaccctgcctctctttcttcttgagtcaatctaagtagtttattctttctaggaatttgttcatttcatctattttatctaatttgttggcatccaattgttcacagtattcttctgtaatactttttatttctgtgaaattggtagtaatgtctcctctttctgattttataatttgaattggctgggcacagtggctcatgtctgtaatcccactttggaaggttgaggcaggaagaccacttgagcctaggagttcaagaccagcctgggcaacatagcaagacatcatctctaccaaaaaaaaaaaaattacctggacctgatagtgcacctgtagtcccagctactcagaagactcaggtaggagaattgcttgagcccaggagttcaaggctgtagtgagctatgattgccagttttattgccaattgccactatactccagcctgggcaacagagcacaacgctaataataataataataataatttgaatcttctctcattttttcttagtctagctaaaggtttgtcaattttgttgctcttttcaaaacacctccttttggttttcttgctttttctgtgttgtttttctatcctctatttcttctatttccactctgttacttcctccacacattcttgtgcacagtgctttgcttgatagtgatattcctctggtagctccaaggaatatttgtcacaattatcacgtacatgtggaagacctgtggtaacattggactgtaaagtttgtaggatcccagtgcagaggcaggctgctgagtgcaagagcgagatttgcaggatgtgttgtagaaagaacgtccttgagtgggttgagcgcccatgtgccttgcctcctccttttcccagcaagccagaggccaggatgctggagagtagggcaagcaggaagctgccgatctcagtcctcagtggggctggagccacccttgcctctgctgtgtgcacctctctgcagccatggggccacacaggtacctggcaaaagggttacatggagaacggtgtgcaaccacaatttcctgttcctgtctccatgtagactctagaataacctctaggaagcaaagctaaaatggggaagagagctttgcttaaagtgctctattgactgtggtgatcaacagctttgccaggaaaatggccaaaatagaacaaattcacatgaaaggacctcaaagctctgctctgaataaagtagtgattgctaaatgggatgttaagcatgaactatttcaagtagttctgctgaatagagccacattttctcattgagttagcttttagcatgctatggaagacattcagtttgccatggattctgtagatacaaaatgcttttcaagttggtttctgtgggaaagaaatcaggcttcacatgtacacaggcctttctactgcactttgccaagcactgccttatccttaacccttttattgccccaggaaatagaaaagtccgtagttccccctactttacgaggaaatctgttacccagaacagttgagcaatttgcccaggatcccaactctggtgtgtgccaagcccaggcagggacccaggcccccagctcccaggtgctgcccctgccgaggctcccctgggctgaggaaggcgcttctcccgggctgctggcactgacgattgtttgctgagatcagaagtgaagacaagctctgctgccaggcgctcgccttgtgccaggctaatgcctgaagcacatctttccctcagtcctcacaacaacctgggaagtgactgcgtctttccccatttgacagaggagaaaaccctagctcagaggttcagaaagttgcctgaggcctcatagcgggcaggcggcaggggtgggacatagacccaggtgtgtgacacccgcctctgcctctcctgtggctctgaggtccaaggcctgggccaggaccaactgcaggatggcagcaagcaccaggttgtggcgacatgtcataggcttagtggcctcacacgtcgtattttaggacaaagcctacacatgcgaatctttaaatcgcagagggtcctgcaaatgagcccaggagtgaggggagatgggggttcactctgaggactggaacgtcagaagagttggttgaatctgaggattggagaacaagcggggtttatgtattttgattatgttctacatctttccactttgttttatttgttcttcgacttgagcttcttcatctgcgtagaggatgtatttgcagtggaaaaggaaatggaggcaggggatagatgctcaagggcacatgaagtgaagccacagaaatcttttaaaattagcatcagcttctctatttagttctgttgtcctattctcttctctgggaagatacccctcctgtagtagttttgcggtaaagttttaacaaagtactcaaaacaaatgactcagttttcagatttgctaacacttgcaagggtttggagaaaatatttatagttgtgtttagcatcttcatagtctggagtttgctgtttgagttagagaattttctgtctgtgttagaggtacctctaacgcaagcatagttggtgtgaagtttcacattctgtgtgccccatgtgcttgagtagaagaggtgtctgttcttactgtgcttacagtggactctgaaatggtgtctatggtgtggttccagttttgtaaaacaaaactataaaatcccactaggctgggtgcagtggctcatgcctataatcccagcactttgggaggccaaagtgggaggatcacttgaacccaggagttcaaaatcagcctaggcagcgtagtgagaccccgtctctacaggtaattttttaaattagccaggtgtgttggcgtgcacctgtggtcccagctactccagctactcaggaggctgaggtgggaggatcacttgagcccaggaggtcaaggctgcagtgagccatgtttgtaccactgcactccagactgggcaacagagcaagaccctgtcttaatcaattaataaaaataaaaaataatttctcactgaaaacctagaagaaactacaacaaaggtgactgttatggggccgggcacggtggctcatgcctgtaatgccagcactttgggaggcccatgtgggcagatcacctgaggtcgggagttcaagaccagcctgaccaatatggagaaaccccgtctctactaaaaatacaaaattagctgggtgtggtggtgcatgcctgtaatcccagctactcaggaggctgaggcaggagaattgcttaaacccgggaggcggaggttgtgatgagccgagatcgcgccattgcactctagcctggacaacaagagcgaaactccatctcaaaaaaaagactattttgatccagggattataagtgattaaaatttaccatgttttcccataatgggtaggaaaactttttcatgatcagggagaaaaataggtatattttacaagggacccatcttttgtgggtcagtgagcaacctttcttctccgaggcacgtctctgacctacccagcccatataaatctgaaccccagtaggttgtccccccttccccctgccccacacaaagattttagagctagaaggagactggaaaacacataaccttgccacttccttctgcagatgaggaaagcaaggcctggcaaaagcaaggttcctggtctcagggtagtcagtggttgtgccgggcctcctcagcccctcatcctcaaggcccacaacagagcagcggcaagaacagtcccatccagggacactcacaggctaccgtagagacacacgcaaaccactggcgcctgtgcttccagagctgtgggcagagtgccatggagccagctggagagggaagtgctgtcagggccttggagtggtcagaggatctcacaagaggtggcactggtacaagaaaggcaagtaggagtgtagcaggcaggcaggacagagggtgttctaagcagaggggacatgaagtataggcactgagcagaaggcacccttgcccagggtgcagaaaggggctgtattgggagactggcacaggccggggcagggagggctgggctaaggcattggcatcattcttgaagagtttgaagccaggcaggtggcctggtcagaccatgtttgaggaaggagcctgtgtcacaattccctgtgaccagtcagagggtcttctgctggacagatcacatgcacccataagtaggtcagatgcccaggagtgttttgcctcagatatggagcaaaattagcctgacagtaaatgcagctctggtcctacctactggagcttaaagcaagactccgaagaatcaaactgtttcagagtaacttaccagcatcttagaacaaagctcaagaatatttacagattgcaaaaatatccaacatcagcaagataaaattcacatgggcaaccaattaacatttacccaacaagcagagaagcaggaaaatacgacctgcaatgaaaggggaagaaatccgtcaataggagctgacccagaaatgatacagatggtaaaattcatagacaggacattaaaacagttgttacacctttatgtgttcaagaagctagtagagagattcagcctgttaagtagaaaatgagagatagaaaaactccaggctaggccaggcatgcaacggctcacacctgtaatcccagcacattgggaggctgaggtgggcagaccacctgaggtcaggagttgcctggccaacatggcaaaacctcatctctactaaaaatacaaaaattagccaagcgtggtggcacacacctgtaatcgtagctactcaggaggctgaggcaggagaatcacttgaacctgggaggtggaggttgcagtgagcaaagattgcaccactgcactccagcctgggcaacagagcgagactctgtctcaaaaaaaaaaaaaaaaaaaaaaaaacaatatcaaaaaactccaggctgggtgtggtggctcgtgcctgcaatcccagaactttgggacgctgagctgggagaattgcttaagctcgggagttcaagatgagcctgggcaagatggcaagaccctgcctctaaaaaaaaaaaaaaacaacaaaacaaaaaacaacaactcaaatcaaatttgtagggattaaaattgcaatgtctgagctgaaaaatatcactggatgagattaatggcagcatagaaattgcagaagaaaagactagtgagcttgaagacacagcagtgaaaaaccatccacactgaagcccagagggaaaacaggctggaaaatgttcagagaatcagtgagcacagaccccttcaagtggcctcacgtaaatgaaatccaagtcttaagagggaagaagggtgacaggaaaaaaagatgtgaagaagaaatacaactgaaagttgtccaaatttgatgaaataattatgctgagtcaagaagccaaagaatacatactgttatcatttcatttatataaaatttggccaggtacagtggctcatgcctgtaatcccaacactttgggaggctgaggcgagcagattgcctgagcccaggagttcaagaccagcctaagcaacatggcaaaaccccgtctgtacaaaaaatacaaaaattagctgggtgcctgtagtcccagctgctcaagaagctgaggtgggaggatcccttgagcccaggaggcagaggctgcagtgagccatgatggctgccacctcactccagcctgggtgatagagcatgaccctgtctcaaaaacaaacttatttatataaaatactagaaaatgctaacacaggccaggtgctgtggctcatgcctgtaatcccagcactttgggaggccagggcgggtggatgacctgaggtcagtagttcaagaccagcctggccaacgtggtgaaaccccgtctctattaaaactacaaaagtcagctgagtgtggtggtgcacacctgtaatcccagctacttgggaagctgaagcaggagaattgcttgaacctgagaggcagaggttgtggtgaaccgtgatgacgccattgcactccagcctgggcaacagagcgagactccgtctcaaaaaaaaaaaaaaggaaagaaaatgctaacacagatcagtgcttactcaaggcctggcagaaatttcaaaggggaggtgtggcagtggcttcaagagtgtatgcatatgtcaaagcttacccaattatgtactttaaatgtgtgcatttcattgtatgtcagcatacccctgtagagctggtttttttttttttttttgagacagaatcttgctctgtagcccagactggggtacagtggtgcgatctcggctcactgcaagctccgcctcctgggttcataccattctcctgcctcagcctcccaagtagctgggactacaggcgcccgccaccatgcccggcaaattttttttttttttttgtattttatgttgatacagggttttaccacgttagccaggacatacaaaaaattagccaggcgtggtggcgggcgcctgtagtcccagctactcaggaggccgaggcaggagaatggtgtgaacccaggaggcggaacttgcagtgagccgagatcgcaccactgcactccagcctgggtgacagagcgagactccgtctcaaaaaaaaaaaaaaaaaaaaaaagagttagccaggacggtctagatctcctggcctcgtgatctgcccacctcccaaagtgctgggattacaggcgtgagccaccgcacccggcctgtttttgttttttagagacagagtctcactccattgcccatgctggagtgcagtggagtgattgtggctcactgtaacctcaaactcctgggtcaagccatcctcccacctcagcctcccaactagctaggacactacaggcatgcaccaccgcacctagctaatttttaaaaaaatttgtagaggcatagtcttgctatgttgcccaggctggtcttggactcctggcctcaagcaagcctcccaccttagcctcccaaagtactgggattacagatgtgagccaccatgtctggcctctgtagagttgttttaaatattaaagtgtacaaaaaaaaaatttaaatgggccgggtgtggtggctcatgcctataatcccagcactttgggaggtcgaggcgggtagattgcttgagctcaggagttcaagaccagcctgggtattattgtgaaatcccatctctatgaaaaatacaaaagttagccaggtgtggtggcatgtgcctgtagttccagctactggggaggttgaggctgcagtgagctgtgatcatgtcagtgcgctccagcctgggtgacagaatgagaccctgtctcaaaaaaaaaaaaaagttttaaatgaagattatagggtaccctacattgtgtttggtttgcagagggaacagaaatgagtgaagctgcctaagcatggtggctcacacctgtaatcccagcactatgggaggccgaggcaggtggatcacctgagctcaggagttcaggaccagcctgagaaacatggtaaaaccccatctctaccaaaaatacaaaaaattagctgggcatggtggcacatgcctgtaatttcagctactcgggaggctgagatgggaggattgcttgagcccaggaggcggaggttgcagtgggctgagatcatgccactgcactccagcctgggcgaaagagtaaggccctgtctcaaaaaaaaaaaaaaaaaggaaaaaaaaaaggaaatgattgaagctgtttttggagttaactgaccaaaagttaaatgactaaaagaagagcgaggcaggaggttatagaagcaatcatgaaaaaaatacagatccccagggtcccaaacctggtttccgaggatgggtagtgtttgaacttggacttgagactcaatgggcattttcagtgaccagcaggtaaagaggcttggcctagtgtttctgagtagggaagagtgctcctccctgctgccttgggaggactgtctgctgctggaccaccctgaggactgtgagacattagctctgtgggcttctaggctcctggcagtgaacctctgggagtgaaggatgcacaaaggatgttgtgggaaagagaagatctgagatgtcctttgggtcatctttggaggatcttgactctgaggctggagggtttgtggctaattccatgggcagtgggggctgttggaggctcttgagcagggccggacaggacccaaatggagaaggtctgcagtgagctgtggaaattctttggcctgattcgctggatttgtggtgcacatctgtgagatgtgagattgggatggagtggacatggggactctgacatggattgttttggggcagaagaagccaatccatgctggcgtcccagcctgggtctgtaatctcattaatctccttttggtgactggaccagttgcctgtacaagtgcctcttggtctccttgatccaacctcactgagccagcgtcgcttgtatgcatgatactgcaagacttccttcccagctggcctgcacgcaggtgccttggagaggcattgggcagatggcatgtggccatttccagcagtggggcgcagtgctcagggagactgcagcatcctggagccctgccagccaggagggactgttcccattgcgggcagaatctgttacttgcaatcagaagaacttcaactaatacttgttttttgcctgtagattcaattgaccttgggaatgttgcttaaactcgcctttcactttcattttcctatcagtaaagtgaagggtcatatccacattagagccatcagaggagcttattaaaaatgtccaggcctcggccctccctggagatatgaattcagcaggtctggggtgaggcccaggcatcttggttggtttttttttttttttttttattgatttatttgagacggagtcttgctctgtcgcccaggctggagtgcagtggcatgatctcggctcactgcaagctccacctcccgggttcacgccattctcctgcctcagcctcccgagtagctgggactacaggcgcccaccaccacacctggctaatgttttgtgtttttagtagagatgggttttcactgtgttagccaggatggtctcgatctcctgaccttgtgatccgcctgccttggcctcccaaagtgctgggattacaggcgtgagccaccatgcccggcctattttttatttttgagacagagtctcagtctgtcattcaagctgaagtgcagtggtgcgatcatagctcactataaccacaaacccctgggctcaaacaatactcctgcctcagcctccaaaatggctaggggtatgcaccatcacacctggctcattttttaatttttattttgtagagatgaggtcttgctgtgttgtccaggctggtgtcaaactactggtctcaagtgatcctcccacccctcagcctcccaaagtgctgggattgcgggcgtgtgccactgtgcctggccagttttgttttttggttttgggtttttttttttttttttttttttgagatggagtcttgctctgtcgcccactggagttcagtggggtgatcttggctcactgcaacctccgcctcttgggttcaagtgattctcctgcctcagcctcctgagtagctgggagtacaggcacccgccaccacgcctggctaattttttttttttttttttgagacagggtctcactctgtcacccaggcgcgtagtgcagtggcacaatctcagctcactacaacctctgcctcctgggttcaagtggtcctcccacctcagcctcttgagtagctggggctacaggtgagtgccactatgtatttgtatttttagtagagacggggtttctccatgttggccaggctggtctcaaactcctgatctcaggtgatctgcccgcctcggcctcccaaagtgctgggattgcatgcgtgagccactgtgcccagccacacccagctaatttttgtatttttagtagagatggggtttcactgtgttggccaggctggtctggaactcctgacctcaagtgatccacctgtcttggcctcccaaagtgttgggattacagataggagccaccacaccgagcctggtttttatttttcatgaaagtcatacatgaaatgccaagtgtggtggtatgtgcctctagtcccacctactcaggaggctgggtgggaggatcactggagaccaggatcatccaccgcactccagcctgggcaacagagtgagcctccatctgtaaaagaaagaaaacagagtcacatgtgaaaatcagtaggttgacatgtcagtgggttctataagatgtgctataagaaacatgtctctcctgccaattttgccctctctggagagttcctttcagttcttttcgctgcctgtctctgaatgctgcttcgggagctgtgtttggtcccctgacttcaggtgtttctggttgactctctgcgggaagagaagcatgcagagctcttgcatcccccgtcccccattcccccagccacccacctcccttcctacttccaccctgccagagctgcagtgcttcctgggcacgggccttgctgtgaggacagaggagctcttcacagcggaggcaggggatgaatcacacctgcagttccttgtctgtgtgactctttgttttccctggacttgataatcatcttgtttgctcatctagttttttttctttttttttttgagacagagccttgctctgttgcccaggctggcgtgcaatggtgcgatcaatctctgctcactgcaacctccaactcctgggtccaagtgattcttctgcctcagcctcccgagtagctgggcttaacaggcgtgtgccaccacacccagctaattttttgtatttttaatagagacagggtttcaccacattggccagcctggtctcaaactcctgacctcaggtgagccacctgccttggcctcccaaagtgctgggattacaggcatgagccactacacccagcctgctcatctagttttctaagtgcagttccacacattcaatcccaaactctctgccagttgtctcacacattaggaatgtgtcctctccatttcttccccctgcagagatctctcctgcaccctcttggccagctccagtctggcctcgttcctctctctacccgggacccagctgttgtcctagcgtcacctttgacctcccctcatgttagagcccctttctcccggatcccgggtcttcctctctctgtgtctgtgtttgtttgggtggagtttatcttccagtcggttcccaaggaagggttcatggttggtgactttttggaggtattgcatgtctgaaaagtctttcatctgtgttcacccttgaccttgctggatatagcagtctaggttggaaaccattttcctttaggattttgagggtctttctccattgtctctcggcttccaggattgctactgagaagccagaagcctttctttttttttttttttttttttttgagacggagtctcgctctgtcgcccaggctggagtgcagtggcatgatctcggctcactgcaagctctgcctcccaggttcacgccattctcctgcctcagcctcccgagtagctgggactacaggcgcccgctaccacgcctggctaattttttttttttttgtatttttagtagagatggggtttcaccgtgttagccaggatggtctcgatctcctgaccttatgatctgcccgtctcggcctctcaaagtgctggaattacaggcgtgagccacctcgcccggcccagaagccgttctaacacctgatccttgatacttgacctgtttttctttctgaaagtttgtaaggtctctttgttcctagtgttataagaacagatacatagtggtatgccttggtgagggctgtgttcatccttgcagccaggtggttgcagcctatgtgctggtgggtgtctgggtcctctgctggggtcctcttctgccccgcctctcttgttttcctttttttgttgttatgtttttgtgtgttgttgttgttgttgtagggttttttgttgttgtggggttttgttttgttttgttttgtttttgagacggtctctcactctgtcacccaggctggagcacaatggcgcaatcacagctcattgtagctttaaacttctgggctcaagcaatcctcccaccacagcctcccaagtagctgggaccacaggcatatgcaccatgttcagctaatttttttattattttttgtagagatggagtctcactatattgcccaggctgcttttgaactcctgggctccagcaatcctgccaccttggcctcccaaagtgctggattccaggcatgagcaactgcacctggcacccctcctgttttctgtctgctctggctgaaggcctccttttccttttctttttttttttttttttttttgagttggtgtttttgcccttgttgcccaggctggagtgcagtggcgcaatctgggctcactacagcctctgccccccgggttcaagcgattctcctgcctcagcctcccacgtagctgggattataggcacctgccaccatgcctggctgattcttatattttcagtagagacaaggtttcaccatgtttgccaggctggtttcgaactcctgacctcaggtgatccacctgccttggcctcccaaagtgctgggattacaggcattagctactgtgcccagcctggaggcttccttttgtattgtggactttctaagctggcctccacttttcctttctctcctgtttctgtctttttatgcttttatcctgctttctagaagacattctcaaccttatttctccaaccctctgtcagattatttccatgatcacatgtttaatttctgaaagttcctgttgttgtttgatggctgtagagtcagtcttctctcatctccctaaggatgttttggaagtttcttctccctgcctggtctttgtatgtcccaagttgtgtgttttctgtctagttcgccttttacatggcagaggctttcttcagatgttggcagtcccctggttggaagagtgaggcccagcaaggctgactggaagccctgagcacatgcatggagcctgtgggccccgcgggtctctgacagcaatctggctgggctgctgggtggggagtcgttgcttttagccttccagggcccgctgagtccttgccatgcatcccccactttccagcttccagaattgtatggctgcttcctcccctcattctctctgtccttaggagatttgaaccttttttctttgagatggagtcttgctttgtcacccaggctggagtgcagtggcccgatctcagctcactgcagcctccccctcctgtgttcaagcaattctctgcctcagcctcccgagtagctgggattacaggcgcatgccaccatgcctggctaatttttgtatttttggtagagacagggtttcgccatgttagtcaggctggtctcgaactcctggcctcaggtgatccggtctgcctcggcttcccaaagtgctgggattacaggcgcgagccactgcgcccgccccgtttttctttgtttaacccattccctctcatggtagtggtgcttgagaagggagtgaaagagtaattgtgtgctcattatcatcactgcccagaagcttctggcttcttcagcgccctgcaggtgactcttgcacatacccagcgctgagcaccatggtgcagctcatccccttcacctccacggttctggtatcacagtcttcagagtatagccactattttcctctaagcctctgaacatctttgagtggtatttaggtgctggtggggctgcctgttacactgtaagttgttccgtcagcacaactatgctgcctgcaaatgaaggtatgaaacctccccaaactgctgtctaatggtgtgggatggaaccagctccctttgagagaaactaaattgttttttgccacttcctttaattttttccatgttgcctttttttcctatacctccatttaaacatctattgtttttgagctctcttcttcaaaacttgcttctaggaactattacccctcttcaccatattgaactctaagtcttttctctcattctggaaggccatgatacctagaagtagaccacagggttctaacggggtgccctgggtcctgcagcagtcccctcatcgtgctttaacaacttatgacccagtagtttaaacaacgacctagggaagcttgtcccagcctgccctgcgtgtgcccccagtaaaaccatgagcggcaggaaggggagcccctcgcgatgcttgccatgaccctagaggagcagagcccagagatcatctttagggacctctccctctgggctgcactcatccagaaggtgcttccccgagcctgtctgtagagtcagccacagagcagggcgatgagctatcagagaccagggtgtgtgccactgggtccagcttctgctcttcttgtctcacagcaatatttgagtcctggtgctagccatggcgcagtcgttgggctggtatcagtgacaaggtctggagggtagacaggaagagtggccagttggctccaccagcccctgctcaggaaggacagaatgtgacaggcacccaggaaacctgcttctgagcgttttctttagcgcaccccctacaattagcagatgcagcttcttgctggattctgaggtcacacctcagaccagatgtagaggcccagcagtaactggagtcagtgcagaaggacccaccacggagagggagaggcctctgacaggccagaagagagcagcagtggagcctgtttctgtctggagccctgctctgctgggccagaagtttccaaatgttttttagcagtgggacccattcttcaaattaaaaaaaaatttttttgagttaggctcttgttccgtcacccacgctggagtgcagtgacacaatctcagttcactgtaacctcaacctcctgggctcaagtgatcctcttacctcatcctcctgagtacctgggactacaggtgtgtgtacaaaatacaaaaaacactcccagctgtccagccttaaataaaatcttgtacataagccagatgtgttcaacaagtaacagcaaaactggtcccatgaaactgccccttccacaggggccctgaggcacctctgcaaggccagggccccacaggcgctgctggaaaactgctggtcttcgggccagtgaggacagagagagagctcagcacagcaggccccgggcagccatacccacctcgtaccacggtcagagtctcgaggagcctcagagatcatggtccccggctcctccagctaaggacacagaccacgaagaggaggtcctcctagtgtgtcagccctggctctgagaatttacctttaatttaattctagacctattaacatgggtatcgggtttttaagcccatctgaaattgggaagaatagaccagaagcaggaagagggtctgctacagggaaaaaagaactagaaagaccaaacagaagtcagaaagtacagctaccacggggccatgtgacaaatggcccaaccaacccacacgcctcagcgccccctgaggctgcacggatagacggacagacacacagcagcaccatgaatccttgagggaaagtaaagctcagcatgtgtcagtctttacggggattcaaggttaaaacagggagggagagagacttggagggaaaagaaaaggcagtgtggaaagcacaaatggccgcctggataaccgtggtttgtttgggttaggattatttccagaggcgtctttcctggggcatttgtgctgccgcttcaaaaaccctcggtccaccctggtattcctgaaacattcctgctgaatttcttccaagttctgataagtccatgccaaaatggtctgtctagatacatgtttcctttggctgtgaaatcttcagcatgtttttgtttttcagcctgggtttaccacattctgactgaggaacatgtgtgagtgtgtgtgtgcgtgcgcacacgtgtgttgataaaagctatgataaaagctcagctacaagaagtttgaagaactgtggtctgagccccagacacttgtgttttctttttcttttcttttctttttttttgagatggagtctcgctctctcccccaagctggagtgcagtggcgcaatctgggctcactgcaagctccgcctcccaggttcacaccattctcctgcctcagactcccgagtagctgggactacaggcgcccgccaccacgcctggctaattttttgtatttttagtagagacggggtttcactgtgttagccaggatggtctcaatctcctgacctcgtgatccgcccacctcggcctcccaaactgctgggattacaggcgtgagccaccacgcccggcctgtttgttttttttttttgatacggagtttcactcttgttgccgaggctggagtgcaatggcgcgatctcggctcaccacaacctctgcctcccgggttcaagcgattctcctgcctcagcctcctgagtagctgggattacaggcatgagccaccacacctggctaattttgtatattttttagtagagatggggtttctccatattggtcaggcttgtcttgaactccggacctcaggtgatacgcctgcctcagcctcccaaagggctgggattacaggcgtgagccaccacgcccagcctcttttgcatttttatgaagtttttaatatgaataagccaaaattttagatcacctactactttttttttgtttttttagtagagattaggtctcgagctactgggctcaggcaattctcctgcctcagtgtctcatagagctgggattataggtgtaagccactgtgctcggccttttttttttttttaattgaatttttttttatttttttgatacgtagtttcactctttttgcccaggctggagtgcaatggcgcaatcttgactcaccgcaacctctgcctcctgggttcaagcaattcttctgcctcagcctcctgagtaggtgggattacaggcgccccccaccacgtccggctaattttgtactttttttttagtagagacgaggtctctccatattggtcaggctggtctcaaactcccgacctcaggtggtccgcctgcctcagcctcccgaagtgctgggattacaggcatgagccactgcacccggcctaattgaaatttttattgagataatggtcactgcacttgtatttataagaaatcctgagtaccctttacccagttcacagcaatggtaactgcaaaactatagtacactgtcacaaccaaggcttgtctacttttttttttttctaaattgtgataaaatacacatgagatttaccgttagtgacagtacatttgcaatgttgtgcaaccattgtcactatatagttccagaacattcttttttttttcttttttgagatggagttttgctcttgttgtccaggctggaatgcagtggcacaatctgggctcactgcaacctctgcctccccaggttcaagtgattctcctgcctcagcctcccgagacactaggactacaggcatgcgccaccatgcctggctaattttgtatttttagtacagatggagtttcaccatgttggccaggctggtctcaaactcctaacctcaagtgatctgcccacctcggcctcccaaagtgctgggattacaggcatgagccactgtgcccaacctagttccagaacattcttatccctcaagaaagcccctagcaatgtgaagccactccccattcctcctccctcctctctcccagcctgtagcagctgctcacctgatttctacctgggattttcctcttctggatgtttcatagaaatggaatcctggctgggcgcggtggctcacacctgtaatcccagtactttgggaggctgaggtgggtgggtcacaaggtcaggagttcaaaaccagcctggccaaaatggtgaaaccctgtctctatcccagtactttgggaggctaaggtgggtggatcacaaggtcaggagttcaagaccagcctggccaagatggtgaaaccttgtctctactaaaaatacaaaaattagctgggcatggtggcaggcccctgtagtcccagctactcgggaggctgaggcaggagaatcacttgaacatgagaggcagaggttgcagtgagccaacatcacaccattgcactccagcccgggcgacaagagcaaaactgtgtcaaaaaaaaaaaaaaaaggaatcctacagtgtgtggccctgagtgatacgtgctctctctgacagcccctgagtgtgtctgggttttgtctgtttaaatgagggtttattcagccccagacttctggtacaaaccaggggacagctagccgctcttgcactcagcacagctaacaaaccagcagtgccaggctcagccgggagttcttttgcctccaaagaaaggcttgagaagaatctacactaactttagtggaggcacttacatcagtgcctccactaaaaataaagcaaaaacaagcaaatccaggtgacagttacaaaaaaaaaatacagtgagtttataaaataaatacagcaaaggtgtgttgagaccgccagtgaatcaggtcactgtgatgaaagccgcacagcaggtctgtgtgttaaccccacgcggcaccttccttggtcactgtgagcaaacagtggaattccctgctcccaagatcctgtgctgcttcccactggcaccactctcagaccgtaagaaatcggtttgctccagaggaagatgatgaagtcatttgctttgaggtccagtgattatcattgtttctgacctaatagaaaatcatccctcactgatgcccagccctgctggtctcgaagcccctcacaggcatcatgtcatgacacccagggtgtgcccagagccccagcaggcaggactgccaggcagggctaggaccaggcctctctgttactaacctagagagcagtcagcaaagcaacccccgagtttgccaacttttcaagcgttggttttttgtctgttgaaacctcggtgtattttagcagaggcgccttcccgagtcacccgacatctgtggctcggggtcatgattgccgcgaccacccggggtgctgagctccgccccggcctggcgtctgctctgaaaaggtccagactcaggcagagcagacaccccagggccactttgccagtccttcagcaggcgccatgggctcctcctccaaacctgttccatcggcctcttagggcctgcctgtaccaccagcccctggcttattgcaccagcgtccggaacggggttcttgttctacctgcccttccctgcagcttgtcctcactgcagccagaagggtcctcagacgacatgtgctagttcatatctctcctctttttttgtttttttgggttttttttgagacagagtctcactcttattgcccaggctggagtgcaatgtcacgatctcagctctctgcaacctctgcctcccgggttcaagtgattctcctgtctcagcctcccaagttggtggaattacaggcgcatgccaccatgcccgattaattttgtacttctagtagagatggggtttcatcatattggtcaggctggtctcaaactcctgacctcagatgatccacccgcctgggcctcccaaagtgctgggattacaggtgtgagccaccgcgctcagcccacatctctcctctttttttacttttattttgtttattattacagagggtcttgctctgttgcccaagctagagtgcaatggcacgaatatggcttactgcagcctcaaactcctgggctcaagttatcctcctgcctgagattcctaagtagctgggactataggcacatgccaccatgcccagataattttttaaattttggtagagacaaggtcttgctgttgcccaggctcgtctcaaactccttggctcaagcagtcctccctccttagtcttccaaagtgctggcattacaggtatgagacaccgtgcccagccctttcctcttttcacacccttctggcagcttcccacgtcactcagaatgaaatcatacttcttccctcagcctgaagcctgccatcagccctagcagccactctggcctcaccactgggctgcagcctcccagcctccttgctgcaaccctgagctaccctcagttctacacttgctggggctgctgggtaccttccctaggtgttggcaggatcactgcccctccactccaggcagagtcagggtgtccctctggcccttctctctgttacgcagtatggcattggtttgtccgggttgtgccccaccctccccagtaggatggcagttctgggtgggcagaaacaagtgttttgtttgcagttgaggtttccccaaaacccagcatgtgtgggtgctcatttgtcgaacaaatgatcacatgcctccaattagaggtgtccaggagacagctggtgtgaggccttgggccacatgagccctgccagtggtaggggtggtatggtgtaccatggaacccagtctgggaaatactgggtaaaggcatgaggcaagatgataaacctggaaagatgtgtccagaatgacttgctcttcctcttttaaagagcatttactggtgtccccatgtgcttttcgtcagactgtgctctcccaccctctgagacctggcctccatccctaccccttcctgaagccctcctgggctgtctgcaggctggcctctcacctagagtgagggccctgccagggagtgccagtcctcctttcggagagaagccactatgccatgagcttccgtcgtgtaaagtcagacccagacagcccaggccctggtgtcaggagtgtggcagcagccagggccggggctctccttctccttcttgggccagccactggtcacacaggtgcactcaaattgggaagctctgtcatgctgtgcacttaggatttgtgtagttttcaaatgtatattttcctccagtaatacaaaatagagtttctttttattggataaaagcgggtgaggggctggggacgcagaatgtttctgagggaagcaggtggtcagggtccatcctccacgcacctcctcagcatcgggctgggctggagctgggcagacgtggcctcctcctgcagggagctcccaggcagcacaggggcccttcccagaggcctggcaggcagcgtgagtggggttgtgaagggtgggcagcagcgtgccaggtgagcaacgcgtgagggggcgtgtgtgtccggaagggacgactggcaaggccagggtgaggctgggccccgcttgctcttcccaccatgttctgttctagcggcttctagtaaaggctgttaatgggcggaggctcacattaggaggcagagcccggaagcgagagagccaagggagacagggaagttttatgttccagagacgttgcgaggtgatggagagaagaggaaagggatgcggggtagccatcctctgcccgctcacgagcacttctccgcctgccaccgtgctgcttccagcgcccatctttctctatctggagacccctcagagactccactttggtccttgctgttcttgcccttctgctgaagcacagtcatctcctcctctctccatcattcccgttgtccttgacttactattcaaaagctagctgcttcaaaccacagcgcgtctcagctctgggccaggactacgggcagtgtgtgggggagtcctggctctgctccaccacgtcggggccctggccagtgggctgaatggcgaggcctgggccgcttttctgtcttctccacgcggccttccgagtggggaaggcgggagcctggcgggagcctctcctccacatagcctggtggcctcagcctcggcctcagctggcaggcctctcccctcccttccctggagcccctgcatcccctggaatgggggcttagcctagaacagcgcttccccaaatctgcacctctgaaccccaggtccatggaatggaaatggatgtgatgtatggaaagggggttccatagccaaacaagttaagctaagttcagagggaaggtggtgaatagaaatcccaaacatctgatcccagcacagctagcggtggggacttgccttgagtgcgctccaggtggtccctggggactcggtcctggcacccctgccctcctggattgcatcccacagccctgctggccgccccgccccagcctccctgctgtgacaggggcaggggctgcggtgaccctgcagcacaggcgcggctccctcggatcccttggatctcaccggtgcatctgaggttctgcgtggaaagtggctcgggcttccaatgccgctctgctttaagctgggaccgctgtccagggtggtgcccagccttctggcatctgccatccaacccttccctctctcccctcagtggccctgtgtcctccgggcatcaaccctaatgccacctcctcacctgaccacccactgccagttgctcattttatttcctggtggtgcctcccatatctgaacctagcctggtgcttacgtccaattgcctgctctggtgctacctgagagccccatccagcccactcacgaaggcttccagagcctgtgcctgtaacttgggcaaatgtgtggagtgagcgaccaaagggctgagggagcagcgaagggagcccctcgctaggactctaggactctgttctctctgtgtctcttaaaatagctcactcgtggctgggcgcagtggctcacacctgtaatcccagcaccttgggaagccgaggcaggcagatcgctggaggtcaggagttctagatcagcctggccaacatggtgaaaccccgtctctactaaaaatacaaaaattagctgggcttggaggtgggcacccataatcccagctacttgggaggctgaggcaggagaatcccttgaaaccggaaggcagaggttgcagtgagccaagatcacgccactgcactccagacacagtgagactcaaaaaaaaactagctcggacgggtgcggtggctcacgcctgtaatcccagcacttttgggaggccgaggtgggcggatcacctgaggtcaggagttcgagagcagcctcaacatggagaaaccccgtctctactaaaaatacaaaattagcctggcatggtggtgcatgcctgtaatctcagctactcgggaggctgaggcaggagaattgcttgaacctgggaggcggaggttgcggtgagccaagatcacaccattgcactccagcctgggtaacaagagcgaaactccgtctcaaaaaaaaaaaaaaaaaactaaactagctcattcacctcactggcaggctgagacctgcagtcactccagcggcaccctgagtgagctcacacaagagagaactttggccaggcacggtggctcacgcctgtaatctcagcactttgggaggccaaggggaatggctcacttgaacccacgagttcaagaccagcctgggcaacatggtgaaacccagtgtctacaacaaaatacaaaaattagcctggtgtggtggtgtgcacctgtagtcccagattcttgggaagctgaggtgggaggatcacttgagccagggagatggaggttgcagtgagccgggattgcgccagggcactccagcctgggtgacagcgagaccctgtcttaaaaaaaatttttttaaagagaactttctgacagccagaatcaggtgggggcaggagggagggggtggccctgtgcctgtcagtgttttggctgcggagctgcgaccaagtctggatgtgtttgggatttctattcaccaccttccctctgagcttagcttaacttgtttggctatggaaccccctttctatacatcacacctatttctattccatggacctgggattcagaggcgcagatttggggaagcgctgttctaggctaagcccccattccagggggatgcagggactccagggaagggaggggagaggcctgtgatcactctgcaaagcagggctgggtggggaggccgggcggctggggaagaaacctgccatgtctgggaagaccggttggtccttagaggacctagcagcagcaaaggcaaacactggctcaggcagtggtgactggtggtgatgtgccgacaagagcggccaccgccccgtcctccttgctgctctgtctctccatcctccatgtcctgatccactgggactggccctggggctgaggtgtgagacttggtgcccacgggaggcatttcatacatgcgttcatcagcccacagttaggggcccctgcccagagcagccggcgggtgaggatgcgggcagcctggagagggcacctcgatccgggaggtgcaggtggagggaggtcccactgcctgagggccctgagagtgtctggccccggcaagtgtgtgacacgggcactatgacaggagcactgtgcggccagagtgtggcacagggcatccagtgtgattgtattcacggcagccctgagcacaaagcaaggagcaggagatgtgtggcggcagcgagggatctgccagtttccactgggtggcccactcggtcccatggaggccgaccaggagggcagggacccaagaccacagatgtagcagggaagactgtgggttccagaaaagcaggcagtgccaggcagtgggggacagccagcccctcggggctcgggtcacccaccagcactgctggtgaccagaggcccagatcctccagacagtgctgtgctcgcgggcatggaggcctggtccaactgaggggtgggaagccctggggcaaactggagttgccggtggacagcaaacaggacactggagggacttcctcctgtcctgtgaagagcagacaaaggaccggagatgctgagcatggacagaggctgcccaaggaccagggcagggcggcagtcttgtgccgcggcctggtcaacgcagatgttgcctgcccggcagcacattcgggaggacagctgtgcctagaggagaggggcctcagctgagccaggatggtgagggcagcacaggcaggtggcaggggctcctgggctggcgtttttgtttctcacagtgcccaccatggtccttcacagccaggtccgccgcatctctcctctcattcctccactctctgttcacctgggccatccctgcccttcttggcctcctgctggagtccatgctggtatctgctgggctgtccctcagtctggcccacctgacattctggagacaagtgaccatctcccccgtgagactggcactaggggcaggacgtggcctctctgcctcctgcggggcccacactggctgctgcatgctgccactaacatgtccccagttccggaagtctcctgtcctttctcttgtcacccaactcctgccttccctgaaagtcccttcccgcttccagcccgccggggtcagcttggtcagcgtccattccagccccaacgaccagatgctgtgggtgcttgacagcaggtggaacgtgcacgtgcggaccgggatcaccgaggagatgcctgtggggaccgcctgggagcatgtgccaggtaggagcctgcagacagggcctgtggtgccggccagccggggctaccatcactgggggctgctgggcgctccctccaggccgctgtctgtgaggcagcctttgtgctggggctgtgctgtcgccgctgcttcctgggccaggggacaagcctcccatcatgttccttatcaggggaacccaggccgtcctgctggtgcttttgtgggagggcagtttgcacactgcccaggcccttctgtcctttgacttctggctttcggtggctttgctggccctgccaactggtcgtcctttccctcggctcctgccccaagcccagcccatcatgggcactccgtccccgcagggaccctggtggaggtgtgcagcgtcacaagagtcggcttgggaagcagcggcccatcccgtccatggcaggggctcaggagggaccctgtctgcccacagggttgcaggcctgccagctggcgctgagcaccaggaccgtgtgggcccgctgtccaaacggagacctcgcccggcggtacggcgtcacagacaagaaccccgccggggactactggaagaaaattcccggcagcgtgtcgtgtttcacaggcaggtgcccggggccagtgggcttaaggccccttggggttcccagggctcctgtggacgatgtcggggggctctcaaagaagccgaccccactgggctccaatctctcaaagcaagaactgagggcaaagccaggagtgtgtcccagggagggaaggggctggacacctgggctctgccagagtctcctgggcaaggacaaggtgctgttgacatccacttacagctgagggtacgaagttcacatggagatggtggcttgtccagtgtcccccacctagaatgtggcaagcccagacctgcgcccaagctcccagctccatctgtgcccaccccacaggctgtgtgattgacaagtatgtgattggctcttgtccctgcagtgactgcgtcagatgagctgtgggctgtgggcccgcccggctacctcctccaacggctgacaaagacgttcagccactcgcacggcacccagaagagcagccaggccgccatgccccaccctgaggacctggaggacgagtgggaggtcatctgaaggagccctggccgagtcacgcggaggggcccggcgtctgtggcgggcacaggggcttcagagtgactccctggtggacgcgctgcctcaacacttgtccagacacctctggccaggttggacccgcacacttactttcatctatgttggtttctgtctcgttccagaacccacagcctccacccgtggctggcgtgattgctgcagcagtggcgcctcctagctcaggacagtggcgactgcccggctgcatgcactccgattacccacgtgctgccgtcctggtctcatccacagatagctccagcttttgttggtgggagtggtctccggaggcctcccagaaccaagggtagccgggcagctggtttggcccagggcctccttccacattagtagccccagggccagatggagccaaaggtcagctctctgcagcgcgggatgtgctcggtgatggctttgtcccatcataggggggtgtccccccagagacaaagctgcagagcacattccatgccagacgctctggccaggaagctgaggccgggcttgagaggagagcgctggccatgccaggagagaacccacgcacatgcacaccacaacacacaacacacctcacctcacaccacagcacacctcaccacaccacaccgcactgcaccatacctcaccacatctcaccacaccacagcacacctcaccacacaacacaccacaccccacaccgcactgcaccgcaccgcaccgcaccgtacctcgccacatctcaccacaccacaccacaccacacctcactgcccacacacggcgcaggctgcccgcctcctggagagcacacttcagctgaaacagtaaagcctgatgggtgcaaatggaacctggatgtgtgcacgtgtgtcccaggtagggacggcacaggagggtgcatggggcgtgggggagctgagcaagggtcgctcacttagaaatgtctttggaatggtgtttaactaatgctgctggcggacatcctaaaaccagatgcatcctcagaggacgagtctactaattattgcctttgttgttgtattacaaatctgcataaaatacctcatttcaaatcaaatcttacaaatttagaagagagatatgttttccgaaaacagtggaagccctttgttccttcccgggtttgtcctgagcctgcactgtcctcgcctgcagcctcagaggggcaggcatccccgcacagacttgactggcagggcggtcacgggacctgcgggctggctccgagtggcagcccatgccttctgcggggtatgggttgacacttgacaggttgaaaccagtgcctctatggacggctgctgtggccccttcagacaatgggcagtgcccaccccgcccactggcatctgcgtgtgagggctaggccgccctgccacacatcccgccccctcccggaggcagcttcaggacaggacaccaggctggctgctttttttagcctgcccctggcccaggcccagtccttggtgtcagggagcccccaggccgcaggtggagggtgataaaatatgttctctgacaggacccagccagccacataggtggaggttttccatgtccaaatgaggtcaagatgccgaaatcccagatctgacttcacacttcccttttctagaaccttttgtaaaagttggtggcagcagaggcagccccaggccgggctgcatctctctgtgtctgttgtgccttgcccggcgcctcacggatggcaaagctctcctcacccatgggactgtagtgcaattaaacccgcgtctaggtgatgcttttaaagttgtagcttcgtgctttgtacagttttctttctggttttaatttttagttgtgctttgagtcagtgcaataaactagactttttccaaacctggccgagtgtggtgcctgagctgtgagaagtgtcctcagccgacactcacgagggcagtgcaagggagaacctgccagcccagccccaccacagggagagtgcgtcagcagacctgtcctggcctggctggtgttgaaatacacaccggtttgcccaagtggctgttatgggggaatggccgctccagagctggctgtaccccatggtagcctctgaggaggacgctgtggggtgaggtccagggctgcctcctcatggagctgtgtgtgagcaggcgttggaggggttcgagcccctggttctgtatcttcagccagcaaacgaaaccatatcgcaaaccagagctgctggaaaccagcacacgcaaaagatgacgcccagcacagcagcaggacacaccatgtgccaggaaatgacctcagcaagaaacctcaggccgtgtgaagagcagcaaagctttccagaaggcataaaaggaaacttgaataaaggaagatatgttccacattcctggatggaggactacacacattatggaaagacctcattctttccaaaggaatttataggtgtagcttgatttcagttcaaatccccactgggattgttttgttggggcaggcagggaggaataatgttagtacccacaaatgcccatgactgtgcccaatgtgcttctcaccagagccctgcaaggggaagtctcattagccccttgagactcagagaggttaggtaacttgctcaaggtcacacagcactgggactggaagccagctctgtagaactgcagacctgtgctgtttgatgcctcctcactgtcccgtcactcctgggaagaagaaacgggtgagaactgctaagtgatgacaggtggagccccagcaggggccactctattgaatggcatggcccagaccctcggagggccaggcaacaggctagcaaggcccacagggagggagcagaatggagagggcatctcagatgcgcttaaggagcggcgggggcggggcatggggggtgtcacaactaatgtggccactgcttcattctctgggcaaaataatattaaatggattaaagaatctaaaaccagtgggaaaactgtctgatttctggatggcaaaggctttctaaactcaaaagtgataggacaagctacagaggaaaataagtacatagatttgatttctccaaaatacagaaatgctgctgggcacagtgatgtgcagttatagtcccagctacttgggaggccaaggcaggaggattacttgagcccaggagtttgaggctgcaatgaactatgatcacaccactgcactccagcctcggcgacagagcaagaccttgtttctcaaaaataaataaatagaaggaaataaatgtaaaaatgctgcaaattaaaaacctcaaagaagggaaataattgcaacaaatgggaattgatgttgaatatttaccttaaaaacctatacaacaataagaggagtgcgcccttcagcagcatgtatacaaaaattgcaacgatacagagattagcatggcccctgcacaaggatgactcgcaaattcataaagctttccataaatatatttattaaaaaccaataggaggagcacttcgagtcgagtgtaagggcccttcacaaaagcagaaggaacactggcccaaacccccagcaccccggaagcagaggtgagatgggagcagcttgggagccccccattggcgccgccctactggggaagccggtccgtacgtaggccttgcatctcgccacctccacttctgtcctcaagaacaagtcctaggtcaagggaaacagcacagcctgtttataattaggaaacacttaaaacagcctggcatttgggaacagccatgttaacgtgagcaaattcctctcatgaaatagcctgcagctattaagaagcacgtgtgtgcaggaagcggaggcgcaggacctcaccgcgccagcgtgaagttcccgggcatggtcatgaaagcgtggttctgtaagaaatcagagggagaaagggagagaagggggagggagacaacccaaacgttggagggtatttgttgtaaacttcaaacttttggcaggtttgaaatttttcataactccggggaggagcaagaggggtgaaaagaaacaagttctctacttgtgatcagcagctggtcatagtggttgcctggagtatatgcctttttgtatcctttgaatttccagccatgtaaatgtattatttattccaaaaataaagcagatttacattttaaaaattca

SEQ ID NO: 662 - DNA, 524032 bp, Homo sapiens
ttgcagacaaagtaaaatttattgagacagacagaaatgcacctactcaggactacagttaagcatttactattaaccaaagagttgtgttcacattccagataagtctacgtggaaaagcattcagaatttactaggtttttgctacatcactatttcatctacaatagggacaacaaactgacactcaggatttgatgggctctcattacaatgctatacatttaacaggaacaaacatcagtgactttgagaaaaagttataaaaagaccaaaaccacccactgtagaatgggctcttggatgttactgtacagcgtggtcaaggtaacaagaagaaaaaaatgtgagtggcatcctgggatgagcagggggacagacctggacagacacgttgtcatttgctgctgtgggtaggaaaatgggcgtaaaggaggagaaacagatacaaaatctccaactcagtattaaggtattctcatgcctagaatattggtagaaacaagaatacattcatatggcaaataactaaccatggtggaacaaaattctgggatttaagttggataccaaggaaattgtattaaaagagctgttcatggaataagaataaaactgttcattaagaacttttcaaaagtgaattagtgaggattcagcttaatacctgtatcaaatgaggaagtggtttattacaatatttttataatcagtattttatgtgtacttggtcactatacaagtgacttcttgtcactggtacaagtggactttttggaggactatttccaagaagaagaaagcaaacattctacttctaaggataaggtaactcattacaatctttagtactcatggaaagtattaaagatctttaaaaaaatcgaatgctgtcatgtcaaagtgaggcatgaaaagtattattaatgtggctccatcgatttgggggttccaatctgaggagggctttttatttaatgttttaatgaatcaaaatatcttcttagaatgtctctgaaaatggcatctcattaccttactgggaactgtctattgagcactcttctccatcattaagttaatgctaaggatctttaagtgtcatcttaatttgatacttgtcataagataattaggcaaattaaaatcagtggttcaccctgttcctagaagtttttctaagtgaaatcaatttttcaattttaatttgttctcttgtacattttcctaagctcaaaggagatagtaacaatggttttctttgatgatctaaagtgagattttacaatgtcgtgatttttaatatacttcatagtaattttattgcaattaagcacctgttttctaaattatctcagttttgttcaagagagaaaaaaaatattgaaacaaaggtgatggagttgagatcccaaaacagagtttgcctatggtctgtcttcctatggggaaagtaagtacaaaacctcagggttatttacgaagccaaaggactttgctatatcaagtagttcatttcttatctaagaccaactataggtatgatgctactgtattcaggcaatgccgactggattggaacatgctaatttaaggtgagttggtacatctaaatggtcaatttgggatgggggattggtcagctgccactataatcatgttttggctgaacatatttcttgcttgagtttatgtggcttttgtgtggacaggctgaagttcatgggggaaggcaagagatagatatgtgggccagagaggcttgcttgggtggctgattctgattaggacaccctgataaatgaaaatcagtggcggacagtagcttatagactggtactgaaggaaatgggggaacttcagagactactgtttggtacttgtatctgggccagcttgatagggagagaaatcctaaggaatgtagagatgatgaccctaccaaatttggaactagactccaatgagtttagttaaaacaaacactatggtgaagaactttcttcattagtatcttgtcacttgggggagtgagggggggacagaatttgctcttaaaaacccagggtttgcttccatgtgttattacgatgttctttgtaggcctccatttgggattgagtggttaaaaaaaaaaatctgtacagcttttgtgcccttatcatgatttgtcagtagaaagggagtaaaagcaaaacattgagttcagaattagaaattttcttcttttaaggaacaccatggtactctcagagaacaggagatatgtgtgcatgccttagaaaaagcccttgagtaggtaaggaaggaagaaacctatggcagacaggattgctgcagccaaggggcttcaagcagaaatgaaagagatggcttgtgaagctgcccgtgtcgtgtgggagtcgcatggcttctgcgagaaaagtgatttaggcagacggaggttttttctcaatcagaggctttcagtaactctgctgatgcacagagaagagacttcctcagcctgcaggctacaagagccaactgttagtgcaaaaaaggactttaatacaaatttcttattccagaaattttgttccaggtctggacaagctgagaaatttatcattgtttttcgagtttttaagatacccaaacactttttctgagaggtatgggtgtgtgtgcaaggcacacacatacagtctttctgtacatgcatgcatatttatgcatgtacagggaagtatccagacaccaatttttaataaaatgaattccccaaagggagtcttgactgaattaaggctgttgtttataggaagccagatataatgatgtgaaaaaaactaatttttaataataatcaccggcagtaacgggggcagggggaaaaagtacagtgtggtgtattttttgtttttttctttttcacaacatctacaggacacaagagaagcacttagacactgtaaggctgggaaccatgctgtaataaccaccagtgtgggtaatcaaaaagggtctttgacatttaagagggttggggctccctgcactgtcagaattccacgtaaatcacatgcttgttggaaaaatctcacagaaaggaaggaggctctaattaagccaatgacttccctatccaaaaaataaacaacaacaaaaaaaaaacacaacaccctttctcccatacaaacatatgcaaaatcagaatcctctgggaacaagcagttgtcttccaaaccttaggtcgggtatagagagcaacaatggagaagagaccttggtgccttggagtcttagatacaaatgcaggaataggaagtgacttgcaattttgtgcaaaacttgtgtcctctttcttgtgggcactaccatatgtacccgacctcatcctctttgtcatcatcctcatcctcatcatcctctgtcacggctcgggtgtgcaccctcagcttcccctctttgtcctttggtcccagctcccgttcatattctaggtcatccagcaggaccacggacccaccactgccaaaatcccctgaggtttcctgctcctcttctgaaagattaaaaaaagcattgaggttagtttccacttatacctcatgacccacgtcaggggttcctttgcctgaattgtagggtaaaaccaagcagtttactttctgaaaacagaaacatccctgccccactgaggtgagtcttcagggcatacattacaaactttgttctcgtaagagccctagaattcttgagatgctcctaccttcccaggaggtttacaaccctaaatgagaagtgaaggcagcctaagtcaccctttgtctgcagcagttctgtctctcttctctggtcatagtgagttcctgccacttgccaagctagctacacgggagctcatgtgatttcagggttactatgcctctattataaacttaatgtatactggagttacctctcaacattcttctgcagagatccttatgcagtgaggaaccacaggccacccaggtcattgtggggctcatgcaggaggccttactcaccacagctcacagcaccctgtttcctggagccagccaactcattcccatatttgtccacacaccagcactgccccgtgctgccgtggcactgtgtggctttgtaatagccctcctcattacaccgaggtatgaaggcccctgggggaacaaaaggtgcaactttaatcagagacatgcagatgatactcggggttaatgcccgtcaacacagggaagagggctcacatgtcagaatatctgctgcagggtcagcagcagaggatggggatggttggctattagtcaaaattacagggcccttaacctttagaggcccaaacgcgatgagctctaaggatgtcagtgtttaaacgggaatgataatagctatcatgtattgaatacttctattctgggcactgacctaaatcgtgcttacatatgtatgtgtatatatacatacatttgcagaatctcttattcccacaactctaagagatacataccatcattaccttttaatatgaaactgatgtctaggaaaattaagtaatcttcccaaggcatctgctagtaaatatcaagtccagcattaccaatactttgcccaaccacataaagtgactccgtgaaattgttataaaactttctatacgcattaactactgcacttggttctgactagtaacaaatgttctatgaacaacaccagtctgtggatcatatggttccaagctattccttgtcactgtcttccagcctctaagaaagaggtaattaataatagctaagtgctttacttgcattatttcatcaagccatgccaatatcaccataaggtgttgctattactatctccctgtttgcaggcaaaaaaaaaaaaaaaaagtgataaactggagttaatttgcccaatgttaagcaaaattccttctttgattagttctaatttttcactttaaatcttgaatgggtactactgatattacatttttaatgtgagaaaatcatatggtttttatgctttatatacttttaacaagatggattactagtggcacaaatttacaagtatgttactaagtgattgatatggtttggctgtgtccccacccaaatctcatcttgaattgtagctctcataattcccacgtgttgtgggagggaccctgtgggaggtaattgaacaggaggtaattgaatcatgggggcgagtttttcccatgctgttcttatgatagtgaataagtctcacaagatctgatagttttgtaaagggcagttcctctgcacacgctctcttgccttccgccatgattgtgaggcctccccagccatgtggaactgtgagtccattaaacctctttttctttacccagtctcaggtctatttcttcatagcagtgtgaaaatggactaatacagtgattgaggcatataattttgttttggtgttttctgcattgtttcttttgaagttcctaattcataaaatgattcagatatgctctagagatttttttataaaatgagaatctcttttttgaagaatttgcccataaaaatatcttgagcctggtgctcattttgagggatgaaagtagcattttgattaatttcctggttttgattttggttttgatttacctgggtcttctgttatcaaaatttggtaactgatagtatccatttcaactaggttttcataattgttataaattgacttatagcagtggttctcaaagtgaggttccaggacaagcagcagtggcaccacatggaaaacccttagaaatgcaagttcttgggccccacctgagacttagagagtggggctgagcagtctgttcatttatttaatcctccagctaattctggtatatactaaagtttgagaaccacaagtttacagtattcttctataactgagcttatatcccacttttaaattcatgacactatttgagcctttttacttcttcatattgtcaaaggtttgtctatttcatttgttcagaaaactatctctgatatggtattttaatatttttacttcactgttgtctgctttcatcttattcactttgtgttgttcctatagtttaagttacatctagttaattttattttgatccttttttataaatgcatttgacgctatgaagtttcacttagttgcttcccatgtatttggtacaccatgctttcattttctttcatttctagatattttgtagatttttctttcttcatctttgatcaatttttattcatgaaaccaaatgtatgggggtttagtaatctcatattttacttctattggtattgtgttgtggccggtaagtttgatctgtgatcatttatttgaaatttgttttcttctgtggtacggtctgtggcagatgtttgaaagactacattcaatgcctagattcaggaatacatatataagcatgaatgctaacaaatcttagtctacttgaactgtaggtttcaggaagtggtatgtcaaagtttctgaaaaccactgtggctataattcgcccttacagttctattccattttaagttatgagtatagtcatgtgccacataatgatgttttagtcaacaatagactgtatatgtgacaatggttccataacattataacaccatattttcactagccttttctatgtttagatataaaaataattcccattgtgttacaattgcctgtagtattcagtacgataaaatggtgtacaggtttatacctaggagcaataggctataccatctaggtctgtgtgagtatactctatgatgtttacacaatgacaaagtcacctaatgacacatttctcagaacctatccctgtcattaagcaaggcatgtctatagagcaactgatggcataatatggtaaaagggatatttcagcgagatgattgcattataaaaaacagatttgctttgtcagatattaatgttgtttaaaaaagagtatttaccctcatttaatttcaactttctgtggaattatttttgtataactctcctttaaaatactaatcaataataataaatgtgtttgacctgttcacatttattgtgattacagatattgtgattacagaaatgcttactcttatttctgccaccatatctgtttcctacttactaagttttctttataccttgtcttttttccataggtttaaaacatatattctaatattcttgtggttactcatattttccacaggggaacatagtttttcctagtaaaatctacagttaatctatacagattttttttttcatgaacaaactagaagcttaacacattcttaccacctttttctcacttcccccaattgtctggaattttaattccaggttgccatataactatttttattggtcttagcagaattgtcatttctttttcattattgcatctgaatagttctttctgggatcatttgtttggtagaataaatcctttagtgatatttaagtgagtctggggttagtaagctgactgaatcttagatggtttcagagtaccagagtacctctgtcatcacacttgaatgatcactgggataaattttaaattgtaggttcataattatttccccttggcactttgaagatactgattctcattgtactgtgggtaatctttatttataatagtttttagttttggttttccttacagggtaggtgtgtttcttgatagtgtgcatcttctatggaagaattcttcctctttgtgtaacctgggtggtaacaccatctacatcagcctcctgaaaacagaggttcctgccttccactgtagctttctatgccctaatttaatttctgattttgtgagcgtgcttacattttcaaatttgccttttatttagtggaacaatcccagaataaaagtgtggcatgggagggacagatttctcctattttgaaccaagacttcaacccagacccaggtgactctagggtctagtctagaacatgctactcaccaggctataccaagatgatcatattctcagagattaaatgagaccatggaacaccatgtctatcacttaggaaaggctgctgatgccacagttagaagcttagtggtatccaccctctcattaaggagtgtacgccattgcatgctatcagttttcaaagaacagtagatagaaaagaaggaaaatgtagatgcggtcagtagcccaaaaagagatttgtgaacagattctcaatcaaggactgcagagaaagtgaacatgtagagagctggctcctccttggaccaaaaaaaaaaaaaaaatgggctgaggccctgggttggtaagaagcaggtgctgctctaaaactacaatgcaataattatagctgataataatttgttgattgttttatttatttgactctgtatacccctgactacataaagaatttgtaagcaaatggcattttttctgagtcagctggagtaatctccatatgtgggaaatgtgataaagcaagctttaaaacaaaatgggatttattttaacagaaaggtaggcatttcattcatgtgcactggggtaaatgagacatcttatcacaggtgacccttaccaatgaggcaatgtatgttttaataaacagcaatgtactaattctacaactacctgcagatcataggtacgtcactcaaaataatatcccacatggagaaatgagatcaataaacaaacacaagtctttgcactagaaaatcctatggaggagggatccagccactttgccttcagaccagaaatatatctttatgtccttttactcagcagaagaatgtaggcctaaagagttcgaaatcctgacaactttggggaagtctacatgcattttgaaataactcaaaaaatcctaagagaagaaaatcaccggaattcatagactgcctacatttgacaatctgcaagaaaacttgcccatttccttctctattcatttccttcaaatgaatagagaaacttctgaaatggcaggctgcttggggaatgcatctgcctctgaatgcttcacgggaataattctgtattactgtgttgcagctgacacctctttttttaaaagcaaggaaagcaaagcaggctcctcctttcttcagcaaaccaatgagaatggccagtgtttctatgacaaatgccaggacttcctccacgtgctggagaaaggcaggcttggagctaaaggggacactttgagaggactgcaagttgtgcatgttaggggaacacacattcactcaacccacttgcttccgtggtgtccaaacagcctgcatactttcctggagggattaggtgaaggtagaaataggcttaagcacatacatgtcgttcaaccctgtttgataaattctgaagagagtacagcccatctgcctccttcaacagacaatcctatccggggaatggaggaaatgctataatttttagaccttatagtttgagcacttgagagcaccattcaatgatcttacttagaaaaagccaagatttgttttagcctaagatcagggaggagttagcagtggggaaggtgctggacttcggccctggctgacctctcttcctgccgaaggaacacacagcagttttcaaccagccagtcctctgtttatgtccagctgcctggaagagctctgcctggggttaaaacaaggcatttctttcatgaaacactagccctaattgaataaccattgccatgctgatcattacaagggacatggctggcttaattagttgtttaaatgagtggcaagaaattgtacttacccaacaggcttttccccttactcagcttctgaattctgttcatttcattctggcaagggagacctaaaaaataatttctgaaagtcagcttccagatggtatggagtataatcgctaatgattgacttcactcttgatgtgaaatgtagacaatgacacacctgggagtggaattgttccatatgctgttactatgcaagaaaacaaattcgggccattagtgttactagttaaaaaacaaacctcataccacaatgcacttaaaatagtatttgggggccacttgcattgcatagaaatttttctttctagtaccaactcaagcaaataccaagtatctaataggtggtgtaatggactttttcctttctatcaggaagcaagtaatcagccaaggcttattagtggggaagtgttctgaatccacagacgaactaaccagaggtgacaaatacttatatagcctaggttttcctgtaggaaaggatggataggaatggttacttcagacctcaccacccccaggaaagtaaaataggctttgagggacaactatgaagatacagaagagatctggagaagcactgatgagactttgtatctaggctctgccacctcctagctgaattcacctgtcccagcctctgggtcctcagcggcaaaatgcatgtcatagaaaagaagttagtttcattctaagcaaaatgaaaagtgacctcattcattcttcagagttttaccatgatttgcctttgcagaccttgtggctctgggagttctgctatttgttcatggttcatcctgtccttggcagaggagttctggttctctgagttcttatctttggctgatactgcctctttctgcaggccccacacttgcatataaagtatctaagcaaccatttacaactcttaccctgtagactgcacaatgctacctggtcttgctgcttgttccatgagagaaactgcttgtaaaatacattttgttgacttcttgttttaagatgctttcagagtaaaggagaaacaaatttcatctggattataaaaggtagcatttcctggatgctgtgccacaggaaggggttctggctttcagcaactgcaagagtaagggcagtctatccagagatgtcccatgtggccaggtgaccagctctggcactgttacctccaggcaagcattaacacataggctctgtgttgtaaggaaaccatgctaaaaatcacatgttacaatacgaactcaaacctaaaactatcactagtcttaatgctgagaatcactacaagtatttacactactaaaatttttaaatggctattatcttaacattgattttaggtactaacagatgtaattagaaaagaaaaatgaggtataaaaattgaaaatgaagagaaaaattatcactatttgcagatgatatgattgcacacccgaaaaatctaagcaaaccaaccagaataacttagaaacaaagcaagattttagtaaggtggttgagaacaaaattaatgttgaaaccaccagggagggaatatagtgcaaaaaaacacctatttcagttacaatggtagcaataataaatacaagggaagtataataattgttagaacaaaatttcaaaattaacaccatgggttgatagatcctgttctaaaacaaaatgattccatattatacagctattgatttttatttgattaatttttcctgatacttaaaaattaccaataggaattgtttttaattggataaactgatgctaaagttcacacagggaaagaaacatactaatatccaggaaaattctagaaaaacagtaatggcagcaaaggacagttctaccaggtagtaaaacatattgtaaaacaactgtgatttaaaagtctaaaactgatttattttatatatatatatatagcaactggatgaccatctccagggaggctgggagcctacttgactgtgtaatacacaatctagactgatacagaatttaagtgaacagcaaaaaagataaagtgagaaatacctttctaagctttatggcttcttagaagccataaaatacagagaagcttggctatcttaaaatttctccctaacaaaaatgcatgaactgtaatttgggaaaaaatatttacaatacctatgaccagaaaagttccaatttccttaaaaaacaaacacacaagaacctgatagaaaaaatatacaaagaacatatagacatttccagaatgtttcatttgtacagatgttcaacctaactcataaatcaagaagcttggtaacgccatagagaataggtattctcatatatctttggtgaaagtaaaaattgttaccacctctttggaggtgaggtcaattgctcaaattttaaaaggcacatgccttttgactagtaattttaagaacatatcttgaaatcccatacacacatacttacctttcactgaatacccacgttttttgttgtgtgtgtattgtctatgcatacataacttaaatactttcatattagcagccatcctcctttcctggcggtgggatataccagctatgcctgtagttgtatgttctcccgatgtgggcctgtctcttctggtcccattaactgtgactgccatactcaggtgcaccccccagacagagggaggtaaagtcagggcacctgccactggcttcctgtccttaatctgaatcccccagcaggccaacctgtctgactttgggttatatgaaatatcctggtatcttttcttctattccccaaatcttgcctctttttttcattagctggagtttatttataaccaaaatattcttgtctaggacacttagtataaatctgaacttatcctagagaaactgacaagtgactttctcaatgagaatgattttcattgtctcttacatttttaaggtattttttacattgagagctcacagtgacctttggattatgtcatgaaggtttctatacccattgtatagatgaaaatacggacagttgagagacttccccaaagggaggaacagacagaagtaactgactacttgatttatactcttggtttttctagtataccacattaaaagcagaaataaactggaagaaatgagactttgggcctggcattaaatggaatgaattatttattctctggctgtggctctctgcccaattcatagtcatacgcagtcctcctctgctccagcaaggctgccctgggctagggaccccaaccctccatcccaccttacctccaggcttctggaagcagtagcaccactcattgttagaaagcttgccatccttgaaggagtcacacgagttgaaaagaggcttgatacagggctcgtacttatccaggtagatggcattgatctctgaagggtcaagcaggaggtcatagttcatgtccaacttgttgaacatccagcccagggagtccttgcagatgggcaggatgctagtgtcaaaccctgccaaacaaaaggcatatctcagctgccaccaagcctgatgctttcctccctgctcactccccagctttctgccccaagaagatgccaaggcccacctgactcccttcctgaggctgtttccttcccagcatacagatttagtggttctctagaatattttgtgtttttttgttttgtttttaagtgaaatggtttaaaagtcatcatttgaggaaaatatgttctaaaggggaaaaatccccaatgttaacatatctgtgatataaatatgtgttttcatttgcttaaaatggggtgtgcctgaaagaaataatagaaacatggtgagtgagaggtatagcttatggtaccaaaaactatgctttcgtatttcaaaaaatactggaaaaccaaaataaaatatttttaaaaggatagcagtgaaatgaaacaacatagcataatccagaagcaccgcttgcatcccagaggacctttaaatccaagcagtctgaatgttaatggcaaaacaagccaggtgcctgcctctgttccccactcttctcttctgcaatcccctaaggagatccatgagatggaatccaaatcaactcagacaataatttctttcttatttccctgggggagaagaagttgttttcttaaagaattatttgtttccacaatggaaagtgtatgcactaaaataataacacttagctcaacactcgggatattgagtctactgtagacatgtcccagatttaaaactcaacttttttcagaatcaaaggtcccgtgcaatctcaggttattccataaactggatttctagggctagttgtatttttctggaataccccaatgataaaagtgaacgtctgttgctatatagaaagcatgcttctaagcactttgtacttaattttctcactgaatccttgtaacagtcctatgaaatggtgctatatcattcccactgtacagatgaaaaaataaggctcaaggtcatacaattgtagaatggagattcagaccccggcaagcttaatccagaatctacatattctcaatgacacctctgctagccttctgcctgacttgatcttcctgtcctgaggccatccagttggcctagagtgtcacgtttagggatgggcagtgcaagggggggcctgatggggtcagttgcccatcattaagcattaatgacagcctggtcattaagtttctatgtgaatcactaggaaccctttcttagtgaaatgtagaatacagcaaaatgtacccactctttttttttgagacagagtctcaccctgttgcccaagctggagtgcagtggcaccatctcggctcactgcaagctctgcctcccgggttcgcaccattctcctgcctagcctcctgagtggctgggactacaggtgcccgccaccatgcccagctaatttttttgtatttttagtagagacagggtttcaccgtgttagccaggatggtctcgatctcctgacctcgtgatccacctgtcttggcctcccaaagtactgggattacaagcttgagccaccgccctcggccctgtacccactctttaaagcagcatctttgcagaaaagtcttcactgtctagaagccagtaaaataagtacagcatctcctcctctgagctctcttataaccctatgcttcccctcattgtccatgcttgttaatcaaactataggctccctgagggaaaagactgtcttgtccccttcagcagcctcaggcatgacaggaatatagtgctcaattaaaaaaaaaaaaaaatgttgggagacgttttctagctattgtaaactctattgctttaaaacataaaatctttccatttttaaatttattcaatatcttagaacacattttaaaatacccacccccctctttttttttttccagaagagaggctacgggacataacgtggccccttctttgatcgaatgtcatgattgtcaatagtctttgatgatgctgtccctcaggggctgctgaatgagagataatttactttggcactacacagctctatgcttttgtaaacaatattttacatacatcaattttataggatatcgatattttaatgcataaggcaagaggagtttactgctgactggtcggcaaaaagaagtgccaatctggttgggcagtagtcaaaaagtcaagcgcagcccaccctaccactactagaaaaggagtgcctgcatcttgacatctgtggttgcctgtcatgcaggagaaaggagagcagcccttctagttggccccaagagtgcagggaccaagcagggttccagggcttccccttcagaactcctagactcaaatgccgctcactcctctggccttctgggctaaccaacatcatgctttaacattcccttcactccagttgcttcaggatatcaaacctaaaagcctcttaggggactcaatttgcttttgggcaaaggcaggtcttctggagaaatctccagagactggaggctgcaagcagctgctctcctcacatcaatctgcttttgttgataggttgttcagaaaacccaagggtcaggctgctcctagaggatccaggggaaaaaaaatcttattttgcttttccaacagacccaaccaccaagaaccccaccaagaaccactttggagacacttaaatgctatttttttcttaaggtaaaagatcccaactactaaaataattgtcccctggattgatgttctccactgatatctctagaaggctatgagcagccaaaaataactaaaaattaagaagatcatttttgttttggctgaaaaccagatgctagtcaaactcgggatctcaacagttgctactctaactaacttcttacctactgcattcaatccaggagcattactttcagaaattccaaacaagcaggggatcaggtgaaatgctgttttaaatgatgtgtttttatattttgaccaaataatatcagaatggctacatagagaaggctgtggccaaactacatatatcaaataattgtgtttagtaatctattctgtgctcattggccacagtgtggagaagcctatacctaactgcctttgaattaaaggcatcaaagagactccattgatgtgcaaatgtgaggacccactctgagtgttctctgcagcttatgacaaaactgagtatggtctctgccaactcagcacctgatgctggcgggaggctccttgagcaatctgcatgttatggatggggagaggggacacctgtctgggagtttctgtggaagacaatatgcagtctgactattgtacaaaaagacatagcaccaaagatgtttgctacagtgttacttctattagcctaacattggcaacaacctcaatgtcccaaaataaagatcaaattaagtaaactgttatctccataaactgggattctgtgtagctatcagaaagcagaatactattcacaacatgaaaagatagtcacatttctacatggtaaaagatcataaaacagtctggaaagtatgatccaaactttgtaattatacacacacacgctgtttcatatatgacaccagaaaaaaccttaaagtatgtaccacagcatgcttacggtcattaaaatggtgagatcatatatttttttcaaaatgcctatactaaacattttttaatccaacttttttttgagattgggacatatttaaagtcaaagtatatatttaatgtaatgggtgtttttcacccccaaatgatattgctaaccctaaatcaatgtctaataaattgaggaaatgtgatatttaaaatggtcttactgccttgggctgtgttggagctggtgggcttgatgactctgttcgcatcctcgtggagagctccaaaccaatccttcagccgggaggcaaggttccgcaactccttgtctgtgcaggctagagaaaagcaaacagaacagacaatggggctgggggctttctgccttctgtgtgcagggctactggcaaagccacgttcaaagcaaacctttctatccaaccacgatataactgttacctcacgtggaaaacaccccaaagatgctgttagtacaaacaaagagtgggacaaaaagagagcctagacccccagggcaagcagcctttgttcagaacttgaatttggatggcctctgtgctgtgaaagcaagctgcagtggtctcaccgttgtgtagcatcctcagaagacagacaatcacagatcacttttgctaaccgcataaagcttgctcttgcagttttgccagaggagattacattttccactaaactcatgccaagagattaacacccaggcacagctaatgctcttagagagaggctgcctaggacaccaaaagatcctattaatagcagactcctaattttgtcttagcccaaggtttggatttggggattgggcctattttgctagccttccagtggtctcattcttgactttccactgtaaacagatggatgccttctccatgaaacagtcctttcagcccatctataactatttagtcatttcttagggtaagacagaatcactggggcagacagatactcctgagaacaagaaaatccagacagatggatgggtgggcaggtgagtaggtaggtgcaagctatttgaaggtcttgtagagtgctaaaacttgaggaaagaaatcccaaaggaataaaaatggtgcagagaagggagttgactttccctagcccctccctcttccctcagggcatacgctaattcttggtactgagaaaacctgcaaagggtccaagcagtaggctgctaccaagacctagagaacccagcaatgcatttggggtctttagtatctggagagacagaaatgaaagatctgaggagtcaaaattccaatgagtaaaagggggcaaagaacagagccccacatctgtaacttctcccatattctaaagctacaggagcacactgctaaggagttaagcagaaatgctgttacaaggcacagccaagttctgaatatctcatggtgctgaagagacacagattagggctcagaacctaccagtgcagagggagcctgggggaatccctggggtcttcactggaagccatagggacagtgatgaaaaaggagtagacacagcctcaccaaaactccaagctagccttcaaccaacgcaggacctgattgaattaaggtgatcagcccccatcggcctgccttgcaaaagactaggtgaaacttctccagaagaaaataccatgcagatcctctcctcatttttatcatccacatatgcttatcaggcaagcccatttctcaccctaaggcttgatggagaaccgagcttcccagagctcaggcagaaaaggtctttccccaccctccatattagaggagaggtgaccaggccctgactgggtctctgcaacctggggactctcatttacgacgctgccttctgtccaggtaggatccagactctacactctgcaaagcatggaatgaatgcatgtccagtgtttataccccagtttttaatgaccttaaaacactgccttgcttttaataatcagggtttggctgtattttaaaacaccagccaggaaacaacactgagaaatgtctcgacagggagcaaagaataacttctcaggagtcgcgctggctggaatgaatcccagctttgccactcactggctgggtgacctgagacaagtcagcctccagcacctcggcttccttatctgtaaaacttcggataatatggttatataagtataaatcagacaatgtatataaagttcttagcaaagtacatgatatatggtaattacttagtatgtgccacctatgattttgattattattactattgctatttttaaactgaacatttataggtaacattagggctagcatcacagcattcagaaagccaacaacaaatccacctacacacaactggctttagccacataaaatagttgcttgtgttatctagtaagctgcaattagccatatatggctatttacattaattaaaatttaggccaggtgcggtggttcacgcctgtaatcccagcactttgagaggcagtggatcacctgaggtcagaaggttgagaccagcctggccaacatggtgaaaacttgtctctgctcaaaatacaaaattagccagtcatggtggtgcatgcctgtgatcccaactacttggaaggctgacacaggagaatcgcttgaacctgggaggcggaggttgcggtgagctgagattgtgccagtacactccagcctgggcaaaaagagcagaaactcagtctcaaaaatcaaaatttaaaaaatctaatagatagttcctcagttgcaccactgcattcaacagccccacacagctagtgacctccacactggacagcacagacgcagaatcttcccaccgcagcagggtgtcgtgctgggcagcactgaatcaggttagcgatcattttgggctaactttctggagcatcatcatgatattctgccatccaagtttgttcccgtacttctccccttcaactgtttaagatgagctgagaaagaagataagcccccacaagccaggaaccagcatctcttgctaagccatgctcccaaatagcagggaaggtagttgtttagttgttatgaaggtggagaatcctggcttagcccaggtgccaaggcagatcctcaggagcaggccctcccaacacacttattggatccaactcagaacctcggggccctaggttttcacttttctgacactgccctgctctaagcaggagagaatgtggcctgtttttctgaggaaaataggttgtgcattccgtagtcaatttcacatttgaaaatgggaaactaatagcctctattttttctctattgccatgcgcaccatctattctaaatgttctctgaacagagaaaattgccaagtcaacatgcagaggaaatctcatgcttcaagatgaattagtcagtcgtgtttaactaaaccctgacagatgtgcaggtaatctgtatctttacaagactgctagattttccacaggctccccaaagtacacaagtcttggatgtctgatcggatcaggcactgaaatcctgaaagaatgaatctgtcactcagggacaagtccactagcagggagccactggtgtgggtcgagagagatcagaaacccgaaatggaaagaggaggctctcagttactgggccctgttcactcacaaggtcttcaaccgaatggtctgtatgagaagaaagtcaggcacaggttgcctggagcttgatacatcccaaagaaggaaataatcaaaggcaacagcctgcagagggctatttgttcaaatttggtattctagccacaacacacaggctggtgatgggagaaaagtgcctgccttttaaggtgctcatcatcgcccccaataaaggtgtgaacaggggactgaagctttcagaagtggggacccagaggatacatcccacacacttagtacattcctagggaaaagtaatgttcgtggggtgaaaaatatagtcatatatccccctactattctggtgccattctggcattctaccctgtggcaatcccggcaatttctggagaggggtcctggcgagaggagcagggcacttgggctaccagcatcagactcttcagaggaaaagacggtgctttcttgggagaggatttggattaatcacgaagaccaagacctgctttcttgtgctctcctcaccctcctggatggacacgtgccagctagccctctaattctcccattttcaattacattccctcccgccctccatcctggtttcagcttgcttttcattgctcttgtgctcccagttttcttctcagcatcctactgagaggtgaagccagctagacttcctgggtcgagtggggactcagagaacttttctgtcttacaagaggattataaaatgcaccaatcagtgctctgtaaaaatgtaccaatcagcactctgtagctagcaagaggactgtaaaattaccaattggcaggatcctaaaagtagccaatcacagggaggattgaaaaaaggacactctgataggacagaaatggaacatgggaggggacaaataaaggaataaaagctggccaccccagccagcagcggcaaccctctcggttccccttccacactgtggaaacttcgttcttttgctcttaacaataaatcttgctacctcttactctttgggtctgtgccatctttaagagcagtaacactcactgcaaaggtccacggcttcattcttgaagtcagtgagaccatgagcccactggaaagaaccaactccagacacactacttctcaatgatgtttccccatttaccctactgtttctacacgttatgacgtatcatttttacacaatctccatctgctccaatgggctggtgtgtgagccacgtctctgggatccactccccagcctcatatctgcttcttcccatagtcagaaaatggtaccagcaaatactcatatattctcagggcaaacacttgggaattgtcctggttcacagtgaaaaagttcactgcttcttatctccactgcctctattctagtctccaatgccaccactacctcccaccaggacaactggaacaggctcctaattggtctcccatcttgccccctccctcccccgccatgttcccttctccatccagcagccaaagtgatatttccaaaacggacatttgatcaagtcactctcctgtttgagacacttcagaggctcccagttattctgtaggttaagtctaaactccataatgtgagctaaatggcctgcaggacacactcactgaaaaaccaaatctctcttctgtatctgctcctcctcaaccttcacgctctggccttactgcccctccgacatgctcttctattgggaaacaaacacctcttcccactgccttgctaatgccaattcctccatcagatcttggctttaaagtgacattttcttagaggacttccctaatcctcaaacttgagatttctcttttctatgctcccaatgccttgtttctctgatagcattcataacacccatctcgttcagtgcccatttctcccctagatcatagcaacataaaacatgccctgactctgcccagcactggggacccagcatctaacccagtcagttcctggcatgaagaaagttctcaatacacacctactgactgaatagaatcacccttttactgccttttgtaaacttcaatttttccatctgcaaaatggtgtaataaagcttagctcatagcatcactacatggaataagatgagacaatattagtaaaacatagctcacagctactggcatatagcaggaactcaataaatttatgttccccttctcatatcccaactgtctgcataatatgttagaattgtattgttgtgcgttttttaagcctgaggagatgcttgtgatataaagaataacatctctccttattttatacatgggtcagtagaagtccaagaaatacaggttgcaatatctgtctgctgtggataagttccaggattgggagattggtctgacttccccacacccgtattcttagcacttgctctaaggtactatgtagtagttgttcaaaaatatatttatcactaagtatattttaaatgaatgaacaatagatcacagactcccaatgtcaaacagctattaagtggaagagacaggatttgaatcaggctgtcatcctgctgggccatccccacgtgcaggacttacttcctggatatattggtcttgtgggcagccaatactaacctaacaattaatatacttggtccatactctgggttgaaaaaaatcaaaatatcaggccttgccttgcgtaggaaactctgccaatgatgcaggtgaggtagctagctgagcaatataggatggagggagagcaagtaggctctcacctttgttagctttggtgtgagaacaatggtcttttggaagaactgcgaacagcctgctgcctgtgtcacatgtgtggccactggggcttcattagagaaaggtatagtgccattgcacattactccaaaatgtggaaaaagacagctctctcccccaggaaagcacagcactcaggcagagaagggcccaggtaatttggtgctctcccagtggacttttcctttctgtttggaaaatatgaacaaaatgcaaagagcaagtgtaaataaggcacgttcagtctccatggaaagtacatagccctgggaagaaaacgtgatcgctctccacctggccacctttgccccctccacccaaggcatggagctttatagggctttaagctagactggatttgaatgcagacagtgttcaaacatagcttggagtgcagcatgaggaacgcagctgatgggagggagaaggaggcattgttgtcaatactgtaggacagagaagctgctccagggttaccgcagccttggtggggttgtaagggggaaggggagctctaagttattagtatttgcttatgtggcagttagactccccgggcagtagtctttggaggaaagaagggttgcttcttacctagatgagtgtcagtagtctggctctgcctgtaccccgggaccccattgtccccttctccctggcccctgtgtcctccctcagacaaaaccaggggctagtgaagagctggtgaggaagtttcaaaacaggtaatggttttgaaagtggagaggtaggagctaggaaatccaagcgtctttgaaaaatgctcccaaaggctataactggtgttccacgctggtctcagctcattgatgacttcaagggctgaatgacagtctgaaaagccctttctgaggatttgacaaaaacggggaagaaaaggaaacaatcagtgggataaaaaacatttgggagatgagataaaaaatggaaagggagacagaggatagaaatcctttattcaaagctatagtgttactatctaatagagtaagaagtggcgagcaagtgtgagtgagcgtgtctctgttagaaatcctaactgaagccacatttgaacacccaattggggatgtccgaaaatggcaaatctgacacacaggcatcacaggatagctgtaaacctctgttggggaaccaattactggtatattcttgtaatgcatgaaatctttcagctaaagaaccaaaggataaaaataaccctaccctactcctccccttctgtcacaggaccagcccccctctctcaggcaaacctcaccaatgcgatctcagggctctagcagaagcaaatatgaaaacaatcagaatttagtttaaactttagtgcctccgaaggtgattaaggagttgggcgagactcaagttctctttgggagcaagctcggaggcctctcagaaatggagacctgatgctgattctttcaaactaatctccttcagccctcctaggtgctgttgtgaataattacttaatcagagcagccctggatcaacgtgctcagagtgtttgcaattagtagctcctgtagaaggtccagctgagccttccttagagcagtgatgagttgagatgaaataacactttccagagtctgggttcaagcaaacacaagggtgccttcctgaactgccttgcctgggttgggtctcttccctccatcatggcattctcaggctgctggaagccttcagcagcaagtgtctgtctcccagtacagcatggtaggctcctcctcaccaacagggaccatgtccctcctgtcattcaatatctaagcaaacagaaggtgccccagtgctggaaaaatgtgtaggaacaccaaggagaggatgctacatgccatgggagcatgaatgtggagaaggagtgagtctacaattcccttaggaatgtggaacccaataaacttgaatgcaaacaggtgaagattgattctgcttagcacagtcattctgccttaaaagcttaaaaacaggagagagaaagtaggctctgggctgggcatggtggctcatgcctgtaatcccagcattttgggaggccaactcacctgaggtcaggagtttgagactaacctggccaacatggtgaaaccccatctctactaaaaatacaaaaattatctgggcttggtggcatgtgcctgtaatcccagctactctggaggctgaggttccagtgagccgagatcacgccactgcactctagcctagaagacagagtgaaactccgtctcaaaaaataaataaataaaaaataaaaacaaaaaataggctctggagtcagggctgaacgcagatcccagtggtgccatcctcgctgagactacggacaggttactttttaatcttcagtttcctcatctctagaatgaaggtgataacagaactagtattaggaccacgaggagaatgaaactataatagaatgcacttaagcactcagctccaggcttgccatgtggtagcaccaggccacactcagtagctgtcggctgtgatctgatttgtgtttgtggacacagagcagcatggtgatccaccaaatagaaaagtataggaatcaaggtcatgcatgtgatgttttcacaggaaatgaccacaggaagccatccagcaagataggaatctcttctattgcttttcagagaaggtggatgatatctcccaggtcctacggatggtaaacggcaaaactgaattcaagcccagctctctcaactagagtttcactcatctgctcatctatgacaaccccattctccccaagaaaatacctcctccacaagatacagaccatgcacttgagtgcaaggttgggacccacactccctcagacttccagctctcacaaccctcagtgtacaagttgttgctcttcacgcaagcccttgctcttctctgatcccctgctttttcatctgtaaaatgggaataatgtttgtggtgaggattttgctttcaaatactgacaggcagccactatttcttctcttccaaggagcttcaggggctgggagcacttacccttgagaggctaatagataataagctccttgccataagcagttttgtaatagaaaacacaataggagcttactgaagggatttaaaaaacatatacaaggtgaattgcctttctaattggagatcatctaacagagatctttgagccaggttatgcctgctcaaattaaattgcattatatgtaattccagcttttacttttcactgcctaaaacatcaatatatatgcgtgttctcttatccttagagaatgcgtcattttatgtaaaaacaggcatgagcaaaggaattaggtgccattattcaggaacttgctaataaagtctttaaaaagcaatctttggaagagtttaaaatactgacattaaacttggaataagatgagttatactaattaatggtacaatctacaagcaaagatggataaatttccctattaaacccattaagactattctaggtaagctgatttgaggagactttaatgtttcccttgattctaatgataatctttcatctggaaaaagaaacatttagaacttgcataataacatctgtaaatgtgcattagtggagtaacgcttattttttttttctccctgaataatctagatcagggaagttagctagatgaaataagcttttaaagcttctgataaaatccacagccactttcacactctggggccaaaaaaaaaaaaaattattggatatgcaaaatattggtttaaaatgccaagtctggctttagctgtgctccctagccagtgggtcagcatttccctacatgggagacttgaaatcgattagcagcatcatacccagcagttttactgaaggatttcatggccaaccagactttttaggccctcaactaataaagactaagctgcagaaatgacaactgctgttctcacctaaaatcagcaatggcaaatgctctgagatgagggtgtaaaacaggctcaacctggactactgagagagccatgggggaaggggaaggacagagtcctgggaaaggggctaggtgataatgcctaattccttcatgggccatcccactgtggagagccagactgagtgtctgagagtcattttgccttttgttaatgtatgagctcaactggccaacagcagtcagtgaaggcttcctggaggaggcaagaattgaactgaggctcatacgcagggaggacttagagacattctaggcaggccttagaaataatgaggagcccactttgaataaagtgatttatttttaatgctctgctcaaattatatataccatttctaaatcataaatgtatataaaatcataagttggggccaggtgcagtggctcatgcctgtagtcccagcactttagaaggcccaggagggtggatcacctgaggccaggagttcatattagcctggtcaacacggtgaaactgtctcaaaatacaaaaaattagccgggcatggtggcacacgcctgtaatcccagctactcaggaggctgaggcaggagaatcacttgaacctgggaggtgaaggttgcagtgagccaaggaggcaccactgcactccagcctgggtgacagaatgagactctgtctcataaataaataaatcataagttgtataaatatgtatatttgttctgcatatctgtttaatctattccactatattacataatatatatgcatatatacatctcaagggatgacttctgacaaaggtagcaccgcttgttccagggccaatatatgaacttttatatctgtaagaggttgttgacagaagatgtctttttagggtatgtacaagtctctatttctaatgagcaatttgtgtccagtttgacctgctcagattcaacatccaaatctaggtattattgaacaattttaatttctatattttttccatcccagaagcatcaaaatatgcatgtatgtttttacacttaaacatgaggtaaacttaaattgttatttaatggagcagaaagccacaaagaattggtggaggaccaagcctgggatttgagatcagatcctgaaggtgataggaagcttaggaggtgtccagaacctgggaatggctcttttatttgggagtgggaggagaacactggtacactttcattcacagattacatggggaggatcaggcatagacttaaaatgaatgcagagaaccatgagctccttttaattccccccactactccaccattgccctggtttagagtggatggtgccatggggatatgggttgatggaagggtggtagcattgactctttcttgcaacaaaggtccagcagcatctccaggggtgccagagtctaaggtaagatggtggacatcgagctggagttgaaaattcccacttggaattgaggccagaacagaataatcctggagatgcctggaccagatgcagcaggacacctgcattatcatgcttccagtgaacaagctgatgaaggaggaagatagataaatgagggtctagagacaaactgcctcctgaaaccataaaggtgttttaggctattccaaatcctgcttgcttgggtgtacgacttactactcttctcactcttcaggtcatgcaagtctctcaatcatctccccttctcctgagggcatgattaggtatagtgacttggcatgaaaagtagctggcattcaagcctcaagtgacctcctctgggctcagagaggatcgtgtgactggcacagtgataaaatgtttgctattattattatctctatttctagtaaaactgctatatttgatctacatttcctatttagagatccagtatctaacaacacagcatgacatagctagtaatttctctcttcccctcctgaatgtcatatataaacaacaatgtacccaggaaaaaaaacctaaattttattttcagtaaaactaggagatatatccccaggcttgaacagtacaacagaagccacccagatggaagttaaaaggtccaggtggaccaataaaaacacaatgacccagcaaaaatagacttcctacaggcaaagagctccttctgaagtgatagacttcttgttcagcaagaactaagggatctggaagaagggagagtgcacagattaaacagaagctgcacaggaaagtaaaataagggaaggaagaaaagagcaaaatggcctagaggcagcagatctcagagagcatctacaaaattattcttcttgtaggcaagaggcttgccataaagtaccacttgggtctggcaagaaaattagagacagagtgagcacagctgataagagaaaccctcttagacctgatctgtttcatagaaacagaaaagataggaccatacagaggagccatttttataggaggccatctgtcactggtaaatccctgaagcaagtgcctttggagtgtgaatctataaagatagcctggttcttccccttccatccacaaggcttccttttgaataggtaggccagtaacatctaacttattccaataatagcttttttttttaaaggggctggcaagttgatttttaaagtgagttacaaaagagcagcattgcatctatgttctaggttttgaaaaaaaaaggaaaagagcaaaacttaccacagaacacttagcagaaagatggaaaagacgaacatgtagaccaagtataaaaccatggattaaaatgaaacaatcacctttgtaaagaaagacaacaaagcagtattcaagaactcaggggagagataaggagtcaatgaggaaatggtatggaagcatttagaacccaggggaaaatgaagccaaagtggagaagcacaagggagaacagcacaaggggaaaaatacaagagagaaggatgccagaaatgagaagagtgaacaacatgaagaggaaataaagaaggaattacagaaggttacagagtaacatatagctatagagaagagacaaaggaaaccctatatatggataactgaagcctctgaagaaacaaaagacaacaatggaacatgacataatttaaaatacaattcattaaaccactccagaaataagggtggaatttacatgtttaaaaggcacagcataagctaggaaaaagggaccgagaacggtcaatactaagatctacctaaataaagttactgggttttaaaagtaaagaaatatctggtttgtcaaagatcagatggttgtagatgtgtggtgttatttctgaagcctctgttctgttccattggtctacatgtctgttctggtaccagtaacatgctgttttggttactgaagccttgtagtatagtttgaagtcaggtagcatgatgctcccagcttcgttctttttgcttaggattgtcttggctatacgggctcttttttggtaccatatgaaatttaaagtagttttttctaattctgtgaagaaagtcaatgatagcttgatgggaatagcattgaatctataaattactttgggcggtatggccattttcaccatactgattcttcctatccatgagcatggaatgttttcccatttgtttgtgtcctctcttatttccttgagcagtggtttatagttctccttgaagagatccttcacatcccttataagttgtattcctaggtattttattctctttgtagcaattgtgaatgggagtttgctcatgatttggttctctattattggtgtatatgaatgcttgtgatttttgcacattgattttgtatcctgagactttgctgaagttgcttatcagcttaaggagttttggggctgagatgatggggttttctaaatatgcagtcatgtcatctacaaacagagataatttgacttcttctcttcctatttgaataccttttatttctttctcttgcctaattgccctggccagaatttccaatactatgttgaatagtagtggtgagatagggcatccttgtcttgtgccagttttcaaagggaatgcttccagctttgcccattcagtatgatatttgctgtgggattgtcataaatacctcttattattttgagatatgttccatcaatacctagtttattgagtgcttttagcatgaagcattgttgaattttgccgaaggcctttttggcgtctattgagaaatcgtggtttttgtcactggttctgtttatgtgatggattatgtttattgatttgcatatgttgaaccaccaaaaacaagcagtggggaaaggattccctatttaataaatggtgttgggaaaactggctagccatatgcagaaaactgaaactggaccccttccttacacctcatacaaaaattaactcgaaatgaattaaagatttaaacataagacctaaaaccataaaaaccctagaataaaacctaggcaataccattcaggacataggcataggcaaagacttcatgactaaaacaccaaaagcaattgcaacaaaagccaaaattgacaaatgggatgtaattaaactaaagagcttctgctcagcaaagaaaaaaaaaacctatcatcagagtgaacaggaaatctacagaatgggagaaaatttttgcaatcatcaatctgacaaagggctaatatccagcaactacaagaaacttaaatttatgagaaaaaaacaaccccattaaaaagttggcaaaggatatgaacagacagttttcaaaggaagacatttatgtcgccaagcaacatatgaaaaaagctcatcatcactggtcattagagaaatgcaaatcaaaaccacaatgagataccatctcaggccagttagaatggcgctcattaaaaagtcaggaaacaaaagatgctggagaggatgtggagaaataggaacacttttacactgtgggtgggagtgtaaattaattcaatgattgtagaagacaatgtggcgattcctcaaggatttagaactagaaataccatttgacccagcaatctcattactgagtatatacccaaaggattataaatcattctactataaagacacaggcacacgtatgcttattgtggcactattcacaatagcaaagacttggaaccaacccaaatgcccatcaatgatagactggaaaagaaaatgtggctcatatacaccacagaatactatgcagccataaaaaaaggatgagttcacgtcctttgcagggacatggatgaagctggaaaccatcattctcagcaaactaacacaggaacagaaaaccaaacaccgtatgttctcactcataagtgggagttgaaaaacgagaacgtatgggcacagggagggcaaaatcacacactggggcctgtcggggggtggggggcaaggggaagaatagcattaggagaaatacctaatgtagacgacaggttgatgggtgcagcaaaccaccatggcacatgtatacctgtgtgacaaaactgcatgttctgcatatgtatcccagaacttaaagtataataataaatacacacacacacacacacacacacacacacacacaatcaacacagtagcagaaaagatacccaagtaacttaggagaggtaaaaggaataagtctgccctcagatttcagcacggcaatattcaaaagaggaagtcaatacaacaatatccttaaaacagccaagaaaagaaagttgaaccaaggattttacatcaaactgtgctatcaataataaatacttcaggaaaccagttctatacagttaaccaggaactactgttctcatgagcccttccaaaggaaatactagagaattgtagacaactgtggtgactggagtgacagataagaaggcaaatgctacataccctgtcaatgaagaaatgatacaaacaacaacaaagaggggaagggaggaagaagatgcaaagtacaacaagtttactgatggccttaaacataatagttggagtcagatgacagaattaaaagctgagtaatataatattgaacatatttcactgaacaaagattaaaccctaagaggataattgtatcaactatgatcaagtgtcaggagaaatgaaggggaggctaaactgggggagaagggaagagagagaagaatcatattaattttatcactgttttaagtgagaacattcctgaatatcagaagaatgatacacacacatgccctgccacacaatattaaaaaacgtaaaggaaaatatggaaaaataacagagatgatagtactaaacataactttttacttcgataagtctaaatgagttaaaattcacctctcaaaagaataagattttattttcagaccaggtcacaaagagaagcctaactccatattgatttttacaagaaatataacaatggcaaagtgattcagagaggttgctagatattttgaccccaaaatttcactttgggactaacacctacagataagcatataaatacatttgaagtagcatgtataaggctatctataacagcattatttgaaatagcaaaaggctggaaacattcaaatgtccatggttaaatcaattatagtatatccaccaatggaaaaactataaagctactcatatgagatgcaaagatctccaagagaggtcaaatgaaagtgcagaatagtgtatattctatactatatatgtgttaaaaggtagagagataatctgtatttgcatttgtttctatgtgcatcaagagcctcttcaagcatacacaatataaatacatataaatgagtgagcaaaggcagtgcagggtagtagccctgaggtgggagaaagcttgagtgatatgaacataagagacttgttagctataacccaagacagtttgcaccaatccatctgttctcatgctacacactaacatttttcttttaaaccaaaagggagaaaataattcctaaatgcaggattttttaatcaacacaatctgtgtgctgttctccattctgccctgtgaccttgggcaggtctaaattcaattccagcactccctaaatcagacactctgggggatacaaagatgattaagacatagcccttgcctggtgcttggtctcccctctcctaatttgtaaaaggagaatgctttccctccactgagttggtggaattttaacaaggaagacacagaccctctctctctcagaatcctccttcctgaagaatcaaggtttgcttcaaatatgtgttcacctggggaatcttctcccaacacccatccaagaagagtctacctccccctccttggggtgtccccagggccctattcatgcagttctacttttccatgccatatcacaacctgctgtctcttttggactctgaggtcagatgcagtaagaattctgcagtagtcacatctatactcgcccgagttccctgcagagtgcctggccaaaagtcggcatcaatatatgtttacaggaggtgcaaagggaagaatgtgaatacttaagtgaaaacgctgctccaattaccataacagcaccaagaataaacatgccaaacaggtcatggccagcatgtacgtttgaggatgttgtggagagatagagccaccatggagagggataacttccagccaaacagaaaatggacttgcgaggaagggaggggcagggagaaatgcatgtgtgtgggacactatgatgtagcacagataaaaagacacatattgtctcagtgaagcctcaggatgtcctgggagggtgacactatcatctctactacatacctgagaataccaaggtccctaaacaggctagggggcttgctcactccagcctccagttccctcaccagcacacacataaaggccaaagtgaacatttgacaccaggacaaaataactcaaatctgtgctcttaacttcacccatgctgactaatttatgaaaaatatggcctaattcttctaccacagatatcacgccaacatcccttgcctgagaacaggaattaccaggtacctaccacatgccgaaattgggtctctgggtttatagattgttgctatcccaccctgataacacctcagaccttagcttagcctggtagcagcctgaggtccctggaatgtcattttcatgtttcttcgcatattgtattgagggatgctagaacgattgtacacctagcttgttttgcactggcttctcattcctgtctggatagttaccactaagtaatttagtttatctgtgtctccacaagcttatttgaaaaccatggaacgctgcttacagaaaattaagcttcattttctttaagcatccagccaatagcgcaggcaggagatggtgatttggaggtaactggcttatgcatatgtaaacatgatgcatttagcaaattatatagacttcgcacttcagagcattgaagaaaacaaaggtaccttccaaagaaactttagtgcaattgagtcattctgaaaggaatacagaattactggtttgtgagaatagttgagctcagatatgaatggaaaataatggtgtggagcacaggcatagacaagaatttgaacagggttaattttaggtggtattacggcatctctaaggactcccaggaattataccccataacgtgccttgagattgaattcatggtgtaatgaggttgtatgtttcagactcaattccactgtgactcttcatgctttccacaatttcccagcatgtttttctccctaagcccagagacagaattctagacatgccttgtgttcacaaaggattgcaatggttaaaacatccctgaaatttattacataccttttccattctccaccaggtccttttgcctcagtcccatctaccacatcagcaataaattgcactgataatgtaattaaaaatatcaccccagaagagcaaccttataagccactgttatggactttagaactcctggacaagtcaaattagagtacttgggtgtaagtagtttccaatttgtagcccaaagtcaagatggttcatttgtctgcaggtgctgcacctaaggggtccactagcttgcagtgctcaaactgccaacagttgactgcaagggtccaagtggcaccagtgcagttcaacttgtcatgttcatcaacatcaacaccaggagtcccgagagttgccatatattaaacacctactcttgccaatacccatgttagcactttgccttcatttatttcttttttcatttaatcctggagaaaatccactgaaattattatttcaagtgacttttatccagctgccactgactgcttgttgtaggacaggcactctacacccaaatgtgatctcattgactcagcacacgaacgttctgtgaggcgaggattttaattcatatcctttttccagactgtgaacctgaagaagttacaaaacatgtctaagtcaaggagctaataagtggcagaactgggagtcacattcaggtcatggccacagtcatgtctgtcctgttgtatcctgcattctcaccatttaaaaagaggttctaattgccagaaaatgaggacgagctggagaaagaagcactttgggcatgcagaggttatgttggtctctggtacataattcttccctttcttctccctgccatcctcccacacacacacacatgcaattccaagtgatagattcattaattctcacaactctttgaggcaggcactatttatcattcccattttacagctgtggagactgaggcttggggaagtgacataaccagtgaaatatataatagggtcaaagtttgccccaaggctgtctgattccaggtcccaaactctcagccagaaggttctataatagttaatctaataattagaggcatgtttctgatggtccaagagctaattctaattagggttctgcctcaagatgaggggcaaacactgaaaattatgacctgttagattttctgtaatacttaagtcgaaaaagcacaggtgggtgcaaagatgatgttgtactcttacaactataaggcttatcatagaaaaaataacctagaaataatgtctaatattaggggttaagttgtggttcacaaatacgttggaaaactgcgaaggcattaaaaatttgccaaagaagaatattatgacatggaaaatgtttatgatacattaagtgaaaaaaagcagcttacaaaagcatctatgatttgaccccacttttgtaacatgaaatgaataatgtggatgtgtggagtgagttggagggagaaagagagacacagagagagagacaggggaaggtatataataaaaggttaacagtggtctctgacatgagaagagcatggttctttttctcctattgcctatagatgttttctaattttctacaattaacattgtatccatcattttgtgatttctttttaggttttgttttgttttgttttgttttttggcctaagaacttgaatgtatgtggtataagacaaaaacactccgatgagactcagaaaagattgctggagatcagaacagactatctcagagtcttgagtttgtggatatttcctgaaaagtctttcatgataacattcacttggcaaactttctttgttgacttggactgcagcctcgtgttaaagagagtttatttaaatttgcttaacctggaggttccccaatttatatgaccacacaacattttttatgtgcagtatataattggtatcttgcagctctgaggaacccagtctgggaatcatttgcctagagaacattttttattcatatctatgatctatgtgtagtccgaatgccaacctctccctccagaaattctcattctctaacacctgtaaaactaatgaatttttcctctctgcatcccccataaatactttcagaatttaactaaatgaagcagaaatatttgtactccctctagacatgggatacctggatctgtagacataaattccagtcaaaatactttgtgaaatatgagacacttctctttttcactgcatctactgctaatattgctaagagtgttataaacaggagttacagttttttttaagagcttgccttgggagccgggtcagcagagatctgcaggtagtggagacagtgggggcgcatcggggtagtaaagatggctctgactatctccttccttgttgatatagtttggatatttgtccttgcccaaatctatgttgaattgcaatccccagtgctgacaatggggtctgctgggaggtgtttggatcatggaggtggatccctcatggcttggtgctgtcttcatgatattgacttcttgcaagatctggtcatttaaaagtgtgtggcacctctcttcttcctccccctatgcccccacttctcttgctttgttctgtttttgccatgggatatgcttgatcccacttcaccttccttcatgagtaaaatgctttctgaggtctccccagaagcacttgccagcactatgcttcctgttcagcctgcagaatcgtgagccaactcaacctctttccttataaattacccagtctcagaggtatttctttacagcaatgcaaaaatggcctaagacactcactgagtccattttccttggccatgtggtcccaagtaggggtgtggtctaaagacattcaggttcacacatatatccttgctagtccaagagtggaaatctttcggcatcaagatttggagttttattcaaaaagtgcccttagacataatttacaagctagttaagcctgctatgcccagattgtaagtatccaggatagaggaagaagagagagaccctcttgggtctctcagatctatccacaagagggactttctgtgtcaatatacctgagcttatcacccataatggaatatgtacatagctaagactcattaatccaattttctatctcaagggatattagaatcctgacaagaacaaattcctgagagggtcagaatatcttttatttagtttgttttgcttttttaatcttgtgtaatgatgtgaaaaccgccaaggactccagcagaaaccacccatttatctgacagttattctgtacacggtgggggtcttgctgagaaaacttggcagggtgaacagacaaaggtcaagcccatttggaggtgacttctccagaacagatagattctctcctgtgaaattaagctggagctaattcaaaaagtgtctttgggtaaaagcgaattctgaaacctcatttttctacttttgccaagaggtggcttaagtagctgtggagaagaatttgtagcatggttatcacagtagtcttgggaaagtaaaattggtctgctttttaaagaacagagcaggccaggcacggtggcccatgcctgtaatcccaggactttgggaggccgaggtgggcagatcacgaggtcaggagatcgagaccatcctggctaacacagtgaaaccccatctctactaaaaatacaaaaaaaaaaaaaaattagccaggcatggtagtgggcacctgtagtcccagctacttgggaggctgaggcaggagaatggcatgaacctgggaggcagagcttgcagtgagaagagattgcgccactgcactctagcctggacgacagagcaagactctgtctcagagagatagatagcaaagcagagattcagacactagtgctggtaccattcacattcacactcacattcagggcacattttcccacaaggttctccttccccaaataggagcctgaaggaatctgggaagcacagtcagagccctaaaaggtcctgctttggatgttgtcaccctttgacagttctcagcatgggagaaaatggggtctgtttgtgtgcacacatgcatatgtaatagactgtaatagactacagagggggaaatcccatcctgcccttctgcatgcaaatcctctcaaggtgacagatttgttctgagacatgtctgtggcctgcccctctggaggcatggagcagatcccaggaagtggccacagaatgggactgcttttaacatcccccaagtcaggataccattttaaaaggctctagcacctaagcacgtgacaatgagcccagtgacagatggcttttaagggaacctagccagcgtagagaagtgtggaggaaaggaggagagaaatcattccatattgtggttccaagatttggagtctgaaggatactcctactgaaatggctagagttaggcaggtcaacttcactgcagaagaaggagaaggcctaggggagataagggtgatggaatcagggtgtcaataccccactggaaaaaaggccgcttttcatcgcaaaatcagaccactaacaaacccccgcacgttcctacctctggacctttacaaacatgaacatccctcccaaactgctatgctctccttgtgagctctgagatttcactcatgtgaatactggtaaaaataatattcccacctcacacattgtcaggcagaataaatgaaggtcatgcaataccgcaagcacgagcacagcagaaagtgggtatttaacaagccggacatccatagaacactcattctctgtcttacgtacttagaactctttgcaagtgaggagctgaatagataatacgttcataagttgaaattcaaatggcatttcccaaataagaagacctagaaaataaatcctataccaaacaataaattttctgtgggaaacaggcttgtactaaaaaacccagattataagaacttggaaaaatcaaacaggtcatcttaacaccaactggtgtctaacagtgaaaacatgaagaagtcatctagttcttgcacaatttttatcacagggacggggtatatttttctagacttccggaaggaaacaaacaacccaacttagagtttgagttagggtagagaaaggctgcccaggcatcaaatgaggctgtctaggaccaaaactatttgctgtattttaagagagcaaaacaatcaaaaacagcagcctactatggcctcacgttcacaatgctgtgagatggccctgcaggtggtccaagaagtggaacctagtggggagtaaaggagaaaccaggaacaatggggctttgttttgggtacaggtgttgggccactcctatgtgctcaagcacatgtggaggctggagcgctgaggctcctccttctgactgggaagtactcgaggccctgcagcatgctgtggcccccacagttctcctcccctgttcttctagctggcctcacacgacctgctgaggcaggagctctcaaggctgcctgctgcttatgtgaagggaggacctcagctaccacagagcgaggaattaaatagtcaactcagccacaggaggcagcacatgtggcttctggatttgagtctgcctccctacaaggctttggcaactacagacagcattacatttctgtctctcttatggcagtaccttgatgtggtaggagcttcatacacagttgctattggctaccaattaagaagctgaggctggtgttcttgcttcttttctgagccaaattccaaggggaaatttaaatgacttaaaaagtcataaaagaaaacaagaataataattttggaattacattattctcaacacctagctatgtatatatgtaaacaaataatatgtaagtagggtctttgctctaataattaaaaactataatattgcaagattctttagacagaaccacaaaacaatatatgacgctgaaaaggtaataacacaatgaatgtcttaaaggacatcataatagaattatccaaccagtggcatcattatatttgttattttaaaagaaaaaagttgcaaaaagttaaaactccacctcacaaaacacatcattgtaagttttacagggattaaaggattaggctaaaaacaattaacagtaccaattattaaaagatgaataaagagggggtctgtatatatcaaagccataaaggaaaaattttaaaaaattctaaaatcgagtataaaaatgaaaggtttatgttcattaaaagactcactatagccccacaccgtggaagacagcctatgggcaaccagccacaattacatccaagcaaatcaagccagaaaattctccaaattacaattcaatctaaaagtccccaaagcttagaaggaaacatctagcattaattgccctgtgtcagcttcagcctggaacagtggttctcaaccagggctagttttgcccccgaggggacatttggtaatgtgtggagacacttttgtccttcataactggaacagtgctaccagcatcttgtgggtagaggccagggatgttgttaacatcttataatgcacagatcagcccccagcacagaaaaatcatcccacccaaaacggcaacagtgcccaggttgaaaaaccctagtgtagaagagaaaaggggtttattctgtggaagatatgactaagtggggaccagtcaggtgacctggaggaagaagtggacacaggtctaaacctcaggactctggtcaacgtggaaccatcactgggttaattcctactataatacgtataaatcattaccctgcatatattaatagttgtaatttgctgaagccttcctttcccctcaccttgtcccctccctcaggtatctcatatagtgacaatgaagtgttataaccctcaggaggtacatgataaccattgaagatactgatacgaaagtatggatatgtacatccacagaggaatgactgatgaggcaaatcaccccttccccccattagttaaaaactctagaagaatgctctgcccctctccttcttagaggcgtattttatttgctttttctctccttattatacaaatgcatattaggattttttttgagtatatattttaccttgcctgtaattattcctctctcttttttcaaaatgtatacctgaatcatttttaaaattttaaaaaaagaaataactaagttactataaatgatgttacaagacaagctggaaaacagtttggaaaaaggcagagtcaatattcttcatatataaaaagttctttcaaatcaatagcaagaccattaagaatgtaattgaaaaatcaacaaaggcaacgagcaaatgctctagagtgagaagaaatacaaatagccaataaatacacacacatacacaaaagtgtttcacttcaatagtaataaaaaagtaaatggaaataataaaatactatagtatgcttacaaaattggcagacattaaaaatataactgctacttatacactgctggggtcagatgtgaatgtaaataatccaatcttccttaaaatcattttgattatgggaaatttacaaaataaattactggtttctaattataaatgctatacttgcttgtgcagaaagtttataaaatatcaaaaagtataaaaatgaaaatcaaatcacctatcacttcaacacctgagaaataattttaacgttttgctatacttttcctagttttatctcaaggtgtttatgggtatgtgtgtatcatgttatacatacagtttagtgccttgctctttttcacttaggattgtattgtgagtgtattcctatactatcacattaccttttaaaacataatttatggttgtaaaatatgatgtcatatttgtatagctaaccactcccctattgtcaaatatgtaggtttttcactgtgcttttgtttttgtctttcataaacaatgcggtaaacatcatcgttgtgcctcaatcttttctgaattttcaatgattgctatttgccaagattttacttagaatgacaggaaaatgaagacagtgtgagacaaacaaaaaatagatattttgcaacaaacagaccctcattacaggaatttccattaaaatatactgtacttcagacagaagaaaagtgcccacagacaggacttctgaagtgcaaaaaggaatgatagacaaaggaaaaggaaaatatgtaggtaaaaccaagcaaaacataaactatataaaataataatatcttggaagttagaaaatgtaacacacaaacccatatcaataatgccatataagttagagctaaagtatcctaaacttcttccttgtattgtctgggaggaacacagagatactgattaagtttaggctctgacaagtaaagtatgcatgccaaaatctctggattacaaactaagagaatagaatagggtggttatctttaagactaatgagcataaaaaaataggaaaaagaatccaaaattagaaaaaaaggagagataaaaagcagaaaatattaataagagagtagaatttccataactctatgtaggttaaattataacagaatgaaaaaaaaaccccatctgattgctgttaccagacaaccaagacaaaaaggataaagaaatatttaatataaaaggataaaattttaaaaagatattctaggtacatactaagagagtggcagtagctatattatcagacttttaatatcagaattcttaattatcaaaattcaaaaaagactactgaaaacagaatcaaaacacaataagaggttcacatcaccagaaatgcagtctccctaaaatgtatgcacttaataatataaaagatattcagaagaaaatagaatatgtttatgacttcaaggtcgggaaggattttcaagtaaggtaggaaaggatttttaaagaaggacccaaaagactgcaaaattggatggtataaaattaacaatttctttgtattaaaagacactacaaagagtaaaaagaagcagcccacaaactgggagaggatatttggaacacacaactgaaaaaaggttagtatccagaatagaagaataattctataaataaattttttaaaagacaacccaatacaaaaatcaagaagagacatgaacaggaacttaataaatgagaaagccagaatgaccaataaatataagaaaagatgcccataaatgccaaagaaaaccacgaagatcctatttcatacacaccaggttggcaaaagttaaaaacaacctaaaaaaatagaaaagaagtgttggtgaggatgtgaaataaccagaactttcatgcactcatggtagaagcatcagtggaacaatgactgtggaatactatttgccatttcttataaagttgaaaataagcatttattattcctcaataatttcattcctaggtatatgccctgcataaaatcatttgtacacatacacccagagaagtgtaagaatgttaatatcagcattgtttatgatagggaaaactggaaaaaagaaatgcccatcaaaagtatatgttcttgtttacaatgttgaatgctacataacagcaaatgtgattgaaatttagctacatgcagcagcatagataaattttgggaatgcagcattgagtgaagaatacgatatgattccatctacaaaaatattctaaagcaagcaaaactgaacaaaatatcattaagggatgcaaatatgtgccaaactataaagaaaattaatgtagcaataaacacagaagtcaatatgatagttagcacgaaataaggaggagagaggatggggttaggaggtgacacaaggtaacttggaaattaatggcaataataaagttactggtgttctttctttgtattgttaccgtttatcccttacacacatttcatagatttaaaaaattacctattttatattaaataaaattctaacaaattaaaaatgaatatactagctgtgtttcattaaggtagttctgagcctaactgtattcacaataatctggcagccatgagagaacatctttctgcgaactagaaaactccaaaatggaatgcagttattctacaaattattctggttgttcaacatccttggaactactctaaattatgctttgcttgggaagaagatgacaatattttccattgattggtactgctcaagatgcagttgatttttttaatacccatatgtttcactgagaaaagagatgatatcaataatgagtttaaagagaaagatctatgctgacaaaaatgtttgcttgatgcagaagttttagctctaaaagaaaacaaatttttggaaaaaaactgtggcagtttatattttcaaaatatgctcttctttataatgcgaccttggcacacttgcttagagagatggcatctctctgtcccctccttttacttggacagagctttgtgaccgacctacagagtatggaaggactgatgcatgatgacttgccagcctaggtcattaaaggtgacagagcttcccctcaaccccaccttctcccttccataccacattgctagctctgcctgtctctggacacttgccctgggaatctagctgccaagttctgaggaagcccaagagaccacaagtgggtgttccagccaacagccccaattcatgtactagctgacagccagtttcaatgccaaacatggaagaatgcttttaatacgactccagtcccaggcactatctgcctgcaaccacataagagaccccaagtgcaaaccaccccagttgacctgaagaaccaccatagatactgacgatcagtaatttgttattatcttgtcaccaagatcggggcagtttgttacagggcaagaaataactgaaacaaactatgattttaagctcctttaaggcaagtagaggaaagaggatatagaatattacactcatgcaagacgcccaggatgtacaatgaagccctgctactaagtagctgcgtgcctggttaagctctgtgagcttcaatttccctaagcgaaaaaaagtgtcgatttatatcaatttacatgtctcaaggttttttaagcataggatatattgcatgaaagtcagatcatatacagtaaacaacaaagggcagctattgacattagtattactgttgttagggctggtatttgggtggccagcgttctcttccagacctcttccattcctatatgggccatagatagaattctccactgctcattggctgagaacacatcaattgtgtctgcagctcacacgagggaccagttagtttcacttttctctgagtttgctctttctttcctattccttaatcttggttctgattcccaggcagcaaagcctagcaaataagagaggcagcacagtgtagtggatacaggcataaatgctggagctgactgcctgagtttggatcctggctctgcttcttgctgtctttgttacctgggacaacttgtatgctttctttgcctcaatgtcttcatcttaagaatgggactaagaatactatctatcttacagggcttttaagaggattcaaataaatgaattaacatatatagttcttagaactttgatatatagtaaatttcttagtaagcattgagagcacttgttcactaagttggataaagtgacttattttggtaatgtgaaaaatagacctcaatagaaacagaagggctggcttcacttccaaccagctccccagtagagagtagggactgggttttgactaggggattgggtacccctacagtgacatcttgaagacacattctggtagccattgcttgacaggcactagggacagatttgaaggcagggtgtgataggctaactattgctgtacttctaaaatctgaaacacataaaacatgctccgagaaaagtgacatgaaaagtgtgacttatataccagactggggctagaagaatagatgaggaaatgagaatcaaattgtgctaccgatggacagaaggtgccatgaggaaggcatcatttcatctgcaatgcgatgcccagacatgttcgataccctaattatcacgagaggaaatgccaattctttgtcagcctaagtgattttcttcctctgtcccttcctttatgctctcacagaaatgaaggagaaccaagctgatttgtctctttcaaaagactgctcccaccaaagacattgagtatcattagcaagaactgcttctatagcacaatgcaaataaaggtagtaaaattcacataaccatagcagactacatggtgaaattggatctaattagcaagtgtcaatatagtattttttttttttttttttgctaactttaacacttgcatcctttgctatttcaggaagtctgcagaagatcttcttaggcatgcaacctagaagcttgtacttcctgttaagttactttatattaataaggtagcttctctctgaaattctagtgctaggcagttccttaaatgacacagaagaaaactttggcttttgaacagcaaacccagcagcacaggtactgctactctgataaggttagcacagaatgagagagtgcggccgagggtgacgggtgtaattaaaattatgttcggctgctgatctgccagacagataaattccataagcactaaattgcaccagtttgaaggggggggggtagttacaactgactgctcatgttttgttaaatacaacactgatgtaaagctgggatccttaaactttgctgtgattaattaacatctcaccaggttttcagaataaaaggagcaccaacctttgacctattgaaatatttaaagtaataatgcagaacatgggagaaaatgacctgcttactgctatctacccctctgtggctctaacatttgaacatctcaatcattaaaaataatttcctgctgtatagagcaattactaggaagggagccatctgacatgtaaaaaaaaaaaaaaagtagaagaaccacaaagctagaaggggaaaataaaaaaaattgaatatccactgatctcatgatatgtcagtcatctctaccatgtagttaagactggaggcatccactatatgctccagcaattccacttctgggtatttatccaaaggaacagaaatcaggatctcaaagagacaacactcccatgttcactgcagcactgttcacaagatccaagatgtggaaataacctaaatgcccatgaagagatgaatggaaaaataaaatgtggtatgtacatataatggattattattcagccttaaaaagaaggaaaactcataatgcagcaatgtggatgaatcttgaggacattatgcgaagggatgtaaaccagtcacagaaggatacatactgcatgattccacttatatgaggtatcaaaaactgtcagtcaaatggatatcatcaaagagtggaacagcagttgccagggggaagagaaaatggggcattactaatcaaagggcatgaagtttcaattaagttaagatgaataagcactggagatccattgtacaacattgtaattatagtcaacgataatgtattgaatacttaaaaagaaggtagacctcatgttaaggtagatcccttttccaggccttatctcacctgtgatgctgccagagcacaatgaaattttttcaaaaaagactggcagcatcacaggtgagataagtcctggaaatgggacattaacagcaagccagcaacagtgggaaataatcctacacttgaagcacctgctacatacattacctctgcccatatcactcccttctaataaattcatttaacatttaatagacagatatttcatgagcatccactgtattctagctattctatttacacaatggtaaataaaacataattcctgtcctcaaaaacaaagaagcagctgggtgtagtggctcatgcctgtagtcctaggtaccggggagctgaagtggttgaggtgggaggatcacttgatctagctaacacagcagaacctgtttctaaaagcaaaacaaaacaaggaaggacaaagagatcaggagaaaaatctaaaactgaatgaaaagtgatacaaagggtaccatgaaataaactagcataccattttacagatgagataggtgagattctgagaggtcagccagcaataaaaccgaggttaaaatctaaatctgagtccaaacctgtgatatttccagtccatcatgagcctccttctagctgcaggaaggagaagaaactagtcaaggcagctagggaggtattaaccccactcaggaatacattgcgaaggaaaattgggcttaaggactcatacaaacaagtgaggaggctggctttgaggaatgatgaaaactatcattaaatagaaggaaggcatacagagaaacatgcctgcaagaggcgagattctatatacctgaggtcatctagctctccatagggatggaggaggaccaggctagagaaagaaccagacaaataaaaacattggctcagtgtggtcaggaaatgggtctccttcagttgcaactcatcaccaccaagggtaggtaaaacaagaataccagagcagttaattttatgtgtcaatgtggctaggccacagtatccagatggtaagtcaaacattattctagatgtttctctgaaggtatttttgtagatgagattaacatttaagtcagtagactgagtaaagcagatgactctccataatgtcactgggcctcatccaattactcgaaggctttaaaagactgacctcccctgaaaaagagggggaattctgccagcagattgtctttgggcttgaagtgcagcatcaattcttccctgggtctccagcctgccagctcaccctgcagatgttggactttccagctgctataactgcatcagccaattccttcaatacaatttccctctccctctccctctccctttttctgtccacacacacaccctctattggttctgtttctctggagaacactaacacaaccacattaaaatacagaaccggcttcaatatccagaagaatccaaccaagcctggagcacagtcaatccaaagctgcctcccaggtgctggtctgagttgctgggccaaggacctccacaacattcacaggaaacaaaaaggaacagcaggctggatggcttggtggacttgttctagggtgagtaatttattcattcgtttgataaatatttattgaatatctattatgttccaggccctgtgtcaggtgctggtgaatctaggctctgattcacctgaatcctggcacagagtagtcattcagtaaatatcctttaaatgaatgaataaaatcttcattctaaaataattaaactcatgtatttttatgattgttttattttctgaaaaactccactgctgatgactaaatcaggaacttgggtcaaaatacctagaggacaaacatcacctaaaggaccaggtgacagtggcaagaattcctgtgagagactgagagttctgggaccctgcttcacaggcctgagactttctcaagctctttccatgttttgaacttgattttttgttagggggaaggagagatgacacacagatagtgccttcagagaaaagtaggccccaatttatacaaataatatagccatcataagctgttaggtcagttttatatgaattcaatgcttataaaaatctagtgttaatggaatcccaaagtggcttcttttgtagagccagtaatcccctgccctgtcccagagcagtgctatccaatataactttggtgatgatagaaatgccctatatcatagtgtctgatgtggcagccattaatcatgtgtgggctattgagtacttgaaatgcggctagtgtgaccaaggaattgagcttttagttttatttaattttaattcattttaatagccataaacactcaatatccatatgtagctagtagcagatacagactaactgaagggtgtggtaaaagggtgttttaacagagtaggtctctccaggcatggggaggcttcttccatcaacccccttgcagagcttatcagcagtcagtatggctgtagtccatcctcctgcccccatacacaccaccccttttgcacccctcattctctcttgcacaaaagcaggcaggaagccaaatctcagtagagaccttgtagctgcactgctgaaaagcctgctgggcaaggaactgatgagaaccacggggtgaaccataaggtgggcagcagggagagtgagtgtctatgaggctctgtggtcagaataaacttaccacccccaaactgctgtgcccttcagatttcaggaagccaacctctcccatcccccctccaaactggtataactaagagggagggcattttccaccttggggtacccacacctcttgtgctccactctttaagtcaggtgactctgacacaccaaagcatccagctgtcagagtggtgaatctcctctgtgggaggcaagctgcttccccagggacacaggtgaagggctgaaggagtagaaattacagtatgaggacacatgctctctggccacatgaaacagagtagaaaagtcacctcagccaggctcttactgggcaaaatgctgtgtcccagaggaaatgtaattcataggactaccacttgcagactctaaatgacagaatacaggatctggcagagaaggttcactggaaaaaggtattatccagcacagcaacacagggccagtggctttgagcatgtttaccaatatgttcagtggcctcttggagcagcaggagttccttgagcttgctgccagcatcccagagacactgagagagaatgtatgtgttgttggggatgttatccctgggggtgggcttcatattccagatcactgcttaaggtaggaagtttacagatgggtcctggggtagagagatcagtgaggtccaaacctcctacctacctactctaggactctctggaaatgagactgcctcagagaagtgaatgacagaaccaatgggcaagtgaacacatgtgaaatctctccccgagactcgaccccagaatgagagtgaggcttggtgggaactaagccagtttcaagacattgacacatccagacaatgtgtcaaataggaaaaaagaaaaaagtggtcattatagaaccaagaagaaaatgagagcttgagaggcaagcactggaagcaccctttgaagacctctcccaaggggctgggacctcagtccatggatggtcatgtgagcaagactaaacctaaaagcagccaaggtcatcaagctattttagccagggtggtggtggggggctgcctgcttatggtcaactgagtccccttgctctaattcccagctcacctaacaagcacgaattataatctggctctcagagagccatacccagagagtaaaactggcccaggatgtgagtattttggtctccatctatttaacaactgtccagacttgataagctatcttggttttggtttatagaacagtcttttgagaacttgcttcatgtgacctcatccctgagagactgagccactctcaatgtaaaactaaaatcaagtttcagatctgtaaaactaagatccagacagatccaggctataataaatatgtcaaagaaaaggccaccttctacaatcttttgtcataaccagctagacttccttaatgataaacttatatgacttggttaataacaataatttaaataatcatcttgactgatccttacaaaaacccttgtgcggcaatttatttatccattttaaataatagggaactgagacctagagaagttaagtaaggcacccaagactttttagtggaagagctgggattaggccctgggtcggcttggccttaaagtcctcacacgtgcaactccaacagtgattatcaaacttggtttggcaaggaagccagagatcatgctagggtcatggcaaaagccaagaggaaaccaaatttattagcttctacagaaagggtactagagggctaggtatggtggctcatgcctataatcccagccctttgtggggctgaggcagaaggatagtttaaggccaagagttcatgaccagcctgggtaacatagtgagatcccttctgtatttaacaataatatgaagaagaaagggtactagaggaggttccgttttgtttactacaaactggatttgatcatctgtttgttgctcaaatttgcctccccaaggaagcatgcaaggagaaaagagacacatgccttagaaatcatgtgggctgggaggcttctgctatttcatgaaagcatgagcactttctgtgggtcaaaaatgtcccctcttggactactgttcaaaaggatttcctttcatgagttcacacactgtattataaactcttctttagaccagcattcttgagagcaggaactaaagcctaatacacagcctggcacacttaaaaatatataccgggtagagtgatggatgaagtaatgtcctgccactcctggggataacagccattagctcttggccctacggccatccaagttactgctttatgattcatttagcatttatccaacaaacatttatttttggacaaatgagcggtttaaaggtctgatccaggaggacataacacagcttaatgaaccattagtgactacgccatggcaattcgatgcaagagcagaggtattaaacaaggcctctaagtacaaaggacgcaaatggcaatttacaaaggaaggactgcagcttgccaaacaaaaaagaaaaaatgttcaacctcacaagtaatcaaagcaatacaaattaaaataggaatcaattctggggggaggtctagcaactaagaaacacttaaaaaattctgtgtctttttaactaacaactcaggattagaaaagatgttggcaaatgaccagaccatgggagtatgagttggtagggcacttttgggcagatatgttggtagcatggatggattaaaacacctaaagttatctatacttttgatgtgtaatttcattttagccatttatcctatcaaagatgtggacaaacgcctatctgtaataatgctaacaaaatattttgaatagcaaaaaaaagtcaacttaaacctggcaactagttaaacacatcctatgacagaatgctatgcagccctttaaaatcaattcctcaaaaaactgattcgaggggagtttgtgatatatcttaaagtcagaaaagtaggttccaaggcactacctataaaatcattcctgttttgttttaaaaagccatagtttctgtatttttcttttctctacattaaaataattaatatttcccacatgttcaataatacatattttgtaatttttttaaatagcatttaagtctcacaaataaaactaacaataaccactcaaatttgcgtgggactctgtaccatttcctaactctttttattccccacattatccctgacttggaaagagaagaaacaatacatccgatgctttctacttattaaataccacctcacacccaggtccctcatttcatttcaaaggcagaattctttccattaaactaaagttaggtctgccctgaaccagtgtcaatttccaaaattcaccggctctcatgttgaatttctctgagttaacataatccagtggacttcaaaaacagcaaatgtaattatgccatttctctagatgtaaatatcccccaatgggaaaacctagcagctactatatgtttgtaattctaattcttcccaaagagttttaaaaattataatatgtacagtaaggatgagttttgtaagtgttttcccccagaattatgaaagcacattcttccttgtaaattatacgtggcataactacagcaagatgggccatgttttgggtcttgtttcaaagatattccattttaacacattccttctaacaaatacaaaacactcacagcctgcactgtgcaactaacaggaattatcagaccctgttttttaacggtagacaccatccagggaattaataccaagtcctcaaagcctaagctttatctcagaaaaactctttttatcataatcaagaattaagtgggtggcgaaaatgacagtggcaagaatgattaacaaatgtatggtgtacatacagttctagcttgtgggtgaactatcaaagaggagtttacaatatagatacatacacacacatacatacatatgtgtgtgtatattatatatatgcatgtgtgtgtatatatacacacacgcatatacataatatataataaaaagaaatatatatatattccccatatatatataatatataataaaaataaatatataatatatacatattccccagccaggaatgccatttcttttttggcattctctacatctgtccatctcctcaaactcactagaaacttctgaacagcaagctacatgtcaggagctcagtacacgtttgctgactcactgggagtaccaatgagaaagatcctccccacaaacaaacagataaacatgtctcatcccagaggaggaatcccagtaggttagcgtggcttcatgagttgacaaagaaaagaggattctcaggtttgggaacagcataggcaaaagtctaatcattttcacaggacaatgagaatgagcctggttataccaaaagggaagaatgactattccattaatcttttaaaagattaatttggggctggggaacaggggagtgggaaggagaaaagaacaggcaagaaagcttgtgagcaggcagtgcagcggggaagctgagagatgatggtgccagaaaaaggcacgaggtagcgtaagtgaatagaagtgtgggctcctgcaatgtggaaaatgacggtactcacgagaaaaccaagggtgaggaagcccagcaatcagctaaggcaaaaggagaagagtttgcggaaggaaggaggtggtcaacatccccaaaatctatggagagaaagtagctgaggatttagccatcagggttgctgtggtgggggcaggtgatgagaaaagggaggcagtcggtatgttcttcacgatgaactcagaagcatggtggtaacgaggtgttcaagacaggagagaccctaatggacttgaaggctgaggatggaacaggcagagaaggagggggcaacaggaaaaaggaaggtggttcaccaggtgtaaagggattcttctgttcctgttcctgagaagaagagatgcacaagaactcggccctcacagcctcagtgcagctaaatcaggaagaagtgggcccgctaaatggctggggatgggcagagaggcaggtctaggtctggacttggcagggctgcttcagggtcaggaagtgagctcagctcggctatgatgcagctgaatgagagcccagtgggggtcaggggagatgaactccctcgtggcggccgaaggcctgggtgagggtggagcagctggcgatctgcaagaggagactggagtcccggtgtgctgcagcctgcagtgtgggaagcatggaagcctggatgctatggagccacaatgtcagtaagggctgaactccacaggagaggacaatggtctctgaacatgctacgtgccttcgaatttgcatgcctttgcatttgctgacaagcctgcctccctaccaaacccctattccttttttcctttctattgaaatgccccacgtctgtgaagcccagcccccaaggaaatgcagggctgtttcctcactgctcttcctgcatgttcatgccatccttcccttgtccccgggactcaccttgcacgctatctgaaagccactcaaatgcatgaaggggtctccccactggtagctctgtctacccctctccctcacctcattcacacttacaaatccttccagcctcagatcaggtgtcatttcctaatggaagcccttcttccctgctcccacccaaatgaggtcaacttcaaccactcttctctttcatggtaccttgtacttgttcttcagggcttctctatgttgttattaattttcatttattttttattttttgtagagatgagggtctcactttgttgcccaggctggtcttgaactcctggcttcaagtgatcctcttgcttggcctcccaaagtgctgagattacaggcatgagccactgctccccaccagggctactcctaacacacttagcatattcctaatcacacactgtgttttataatagtatcatcacagtccatgtctcccactaaactgtaagctccatgagagcagaacccttttcttttttaccattacactctaccttgtagcacagtggctgacctcgagtaggcactcaggaagtccctgtcaaataaccagcaggtgaatgacttggactccaatagccatgtgctgcattctctcctgccctggaggacaggctgctcagggtctaccatgcagtaagtccctgccctcaaggagcccttgacctagggagagagacaaatgaaaccaagcttttcaacagagagtgaagaatgctgtgcgagtaccatgtacagtgccgaggggaaatctccacccacttattggtggggtcctaccaggtgccaaagttgctggagacacttcaccaagatgacctcatgcagctcctcataatacccctacagtgagccaagggatggcattctccgaggcagagctgtaaatccctacaggcagctgttggtggtgagaaccccttgcacccattgctgtgatgatggcagatggcatgacggtgcactcactgtattccaagccctatataaaatatttcacagacatcatctcctggctttgtcacactccatgggctcagcattatcaataagcctgttttatagcacagaaaactcgggttgtctcagagaggttaaatgatttgtccatcctgaggctaggaggtagcagaactaggaatgaaacctaggtgtgcggagttccagagtgaactatgaggctgtggttaaggaaatattcagtccaaacaggagccatgtggtgatgacagatccacagttgagaaagggcactaggatgtggcactggggccaggctggtgtggacagtggcacggattacagcagctgcattttccaactgacaaagcgtgtctaggaggaaaattggagaacacaaaagggcacatgcgggcggcccagaggggtccaggtgtaggcctgcccagccttggtgggggtgggagggggcattggctacctccagagtgggttctactgctggggttggctgtggctgagttcttccatcagatgcatgccttccctgtgagtgaggccacaagcaactcctcaggccctgagcctgacattcacaggactgccacaagttagcacctgaatttaaatcaggccaaattagtgctatttctacaggtgtctgtgctgcttcttttttctctccctctgcctgaaggaggagagggagaaagcaggcagccaaggagcacagccagccgtatcaggaccggagtggtggctgtcagcccctgcggctcccccagcggatggcagctgtcagtctgaatcacagaacccctggggaagatacagggtcttcactgctttcaggaagccatttctgggcagagactccgatttgcaaggcaaaggcacagacactgtacctctctgcaaggtggctatttttccaaaggaagggtagatggaaagaaggacggcaaagctggaagagggtgaattaggaagggagaggaggagatgcaagctataaccagggggaatgctcacctggggctgctggctgctgcccttcaaggatggcctgtctgccagaccatccctcagggtggggcttccagtctgagactccttggagaagaagcatgatcctgaggtcactgtgtgctcatgccctcccccttgtcacaagaatgaatcatagccagcctttgctgggactgtgcctaacccaagctggagctgtggtggggagcatgtgtctgctagcaagtcctcaccccacggtgcccaggagactactcaacttgccttctctcttagctaagctgaacaaaggcagtggggaaaggagagaccaatgccaagataggagcagggttgcattgtctctctgttcagactccttctatgtgtcagcccagtgctccatgctggggattaaccagggattgaggcagagatggagctgccctcatggagctccccacaaggatgagagtgaggagagggagactagcagaaaaggggaggtgtcctcagaacaactgcaggggaggcaggagagagctgggcttgcataggaaatcatatgtccctgacagcaaaaaaggactaagcaacactcaaggatggtgggttaaagggtagtgcatctgttttcttgaagaggaaagaagctaatacctgctgggtaccagctctggcaaatattaattatttttctaattaacccttatccatctagtaactctgagcagggaggttgatcacatagttctggatttctctgccttgcccatttttttttttctttaacaatcagcagctcttggagaaggtttgcaggtaaggaatagtcaatggcaagacatatgaagacttctcttccatccaggaagccctctctgatgatcccatctgctcctgtgtcctcctccctaagctctctctactttccttccttcttgttgtacaatataaaactatcaacctgtttgtttatctgccctgcaaacaggaagctgagggcagggatggcatgtccagcactgaacacagggctcagaatttgtgtcatggaataaatgagtaaatcaatgaatgaatgagtgattgccattctctcagaccctcacaagcatgccgactaatttccagttcaaagagcccaggcactgaggcagtcattttacaggacggtaaggccggaatgtgatgggagggaggcccctccacctctgaggcttttcctgctccaggcagttcctgctgccctgagcactgcccccaggctaagcccttgggaacctgcttcataaacacttacttagcaagacatttaaagtgctattgatttctctcctcagaaggaaaggtgagacagtgatagacacggtgagcagttagcaacaatgagtcccattcaccccccaaccagaagtcatttccctctcagattaccagcccggcagccctgggagagagagagagtggctgcacgctaatgtaggcagtgctagaaccagcaggtgctctcgctccgatagtggcaattagagcttaagctcctttttctatgagacaatgaaaaataaagctaatttcagatggcatattctgtatacctgaatccaaggcacccttctcccctacttaggaagaaagacaggagcccatgcctccccaagaaccagaaggagatgcctctgatccaagtcatggtatcgtcaacaatattttcaagcacttactagatgctagacagagatcttactagacgggaataggtactgggaaatggaggcacataacaatgtagccctcatcccctgtgcctagcctatgatggacagaacacatgtgtaccacacatactagatagatggattaagtgctgccctgcaattctagctccatgagagcaaaccttcctctgtagtccaccttgttaggctcccaaatttccagaacacttgtctcatagcaggtgctcaacaaacactgtttgaattcattttgtattttgttaaggtaacagcagctgctataataaatgcctaacatctaagtggtttaggataagaaagtgtataatcaccactgtcctctccaactaagatcagggaggagcaagatcagcatacatatactcccttagcctcacttgcagatttctctggggtgagctgtattccttgaactcatgggagtcgctaacctaaaaaaaagtttcctgatacataaatacgcgttgggaataacagacctagaaatgaagtttcagaaactccagttgcttacccctgatgtttgaggctgtggcacagctgagcagggagaggtgacccaggggtgctggtctcattcacgtgggtggaatgcagccagtagctgcatttacatactttaatgatcacataaatgggagttggtggcagaggccatatcagatttgtcatagaatagaaaaatccctttgggaaactaggtattagggaacaacaacagacctttctacctaactgcaagaggggttgagatgtatgcccttgcctgagggtggagctgtctctcccgtaagtctgttgtgggggaacatgaagcaaaagcctcatggattgaagaaagaaatgccactgaatgattcctctcctctgctgacatagagggcaagacagtttaagaagctatgtagatccatgcttttgtcaccaaagtctgagactcatgaaagaccttactggatgtcaaattactctgtcttaggggaaaccagacctctgagcactccctctaccccttcaccccagtgaagcttccctgcatacaggatgctggtatctggcaggtaaggagcaggtacctgacaatgcccagaaccaggcctgggaagggatgaagatcccagtagacatcttctgcccctttcctcttcctcctgtagaaatattttaagtgccaaggtttcaactgactgagtggtttgaaagtgaagaagagaggtatggaatggagggatttaagagagaaaaggaagaaggcagggaagggcaaagggaataactacttaatgccagaacaacaacaaaaaattggtgaggagctttgcagtggctttaatttactttcctgtcctctctggctctcattactttttatagaaatatattttttgtgtcacagattgacaatgacatgagccaaggaaagaacttatgggtcagggctgtttgaaatcagatggatgccattacttggttttctaagcaattaataatcacaaattgcattgcttatttttatatttattaatgaaatttaataaatttatcaagtttcacccctagaaggtataagctctatgagagcagaaactgcgtatgcatgtctgtattcatcagtatgtcctactatatgtccggcatatagtaggaaacaaaaacggttctctgacttttatttaatgcagagagctgatgacagagggtggaaagaatgttgttacacagaccttcctattgctaataacagtgtagatgatgatgatcgtggtggtggtaataatgtcacttattataagctggatcccattccaagtgctttattttgatcatttcattaaaacctcaaaacaactccacgaggaggtattgttattcttatttccattcttccaatgaaggcatgaattcaacaggtaaaggatttgttaaaagtgatttaactagtagatgctgaatctagaaagactttatcactctgcctttctgcctgccacacttttttttttttttttttttttttttttgttgttgcaacggggacattctgcctatacccggagccctaggagaacagaggtgaacttgagacgtgtagacaaaataaattatggatcttgatccttgaggacctcaatgcccatgttcatgctaatgatccattgagtacttgaatttcagttactacttttcctcagtattattccaccctgtatgctgacctttgcagaagactcaagttggaagatgcaaattcagattacaagctacctcacctgctacctgccacctctctggctctcctacaaaccagatcatccatgcaacaggtcccacgcccccatgggcagggcccacaccatcagtaggaaaggctttgctaatgatggcctagagggaggagtagccctggcatcagagccctgtgtatgatttagcctataaacccaaagctgttattagcttctactaagccaccacattgggcaggtcctgaaagagaagaacagagcagccccatcaaagggaaccttctatgcacccagagcaatgctgggtattcacaggtatacaggtgcctggctcttcacctgaacaacagcttccctccatggtagctttcctaaggttaggttatgaccaaatatccctgcaggcaacccattcattgctcctatactttgaataataacagaaccggctgctggctggagtctgccaaggttacctcccaggagagcttctctgaaggttaatgcggagctgtcatgcacagccagattttcacttaggcctttgttgttcctcctgcacttgcttccctgctctggctgtgtccagcagcttcccagtgcccactaggtggtgatgcccgcagagactgggctctgagcctggagcaaaaggaccatcagtatgaattagtttccagctgaagtgggcccacccagcaatccgaagaggtgggaaggatggtgttaacagcaagctagcacttcatgagggcttggattactgttcaatgcattctgatgagcaccatctgctgccaatccacactgggcatatgtcttttcgcccaagcactgcactgtggctacaaattcatcacaaagcatgcataggccttgcagagaagagataagtgctggagacaatctccaaacatatctgggagcaagggaagacaggtggaaaaacactgtaaatacaggcccacaaaatacataagggacaaatactgcctgagacgtttagcaatacccaatttgccatatgacagaccatagaagtgaccagagaagtttctgcaccagctgaagccttagctaaatctgttgcttaaactgcttcttttgtttctgtatggtatgtttgatgttctaattcccattcaactatgagatccagttcatcctaaaacttttttgttgttgttgttaaaaacaatcaatttcacatctctctgtattaatcatcagcactaggaatcagttttcttttgggaaccataagtgtctgtcaccccatgagagatgatgaggcataatggctcatcaagatggtcatgcccaaccatctgctgaactcactggccaaggaaattgttcctactgtccttctaagcagtcagcaagtgataaaggagggcctactgtgtacttggccagcactagattgcccagacaatgtacatgtatcaggcaaaaaggctaggaaccatacatatttctttaaaaaaatttttaattacatttttttaaaaagagcattgtaatactgaagaagagaaacaaagtatgaagtctcatattactagatttcacgacttactataaggttacaataataaaggcagcatggttgtggtggaaaaaaaataaacagattaatggaacagaagagaggaatgagatatagccaactgattttttttaaaggcacaaaagcaaggaaaggatagtcatttcaataaactgtgctggaataattagatattcaaatgcaaaagaatgaacctagtcagagaccttctaccttacagaaaaattaactcaaaatggatgataggtctaactgtaaattactaaactataaaacatctagaagaaaacatggggaaaaaaatctatgtgatcttgagtttggtgctgaaccaaaatcacaacctataaaagaaaaaatagataagttggactttattaaaattaaaaacttatactctgtgaatgacactgttaagagaaccaaaaagcaagccacaacctcaataaaaatatttgcaaaacacatagctgataaaagacttgtatccaaaatacaaacgctcttaaaattcaacaagaacataaacaacccaactttaaaagtgtacaaaacatgggaacaaacactttgccatatgtgatagaaaataaccatatgaaaagcttatgaacatcatttttcatagggaaatacaaattcaaacaataataccatatcaccatgtacctattatagtgtctaaaatccaaaacaactcacaataccaattgctggcaatcatgcaaagcaacagaaactttcatttattgctgctggaaatgcaaaatgctgcagtcactttgcaagacagtttttccatttcttataaaactaaatatcttataaacaagttagtaacagcactcctaagtatttacccaactgatttgaaaaattatggtaacacaaaaagttgaactcaaatgtttatatcacctttattcataaacaccaaaactggaagcaaccaagatgcccttcaatatgtgaatggataaacaaactatgaaacatccatacaatggactactattcagtgataaaaaaataaatgagctatcaaactacaaaaagacctagatgaatcttaaatgaatattgtcaagtgaaagaagccagcataaaaaggctatgtaatgcacagttccatttatatgacattctggaaaaggcaaaactgtagagcaggtaaacagatcagtggttcccagggttttgaggtagggaaaaaggagtagttgaaaagatgaagcacagagaatatttttagagtaataaaactatttgttatgatacaataagggcagatacatgacattaggaattagtgagaacctacagaactttacagcgtagagtgaaccttaatgtatgcaaatttttaaaaaatcatttaggaggccaggggatcctaggatgtaatgcagaatgtgacacagtaatctgaatgtattataaaggtgctgacctgtgtagttttggaaatgagtggagattataagcaaacagcctatacataagcactctactctagttgataaagttgtttcccatggaaatagaggctaataattttgatactgggattaaagaattaagtaaatggatagtggatggtgggagccaagtttcctactgttggagtggagaattacagataagcaaggggaggaagctataacgacatggtaatgagttggatacattagcataaacttgtatttagcttaatatagatacatatagaataatttataaatgtatgtacatacatttatatacacacacatgcacacacacatatggattagtatacacatatatattcccttgctgtcaaatgagagtgcagaacaacaacattcccgaagtagtgagcacaatgagtgctaggatcttggtttctaattccattctacaataaaaagaaccaggtctgtttgtggaagttgctgattctatggctgggatactaaatacacaagatgagcctggatattttatttctgccagaaattacagaagtgttcaagagtaggtaaataaaatacaccacagtgggggtatgtcaaagggacacaagaccaacagaaggagtgccaaatgaccaaagctggaacaatttgaaatgtaaaatcttagtattggattaatagttagtattggattataacctcaagcacaaaatatatatccatgagtccacattatataaatattaatacatgctttaagaaacaaataaatggggtaaaagagataaatctctcatgtaaaatatttcaaataatttatgtagacactctaccctgaagcatctacataaggagatggaacattaaatacctactctttaagtgtaggctatgcgtagtaacttcttccaaagagtatggtgtagaaatggggtaaaatgagtacctttgcagtagagaagcctgacaaacactacctcagccaggtgatcaaggtttgcatcaatggtgataagtcatatagataagcatgtaattatgacttcataggatgacaatgacacttgtgctgattcctctgtggatcttgggggttcttccccaaaactcataaccctactctaatcattagaccaacatggaacaaatcctaattgagggacattttagaaaatacctgaccagtactcagaactttcaaggtcatccaaaatgaggaaaatgttagcaaagcctaagaagacctgatgactaaatgcaatgtggtatcctggatgagatcctggaacagaaaaacgaaattaggtaaaagctaaggaaatatgaattaaaacatggactttagctgattataatgtattgatatttgttaattgtgacaaatgtaccatgccaatgtaagacaataatagagaaacatgggtgcagggtatctgggaactctctactatctttgcaatatttctataaatctaaaaattttctaaaataaagagtttatgtgaaaaaattaacattaaattaatgactttgggatatagtagagctttattggacaccagttgctgaacagaaggggaacacagtgttctaagcataaagaatgaccaagaattgatcaagccaagaaagtgaggagagttgtctctaagtgacgcatcaggagttcaccagaccaatcttagaaggatggtgtgtgcaaaggccttcacagccttgattcccatttatgccccagcaacatcggaaattaccatagcagggacttcttagcaaagtattattcactttatcgtgaaagttttaaccaaagcattaagacacacacacaaaagaaatgtaacatacatatagaaaatagaatgaagtacttaaacgcccaggtggaagagtaagaataatctgagttcaaatcttggctctgccatttgccagatggaagaatttgaattttaaaaggcgtatttttttgtatttaagatggagatcatagtccctcccaacactgggctttcaggactattacatggaaacatacataaggtacagagtgtttagcaacagtgagacataaataaatgactatttcttttttttttattattatactttaagttttagggtacatgtgcacattgtgcaggttagttacatatgtatacatgtgccatgctggtgcgctgcgcccactaactcgtcatctagcattaggtatatctcccaatgctatccctcccccctcccccgaccccaccacagtccccagagtgtgatattccccttcctgtgtccatgtgatctcattgttcaattcccgcctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttataatcttttaggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttcgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattacgttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaagtattttattctctttgaagcaattgtgaatgggagttcactcatgatttggctctcctgttattggtgtataagaatgcttgtgatttttgtacattggttttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgacagtttttagcatgaagcgttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattcccttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcattttgttatgtacccagtagtcattcaggagcaggttgttcagtttccatgtagttgagcagctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcatggatctgtctaatgttgacagtggggtgttaaagtctcccattattaatgtgtgggagtctaagtctctttgtaggtcactcaggacttgctttatgaatctggctgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtctcgatggtctttacattttggcatgattttgcagcggctggtatcggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccattctcttctggcttgtagggtttctgccgagagatccgctgttagtctgatgggctttcctttgagggtaacccgacctttctctctggctgcccttaacattttttccttcgtttcaactttggtgaatctgacaattatgtgtcttggagttgctcttctcgaggagtatctttgtggcgttctctgtatttcctgaatctgaacgttggcctgccttgctagattgggaaagttctcctggataatatcctgcagagtgttttccaacttggttccattctccacatcactttcaggtacaccagtcagacgtagatttggtcttttcacatagtcccatatttcttggaggctttgctcatttctttttattctgttttctctaaacttcccttctcgcttcatttcattcatttcatcttccattgctgataccctttcttccagttgatcgcatcggctcctgaggcttctgcattcttcacgtagttctcaagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctctatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgctgccttgcagtttgatctcagactgctgtgctagcaatcagcgagattccgtgggcgtaggaccctctgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgggcttcccaggtgaggcaatgcctcgccctgcttcggctcgcgcacggtgcgcgcacccactggcctgcgcccactgtctggcactccctagtgagatgaacccggtacctcagatggaaatgcagaaatcacccgtcttctgcgtcgctcacgctgggagctgtagaccggagctgttcctattcggccatcttgataaatgactatttcttaaaatttactttagagaggaagataaaaatgcccattatctgcagatgatatcattttctaaagaaaatccaaaatgataaactaaaaactgtcagaatcaagatttcctatttgaaagaaatagtcattttaacaaaaatggaaaacagatttcattcacaaaaagcaatctcaaacattgactctctagtcataaatgtaatgagaaatactcccgtattctgaaagaaaactgcagacgttttccaaggaggcttggagagatgtgtgccacatttccagatggaacaacaacttaactctaaagttatcaattcttctccaattactttgtaaatccaatctaaatatcatttctttaaagttttcaaaatgattttgaatatcgtcggagagaatagataagaatacccatgaaaaaatatgaaaaagcggataacttgttaggtgaaaaatgaattattgagtaaaagtcattttttgaactggctatttaaaacacacacacaaaatacagtttcagttttcctattataccccaaaaagtatgagactgattattagtagtacttttccaactacgagttgcaatctacgaatgggtcctcaaaaaatctttcccaaacatgaggtatgatagcagagaaaagaaaacagggcatgtcttacagagtaagggcgctgcctggtgaaagctttgggtattggcttactgtagaaatgatttcttcctgtttgaatgccactggccttatgcatcaaacatgaaaaattcaagccatgacagaacaaaatagaaacataggtgaaattttatctggtctcagagtaagacagagatttataaacacatatcaatgccagaaattctaaacaaaaagaatgatggacctgactggataaaaacctcaaaatcttagttcatcagaaaccactgttaaaaacaaatgacatattgggggaaaagtgaactacatatgaagaattcatatcaaattaaggatataaaagaataacctgagaaactattgagaaaaaaaatcagcatcctaaaagggaaatcataaaggatatagggcattttaaaaataattacaaatagcatacacgcacacatacacacctttaacctccagtatgatcaaagaagtaagaaatcaaaatgtgtaggagtcagataattgtctcccaagacccattcttctgcctagtaatgagaaccttgattttctgctggcttactgcttttgacctgaaaactctgtactccccagcatctaggtaggaccatgcgtgactgtactcagactaaattcagactgagatggccattgagatgtaagcagaactgtatccaaattcacagaggtctgctcaaaagaaaggggtgcccttctttgctcttcaatttttcccactgactggactaaagctggaatggctggagctctagcagacatcttggaccatgaggcagacttgtttgagcaacaagagtggagcctggttcccttatgattgaggttgcctcatacaagccctggacttcctaccacttgactcattttatgtgaaaatgaaatacaccctcttttgtttaaaccactgttatttaggttcaggagtgtcagtcacctaccgttaaactaaatccctgctaagaaagctacctttttcttaacccacaaagtggaaaaattcttttaaaaattatagtatccaaaaatgacagtggtcctctgactaggcattcctacacatcacttgtggcacatcttttctgaaagaatttctgctagtatgtaacagaagacttacagtatacaagccattttacccagaaattctacttctaaaaatgcatcctatgaaaataattaaggtgtgtgcaaaattaatatacattgttgttcataaaatcagtatttataactataaattagagaagctaaatgttcaataataaaggactagttacaataattatagtacttttatagaattgaacaccatgcagccattaaaaatcagtttttaaaagaataattgatgatatgggaatataattaagtattattaagctaatagtaaagatttttaaatagtattttattatattcagtttgggaggctgggtaattttaaaaatttattctttgtattttgcagtatttttaagtgttctataataaatatgtataactcctatttttttttaatgctcattttaaatgagcctatgtctcctgtcttccatcacataactgtcttctccagttaggtggtttcttctgtccaactgcaggcacagggtgttctggtccagcatgccttgttggctggtaccatgggacaatttttctgctcccttttctgtctttccaaggcatgaggaacacatgatttataaccataggtcaaatattccctctccaggacattctaagccctttagctaattctaggaactacatgctcctgagacaagaagcatgacctctgagccacactgtgatgtcccttagctgctgctcagggacaaggaggcaacaaaccaaggtgcacagggcgccagagggcaaagtagtcagttgtggttatcacagaaagccaataaggaaagccacccagagagtgtagaggccaacttgcatcagaagtcttggagtaaaccagagatggctcctgaggccatctctggtctcctcctcccctagataccaagttgccattgttcctggcaccttgacaacttctgaccttgcaccaatattgcctgtaaaaaggatgtgctctatctccattagaaaatgtgtttagctgcaaataagaaagcttagttaacagtggcataaattcatggggatttactttgtgacacaagaaatcagaagaaaggcagtcacaatgttgcttcagctactccatagtgccactggggacccaggttctttctgggcttcggctcagtcatccttaatgggtggggggtgggtctgaagctttaggcttggcatcttgtggctacaaaagggctgctgcagctccactcacacctctgcaaggataaaacacagcacaagctctgcctgtccctgtttgttataaaagcaaaagctttcttagaaatctctagaagactttacttgcatttcacgggccagaactgaatcacagggccacatcctcagctggaagagactgggaaaataagaatgcaggtgagcttattcttcctcaaagaaaaccagaatcaaatggctatgggctagacaactaacagtgtctctgctacatgtctacaagactaattctagaattccaaggtcttttggaaggctggtattgtcaaattgtacaaagagcagatccatgtctgtgtgtatgtgtgtgtgcatgcgcatgcacacacattaaaaaaggaaggaaaatggtatacattgagcaccttttagaaccagccactttcataattatctcaattaatttgtttcattctaataacctcacaagataggcctatctatctgtttttacagatgagaaaactgagactcagagaagttaagtagcttgcccaaagccacatagctagcaagttctggggctagaattcaactttacaattgcctggttccacaggcaatgcattttctagtgtataagactccctctcaacaagtcttatcatatataattgaaggcaaataatagacaagtgcaaacaagtttgcctaaaccttgaagatacagagttaggctcatggaaggtcagggggacaggagtcttcctgtacaagacagaaagcaaaggcagcacatgtggcagaggccacactgtgatgtcccttagctgctgctcatgggacaaggaggcaacaaaccaggtgcacagggccccagaggacaaaggagtcagtgtggttatcacagaacgccaacaaggaaagccacccagagaatttagaggccaacttgaatcagaagtcttggagtaaaccaagaaggaggtcagtctctgccatatggagaataaacaactcataataggaagcagaaatgcactaatttaatctagatatttattaagtattgctctaattaaatttgtaacagacatattacaaattaatatttacacttagtggtgaccatacattcgacagatcctatgctggggatataaagataaattagacataatccctgctttctagaaggtcacaatctaatgagtttacagtgccagtacataaggtccaaaatgtaatagaatcacttgtatttttaaataggtttccttgtttcaaccacatgaaatgaaacctagttcttctgaccacagagaccacaatggtagtatgtcaaaattatagaaacgtactcagcaataaaaattattggagtcctggacttataaactctgctctataaagacatggaaaacagctcagctcgacacaattattaccctgagacataagtgagctccatatgcagacccatgagcaacacactgtggttgtatctggtcctaagagttcttgttatcccacttaagggagaaagagcataggacctgggcacagaacaggcacttaataaatgccagctggctggatggacagctgaatggatgaagatacattactcattaccaacagacccagtcactgtcctcaattttagggcaaaaaaaaccctctgggggtattgttttaagctttaaattttaaatatagctcagaggccttgagaagcaaggtacacgaagtaacagatctgtgttattttaactcactatgctttccccaagtaggcaagtttcctcttgggcacaatggtaatcagatattaagccaactatttcacaacacagaactatgtataattcttataacaggagctcttcactcaaaagagaacaaatgcttgtaatctccagatactccctcctctggctataaatgttctgtgttctcacaagggcacaaggaaacactaaacagaatgttctataccacaggatgctacacctctgtcatcaaggcaaaaatacttgcttcttgagacaccttgagcccttctctctagtcagggaggtgggctgtagggaaagaacagactgcctgagcttgcttctgatgatggcatcttcccagtgcagaggagccagaaacgcacagcagttacctgttagcctgaggtcgtgccccagaatgacccatgtagggaagtacatagacaagtaccttcaggtggaggaacctgcctctttgacttcgggacctaagtcacctacaaaacccaacttttccaagggctgggaccaccaaaatctcaagtacataaatgtgcctggaaaacagtaagaccctatacatttcctcagttacttcattccacaaatgattgaagtcagtctaatctgtgccatgcactgtcctgggcatggtacacacagcagccaacaggctgtaggaaaagctggagctgaagaccctggtggacaagacaggctggcaggtgtgaatcacagacagaagtctggcaggtgaggggacgctgttgcagctacacaaccatgtgggggtgggggacagggggtctatgggaagtacagatgccagatcctggaggctggggagaaccagcagtatcctaccctaaaggaaccaggtcatagactgagatctggatttagatgaggtcaagggagtaaggggacatgatgccgtccactccaagctactgtcctggagtgcaaaaactccctggtgactggcctggcttaggatataatatcctaaattctaagattttgggagatacagggagagagatttaggcctcttcagcctctgtaatacttctcaggggtagttccataggattagtagccctcataaaaaaggacttttatttttttttttaacttagtttttttgcaagtcattttccggagtatttcttggctgcggctatgatcacatctgtttttgagtgaagcccaggagatctacttggttgacagcctcactccacttccacacatgacttggtggcaacagccatttagcagactcaagcttggaccaaacatagtaaggccaaggagtccagagtaaattggtgctctcttggctaggatgagaggagacaggcacatgtaactaccttcttgagaccctccccccaccaccgactgctatgcaacaggtgggctaggtttgttcattcaagatccttctacatggtaaaatttacgcaagtatgaaggacctgcctccaggaagacctgctactacatcactgggaaacttgaaagcagggcttcccacattatgcagaccctatggtctcctctctactaatatcactgttcctcaccctcccagtacttcccctaaattgttctgaagttattgctgctttaagctcattctaagccttgaaataataagattcataaccagatctcctactgtgtcagcaggtcttttctcttgccatagagcgctgctcactcttttcaagcaggagggccttagaggtgacctttctgggactaggagaggaacacagggttttactctaattacttctttgtgatttgaacacatctcagttccctcttttacttcagtctcttcagaataaggagagagctggatggttgtttgtgttttggttgcagctctaaccaacctgaacatctatcactatacattcaaccaactattgattctgagctttatctggcatcattatatattcctcaagttaaattatcaaagtgacattcctgctttatatgtaattgccactttgggttttcaaacagagaatcatcatcattgatatgacaatgatgataaaagttatattttgtgaactgtaactctacttttatagctaaaattgagctcatttgattcttactacacctgttggactggggccacacctttctttgctctctgccctgtcaaaggcctagctcccaatacaccacttggatctaggaaagaggcctaccaacatttcactaagcagtctgctttgtggggtggaagccacttactttcgtctggtgataatttcaatttattttttattgtaatgctgtcttttcttttcacagtaatggatagcagggcaatggaagaacagtcaacctcaggacagattacaaatgaatttttatctttaagagctaggttggaaacttgtagctatcagaaaagcataatatggtgatgaacaatgagcccatgccagtgttttgataaacttcagagagctaagcctgcttgagaaaaagacaggagaaaatgtgtgaggacattaattctttcactttggaaaaatcccatcagtgaaggctgtgatctcgtaaagggctatattctctgagtaccgaaagcatgggaaaatttagcttaaagtgtgcggatggacacgtgtggaagagtggggtgtgcactttttcttttttcaaaggaagcccgacctttcagtggacattgaatttaggttaagaacacagtataatgtaagggtaagagcacaagttccagaaaaggtttcagatccctgttctgtcatctattatctgtgtggccttaggcaaggtactgaacagatccaaatctcaaattttctcaccagcaaaggagataacattatttggctgttagggggattaaacatatgtataaagtgcttagcacaattcacaaattaagcactttatacagactatcttgtgccataaatcatctgtttactattttaaacattgtatattatggtacatatgtacaatggacaacattttaaaaagaatgaagtagattcatttgacatttgtcagtcattgaaaatctagacaaaaagacttcctgtaacttccattctacttgggcaagatagacaataaagaaaaaaggtaagcaaacgaatatattagaaggtgataaatgatacagagaaaaataaataggagaaggtaggtaggaagttcaggggaaggtttcctgagaaggtgacatttgtgcaaagatttaaagaggtggttgacggagtggccccatggatgtctggggaagagggtcctggcctaggagatggtcagtgccaagccctgaggcagtggtgagaagggcacatttgaggagctccagggagacctgtgtgcctggagctgagcacacaaggatcagagcagcaaaagatggggacagacacgtaacagaggaccagagcatgttgccttgcaggtcactgaaaggactttaacttttcctcttaatcttaacaagatggagtgtcttgaacaggggactacataatctgatttacattttacagaatcagctggactaccatgtgcaaaaaaaagaaggtaaggaccaggagatcaattaggaagctattataatacaagacaaggatgtcttaaagtttgattttagacattaagcttgatatgcctaggggcatccaagtggaaatgctaagtagtcattacatatttaagtctggagttcaaggaagcaggcaggttagctggtgacagacaggcaaatacacacatatctagataggtctacatgtacttacgtgaaaatatatgtatgatatataaaaggcagggtgcaaaacattatgtagaatataatcccaattatggatgagtaaagttaaaaaattattatatgcatatagaaataattgaaggtaaatgcaaaataaataaataaccaaactgggatgatggattaaagacttaaatgcgaaacctaaaactataaaacctcttcaagaaaacctaggaaatgccattctagacatagaccttggcaaagattttatgacaaagatgccaaaagcaattgcaacaaaaacaaaaattgacaaatgggacctcattaaactaaagagcttctgcatagcaaaagagagtaaatagacatcaacagagtaaatacacaacccacagaatgggagaaaatatttgcaaattatgcatctgacaaaggtctgatagccagaatctataaggaacttaaattaacaagtaaaaaacaaacaactcccttaaaaagtgggcaagggacatgaacatttttcaaaagaaaacatatacatggccaacaagcatatgaaaaaatgctcaacatcactaatcattagagaaacatatcaaaacgacaatgaaatagcatctcacatgattcagaatggctattattaaaaagtcaaaaaataacagatgctggcaaggctgcagagaaaagggaacacttatatactgctgatgggactgtaaattagttcagccactgtggaaagctatttggcaatttctcaaaggatttaaaagagaactaccatttgacccaacaatcccattattgggtatttacccaaaggaatataaattgttctaccataaagacacctgcatacgtctgttcatcacagcactattcacaatagcaaagacatgcaatcaacctaaaagcccatcagtggtaaactgcataaataaaatgtggtacacatgtaccatagaatactacatagccataaaaaagagtgagatcatatcctttgcagcaacatggatggagctggaggccattatcctaagcaaactcatgcaagaacagaaaaccaaacactgcatcatcctacttataaatgggagctaaacactgagtatacatggacacaaagaagggaacactagataccagggcctacctgagggttgagtgtgggaggagggtgaggatcaaaaaattaccgattgggtatgcttattatctgggaaatgaaataatctgtacaccaaaccctcatgacatgcaatttatctatagaaccaacctgcacttatacccctaaaactaaaagttaaaataaaaagaatgtatgttaattttgtacataaaaaaaaaaacagtaagtgcaggataagagtgctgtctgggcaaactatcaaagccattaatttctagcacaaacctctatcccgttcactgaactctggttccgaccgcagctaccctttgcctcagcttatccttctttctctgttcacctttagctttccccaatcacttgctatcaaatagacttcagaggaccaggaaaacctgtggtgcactttcccagagttgaactcacagaagaggaagaatctgagatcaaagtcaaagtcagcagttacctcagagtcctgacaaatgaatttttcttctttgatgcagttgccaatttaattctcaagcatttttttaaggtcatgacatttagaataacaaggccctaaaaaatattcctttatgtgcttaatttctgacccaaatgtagtactgaatgacaagtgaatgaagctgaatatgtatcgaaaggttagtataaactgcttttaaattccaagtttgcaagcccaaggctttcactctcttacacaacgggcattaaacaaaaatgttctttcctggatgcaaagataaatctctatttttctaggagcctctgcagcaggattctttcaggaattttccattgagacattacagctaggaggaactccttaccccattccctttttcaccgcctcctgttcccttttatccacgtttccagctccacttgtgataagtaatggaattggacaaccgtctgtcaacccaagacagtttcccccagaatctagccctcgggttgaaaacaccgtttgagaaaagaaaatcactgtagactatttttctactgttctaaatagctcagctggagggaagttgttatttcctctttagcatgccctgttggaaaaacttgcagttctctttcctcccctcctgcaccaaacctgcccccatcctgctcctacctcccagctcatgtcaggccaggaagtgggtaacagttccacagccttctccataatttcttaggctggagccacatcccttctgatctaatctgtgccaacagaagaaaagaaggagctgtccttggagaatgttctgtttcctcttctagagatagagtggagggggcgggtgggagggcgtctgtaggatgccattctaaaccttgctggtttgggagtgtggtgacattctctgcctgatggttaatactgtaagatgtgggcaagtgacttcagacccaggagaaattaaatttaactcccatcatacagacctgccaccatcttcaggctaaagatgctgctgactgtgactgaggatgtacccacacgtgataggaacaaactcactagacccagggtcaggtgagctgtcagctgatggcacgcaaggatcttttctcagtgagcctccagggttctcttctggtgaatgtggactgaataaagaccagtggtggtcaaactcttcccacaggtgtaatctaagtggtaacgtgtaagaatggagtcactctggaggagatctgaggccccacccatttggccttcccctggtccgtatggggaaagctgtggcaccttggaggaacagagaagactcctcaacatggtgtggataagtgagactcttcttgatccaaaatcctacaaccctgccaagtcctcacctcggggaaggggaagctccaaatcccttctcagatgaggtgcagggaatggggctgctatgctcaggccagaagggagtggtttatgtccctgaaacaggggaagtagggcagagcaggcagatgctcaggttcagaaggggtggagtatgggctagctgaaaaatctaccttaaagcctccacttttgagagacctctatttcctcttgagattttcaagcattataaataataataataataataataataataataataaagacagcacctcagactttcctcatggttttcaccgagtactgaagaaaaagcatcagcaatgccctggagctgaagaattcaggtcagagctaaaaagtgactttgctgacggggctgactgttgggtcctaaaaaataccaagagaaactgggagagacctttcctgaaaaaaacaaaaaaatgcacagaaccccagcccaacgcagagatttcaatttcatctccctctttttaactgtgttttcctttatttgttttttgtttttgtggataaccattgcttcatactcttgaggctggactggctttatggagatgagagagataaggcaatgaagtcacctgcccttgtcaggaggtaatttagagatgtagtaagaaatattcagggccgggcgcggtggctcacgcctgtaatcccagcactttgggaggccgaggcgggtggatcatgaggtcaggagatcgagaccatcctggctaacaaggtgaaacccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccatctcaaaaaaaaaaaaaaaaaagaaagaaatattcggaaattttaaaagatggtcccaccttccaccatctcttcaggttccaccatctcttcaggggacatgccaaaggagagatgccagataaacaaagagaacaacaacaacaaaaaaatcttggctttgacttctgaaaaaaaaaaaaaacagatgaaacttaaaggtgagacaagagagttctgatttgccagagctgaagatgttataactcaaaagaccaaaggctggaagaggcagagaagcagagcacactaggagattggaagagagtgagttagacctgcctcatacatcctccacactgacatccagtgttgaccaaagtggggctataagaagtaaacctctgaaaaggagaagaccatgcaggtgagtgttggattctcctctccataattctccccatctctcacccagttctggaccctaggttgggaagaggtgattctgaaacctgagacaggtggggagccctggcagtaaagaggacctgtgtttggctaccagcttgaaagccaatttgaggcaagcctcataaaactgtactctgcattgaatagaaacggttgccaggcacctctaaaagaacctaatgcatatcttggtctaacagaacagatccatgaagagaaggcttgggatagcaacctcactacagtcttttttgatgccagaaaaccacggaagggcctcctcaagttttctgtgcccctgaacagggccaagaagaagctgagagggctagtaaacccagagaaatctaacagagaagaaagaggattcaccgtgaccttagtggacaaggtgagtacaggtctctcggtagatgcagtgagaatgaacaccactggcctaactgaagatgttaagaactccatccaaggggatggatcccaaagaaaaagaaaacaccaggaaaagcctcccaccaatactgtagctcataagccctcagcccacttctacttcctggaattcaggtacagccctgcattaacagaattgacctgggagtgactttatgtttcacctcagaaatgaggttcagaatagaggtaaggttgaaaataaaatatcaccacaacagtttgtgtgtgtgtatgtgtgcgtgtgtgtgcgtgtgtgtattgccacagtttttacagacctgcatttataagactgtaaactctcatttctgcaataggcacagaaataagacagctcctcctacggtccagagccacaatgtgtctcagaggccaggactgcctgtggacaccatgcccactgcctgcagcttctggaaggggctgctgacaggtaaggggaggtggactgcatgctcagctcttcttcctccctctgtccacggctaagttgccaactcaaagtttccttttatttcacctctgacctctcccttgtacccatgccctcctcttcatttgaactgccaccacctcaggtcagccctgttgcctgtcataaattattgtgagagctgcatggaaagaggtgtcaaatcaaaggaaaaggtcagccttctcttgctcaattttgtccaggtaaagcattattacttaaatgtttcatttcaaagaatgactctggggatttatcaatgccctcactcccccaaatgtgttcttatcctgtaggaaaacactgatcaaatccatattagatagtttggccaggcctagtagctcacatctgtaatcccagcactttgggaggccgaggcaggaggactgcttgaggccaggagttcaagaccagcctgagcaacatggcgaaaccttgtctctactaaaaatacaaaaatcagctaggcgtggtggtgcacgcctctactcccagctactagggaggatgaggcaggggaattgcttgaacccaggaggcagaggttgcagtgagctgagatcgcaccactgcactccagcacgggtgacagagcgagatttcatctcaaaaaaaaaaaaaaaaagaatccatattagatagttaaacatgtaccctaataggtgattattttctcctgcattaggatactgttggtactgtcataaattaactaccaccaacaggtagcttctgcttcccctcatgcttacgtgaaaactttgctgtaagtcagagcctagaaatgaggtctttaacaatgaaggacagtcttagaacctcatggaaagaatcgtaccaagtttgaactactgacacttcaattaacagactcattggtgcaggcttccaaggtggtatttcttagataatttccaaagggtgttcataaaagcaaactgttgacccaagatctggtggagcaaaaataattatattggactaaaggaactgatgaggaaatagaattttagttgttttataatattgttggtattatttttaatgttctattttctgatatcacagagtgttttctgttttttcctgatctctcaccattaacttagtagtctgtgcttttgtaaacattttgaaatgaaagatttttaaatggtaatcttgttctcactggcctttcagaattcaggaacaacactttgtctgagtctctttacttttaatggcaatggggttacttgtatagattcagtaagaatctgttctcatttttactcgtaaataattgaacaaatagatggcacagtcaaggccacacctggagtgtcagtctcatctgcttaaatatgaagcccatcattaagaaacaagggttgttttttatttgcaaaatcatgaggccctcccagaaacctggactgttaccttataatggcagacttggaggccatctctcttaaggagagatgcattcaccctcatttgtagatgctacaggcaaaatagtggcaatgactttattttattttttatttttgagatggagtctcactctattgctcaggttgaagtacagtggcgcaatcttgactcactgcaacctccacctcccgagttcaagcaattctcctgcctcagccccctgagtagctgggattacaggcaccagccaccacacctgactgatttttgtatttttggtagagatgggttttcgtcatgttggccaggctggccttgaactcctgacctccagctatccactcaccttggtctcccaaagtgctgggattacaggtgtgagccaccacacccggctggcaacatggcaatgtctagcctcagaataaaagcaataaacaatatacctagaataagagaggcttctgaaatttcctaagatttttaagaaatctccagacagaagttaattttctgggctacgtagttgcttaacaccacatggctttagattttctgaccagactacaaagaggcttatgtatattagttaacttttcttactgcatttataactaaatgaatcaggcctaactgcaatgagattagctttttagaaatcaagaataataactggagattatttgtaatcacagtgtttcatggtttacaacgtccttccacatcctgacttaaacctcctaaagagcctttaaacacaatattcctgaagtcaccatgatcacatttagatttgaaatcttcatcatttatttgccctggaaaagacaacatagcttataaagagccagatagataaacgctcataccccattcattccactccattacaaatcactcctagattttaaaacataagcatacacacacacacacacacacacacagagagagagagagagagagagaaatgcaacaatttccaagaaaagccaactacagctgagaaagctgaattccacagaaggcaaattcaaacgtctatcttgggtctcaccaaggaaggctcaaaaagaggctgagaccagtgggacaacattactttctccatcatgaaaacatccaaatgagcccaagctttcctggccctctcagccacagaagagaaacagttacccttagggaggtattctctttcatctgtcccctggctctgtgctgccttacaagcagaatatattaataaagaaatactttaggggagaactctctccactgttgtgacatctctgcagtctctgttttgatatttggccttgagaagttcaaaggattcaaaagattagagttcaagaaagactaagatgtaccccagggcaggtccggtcttagatgctgaaaaacagctcctcccacaccatagcgaatatgacctctaaaagaacctagtggatatcctggtctaacaggattattttcaaaggctcttgttcatctttttaatggtagttgaaggcaattcggtttagggtccctaaatctggagtacttacctgtcatgtctgctcatttctccagtttgttcctagtgcctgggacagagctcggccacatcaaccctctgtgaccccccattcctgcccacgaattctctgaaggaaaccctcactcaccactcctttctgccttgtgctttggtggctcaggctctgggagacagggacagggcccatcacagagggtggcgaggcttttgccagtagaacaagcatggaactccaatttgcactgcaaaagagagacacaacaggtcttaagaatgcagccataacagacccctaccccgcctcctaagaaacagcagtgccctttgcttcacaaaagcaaagacaaagcagggagaggtcgacctcaggtagaggtctcaattacagaatactaaataagaaatggccttttatattttaccaaatgcagaggataacttctaaaaacactgtggaagccctagaagacttcctttaatgatggtaaaccctactgtcactatttctaaaataaaattattaatatgaaacttaacatctgtagagtcctatctggtccaggaaccccctccattcactttgaggcatcttctccacactcctcccgtgtggaggtaacaccgctggaataccactcctggtccctctcagcctgctcacatgctcttcctgggagggaagagtaacaatccctttagtaagtctgtatggtaatctgaggctcagccccttccccttgggagcaatgaagaatgaatgctcttgcttccgttgtccaaaacctaagtttacacgggtcttcccccatcagaggatgcctgtggtctaactagcttgtgactccgtggaaatgtttacctaattctaggattaaatattagaagcccataatccacatcctcttgtcaaccctttatcagtagcaatggtaatattttagtcatttttctgtcagctctttactctaaagtctcaatgaattctcagaacacaggcaggagagaggaatgttattaataggtgcaaaagaccacaacaattatcagcatttgtattattcttgcattatggaagaggaaattaagactcaggttaagtaacttgcaaaagatcacaaagctcagggccaagcacttaatgcattccacaacactgtgtatatggggcttcggaatacagacatcccatactgaactgtgtgtggctaattatgcaactttgctattggcctggatctgtgttgtctgagactttactccttttttgtctgtaaatttctcaagatcaagaccggtgtgtaatcagtcctctgcaaagacccacgggcccaggaccacatgcatatctggtggaggttcaaaggaagaagagataggtgaaatttaacaagcacccactgtgcatgcagctcttatcaggtgccatggggaatcttttaaatgaaagaaaagaggagatacagtccttgcccttggaaaacacaaatgcatacctttgaaaaaagtccactagcatttgcaaagccacacacgagtgcagataaatactggctcattgtaagaggacaagctattcagtccctataccgattagaaacggagggaaagaatactttaaacctggttctaatgtactgaagtcactcctgtgtcactccaatgatcacccatacagtcaccggctgcccattcagggagagggcaacagagcaaacctacagaatgctggctccctcttgatacaaaacttcctcttgtgcatatttgttcagtgcctagtacgtgcccagcatggcagcaggcattgtgggggctacacaaaaataagccattgcccacgtctcacacatcaactgagctgatgaagcaaaaaagagtgtgtccttgtaaagccatgtggatgtgactatgaggtgaggcaggacacatgtctccatagggatggggcacgaaagaggacctcaggtatgggatgtgctacagagagcacgtggactgaaggtgagccgagtggaacgccgggaaggcagcaggcaggtcactagcatgaggagcttcctttcattcagcacagcgtgtgtgcacgtgcccagagccggacacagctgccatgaccgggctgcctcctccgcctcttctgggctagttctctggaacaatcctctgtttcagactagtggttctctggcttattaaaagaatccttaaagctaatttaggggaacaaatatatttttatgtgtccatttgtttcataaagtcaaaattattacctttgtttatcataaagccttatcatgctattgctgttactgcccgattgtatctgtgatagactgtgagactccccctctccaacccattctcttctctctctgagagaggaatccacacttctgctccaggccccatgtcttgcagcagcacctccctgtaggagggtcaactttcccaccaggtctagccacatgctcactccaaccagtggtggttagtaggagggatgcaagccaggtttgagcagacatgtcaagaatcactggtttcatcacctctgttgctcttctctaccatgaaaatgatgtgccagataagggctgttcccttctgcccaggacccagaaggcagagaacatggaacagagctgaagtgttctgaacagagccacagctaacgcacaatgtgaacacggaaatagggtttatcataataagccaatgatgtttggggattatttgttattacagcataacttagcaaaagctgaccaacagaatgacttccttcctgctagaccatgaaggccttaacagcaagaaaaggttttagttagtgttttatccctggcatgatatgacatacacagagccctggcatagagtaggtgttcaataaacagctgctgaatgacaaaggcagaaagaagggagccacaattcactttgctgctctggacctctgttccagtccctgggtgcttaccaatctgcctgcacaaggaaggaagtgctggagctcagtactcaccacattcatcctaaaccatcctttacccatgtctactccctgagacgcctctttgagctccacattgagtactctgcccctcagcctgcctgctcaccccagcctatcattggagtatgagcctctctgggtggccttgccatgactgtgggccctgtggactgtaattcctggaatccactttctcggctggcctgcagcatcccctctcctgtccagccctggtggccatctctgcaggcagctcagtctcctccctagctacagaaagacaccaccagagaaaacagtacttatctcttatctgtatcagtgaaaatccaagttcaagggcacagatctgtttttttacctttcaggacaatatgtggcatttcatatatgtagctcaaaaggccaatttcttttttttttttttttttaaagagacagggtctcactctgtcaccctggctagagtgcagtggcataatcatagctcactgcagtcttgaactcctgagctcaagcaattctcctgcctcagcctcatgagtagctgggactacagacatgttttgtagagatagggtctcactacattgcccaggctggtctcaaactcctgggctcaagccatcctcccaccccagcctcccgaaatgctagaattacaggcaagagccatcatatccagccataattccattttttataaagcttaaaacaggctatttagagatacagatacatgtggtaaaagctcctttaaaaactggcaggggaggggaccatgacaaataccaggaagataggggtcacctccccagggaaggcagcaggactggtcagacaggagcccaagggaagcgtcacaaacattgatgatgttttattttataaagtaagcattagattctgaggcttttgttctgttactaagcttgacaacttctataaataatatatacatttttatgtatcaaagactttatgataaaatataaaacaatgtttataggctcctatggaggtgacaacgaagctagaaccacacctcccagaaaactccatgagcaagtgcgggtagagccctccaggaagggttgagagtgtgaagctctgctcctgagcccacggcctcccacagatgttctcttcccacaacacttctctaattctcacccttgaagttaccctcccaatcactttccctcatcctccctcctcccttctcccaggttctttctagggaagaacagatacagaagccaaaacctgatcaccattccagctttacactaaggactctatgtaaagactataaatctctgttgttgaagcacccagttagtggcgctttgttacagtagcactaacaaattaatattctttccatccagattttttaaaaagagagagactctaaggaatgaagacactttgtcttaggtttataaagcacagatctttgtgccaagatggctcagctctgctggaaagaaacaaaacaaaaactatgaaacagcagcctcaggatatgagcagttggacctaaagaacttggccaagttgtatcagttgtgacgcatgcccagaaaagaggaaatattaaaaattcaaacctttatattgattttatgatgaagcagtcaaataaataattaactctaactctctaaaggaggagagttgagaaactaggaaataagttaaggacttttaaacattatactagaacccatactcatacacaacatattattataaatacaaacccctggggattctagaccctcgacctgctaaaacagagatgcctgcctgcccttatcactgcagacagaaaaagaagcaagagccaatgacgacatgaacaggcagatacactcaaaatgttgacctacttaaaaataaatgtgctagcagatttcccaaccaatctttccttccattttgcataacactctaatacattggttggaatgagtgaatattttccgtaaatggtcagtaaatctttctcttttatgatttgtaaagcacagctaacaacctctttctggttcattgctcacacaggtctcaaccgagtacatttctctaccacaccacactctgctttgcctctcatgctttgggtattatttttaacattttattcaaattgctttctccactgtatttcatcaacctatcatccattttttaagccagactgttgacagttcacagttgacaattttgttcacagttgatgaattctgatttgtttttattcacccaaaatcatgtcacagtaggtggaggggagcaatcctgaggctttgccggctttaataattgggcaggaagtgagcggctgctgactgcaccagtcagatgccaacatgctgttcctggctgacgggagaataaccacccatttctgcacagagcttgagtggctcagtgttcatctggaagaagctatgcacagaaacaagggaaggtctttggtctcatttagaaccttattgaacatccataaatacatgtgttcctttctgcatttaacacatattcactgagcatctactatgggccagaccctggtctaggtgtagaaccaatgggacaaaggcctgtttccatgaagttcacatggcaggcattgatgggagtcagggaattaagcaagagagagaaagagacagagaataaaggagagggaatgatgtatggtgtgatcagtaaatcttctggaaagatgacatctgagcagagaacagaataaagtgagtcatgcagctctctggggaaggagggtcaaggaaaaaggaagcacaaaggcccagggtagaagattttgactacacttgagaaacagtgaggaagctagagagggatgaggagagcgggaaggaccatcttagtggaaccgatggttggcctgtgtgtgacccacggcacagtcttttattctccctctctccctctgtgtggtacacacacatttctatgagttaaggcttccaaataagtcagagccttaaacttcttgaagaccaagctgttaaaaatgtaaaagaggaaaatgctttttttttttacaagagaatagcagctacaaaatttaaaagaaaggctagagttagaaagtcaccattttgaaactcctcatgtaattaattgagtcagaaaaggaccatttaatatttgctaaaaattttgggtgaaagttattagagaatgaaacattcacacagtcttaaaatgtctccttatagtgttattattacacaaagaagaaaatgcacactttcaataaaacaaacggcagtcaccccttaacaaagggaccaagggtccaagctaataccactggcggcgggacaggctggcatgtgcctcctaatatgcaacaaaagaaaatacacagtagcacctgtgaggcactgtattaaaaaggttgaacccgactctatgcattaggaaacagacaaatccaaaattgaggacattttataacagtctgaactctaaaagcaaaccaaacaaacctggggcaggtggattatcatactagagtaatcatttctaattaaaataaattaaaaatcggaaacaaatgaaatgagtgaaagttaacagaaccttgactaataattattatacaaaacacattattatacaaacatttggggaagaatttctgtgatgttaatgtgaactatatgctaggtgatattatggaatgttcttacaggcataatacctactaaggttaaggtggttatataagagaacaccccttttcttaggggtgaggtgtcacaatgctgcaaattacttctaactagttcaggggaaagtacgtatgtatatacagaaagcaagagtacacaaatgtgccaaaatactaacgactgccaaatctttttgttttgtttgtgttttgagactgagtttcgctcttattgcccaggctggagtgcagtgacatgatttcagctcactgcaacctccgcctcccaggttcaagcaattctcctgcctcagcctccctagtagctgggattacaggcacctgccaccatgccctgctaatttttgtattttgttgttgttgttgttgttgttgttgttgagatggagtctcgctctgtcacccaggctggagtgcagtggcgcaaactcggctcactgcaagctccacctcccaggttcaggccattctcctttctcagcctcccgagtagctgggactacaggcacccgccaccacgcccgactaatttttgtatttttagtagagacggggtttcaccgtgttagccaggatggtctcgatctcctgacctcgtgatcagcccacctcggcctcccaaagtgctgggattacaggcgtgagtcaccgcgcccgacctaatttttgtatttttagtacagaccgggtttcaccatgttggccaggctgttttcgaactcctgacctcaatagatctgcccgcctcatcctcccaaagtgctgggattacaggtgtgagccactgcaacaactgtcaaatcttaatgacgggtatacagcattcattgcattattctttaaatgctctgtacattgaataattattaaactaatagccaggggaagaaaatttaacttgctttgcccagtggtgctaggagaactcttcccagaaaccactcctcttttccctccctaagctcctccctccccagtggcttgccactctcaggtgttgcagttactgtccctcctgcagctcccgctagagggcggctctcggggcagggactggatcctatttcctgctgtatccaggctggcttacacctggtaaagagctgaccttcagtaaggatttgttaaagggccaagtgatccaggttttccagaagcacaaaattctcttgattgatatcagcaattagctttgctcattttcttaccttgtttatcttgtcagtgatttagcacacccttttctagtgagtgaggaggtaagtttcagtccagttcatgtacagattgtcacaggcttggttttagaggcaaggctgaatagtttctctaaactgtgtgacgaaaccagtggagagtcttgctgtcctccaggcaatgcaaccaagagtggccggcaccgtggagaggagtgcagccctgacctgcacgtgcaggcccacccccagcaggctcctggcccctgctttaagctcccaaactgcacacaaggggaactgccttggctcacctccactgttctcacttctggacattttccctgttatctcctctgcctgggattttgttaggactggacactattttgacattttaaatttctgtgggattttttacttaactgggatttcggagaatagtgcagatgaggaaggacttgaagttcctgggcctgtcatcctctctaggagatggctggccccatggagggaggacaacctgctgtacatcagagaggtgggaccatgcacagcctcaccatgcaaggcctggatgcagcagagagcccagacccgaagggctctcagtgaaggcccacagttgggccagctgcagccctcccctcttccgaacggggctccagtgcctttcctccaggaaagcttttctgaggctcctgcctctgtgccccaggacaattctctcattgcactcaccactggacagtgcttatctgtttacatatctacttcttgaaggaaatagtatctttgactagagcctagcatatcacaagtacaggtgctcctgaacttactatggggttacatttcaataaacccatcttaaggtaaaaataatcagagattgaaagtgcatttaatatgtctaaccaacaaacatcatagcttagcctagcctaccttcagtgtactcagaacactcacattagtctacagtggggcaaaattatctaagataaagcctatttaataataaaaagtaggatatctcatgtaatttattgaatactggactgaaagtaaaaaaaaaaaaaaaaaaaaagaatggttgacgggtagccaaagtacagtttctagtaaattcatatctcctttgcaccatcttaaagtcataccattttcagttgaaccattgtaagtcagggaccatctgtgtcttatacattttttgtttatttatgggatatatcttatgtaaccctatgtgagagcaggtgttaatacattcattctatagattaagagcaggtgttaatacattcattctatagatgaagaaactgaaactagagaaagcaaataactgcctcggggacacaaggtgagtaagtagcagatttaaaatttttttttttgagacagagtctcgctctgttgcccaggctggagtgcagtggcatgatctcagctcactgcaagctccgcctcctgggttcatgccattctcctgcctcaccctcctaagtagctgggactacaggcgcccaccaccacgcctggctaatttttttgtatttttagtagagacggggtttcaccgtgttagccaggatggtctcgatctcctgacctcgtgatccacccgcctcgtcctcccaaagtgctgggattacaggcgtgagccaccgcgcccggcccccgcagatttaatttttaattcaaccccttcacttctccctagtccagtgctatgtgtaatgactcacagacttctacaacagtgaggggtttggcaaagcctttacaggaatcctaggaggacagagaggagacagaaattatgccagagctcgggaaagggagagagaacaggaggtgccctgctggcggctgtgtggtgctgaccggcagggaagaaatggagtcagccaaatacaacccttgcttgtcaactgtgacttgtcactagtgatagtgatgttagtcaaagccactttaacatgttgcaattagctaagccaacttacagaagtgaagctgatcagctcacagacctgaatcaggtgatgtggccaccttctgtgttccagaagctgacagcagccagacttagcctctcctggaggcataaaggcctgcagctattcctagctaacagattaactgtgaagtgtgatcatcagagctctcccaagcagtccagagcggcccagccagggcctcagaagacagttctgttcataggatctggtctccgaacttgactcccacctgatgcaagctcctagagagagctgtccatgctcatacaccctagggccacatataagctgtaccttgaaagtggacaggaagaggttgctgaaataaattcatcatcttcccagaaactctaggaagttggagactatcactttcattttacagatgagaaggaaaagggtaagaaaggaaagaacacaaataagaatgaaagaaggagagagcaagaaaagaaagctgtagaggaggcatggcagaggagaggagggaagaaaagagagaagaaatacaaggaggagaacagaggagatgcttcaagtatagaaaaaagcacaaaacatcccagagagacttgggagatgcaagaggcaatgtgggagcagagacctcgttcacatgtctctcgcccagcctggatatgtgggctcaggcagcgctaggagaaaggaagaggatgttctgaggtgctggcacctgcttaaaattaaaatgtctctgcagctataaatgccctcgagatgcctgtctctccagctgtcctggtttccttgcaggggacccagcccacactaagcctcctctccatgctgcctgttccccactggctcgggcagtttactccacagacagaattcaccggaggtggagggcaagttgaggtggcacctgattctatcatgactcacacctctccagctgtgatggtgggtagggagaaactctctgcccaggatctgtctgcatctctcattacaaacctagtagggaatctgacacccagggcgccactgcttactggggttaaaggcaggtcaatttacataacctgtccaagtcttcatttcctcctcactaaagataatccctacttcctgcagccatcctggaagtagaaaggataactaatgatctctagatctctagtgcctggcagcattcctggcacatggtagacaattaatctttgctccttcctccataccccaaagcccacattcattctcttcttcctccaatagcttctccatgccggactgatctctgtaaaatgcaaatgtgtttgtgacaccctaccccagcttacaaccattccttgtatcctgctatcctcagacaaaaagtaaagacttttagcccagcagaaaaggtccccagagatctgtaccccacatatctctccactcacatctcttatgtctctccaaacacatgcttactgtgacccagcttgcagaccacgcttactccccctcggtctcctcggccatgtcccttgaggcttcctcttggatgctttgctttgtctacagctcccccaggagcctgcagtaggcatccctaggtacttctagcacctgcccacctctaacactctgtctcttgccctgtacttcaatgacagctttcttgcctgtctctcttatgagttccatgaggactaggttttaattcacttggttagccccagtgcctggaaaagaatctaaaaaagagtatgtactaaataaatgttggacagctatatagatgcatgggcaggaggatggagggacagccccacccatctaaccacctgctgaacaatcgacacagctctgttgtcatctccaatgcacttggccaaatgaagtcatctctatccatctccaggctttgatactccttaggtccatgaatggtatctggactgtcacagtccaacagatggaaagctttgactgtctctcctaccatcccatctgattccccccccccccgacttagtgaaatgtcgtaccaaagatcccaaactaacattttgctctcaagccctgatcaaaactcaagtcctcccttttgatgctggtcaccatctggtactgatgctgcttcttcaacaacactgctctgactcttcaacaacatgcaacaattccttaatagctgtcttcttcctcctccccgtccctgcttcactctgatgttgcctcatctgaatacctctttcttttcccatcccaaaccttccccacccaggcgtgtcctcctctggacatgaccctgaccactcctactcctgcagaccccccttagctccagtgacatttccagcccaccccactcaacaacacaccgtcccatgcctgctcttctggtttcctcttaccctctaatattttataatttagctgctagacttcaggatatttgtgtcatatgtctatgtattcttcataatacagatacgagcactaagtatatttctattcttcacagtgctggtagaaatggcttctaattcttcataatgtatacaaggtttaatataactaatcatgaacctggcattgtgctaaaagttttacctatattttctcctttaattttcaccccagcccctatatgataaaaatgataacaacatacatcttacacatgaagaaatggaggctcacagatgtcgtttggccaatgaaagccagctctaaccttgcgaagcctgagtccaaatccaggctatctgattctaaagtctgtgctcttaagaggttaattatgtggtctcaagtcaaaatgttttctgatgtttgctcaggtcacatgttttcacagtgttcagggctgtgctgacaatggtcttctctgtcagttcatggtacctgcaggaaccattatcttccaaacaaagccaagtcacacaaatggtaaggaattctctgagaactgtaccaaggtagtgcacactcagagttacagtgtccctcccggatgtctctatagaacccctgccatgatctcactgaaacaagggctccaccaggggtggagatcttggtcttttcattcccagatgtatcccaggcacacagaacacagccagcacacagtaggtgtcctttaattattccttgagtaaaagaatgaatgaatgaatgagatagaaagcaagccccacaaagccctgccacaactatcaccaaagaaagaacaagtttcttggtgaaatgagtgaagaaaactacagaaaatctaagtggctgtatcagagagagcacttcacagccaccagaaggcacgggtgagatgaccacgtcactaataaaaaggaaggtcagagcgaacagaggtctacatcagatctataactgctacaaagcagcccagtaatggcctcttttgcaacttcaaaccaattctgaactgattctgaactcccgagggtgcaggcttcataagtactttatcattcagagttcagacaatcaacagctcctctgttctgatccctcagcaggggggctgtgcctcctgtccctggacatctctgcagatcagccttctgaggggcattccaggcctggggtctgccctcctcatgctgtctgtgtttctttgtcataactaacacactgtagagggcaggctcctgagccttagtttctgaagcagtgacctctcttagactctctgcataaaaacacctctcctcgcttacctacagagacttcacagatcagggagaagaaatgcagacggagaaagaataacagcagatttttaaagtgatagagaggcagtattccatccctggttgcccccagtgtactctgaaaatggaaaaacagatactagctaagcacatccaccaatttctgtccaaagctgacactgtccaaggtcaaaaaaagccattaagatctcaccttgggctgacataagacacccatcaccaaccattcagcctgctttacttctgcacttcagcccaatttcttcctttctcccctatcacttgctctagaaaataaaccccaaatatctttctgaataaagcctgcgtatgtccataagagccaacagaaacgaaaccacagataaaggtgaccaaaaatgccaaagcagacttttaaccaaatgcaacaagattaaagtgatattttttaaatgaaacagtaacttaaactttgaattactgcctgattttactgcttagagatgaaagatgctgtagtgctgaacgaaaaagccatataactcaaagaggattttctttgcttggcatcacctctgtgaaaaatacgtttaagtaacaaaatgcccttgcaagagtcgattctctgatgatggagctgaggtgtgaaaatggtcaagggctggacaaagactgtcatttttcctttcttttgattacacagtttttctgcaacatgtctgatctcatttctcccagagcctgatgaaaggagagctggctaggccaggtgccccaacaggcctgccttggtgaccattctgccctgcgaggcaagttgtgtgctgattgctcccaccacttgctccatggccagaaacgcccaagtcacatggtccatgcagaccccactctccttttctatttacttttgaggccagaactacagccccagtgatcctgagatagtcatgatttgagcagacaaactcacaaggctaggtgggatgcagacatctgatgtgggaaggcaaatatctgggtaacttcttggtgtgcacagaaagaagcagatctagaaccaggaggccagcccatggggacaaagggaggagagacatgtcagctacttgcaacaagctattgggataagatgccacaagcctaaccaggtgggtggggatgcttatggagaaagatccacagagaagcaggtggcatgggtgcagtcaagaggggtgagaacacaaaccctgtgatacagacgcaggcattcagggacaagacacctctggaagtccttgtgaagatttcagggaatggtgacattggatgaggatgcataacaagcatccaggtttttaggaaaagagatacaagagaagcagttggcacaacttttgagggtcaatcagccttagatttccatcctggctgtatgcttgggcatggaacagagccaagaaagccccagagtctgagctgggcctcggcccacagaggcctaagcaaagtggggcagcttcaaagacccaagagctcattacatattcagtcctcagttccaagctttgtacgagccttctcttccgctgatttcaaagttagaaagttcaaactagtctcctccccctcctactaagtttccacttgcatattttgatgtcagtccgaatcctgtgttaatcaggccaaaattcattaacgaaggccaactgtgatctccaggaagctagctgctctccatctaacataatctgtgtttcatacagctaagtggtttctcaaacactctaacaccaagctctgaggggggaccctgtgaacaaaatagaacggctcctgtctcatggtgcctgttgcaatatgtgtgctcccgttttggggaattctgcactgcaaagtaataacgagcagtcacattgtggcgccctcatcatgtcattgccacagataattaagcttatcaattatctcctttccttcactgccttaagaggatgtcactgtgagctcacagggaagccaatacatcagctactcaaatcctcgggagccacattgctgactccccagagcagcagagtggcggaagcagaggctctaaacaaatgaacctgggttcaaatcttccctggctccagccttacaagctctgaggaacttaattaaccctcctgtgccttagctttctgatttgtaaaatgggggaaaccatgatgcctccctcaatgggcagcggcactccatttattcaactgatatttgttgaccacctattatgggctaggcagtgctctggttgctagggatacgatggtaaacaaaacaggcaaggctgctgtcagcttggggcttacattctagtgatgaaagccaggtattagaaaaaaattaaataaaacaatgtgtgtgaagtacttaacacaatgccagacactgaatacttgctatgggagagccgaaaactgaatacttgctatgtgagagctatgttacatttgggacacacatcgcccccaatacccagcctatggagggaatgggcattcctaaagccttgagcttggggaagtttgccaggctcctgtccctccagtgtgacaggagtgagctacaatgcagtaagaatcctcctgggctctggagcaagacaatatcaccgagaggaaagaatctggaggcagacaaacctgctctcaaatcccagctcttgcttgcccactccatgaccttcagcctgtcacttacagctttgagacttagtttttacatctgtaaaatggggataataaaggcacctgcctctttgtgttaccaggattagccaggattatgatgagagttcagctcagtgcccagtgcagagtaagtgctcatccccctctgccagccccacctccaccccatgcagactcaggaagctatggctgttatgttgcctccatcccacttctgaaactgtgcccagagtacctcagtcatttcacttattgcccacaaagatgcagtaaattccatccccacaagctggccctgcctccttctgcttgctaagggtatccctgagcagcaggacacacctcagaagctgcagagtggtgtgggaattgcaaggccagggcagtgcactgcctataacttcccattcaacctggggccatggcatggataacgtctttcttctcccctgccagactgagctccaggagggcagagactcgagcaccagtgccagccaggggcatttctagggcacaggaaacacacaagggatggaaatgaggccaagtagaatcagtgtggcaggggcactgggaaacccctattagagagggatgcatctaatactctttgattccctcaccaaaagtcctaaggcacattagtgaaaaaggaatgctctgttaaagatttcatagagccacagaggagaaggttaaaccacagcgccttaccaagcctaaaaaaacccaaaaaacaaaaaacagaaaagaaaagagaagagaaaagaaactctattagatcctttaatctccactgaaagtcctctcagctgccactgacccagggctgcctttacctttccatgccaacctcactacaccactccaaatgcttttcctcggggtccttacacccatatccctctaaggaagcaaagcacttgctttgggatccatcctcatcagaaggcaagagatttatacaaagcaaaaaaaaaaaaaaaaaagaattgcaccatcacacacattgtttgggtttataatcagaacaaagcaataaaacatgttaaaattgaaaaagaaaaatgtcccatgtatctagaagacaactaaatacgtgattctaaaggaaagaaccttcagtgctgagagtaacaagccacatgaggaggtggcaaggcacctcagggtcggagggttccctaagtggcactactggggctgtctggagatgccccacctggcccaccctacgctcacagggccagtgacaaggacagcacagcatgaagcaggcgtgagggtagcggtcagaaaggacctctatgttactagaaaggaaaagccatgatttaaatttagggccatcaccaaccacagctctgaggcatttgtgaggcaagagcagaaagtgacatttccccaagcagcagctcagccccagtgagatgatcccactcaccatctgcacagagagcttctggccatgcctcttccagaaggaagcggggactgatagagaggcctgtggggagatggctttagagaaagagaccagtgtcctggaaaacacagaacagtttgggtctccacactggggaggaagaacactcaccttttgcaagggaatgaaggaagatcaagccaggtctacacccataacaaaggaaaagcccagctccactcccggtcagtcattcctgaagtgaatgcctaacggtgatgacgatgacagaaactgagtaataagtactaaagttgagctttgcatccattagctcatctgatcttcttgataaacctctaaggtaagcatgcttggttcttaaactacttgccagtttgatgggtggaaagctgtatctcaccattgtttgtttacctcctcacccaaggcaaaaagcccttcctccctgccccaatagtgttattccaggctggagtcatgggctctgcagtgacagagtgacagacctacagtgttttctgcaacatcatagttgagtcctcgttctcccatctatagactagaggtaatagtacctatttcaaatgctgttttaaggcaaatgaaatttaaaatgctcatagagtatttagcgcagggactccccatctgacccatctcccttttctcactgggttaatttgatgcttggaggcaaagcacacctgaccctcactaaggagccagaccttctgcctgagctctggggctccttccttctacccctccctgcatctctcactgcatctcacactgctcagttaccaaatttcacttagggacaaagttagccaccccacaggctacaagatataaagggcttaccttccacgttccagttcccagctagatggggctagaaactggacaaggacagtagcagcatctctgctgggaagacaccgcacccaggccacaaaggcagcccagggctgagcagcactcagcagccctcagggaggaggtcacaaaagaaagtctcaaacatgagggcacaggctctttgtttactctgagtgtgggcaaaatcatcctctaggaggcagagcatcgtgtacagaacccaaattgaataaaggccttctcgggaggtggctggctggggttctgtatgccgggttggaatgaccatgcataaggcattcactccctccaccattcctgcatccactgagtaggtcatgcaagcaatgtctgtgcagcccctgtcacgtgcctgatgtcactagtcactgaagctaccagctgagcaggattatggcagacctaattcctgatcccagaaagtttaaattttaatgggcatgtttcgagttaataatagggaaaagaaacacttagctttctactacaccttattcttagtaaagtgccctcccttctactaagttttttactgtgcagcaagtttttaagggacctaggaagccagctgcgtctgatggatggagaaactgagactcacagaagtcacaggatttgcccaaggtcaccgggataatacaagatagagctgagacttgactaatgttttctgagttccaatcaactgctcttgttatgtaacaagctgtcatttccccagcaactagagaaatccttgtagatatttgctgaaattaatcaaatcgatacaacaaaaagccaccagaaaagcttcctaccgggaatggtgaagggagccaggcacagtctttttttctttccctcccatctgatgaactgcagcagggaggtgtcactaggtgggctcccttcctctctcaaggtgaaagccacatgtgcagctgcatctggaagggctgactgctggaggaataggtctgggcatgggctcagctgcatgaactcaaacaaggcagtatatctctctgcgcttcaacatcttgctctaaagagagaactagtaccactgacatctttggggttgtactaagtgagatcacagaagtaaagtgcttagcactgggcagcactcaatatacagaagccattttattgctattatcaccatcattaatactgttattcttgtcatcaagttcttcactaaaagagctacctccacgaggtctctcactctcaaaaatcctgcaacctggggcctctgcatggcagggagggctggagacttggcctctctgtgaagcagccgctggcagcacctcttccagtgaatactgccatgtgtgtcccagggcagggccctggagagcaccaggaccttggtgtgcaggatacactgaggtaaggggcccagcctccgctggatctttcagaggttttaggaaaggttttccaagccccacgagagggagaacattgagaaggttcagaaaggaggtcaggaagcagggaggaagaaacagaaaaaagtgtgtaaaccaagggaaacacaggggtgggctgtatctaggagcctcccacccaggatttctgcaacaaagagctgacgacactacatgctttctctaagcctgttggtgcccagaagcatctaccactttctcgtgtaaagctcttaggtggaagtggggagactttggttgcagtctgtgcttagacaataacccagcttgtcaggtctagattccatgtgtgtgaagattgctgggggtcagggagtagggaccacaggaggctggactagatgagctctaggctcccctccagaccttcatcagccaccagaacatcctgcctcaaggactaatctgggtccctctccagggagaggttacagcttctgttcctacaaacctctcacagaatgtgactgaagtctcagagcagtgtcatggacttgaagtcacatccttctcctgcatatttgtcgggtaaacctgaacttcgtaaccacattggttttatcaatgtgagctggttgtatgttttcctttgctcagcaatttctcacatacttgaaagacgaacgatgtctatctcccatatgggtttgtttctacttttggatacaaatcacctgatcggcctgcttccaggcacttgtaaagaaagataaaaaagaacattatcaggatgccaaatctatcaatctctgagagaaagtttgctaatcctcctgcccctcgtctcacccaccttcacccccagtcctccagatatcattagcttttcatgccagtcatctttgtgttgcaggagtaggtattttgagaaatacacaaaaaaggtagtaaggtcagagtccctgcccttaaagagatttgaggtagatcaacaaatggatcaattagcatatgataccacatcggtcacaatcccatggtgaaccatggcaagggaacttaagtaccatgggggttgaaagatggaaagccattgtagggagaatcttccaggtggatgtgcaacttggtgcaagattctgaaaaatttggaaagaatgatgtatgggggagatcaggagcaaaaaggttaagaaacaggtttagaatctaatttggtgtctggtcttgtgagaagcaagaagcttctactgtgggttctcaagcaaaggagaagcatagtcaacatgccgagagaggaggccaggagagcactgggactattgcaagggggctgagcaggagaatggaggagggactagaacggggagctagcacagacatgcaggtgcaaggggaggaggagggggcttgtgcctggtggggcctacacagtgccaccttcctggcttcccatccccctctttgtccctgctcatgagtgtcaaagtctttgacactgcctgtgaattaaactgaaacaaaacaaaacgacaacaacaacaaaacttcagaagccactgtgtctcaacagcattttctaattttctggttagtccttctagggaaggtgctcccagactcaaaattgtggtgacagctcccatctcatatggaatatagcagctgtcatggccaacatactaactcacaggaagtggccaccctcctcctcctcccacaccagctacaacatgatagcagagggccttggagccagtgacctgagggcagtggggcaccagcaagctcttctctgtacctaggacctggggaactgtgctgctgcccctcagcatctcctcagtgacctagtgcagccacacctgccagtgcctgaggtcatcaagaggctgctgttcagaagccacataaagcagatgaaactttaataaactttaatgtctctactaaaatcataggtcccctcaactccaaagtcccatcagatgcatcatctcatgatgaaacagaaacgccaaatctacactgattttgagtaacaaaattggaaatgtattctcaattgagaatacatttttagaaattcacatttctaaacacattttgtgaagccctaggttagaggcctttataactatcaaagataactgcacagtttgacctggaataaagaaaagggcctcttctgaaatacaccaggagatgagccaggaaggccacagaggccactggcaggctacagcatttccctcctcaaataaccatgccaggtgtaagcactaggatctaacactagatacttggcatttttgcttgctgatttggttgggactacatggagatacggaatcaacttggagatggcccatcacttagaacaacagaaatggaagcaatactttctctaacaaaaagcaaatcccacgcaaggcaagctgctagtttaaggttgtatttcaatgaagaagggttgagcctgcctcaggaacaaacaagtaatttttagcaaaacagcaacttggagttcatccttttgtcaacaaaactgctacgtaatttctaaacttcccaccaagaggcaatcagccaacagacacatctgtgaataccagaacacctctcttttgttgtgtaagacagaattttaccctgggctctgcctctggccatatccaggccttcctccctctgcagatcacaggcatctggcacacaagcatagactgttcagggaacaaccaaccttccactggagtggtgctcactgcccagccagcataagttaagagatagctaggattgtcaactccttgaggacaaggctatgtccagccatctccacacccctcacctcacagccaggcatggggacccagcaggcacctttgctggctgaagttaatggaagggcagaattcggtcgagcttgattgtgatgtaaagttgtatccctgaagtatgaaatacctctcaaatatcccacaatcccaagcttcaggaggaaaaagggtcatggcacaaacagaatgggcagattctgtaaaaggaaaatctctttgttcccctgggtttttcaagcaaggggctttgacaagatacaacttgattctcctgagacgctcaggcacctgcagtcatgaagtgttttctctttctttcagtattctctggctcagtttcaaattccagtctaaagccctctcctccccacccccatctctttacatactaattcagccatggaactgagccaggacccaggaaaaaaaggtagcacaagagaaatgaaaatggggccacaggatcctctgtgttcaatggccaggaggcaaaggggagctgaggaggatgaagacacgagcataggagagttggctaaagagggtgcaaagatgtgtgtcacaaatcagccagtttctgcacaagcatggggactctgctttcaatctgggcagccagtaggtcatttctcctatcctcccaaggactatctcttccctgctccatcccacccttccaccaacatttactgagcacctactagctgctaagcacagtagtaggtgctgtgaatataaagtaaaggctctagcaaaacacacccaagccaggataagaagacaaccccaagggttatgctagccaaataaaaccctcgctgtagatgaagctgagacactatccttcatcatgatatcaatgccaggcagcattccctgggatgtatttggagaaggcctgtgttcatgtctactgagagtggtgcccactggcagcctttacatttatgttttggtttctaggtaaggacaaataaaaataacagttcccttgacagccacatttaatttaattgccactccccttggctctcaggctctcagagcctcccacagcttcagcagttcaaatttcctcactgtcagtctgttggaggatcacagactggccctccccttcaaacagagagcgcctccaggcaggggagcttgaattattcatctcaggcattcccagagctgggcacaaagcctggaaccaaggtacacagaggacactggatggtgaattgaagtttattagcccctctttccaggactgaaaactctttgcatatgggagctcatctgctcttacagattctttataatatttactcatgaagctatttcatccaccaagactagaaagaatccccaaagtgctcaattatgtcagttccttataaacacgataaactcacatttccattattttcccgtcaagtccctcagtgggcgacagagaccttcctgatctggcccctgctcacctctccagccctatctacccccatactccctgccactccatccaccttccaatacccaagtgtccattaagtaatttctctgtgtcaggcattgtacaagattctgaggataaagcagtaagccacaaacaaacatggtttgtattccatgttcatagtttactggagtatacagacattaaataatcttacaaatacaaaattaatctataactatggcaaatgctaagaaaaaaaagatacatggtgctgttgagatgtgtaacgagaggccctgagctggttcgccctcagggaaggcattcctgaggaagcgaccgaggggctgagatttacaggaggaagagtgtgccacaagtgtgtgaaggggagggcagggtgtccaaggctggccccacttggcgcttctgccagaggcccttcttgacacttctcttatgtaactctgtcattacctcctcaagaggccctccctgatacccaggtgaggtcagacgttctcttactgtgtgcccacctgatacacacccacttttctcaaaccattcaatacatctccccttctgaactgggaattccatgaggacagagacgttgcctagtacatttttgtatatcctgtgcctagagaggaacaagcacccagtcctttcctgatgaataggagaaaagatcaatcgatgaatggatggatggatgagcacagtgcctctttccagcactcacacttgcacacatcagtgtttgggcaactgtagtagtccatttgctgttgctgaaactgggtaatttataaaggaaaggaatttacttctcacagtcacggaggctgagaagtcctgggttgagggggcttatctgctgtgagcctttttgccggtgggggctctgtctagggtatcgcatggccaagggcctgagcacattaatgggtcagctcaagtctctcttcctcttcttataaagccactagttcccctcccatgatgactcattaatccattaacccattaaaacattaacccattaaaatattcattagggcagagtcttgatgatccagtcacctcttaaaggccccacctctcaatatctgccacattggggattaagtttcaatatgtgttttagaggggacattcaaatcatagcagcagttatcaggatttctgtattaaccatcatgatcctgtgctctctttgtctccctgagatcctgaaagagcaattagaagaggctagcatcctcactgggggctgaagaagggcagggtctctctcagccctggagagattctggactaaaataaatccaatggtccatccagcagctttcctggcacattatgagaactatagcactttaatcatttaattttttattcacagtgtttactgagaatctaccatatgctaggccccattctagaaattcagacggaaataagatagacatggactctgcctttatggagcatacagtcttgagtagcaagtgaaataagagatttcagatgcaggtaattggtatgaagaaagcagagcaataggccagaaagtaatgaggggaagacagctctgttgtgtggtggtcagagagggtctctctgaggagataaccttccagctaagatggggatgcggagaaggagccagtcccatgacagtctagggaaacagcatgcaggcagagggaacgggatgttcaaaacgctgatatgaaacgagctcagcacattggaagcagaaaagccacccaagtgactggagcagagtcatgatgagaaaaacatggtaagacagaggtcagatcatagagaacctgggggagcagggtgaggacaccacttgtaagtgaggggaaaggaataggctgtttcaatgatcactcagctgctctgtgaagaacagactacaggcaaacactgatggaaacagagaccagtaatgagaccatgcaatgtccctggggctctcaccagtgtttaaggagtagcaatggggataagtggccaaaatcaggatatagtttagagtgaagaagacaaggcttgctaaggattggttgaacaaaatgagagaaaatcaacaaagatgactccagagatttggcctgagtcactgggcacagaatagagtcattagcagattgggggaaacactggggcccaaggaaaatcaggagctctgttttggacacattgaatgtgagatgccaaccagacatcagggtggatggttcaagtaggccactcaaaagctactctacatatgcaccatgctattcctattcaccactattaaaccaggagagtttagtacttcataaaattcaagtacaggcaaacttcagaagtattgtgggttcattcccagacaaccacaataaagcaaatattacaataaagtgagttactcaaattttttggcttcctggtacatataaaagttatgtttatactatagtatagtctattaaggatgcaatagcactaggtctaaaaataatgtacatgccttgatttaaaaatattttactactaaaaaatgctaaccatcacctgagccttcagaaagtcatgacctttttgctggtggagggtcttgccctgatattgatgactgctgactgataagggtggtggctgctgaagattaaggtggctgtaattcctgaaaataagacaataaagtttgctgaattgatggactcttcctttcacaaaaatttctcagtagcaatgtgatgctacttgatagcattttaatttcctccaataacttttcatttgcacttacaacttggcttggcacaagaggcctggctttggcctatctcatctttcaatatgcctttgtcgctaagcacgatcatttctaacttttgatttaaagtgacagacatgtcactcttcctttcgcctgaacacttagaggccactacagtgttattaattagcttaatttcaatattgttgtgtcataaggaacagggatgcccatggagagggagagagacaagggaacggctggttagtggagcagtcagaacacataccagatttatcaattaatttcatcatcttatgttggagtggtttatgatgccccagaacaatttcaataacaacataaaaaatcagtgatcccagatcaccataacaaatataataataatttgtaaagtttgaaatattgcaagaattaccaaaatgtgacacagggacatgaagtgagcacccattgttgaaaaattggtaccaacagacttgtttaatgtgggtctgccacaaacctccaatttgtaaaaaaaaccttagtatctgcaaagcacaataaaagaacattcattaaaatgacgtatgcctttattaaccaaagaccaaaactgtttgggctcagctaagtctaggttcagattctatttctgtcattgatggttgtgttatcttaggcaaggaacaacctttttgtgagtgttggttacctcttctgtaaaaatgaaaacagaattgtgcatcccaaggtggctgtgaggaccagatataatggtgagcagcaaactcccagagtagcacctggcacagagtacacactgcacacaggcccaccagcactgctcctatgacagccaggctggcaagcagctcagtaaagccagctgtggttctccattcttatcattagccagtattatccctaggttgatggaaaccttaggaaggaaaaaagtcttagaaattccaaagcaataaagtaatactgttctgagtgactgaaatagcaggtcaaaaatatgacagctacagggataaaaatgtggatctacaaaacatgcaatcaagaaaacctgtgagctgtgaaaaccaagtaacctcaggaaccctcattccctccccacagcaccagcttctaatagcacagaagaatctgggtagatgggtgggtgggcagggggaaggagggagcctccctcattgatggggtggggtcatcaaggagaatagattttgggagactgacagcactgaaggcgagtgacagaagcactttgtttgtaggatatgataatggggtggtatacacagtggcctccctgagagatgccatgtggttcaccccatcctcagccccccaagtatagcatactgctggagccatctctgaaattgctcagcagtatgctatactcatctgccatagctgggcactccactctttccaggtagttgtaataaaacagtgacccttcccaagacaaaaaagaaaaaaaaaaaagaacccaaatgggtttccatgacaaccacttctgagtgaggtacttgggagatggtaccatgcagagaggcagcaccaatggggtcagttatggtctatggagcccagccctccacctcatcccaccaacacttagacccctctgctcagtgaaatgccatcctgggctgggcttgtgatcataaaatcaggagtttgggaaagaaacggtccactcaaagggagaaattaacgcaggcataactgcaataggaacatctcaactactcaggaaaagaggctgcttgtgatacttgaaaatgaatcatcacagcacatagttgtatccaagaaatcgatgagccaacccaagccatcgtttgcactcatttgccaaggcagtattaacagaccctcagtctgtagtcatagtatctttttaaaaaaattttttaaagaattatgtaaacatatttaaaatccagtcttcttaccattgttaactgaacccaacccctcccaggttagtgtgaattggtgtagttctgtcatagtggcttttgcagtgtggaggacgcttggctgtctggactctatgagtcagggtgatgtgttgaagcctggctcctccacctatgggccaagggagcacaggagcattaataataactgagtctccctctctgcattatctgaagaagaggtttttcagtagcacccatctttcgagactggcatgagaattatgtaatgtcatgttatgtgcatagtatggcaggtggcacacagcagacagtaatgtagtactagtactagtgttcacgcaaatcacacctacttacacacagggaggagctggagtatgatgcccaggtcaagggaagtgaagctggccactggggggtagactctggtctctggccttgtgaatagaggggctgcttttgcttaatttattagggagggggacttgcccagcaaaagcagttctaagcccagttttctgactcccttgcacatttggcagacctgagaaggttccagtacagtcatcccagcaaccaaagttgctgctcgcttagtcttccaacataaccctgtctcagagagatgtgagccgtggcttagaaattcgagcaaagcctgataactattcccaagctctagcaaatgcagccagctcaattcacctgcctcagcatcctgtacacagactgagcatgtcagaggagctgagcaagcattggacaaatggatatatggtggaatggggataaggggatgtcatagagagccaggagaacaactgagtgtgcaaaaacattcccccttgcaatgctgggcaggcttttattcacttcctattggagcctcacagtctatgtaagagtcttctgatttcactaacaaaaactaacccgaacctgctgtggcctaatgctcactacatgttggcaaaatgaatgaaaacggacccaaataccactgcatctgccacattgggtgctgccacgggattaataatgagtaagaaaagccaggccccagccagtgcctgctaaagagtctgccctcaaccagaggtgcctgctgccgttaccaccaccatcgggcagaacatggtgcaatcccacctacccgagagcagaaggcagagaaggctttctgaagcaaatggaaggtgtaatgtaaaagctgggccaatggagctagggggaggactggtgtgctacaaaagatccttcagacttccttggggagggggtaattagtaataaatgagtactgatagatggcttatcaatgtgacacatactgttcgatgaatttaatatgtaataactcaattctcacaaaaactcttccagacaagtgttattatgtccatttcatggacaaggaaactggagagcataggaagattaggtaatttgctcaaggtcacatacctaacaagccaaggacaagctcttaactcggacactgctgcacccagccctcctcttccccacagtacctcaccctggctctacttccagcactcccctcacctggctgacctgtgaaactatctacatttacatatgtgtcttcctcagaaccaggcagcaacctgagctcaggaccagtggcccagcaggggcctggcaaagggtgggtgtgttagatgactttaaagagaccaccctggaagaggatcccaaagcaggtgccagaaaagtctgtgacctcatccaactctatggactaaaggtctgagcatggaattagtggatggagcctgaacacctgcagtcagaagacaaagtggcccctcccaacacataactttcacaggtacaacctctcttgttcccatcacctacatggctgaaagctttgtcacatcagtctcagaggccatgtcaagaacacattgctcttccctcacctgcactgaccatcaatttttgcctcccagatacttagagactttgcatcgtttattcttgccataccatgagccttaactctccctcccaccaaagcagattttctctgaaatgccaccgggtccacaggctccacgggccacctcaggagacctgctctgcaacctcagccacctcctggttggctcctccggctgctgctcagtcccccaagacctcttctcaaagagggggaagaagggcaacaccaacaaatgagagcaggctttgttcccaaagggatgttaaaatccaggacatgcttcaagtacagactttcttcaggaaaggagagtccagagtgattgagtgttcggggtgcccacaccttttttatctttcaatttttcactggaaaaacatttgaaaagtgtcacctccattttctgacattcctcagcctagatgagagagcaaagcaggatctttctcagtgagggagggtaccagcatcaaaaatgagaaacacagaaacaaacgtgggtgactggaagaatgtgctgatctctggacaccctccacaggtctcatttttaacatacatactttttaaacggctctattgaggtataatgggttggggcaaaagtaattgcagtttttgccactactttttctgattggtttatgtctgtgtcctatatatgtctttaaatattttgtgtaaaacctttgccctgaatgaatgcacgttctctgttataaaagtttcaccagggatcttttctctctctaaccagagtccaagctgaaacaggcaagtgttcttttgccctgttttactaacagatttaaaaaaatatatatgtgtgtgtatatatatatatatgtacacatatatatacacacacatatgtatatatatgtatatgtacatgtgtgtgtatgtgtatgtatatgtacatgtgtatatatatatctcccaccctttaactcagggtgaacccactgaaggtcttggatttatgtttgtggtttcagctccaacttctcactatgttaggacttaaggcattgtatccagtcaacggaaaggagccagtcaagctaatcaagaggttttggggcaacagctgcatattattgcattgaagcatgcagctgttaccttaaaatctcttgagcttccctacctccccaccccccggagtcatggtcaggattctgtctggatttcagtgctcctctctccctacaaccagggatttcccttacatcttgcaagctcaactattaaaataatgtctgcattataactaggagttcggtatcagagagttttcagggactctagtctatcatacggctggatttccacgtgtacaacaacatttccaatgtgatggaatcagtgctccaacaggggagtttacaggaaagaaatggtctagtttggcacaaagggctcaggagggttcactgaggagatggtgcttatgataagccttacagttaaaatcccaggaaaatggttcctccttttttgtagggctagatgtgggtgagggatcatcacagtgcattaaattgccaaaaacaattgatgcattctctccattccacctctccttgtcccttgtttggtgccagggagttgggttgtgcattggtttattataaagagaagccaggtggctggactagatagcttccagcagaaaatggtagaagacaacgtgcatgatgtagtgaatcttgattagagacacctttggggcatcccaccctcactgatacatatcatcttttggcctctccactggagaagagaaagcaaagaaatacttctaatgagctcaatctgaccaaactgtttggggtcaccagcttcctatagcatccaagtttcttacctgcctgccattgtacagcctgactttggggaggtttggattcaaaagctgtccttactgcttttggatgagaacttgggaaaactcgcttatttggacacagggcctttcctgctactggaggtttgctgttctgagcaccttcctggacagaatctagcagctcaagaaggacacccttgttcagaggaagaagcatttctgttctgttcatggtatacaaagattcccaaatgtttcatttgtttccgaaaggggaaaaaaaaaaaaagaaaacttgctttggtaaaaataagagcatcattaaagcccatttccttcaatacacaattatggcaacaactcatggtaagtcccaacccagttaatattccttaatttccccatataacacacaggtctcagcctagggcttataaagtaagatcagcttcactgagccctacctacatcttggcgctgaaatgttctcttgaaaaatatgaagaagtctgaccatactcattagagcagaatgtcagcaagggaatattctgtttgtctcctttaaagaaaaacaaaagcgacatgatcatgaacttcattaaagttgtttgcagtgatttaattaggcttatagcactgtgtctattcattctggccagggacctttctgtcttttaaaggattggtaggcagagatatcatgtgctgtgcaattttacctaatccttaatttcatctcctgatgaagtgaggccaagcatcttcgtgttcaggtaattgctttatcaaatggcttaattgtgcattcaacagaactgacaacaagaaggtattcttcctaatgtgtttttaacaaaagcactaactaattacatggcattctactcagggcatttgagaagaagaaatgaaaacctattcttcaaatcttggttaaatgcatgtttgcatacagaacatagaaataagtggtaaaataattagttgaattgcttccttctgctctaacttcatgactaatctgcatgcttaagtagtctgtgtaaattctgtggatgtattttcacaatggacgatgtctgaacatctgtgctttctgaaaatgtcacaataaccattttgcctgaaagtttatcttcaggagccaaaaagactgtgttatcttggcatgttctaagaagaaataaatgctgggagaactaaggacagatgtgtcccacgatcagaagaaagtattaaagcattaagccaaatggtttaaaaacatcctgaattaaaatgacactagatcacattcccatagatgaacttcctcttcagctaaacaacatgtctgggataaaaacttgccttgcatgcccctctatgcccatcattcctagaaacacaatatgccttaatacattcttaccagctcaaaccaggctcatgcggccatagcatttaatgaggctaacatagttaatattttaaaatgtgactgggtggtatactacttattaaattttattcatgcagtataaactcttttcctcccacttcttctgctgaaaaaaaatcttaactcttattcatagcgaaggttgggatgaagaggttcatgtgaccagagcaggccaaccatagggccatatcagcctggatataagatttcattaagggaagggcacatgattcaaaatgagctagttggaatcttttgccaggattaaaacatgagtaaatttgtttggtgtttctaggctgggagcaagtgaatctggggctattaaaatccctattctctgctgagggaagaaagcctctttgcagaataaatacaagtagaagcaaacaaagacgagagatggaaagaaacggagtggtggcaacactgaaggtttccttctttctctaaggcctggctaccccaatatgctttctagtcttttatgccagtaactgtccttttttgggttgagtcatgtttctgtcattaaaatcaaaagcattctgatattacaactagtattttacattacttttcagatggtttttcactcgtggaagtaaaaattgcagctcttgagtcagacagaccagggttcaaatatctactctgctacttactagcgatattgacctgaaaaaagttgtatagcttcagttttctcattttcaatttaggactgacaatagtacctaccttacaggtttactgtgagagctagatgaaataatacagaaagtaaaataaagaatactgcagcacttagcacaatgtgatagtgcttaatatgctcaataattactgtttttctgtcgttattattatttattatttaaatatcactgtggtagtgattgctggataaccccaatatctactctgctttttgggttttttttgttttgttttgttttttaaagatagaatcttgctctgttgcccaggctagagtgcaatggtgtgatctccactcactgcaacctctgcctcccaggttcaagagattctcctgcctcagcctccagagtagctgagattacaggtgcctaccaccacgcccggctgacttttgtatttttagtagagacagagttgcaccatgttgagcagactcaaattcctgacctcaggttatccacccaccttggcctcccaaagtgctgggattacaagtatgagccaccacgccggctttgttcttcttttaataatgtaactttcctattttggctggatacattgctgcctgtaataaaaacgacattccccagcctcccttgaagcttgcagtggccttatgattaagttctggcaagtgggatgtaaacagaagtaacactagtggcttcgcaattgtgccccctttcttttcctctatcctactggctggatgtagcagccatcctggacccagagacagaagctcagcaattctaatcactgagaatgacagcagactaaaaggatcctggtcattgccagtctggaggctgcacatcagccttgggctgcttaccttggtaaatgtttacaggagcaagagataaaatgtaatcccgttataagcctctgtttaatttgggtttttgttatagcagctacaacctatatcctaactaacacacaattaatattttaaatattattctgactttctccttccaaaagccctgaaaatcagaaaagaggataattctaacaaaactagtacatgaactctatttaaactaatagttgaggattttcacataatgtaaactagctctttttattaaatgatatttggctaaggaaagaaggttgaaaatgagcaaggactgggtggaaaaggcaaaattcagtcatctgacactgagtgtttgtccccaaccttcaaactgttgaatgtatacagcaaaatcacgtggagttggttagatgccactgagtacttctccaaacacatacaacttcatttgttggctttttctaagcagcagtgatatggtttggatctgtgttcccacccaaatctcctgttgaattgtaatccccagtgttggaggtggggctggtgggaggtaattggaccataggggctgatccccactttggtgccattttcgtgataagagttctcaggagatctgtttgttcaaaagtgtgtggcatcttcctcatctctctctcttcctcctgctcctgccatgtaagatgggcctgcttccacttcaacttccaccatgattataaatttcctgaggcctccccagaagcagaagcttgtacagcctacagaaccataagtcaattaaacctcttttttaaaaataaattacccagtctcaggtatttctttatagcagtgagataatggactaatacaaacaaaatcaaaataataaaatctaccacccaaatgccttatcgcagggtccccatccccaaggccatggactgctactggtctgtggtctgttaggaaccggcccacagcaggaaataagcagtgggcaagcgagcattactgcctgagctccgcttcgtgtcacatcagcggtggcattagattctcataggagtgcgaatcctactgtgaactacacatgcaagggatctaggttgcatgctctttatgagaatctaatgcctgatgatctgtcactatctcccatcatccccatctagttgtaggaaaacaagctcggggctcccgctgatgctacactatggtgagttgtataattatttcattacaacaaaataattatacaacattgtgtattattatgtaataataatagaaataaagtgcacaataaatgtgatgtgtttgaatcatccaaaaactatccctgacatggcccagggaaaaaatgtcttccacaaaactggtccctgtgccaaaaaagttggggaccgctgccttattggactgttggtgtccactgtggtctatctgcacaagactcttttccccactaccatccaagagtaggcatggatgaaatcagaattttaacttctcatctcccctcagtgctgcacagatgggaacatccagtgacttgcctaattgctgctgctgctgctctcatccttaacgccattgctattgccattgtgttccagcctgtggatgcacaacatgtgcaagtgccatcttctgccttcagtttccaataattttattttctgcttagtcagaagcaaggccctcaccaataagccatttgcaagtaaagccaattttcaacccacgggtctggtgggagcaggactatccaaaaaatactcctgaaaacaccaacagtctcaactctgcttaaaagaaaagtagccacacataaaaacctcctatgcctgacatggtcacaaggtcataaaagccttgggagacagagaagtcatgctgagcttaaagccatcttgagaagtcttacacatgcacaaccctgatttgctccgaccctgagaatagcctgttgttaggcaatgtcggccaatacagactctacttgccaagaacttcaaacatgacctttacaaggtagcaattgttggaaactattaagatgcctctgaaaaaataatataatctgcagcgacaatatgctgaaagaaatgccaaccctgtaaagcaagtgctctctcgcctccctcacacgtgctcaggcagaagggaagagaaacattttcctccacagcagttcttaactctgcgtctctcttctgtgtcgagacataattgagccatttgctaattgtttaacagcaattaaggaagagaatgtcagggggaggggagtgacagcagacgggtgtttgcctgcttggtcgccgattaccagcagccaagctgatgccagtgaacagtgctggctctcaagactcacagtggtggcgcttagtgggccctctcctcaaagacaaggcccagtgctgggaagtgagcagtcagccctgacatctgagcttcagtcaggtgggcccagatgactgaagtccataaagtcctatcaaaggaggcctggcaattagacacccccaccccccaccacaaccagagccaggacctggagcagtagcaacctcctcctctgctcctttctgagctcccaggagcccagttcctcaccagatctcctcccattttctaaagcagctctctcctccagagtgagaaagcctgagactgcccacttgggtgaagcctgggctgcccagggtccagtcagcagcatcagtgcttctcttccagcagacagaattaaaagctggcaatcaggcccccagcaagctttactctttctatgctgataacagaaaagaaaggaaaggattccagaagtgctgggctcccagatggtccaggacaaaaccacaaagcggcaggcaggaggacttgcaagtcccgccaagctgaagacggtgaagaagtcctcctgggctcggagctgtaatgactctatatctgaaattcgaatcattgctaagaccagctgtagcttcccaaatacctttttagatggttttctatccatccctgcaccctctctgcaaatccaggcctccctcacaccaggcccagatgattccaggaggcttctcacagtcaccctgcctccaatcctgccccaaccatgcccaccctgcagccagtgtaagcatactcaaaaatataaacctttggtaggttccccaatactcttcaggcaaagtccaaaccccttcatgtggcccctgcaaaatgtggcccttggtgacttttctagcctcatttctacagctagtgaacccctttccctacctcacatgtgacccagccacactgacagtcaccagttccttcaaggtgccatgctttctctcacctcttcgaccccctcctccctgactgaatgagctcctgtgcccccagctcttactctggttgactctttccagccttaagatctcacctgaaccatcgcttccccaagaagactgcttacacctccaaactggttgaggtggccttgctctgtgttcctgcagcttcccaaatgtcccttatctaaacatctattctaacgaaaggagactgcttttcaatttgtctaccttccttgtaagttccatgaaaactggggctttgtctattttgtcttttgccatatccctagtatttaacacagtgtatggtacagagtaggaaataactcaatacatatttattgaatttctgaattcaataaagtcagaaatttacttcagtcttccttgccataaaaatgcagtatcaagagtagttaagaaattactacggcgatccttactgcctggaagccaagcgaagggtcagagtctatatcacactctcaaaccagctgcactgttggccttccatttgtcaattccctgtagtacccttctgttccttatcttttatggattatgctttatagtgtctgaataaacatttattgccatgtaacatcttacatcccttcatctcaagactctgtgcctttctgtgcactttatctttgatcctgggggagtcacacagctctgagtggtgtccctggtatcagggcattagaagaggcctgctgtagacaaagactccacaatgcatccaccacttctaggaacctctgactattgggggcccggaagcagaaggaaagcttgtttgatgaaacccaaggacagataccagcatcaagaacaggaagatgctcaggtttcttcttccagctgccccggtgatgctcacacagccatggaacccatcttgaaggagtaaacaattcacctggaaaaatgtgattatgtattatggagtgtgggtttccctgatgatgatgggacagggacagtaatatatttttgccaaaactaatttttatgattttgacttaatgacattgaatcacctccaactacacatgcgtcatggtctcatctgtcctttgtttcctgacaccgatgatccaaaaaaggttctaactccatgggatgggaagtcatttgctcctttacagttaactaattcactcttactaattgagcatctactggtggtctccaacaggtttgtctctgagactaaatcatctttttgaacctcaataaataagtggccaggtatttaggagcaatgtctaaaacactccagtagtaaatccaaccagactgaaatagcccccttggaaggaagcctcatagaatgccacaggggtctagaattgtcctctgcttcagaagtcttcagcaatcaaaacacagcttcagattaagtaatatttgccccactatgttaagaaagagaaaacacaaacttctagatgttcacataagacagaagactagcacactaatgccaagaaccaacacccatgccatttcccactgcagcagtgcccctcccaccactcttttccctttatcttccaatagaagtgaacagatcacagatacccaggcaggagaccatgggcgtaaaactcccactatccttgtcttttggggcttcggtatatcctacacggaatatgggagaagaatattacaacctttggtaagatggctttagacatcttcttctgccccaggaaaagggttaagcaggtctgggaaactgagaagctggtcaggctggtgcaggaattcaaagacactaaaggaatatcaggatgctgtttgggaaggtctgagggccaggcccagcagtatgtatatgccactcctcttatgaagaatccgaagtcattgcaaaggggtctccccaatccttctcaaaccagctattaagtacttctaagcaggcaaccttcccatatccaaaaagtcaactttcctgcccaaactaccaagaggctttgaccagcaaacatttccagagctatttcccgggcaactgacagcatttcagccatgtctgacaggttaccactgctctttgcagctcaaggttcacagggagctggcattttaagctcctcctgcgaatgagtggcagaggtgagtgagcaggtttttgctggggtttgatgtacaatacgccacttgcccaaacagtcctgagtactcagacatctcatggctcatctccagtctcaggctgaggatcagacagtttgctccagagctggaaggaataattagaacagcacaaacaggatcttcacaaagagagaaacattgcaaggagctgctaagtctctgccagagccccaggttgggtgttcagctaagcagcttggcccaggatagggatggcttgtttttttctattgcaaagctctctgcaccccattgactcaaatccaagttgagttatgcggactggaatctccccactccttctcagctagactcttttttggctcctctcttggtaatgatgttttctgagcagccactatctactacaccccatgcctgagcagccactataaacggtctctgcctctgggatctcacattcttaaggcaattataataccgagtatccctccagcctggaattgccagatcatcttctcaccttccaagctggctaagtgtccctgcttagacggtttcaatatcctccctctccttcttatctcatgtttctccacaggggcatcctcatggttcttcaaacacctcacactgacttactgcactggcccatgctattttctctatctggaacattctactcctccactctcagtttaaaggacaccccctcagagacaccttcccggatcaccattccctataaaacaagtctctctccaaccctctctttcagaactatgcttcatagtacttactaaaatttgaaattacatatttatatgcttggttacctgtttatttctgtgttccctaccagatggtaacttccaagtgagtaggaatggtgcctgtcttatttgccaccgccctcaccccatgttttgcacagtgcatacaacaactgcaagtgttcaataagagctgctgaacaaatgaatgaaagattctttctacggtgagtgacctggagcaaaagggggcaggctctggagggccccattagtaacgatagtggcaagggagagctagctgagcatttttagcagaggagacacacagacttttattacaaaaattctccttcttcggatatgtggaaattgactttggggtagcagaaggggcagactggaggcagggagacctattagaagggttctataaacactgatatccttgctactaaaagtgtggtctgtggaccagcagcttggtcatcacctgggaaactgctagaagtacagaatgtcagacctgtcatctcagaatctgcattttaacagcatctccagatgattgtttacacacctaggatctgggccttaagtgaaagacaatgatggcctgatctgcctttgggaatgggggatagaaatgactcatcagtgtcccctttaaatccaccactccagacatggctagggtgtcaaaagcaagtcctgttactataaactatcaaaaatgttgaatctattaggggctaaaaagagtaaggggatggggaagtgtgggtttagttgagctgagatgggctatggctattgagaaaggctataatcttggacaaagaatttctaactcacagaacaggtctggagttagagttaaggattcctgagtctggccatgaagaagagccaactcttttattcccattatgttataaattttcccagcacctagcacagtgcctggcactagaaatggatcaaatgataacctgttgaatgaaccaaggaaccaatcaagcaatgatatgctattgaatcctaaagcagatcccatgggtctgagtacaagccagacatatgtacctttccactttcctgtttgtaagaagcacatttttcttctcctttgttagaaaaatgtgaacatctgggaggataaaactcaactattagtggacaaaatcataaggatatatgacccgtgcatcacaaaatcgatagggaaaagtggtcacagcctctaaataaccctgataagtctctgaggacagcaagcagtgaggatcatcgtgagcctgtgacatctccatggtgtgagggtcaaggtggtgaggggatcacagagaacagaagtggccaattgtctgtgcagtgggagcatgacaagaaggaggtcccagcagaaaggcccaagaaccatgcagcagtgtggccaggagtcaccaagatgtcccctacagcaactctttagtcatgggctccactctgcaagttaaaccttacacagaaaaacaggaagacagatgaaaatggtgtagctctggctggaggagatggggagggcaagagctctactcccacccaccatgtcttacagaaaaccctgacacacgcacccatacactggctcctttgtgtctagcaatgttagtctagcaatgttagatcctcaggggatggttgtcggatatgaaaatgaagaagcaaactcctatcaattctatgatttccctttagttcattatcctggtgaaacgtacccattctcaatcacaaatggccatacttcacccaaggagagttccaagaacaaattatcacctcctttctctacttccataacccctgcctccctgcctgtaaatcctattattagagcttaggtgaaatgcccctctagaagaggcttttcctcatctttccaatagaaataaagccttccctcatccctccaataaatataaatagacatattttatcccagcccctttttctgtgaaacaattttcttgttgttggtttgagttaaaatgacctgtcacacacttgtccctacccccattcatctgtgaatccctgaggcacccccagaaaagaacagtgccttatttggggcctgtgcagggccagatgcattctagatgtgcagtaagtgtgaattaggtgtgcactgatgtcacaccccttccttccactgcactggcacaaggcagcatcacgacccccccttactggtttgctccccatcagttgagctatatgacttgcctcttttgaacagctggctatcccaccttctccaggaagcttgtctagattaacttcaggatcacatgccattctcagaaccatcccttcttcttcccctccaaccagcccagttacacaggatagaatatttttattttgcttgtctccatggccagagaacatctctgagtctgctaatgcagcagcttctcaagggcaaggcctggagcccaccacgcttcccaagccccagttttggcatagagaagtgttagaacaagccgacatgaagtatttttgataacataaaaagacaagaaaaccaaccttggatgtgtaggagtggccatctgagccgcagaccatggctgactgtgccacgggacagggcttgcacttgaccaaattcgaaggtccaacccagtgtttctgggccacgttccccttcttttgcctaaagatgagaaaaaaggggataaattagttgaagctccagaccctatgagtctttcctctaagttcccagaataaaaggccaaataaataaaggactatccaaccaggccaagggatcctgagggccttagccagcacttccatttgctccaactcattgataggaagcagaggattttgtcccagaagcatagattcaacaaaccagatggactgaggaaaacaatgtagccattgaaaacatgactactgacatgggaagatttttacaacacacagaaaaaaaaagaaaaaaaacggtgagggaatatggcttaatcagccccaataccgtatgtggcatatcacgggtgcccagagaacagcaccccaaagtctgagactctcctgggactcacaggcagccttttgtgtggaggacgcacgggcaactcaatgagcgctttagacaaaagcacacctctgaacacaactgaaagactttatcacagctgtagaaaactatctctggatatattttaaagtaatttcagtccagcttccaatctgccatttgatagaggctctgaggtgatgtcactttcaactgttaaaataatcagaattctactctttcattccagctcaagtttttccccattctaacctttgtcataatgataaatgtcgctattaggatgacttacgtccacggaaggaaccccatcactatatcataaaccactgaaataaaggcctgcagttactgccacccttcctctcttagccaaagctgttctccaagcaaaccgcttggagcgactcccagggccctggggctgagttctggttgaaggctacccgtctctggatagcccatcaatcaggcaattactgtgcctttgaaatgtttggcactggccttcctgcatgatgattagtgcttgggctctggagtcagaaagtacaagttcaaatctcagctctgtcattcactcacagtgcgaccttggcaaggtatttaatggtacaaatctcagtttcttcattagtaaaatggaggaaaatagaattgacttcaagtggatattatgaagattaaatgagcggatgtatctgaagtactcagcagagtgcctgcaaaataggaagcagtaaaaatggtagccattattacaattattacttgcccccacaggtgggggtatggaggatgaaattaccataaccatagaaatgtgattaatcctcagtccccaggcttggaatggcatttaattttcaaaataattcatggaagcagaagacggaaatattttctaccaggtgtggaatgaatctccagtcctcaggaattcaggtttggtatctagggtaacctaccctcttccaaatgaaggaaagtgagcaagaaagaaagatgcataaagccaagaggaccgttaatttggttcttattctacctcaaacctactctagcaatttgggggaggtggtaggaggaaaaaggtctgtttggggaacaacctttgagggtgacatcagagaggatcaacaggtacccacagcacagcacatggggccctcagagatcctaggctgggcaggccacagggctgagcctgtctaaccacagaaccagagaagaaagtcttatgagtgtcccctgaaatcaccttgcttgttcaacttgcttgtcttactagcggggaaaactgaaactcaatgagagccagagtcttacctaaagtcgtggagctgatcagtaactagatttcagatggcatgcacacagctgtagagagtgtccagggatgtgtctctcttctttagcccatctcagcccaacctagattaccagcttgaaaattctttgagggcacccatatgtgtgtcatttggggtcttctctccaacacttcactgctttcatagctgctgctcaccttggctttgccctctggattttttaaagtctattatttgcatttataaattacatgggcatgaggcctcctattatccttcatcaaacatacggtactctttcaggatttgttctaggatactgataaagggatggtgggtgggactccttgtggtgaaagagggggctgtcagcatggggttaatcttagggtacgtgattccttcagcagaacactagacttaatcatcatttacacagcagattgtctgacactgataatgaatcagcaaatgcaggaagtagttctggcatttagcagccctgctcctgggtcagtccccagtctgcatatctacagctgaagcaattcttgttatgagttcccagaaaggggctataaagtccaaagagtgggcagctttgctggagcagacataaccatgtaaaatgatgacctagaggaaaaaagcctaagggagcttagccaaagtcaagggagggagacgtaagcactgaaccaatggctttgaagaaaagatggaatcagctatcaatcaccagttaatgacaaatcatctctatcactggacctgaacttcaccattaaagtaagttcattaaagggaagcaacgaggtgaggctgactggtgcctatcagagggcctggtgcatcctggacgctaaagatatccctgtagggtggcggggtcggtggggggagtccctatgtgctgaccactgcagtggtatctcagcagttaatcacaaaatcacagaatgtcagaacgagaaaacaccttaaaactactctacttcaataactttattttctaggtgagaaactagagacacagagaggaagtgactttcccagtgtcaccgagaaatatggcaaagttacatcatctaaaattgttgaacggaagttgttcaggaaaccagcatcaatctgggactattttcatcccctgttttggcatatgtactttcattaccaaccttcagttttataaataatagtcttctgaaacattgttcctggctctatacctgcagagcagcaagctggacatacttgatatcaggtggttatgaattatgctcaggtaaaatcacctttgacttctcctaggacacgttgggggctctgggcacaaagggcaagccattctgaatgctctcaattctaatgaaacaagaatacctgttagatgggggcaaactcagctgttgcttacctccacaaggtaggactctagtggagatagcacatgattctgaagtctctttccagaggccaagtatgtaaagttatgtacaagtatatgtgagcccagggaagcataacttccctggctattgtatattttaatctccacaattcagtgcaaatcataaaaaaataactaacccagtcaaggcaagggactaaaatttttaatcaagatatttcttcatttctcttgagtcaatgaagagtgaaatccaatgaaggtatcttgatgggattgttatgcccaatgtcacagatatttgtcaactggggtgacacaacaatttagtctgagagcaggttctgtcagccttctctcattggccagcgagccctaaatccaccccagcccagctggtgccaaggggcagccacatctcctgcaggctgatggcaccacacacaaaatcccaaccctcaagccatccacgatggcaagaagacagataatcaacagatcactggcatttcctattcctttttgttcaactgtatattctccatctttttttaaaaagtataatcaaattcccagcattatgtttgtgaagcaaaggaatgatttttaggtgcaaatccgatcatgtgattctcctgcttaaaacctctatcttcagctgggtgctgtggctcaacgcctaaaatcccagcactttgggaggctgaggcgggtggatcacctgaggtcaggagttcgagaccagcctggccaacatagcgaaaccccgtctctactaaaaatacaaaaaattagctggctgtggtggcgggcacctgtaatcccagctacttgggaggctgaggcaggagaatcacttgaacacggcaggcggaggttacagtgagccgagatcataccactgcactccagcctgggcaacaaaaacaaaactctgtctaaaaaaaaaaaacttctatcttctccctacctcctagggcatagtctatactccaagcttgagaattaaactgtcccagcctaccttcacaggctccctgtctacctgctcccctccccaacacacacatgcacactgaccacgaccaacatcaatttttgctccagccactctcagccgtttcccagagccagctctttcccatgtgccatcatgtgggttttccttgacccacatttctcccctccatccacctttctctgtggcctggctaaaatatcagttccccaggaagcctcctaggtccctccaaaggcagtcaggctgcactcccactccaccatagcctagtgaccacttctggttgggttctctgactaatttccaagcaagcaccttgatttaacttgacaaaaggttaagaggttattattccaacaggacatggggcacacccaggctaaaagcctgggaagcccatgctggacacctccatcttcctgctcataccagttttccctgccatgcagtcctattaagttctatctccagccagccatatctaccacttaagtgtctcttccacgtgtcatgcaaattcaagtctataggactggacaattattttccatctgcataacaatgtctattccttgttcaagcttcaaatccattgctttctgtgaagtcttgctgaccctgtaaacttcatcccaagtagttaaccatgacattgtttattcaagcattataacctgttcagtcccaactgtggcattcactacaatgtgaaagttctttttgtgtctatcttcctcaatatactatgtactccttaagagaggtgactgggccttaatcatgtttgtgcttctggtacttagaaataggggaacacttggcacatgatcctactcagtccataagtgaacatattaatttggacctttagaattttctccttttatttctggaaaatgttagcactatggtgaagacaaaaatggtgtgttgttttaagcaacaagaattcaacaggctcttgtttccagaaatcctaattcagactatgaaaaaaaaaaaccatttagcaaaaaatcccacaaaactctagaaacaactgagaagtgggtggagggagctcccctgtgcatcagcgggctaaggattcccatactctagaagtcagacagtttccaaagctgcatgagggcctctgatgatgtggttccaaactgtcagcagatattaatcttcaggattcaggaatgataaatcagaatgctgaaataatgtttttctatatttatcacaatattttatgtgtttttttaaataagcaagaaatattaagtttagtagtatttataaagacatgcagcctagagcaaaaattcaaacactgtgaactgtcatccaacattattgggtagtactcaattaacataacatttggatcttctaacaagttaacagtactgcccagaatcacatgttgatattatcaaattgaagacttactttgctataaaacaattctttggaaccccactcagaggatttttataaaatatagtattgaaacaaatctattcacattcatcttatttacaagaacaactctccatgagtggctgacaggactataagcacaatcttttaagatggcaacagctacaagcaagatggactgcccaggtcataacccctctcttcaaggtgctcctgtcctggttcctgggaatgtcaaccttaaccttcaactccgcacgtcagtgtttcccactcttgctttagacaggaccccactaagatatccccaccctcaccaacccataccctgtgacctcccccacaggggacaccaagggagtccttgaagacatcaatgtgacccagcatttcacttgaccatggcataatggggccatagccagggccgacagcaagcaggtggcaagacagagtaattttattttagcaataaatacatgtacaggtgtaaatttcctgacataatcctgctgaatgaaattcaacaatctgtgtcaaaaatattttaataatggggaaagtagctgctaaaaacgtgtagaattgctgactttttctttcagtcactgaaggagggccattcattttactcagtacactctgccatctaccatgtttgtataactttagataaaactgttttcgctctgcatatgaacagctgctgaaggagtaaagcaattccagataatgaagaccagcagcagcagtcaacttgtttcgtgtggctactacatgccggtctaattgccctgaacgcatctccctgattcctcacacatagcaactactctgagggtaaatgctattaataaacccattttacagatcgaaaaaataaggcatacataaccagtcctagtaactggaccttcttttctgtcctgtctttgttctcttatcacatctctaagacagagacctgtcagctcaaagggatgaagaatccaccagagaatgatccctctccaataataagagtctttgtttcctggcacagaaggattacatgcattttactttcatgttactatcaaatcgcctattcaaaaataatgaatttgtttgccaaatcaaaactaattgcttctaaagcagatagttaacatagtggctattttgaaccagagacaaaataatgaatgttaattgaaatgaaaaacatgttaaccattgaaataatctgtcatgtaaaacgatgctataattcctctgttgttagggttatttgagtcattatactaagtcataaaattacacaggaagagcataatggcctgtgtcatttacaaaagcagctctgatgaaagagactcccacgagagagattttccatcgtggggtatgtgggctcacgtgtctccctcctgttccaaatgaagaagatcccagacgtgaaagcatgtccaaagagtccagttttcctaacaaggcaaagagaactgaagagagtgactcctgtgtgcctgagggtgtcccaagcactactgggcacgcaatggtgcaaaagacttgctgtttacagaagctgaaatttaaaaggacaaatatgtaataataacaataacagcagctaaacatttactgagctgccttataagcggccttattatgccactgctgctactactgctgttactactacccataatagctcacatgtgtccagctcctttaacataccaggcattgtttcaagccctttatttgatctgtccatctcctcctctcaacattcccaagaggaagaaaagtcaaggaagagcaagagaatctgttagggaggtggtgagttggggagatttcatgggaaagcagacgtggggcaatgggaaggacccatacccacaagataagccctcagcatcagggtggagggcatccattgattcaagctgggaggtcaaccacaggaataccagcacctttatgtgcttcaccccgtcttgcttggcccagataacgagagccagggtcaccacacatccaggtcaagacttgctcatatcaggagagacaagcaggccccagaagaagtagagagccatcatcccagggcatgctttccaaaccagccccaagccaggtttcttaagcaccttcaaaactcctaggaaaagtgcatatttaaaaagtcttagagcataatcaggcccaccagaaggatatgtgtctggtatgcatgcaattccaaaagcatgaacatctctctggtgtacccgaatgttgaactctagactgtggttcatttcaacttgggactccacgatgtacctctcacctggactgcacaatggccaaggcagctgaggagaatctattcttcatagatgagaggattgaacagcctcaaatgagaatttccaaaaacactgcatgagtaggtgcaaataaattgaaaatgagtaaagaggcacacaccaaatgtgtaacacaccctcaagaaaagtaggattgaggacatgaaacagaactgctgctttgttactctatatgcctttctattgctcaattctcttgcgaccatgtatcactgatctaaattgttcaaaatctaaaaaggaaatgcattttcaaaatttctaaagaaatacatgctgctggactcacacctgcccgccagtctcgcatttctacagcaatgcttaaagaaaccaaagttgtcacagtcagagaaagatctcccaagtgcaggaaggaggctgaagaaaggagttacctagataaaatcttcctgaccagtcctcaaaagttcagtggagatgaagaggtgagatcaatcctatctgaattaaatttccaccttaatattttgagggcctgtttaagctaagctatcaaagctgaaggtataaacattccaaatgtgttaggattctacagtctttactttttcaacaaacacttattaattacctagaatgagccagaaattgagcaacaaattcaaagatactgctagcactgcattaaatgtacgtcccataacatacattaaatgggatgattattaaacataatgatcatatttaatttctctgaacagctaaatttattcagaaaagatgttaccttaactgtttttgctcttattcttattttgagacattaaagatccacagactgataacttttccaacaaaatatttatgtggcaagacatttgctattaatttcaggaatcccatgagccaggctatatttaaatatgccaggagcaaattatgtggccaatgggaaaacagtaagaagaaaatgaacttgccagatcacaatccatatctctggtgattcacacactttggaacattacttgaatcaacgtttccctgtaagtgaaaccaaatttatatataatatatttaaatatataatttgtattattatatattatatataatatattctatattacatagaacattattctttattacatatagtgacattaattatatataatatataaaattatatattatatatttggtttccatatatatttataaaacagggataccagtattcctggacatcatataagtgtgtgtgtatgtattttatatacatatataaaatagggatactaatatccttattatccctattagtagtatccttattatccctattattatattttataaatatttggttttaaatatataatatataattatatataattattagtatatgttattatatgtcataaataatactgttattatataacagtattatatatgattatatatatatatatgatgtccaaggatactagtcaaacctacttccagcattaaactcacaatatcctccatgtttcctgaccagatcatgaagactaataggatgacgtgaccacgtaaagtctactaactggtatgagactgcagtctgcactttccattaagagagtgacagagcacacccagtaacactaagggtatctgtgaggcagacaccagtggggttttacctcaaagttcagttgttgaacaagcaaggcccctgaggcctgcatgcaaaagcagttatacacacacacacacacgcacacacacacacacacacacacagaggcactctcaggctctgactaaaattctgctttgccaaggaaaagtgccaagcagcagtgtaattgcaagctattagggaaatgtaaacgaacagttgagctttttttattcccttaggataatagttagtgatgcgctctgttttaaaaatccatttcttactaacaagggtcagaaaagaaattgttccttttgtccactgacctttggcattttggtttgatttattgttttgctactttacttttttcattggcccattaaagagaggtccatctctatccctgagaccttagaggaaatctttagcaatggacacaccaattggaaaaaagcaaatactcatcaagcaaacccacggctgagaacttcatttggtatctcctgcctgagcattcataatcctccttcttcacaggaggggccagagcagctgggaaagcacagattccagctaattgtaggctcaggtgtgcatacaaaggttggcacaagcacatgtcattccaccatcagcttcgctgttctaatcttggaaaacacttgcttacattccttgagggcaattaattatcatgggatgtgcccatgggaaagaaaacacctgtaattgttttctggtcaccagcagcaaagccccctgttctgggagggctgggtgtgattgccattaagaaggagcaagtcagtaaaatgaagcagaagtggcttcagggacatgatgccaggacagacacagagacaggctagatcctgattgagacatggcatgtgaggagcttaggctgaacaccattccccataagacattagtggtgggtcattcacaaaagcgctacaggaggctggtacagccagatccgcaccattacttatcccctgctcaagaagtttcttcacagtcagtgttggaggagaggagacggagccccagagaagctccttctctcctatgtggccctgactggtaggacattttctggattggtagtcaagaactctggctagctccccaggccttgtgttttctccagcacttgtcttctgctggtatgccccatccgttcccaaaggtgagctcaagtagcagccctctctgagaaggtctcagatagcctccacctccacacacatttgccccgtgttcccagccactcaaacatagctgtttatcactggccactttgggcaatacagttggtactcaactgcccctcttgtacagacaagatgctcaaaattgtgtcagcacagggagtagtaagccaatgtgtcccaatgctattccacagcagaaccagacagaacctattctacctagaccgtgttgaagttatcaagaaaaagccttttgactcaacctaaggaagataacccaaacatgacataagagctgtccacacaggaaagctacctcagaaagttggtaggcaggctcgcaatactgcaagagttcaagcagaaatcacctagaggaaggggatgtttccatttatttaaccttgtcatcactgaacatcctgaatcacactgaacatccctgtatataaacctgtatgtgaatgtctatttacttccatgagatagatccacaaaaatggaatcaaagaatcaagggggtcaaaatacccaccagaaatgttgcaccaatttgtacccccaatgccagcaccctgaaggagcacaacttcatcaccccaagcctctgctctgcctatttctaccaggtattgctctgagaaccgctctgatgcaaaggatttggaaccaccaccgaagaactgtaggtaatcacagagccataaagaacaacaagccaactttccacgtaccacaagacgaagaaaatggtgcaaggagaaactgctcaagttggagaccaggtagactggcaggaaatcacatatttcaattagtttgcagcatatttcaattagtttgcaggtgtatcctgggctcccacatggcagagagcagcagctgcaggcctgagcccctctcagggttgagcagctcaccacccagcccctcttctctgtgcttctccccaggacataaagcgaacccctgaggatgctgcctgctgcctccccaggcttatttctggctgagtgcgcaacacaggcctcaggcagccctgttgcctcctattctgaagggcaacatgggtgaatcctgtggaccaaggggagaggaatcagaccttagagagaagagattctggagcctacaagcctcatggctgaggcagtccttaaggataaacctaggccaggcatggaagagcctcagggctcaggaccagtgaagagccatgcaggccctcatcgagacagtcagcagtgtgcacactcaatacctgtctctctccttttttacttccttaaggcagatccaaggccattctgcagcactctgaagaacacagaactgcaggtctgagagactcctggggccactgggatggatgacatcctctcaccaccaaggccaagcctgcagctgcagaggagagctgactttagatgtgtgtagtcactttgcacaaagagaggaagacaaagagagaaggccctaaataagcaggctaccaggtcgggcagggtgcagagtctagttatgttgctctttctcaagaacagggccactttcacagcagattgacacattacctccagtttccctggggagtttcatagacacattctgagtattttctgtgtatccaggaatgtggtaggttctatgcagcaaacaaaaggaaatggaatatactcacttccctcatggtattaatagcactaactcttactgtaagcatcactttgcaactcggctgacctaacacagcttccattaagtgcaccagcttggccctgtacccccagctcctttcttgatttaactgattcattcatccattaaacgtgccatgaacacctgcagtgtgccaaggcctgagctaggcacaagggatacaagagtgaactagtcatgcccgcctatggctgacactccagagggaatctgggcattgcaagtgagtggtaagagcaaaacaagcagtggagtgttcattcagccagtagagaaagcaacaactgctgtagatcaaatgtctgtgtctccccaaaaatccatatatcaaaatcttaacctctaagatgatggtattaggaggtggggcctttggcaggggtaattaggtcattaactcacctctcaaagggattagtgcccttataaaagagaccacagagagctggctagctgttcccacaatgtgaggacacaatgaaaaaatgtcctagtgaaaagggactctcaccagacagagtctgccagtgccttgacctggaacttcctagccttcagaactatgagaaatacatttctgttgtttatcaggcagtttatggtatttttgcatagcagccccaaacacgataagatggaaaattggtactgagaagtggggtgctgcagtgacaagtacctaaaaatgtaaaagcagctttgaaacagggcaatggacagaggctggacgagtctgaatgtgcatgctggcaagagcctagattgtcatgaaaggatctttatggctattctggtgagcacccagaaagaaaaggagagagctatagagaaagctttgatcgccttagagaatacctaagtaatcctgaacacaatattggtagaaattggatagtaatatagttggaatatctgtcccctccaaatctcaagtttgatccccagtgttgcaggtggagcctaatgtaagctgtttgggtcatggagcaaatccctcatgaatggctggctgggtgccattctcactgtaataattgagtgttgagttcttgctcttttcatgtccatgagaaataattgttaaaaagagcctgggacctccctcctctttctctcttgctttcacccttgccatgtgatgctgctcctctttgccttccaccatgagtggatgcttcctgaagtcctcatcagaagcagatgctgcaccatgcttcttgtacagcctgcagaaccatgagccaaatatatatcttttctttataaattacccagcctcaggtgttccttcatagcaacacaaacatattaagatagcaaaggccattctgatgaggactcagacataaatgaggaatatattattagaaactacaggagatcaggcacagttgctcacacctataatcccagcactttgggaggccaaagcgggtggatcacctgaggtcaggagttcgagaccagcctgtacaacatggagaaactccatctctactaaaaatacaaaattagccaggcatggtggtgcatgcctgtaatccaagctactcgggaggctgaggcaggggaatcacttgaacccaggaggcggaggctgcagtgagctgagatcacaccagtctgggcaacaagaacgaaactccatctcaaaaaataaagaaactagaggaaaggccacttttgttagaaagttgtaagaaagaaacttggctgaattgtgttcatgtcctagtgtctgtggaaggtagaacttgcaaacaactaaactggatatttggctgaggaaatatcaaagcacagtgttcaagaagtggcctggctcctcctgattgcttacagtaaaatgactcaaagatgagattgttcatcaacagggaggcagaacttaaggatttagaaagttctcagcctattcatattgtaaagaatgagaaaacatgatctagagagaatgccaagggtgtggtaaagtgacaatgtataaaggagattagtatgggtcagccatcgcaacagaagccaggtgctattcaagacaatggtgagattagtcagtgacctaaacaaaagccaagagctatcatcaaagacaaggaaagagcaattcagaaatcatcagggctgctctacccatcacaggcccagagtacaagagccacagtgagtactatgaggccaccacagaaagaccacattagggcaatgcccacctactccagcagctccataccagcagagctaccagtgtatgattccagcccaagagagctatggttgcaagaaccagagacactgtagggggacagggctgcctggagccatcaggggcccaaaccctgctaggcaaagccgtgggggcaacacagccatctcaatgggtccagaaggtgagactctcactccagtgggtctggcaggcagtacccctaccccagtgggtctggaagggagtagctctgcccagtgggcctgaagggcagaatataaagtcacaaaagattattcttgaatgttaaagtttactactatttgccgttttgaagttttgacttacttggggcctgttatccctttcttctttcctatttctctcttttgggatgggaatcctatacctatcccacaattatattttggaaccacataacatgttggtttcacaggttcacagctggagagcaatttgcctcaggatgaacagtatcttgaatctcattcctactggatttagatgatatttagatgagagtttggacttaagactttaaagttgatgttggaatgaattaagacgtttatggctattgagatagaatgagtgtattttgcatatgaaaaggacatgaatttaatgggcgtcagaggaagaatgctatggacaatgtttgtgtctccccaaaattactatgttgaaacctaatccccaatgtgagggtatttggaggtgaagcctttggacagtaattaggtcatgaaagtggagacctcatgaatggaattggtgacctcataaaagaaggcccgtagatattcctggctgcttctgccatgtgaaaacacagcaaaaagacagctgtctatgaaacaggaagtaggtcctcaccagacacagaatctgccagtaccctgaccttggattttcgagcctccagaactgtaagaaataaatttgtttataagctgcccagtctatagtatcgtcttatagcaacccaaatggactaagataacaactgacattaaacccagaacattaaaaatagcaggacgctttgcacatatgatcctgaaaacctctgtgagattagcaaggattgttcccccatctgattgttccctgaggaactagaggctcagatgaaagactaaatttattgagtgcctactatgtactggtactaagctcactgctttccttataaaaataccataatgtggggtttaaagtaatcattttagaaggaaatggagattcggtgcaggaagcagcttgagggcagagtggctcttacacagaagatgggtttggggcagcactgccctggtcccccagctgtgccatttaacaggtgtcaacattaagcatgtcccaatgggtctgagccagtgtcctcatatgctcttaaacactagtaaatactaataaacactactaagtaatgctccttatctgagttcaaccctcccccaaccccaactgtagctggaagtgctttcttccttcttagagcttccactttatttcatgggattttctatcttctagattagattatacacattcacattcttaacctcctctactagtctacaagctcaatgaggatatcgttaggatttctaatgcacacagaaccctctagattctctcaagtggtacaaaagtctgctttaaagaacaagaatttaaggaaatacagtccaccctaaaccacacaattctatcactctccaactgaaagccacacaaaacatcccatcatacctggtctgagagctgcgcatgtcctcatggtcttcagggtgttgcagaatctagccctgcctttctttccagcctcatgtatccatactccttctttcctgaagcacaggcctcccctttctcattttcttttggacaccgagctccttctcttcttccccgacatagggcctttgcagaggctgttccctccactgagaacacttcctctcctctctgccttgctggtacctacacctttgtaattgcctgataggttcttcttgcccgctacacagagaaaaccaattcaccaagactgtgatattatagtagaaaaagagtttaatgcggagctagccaagtggtcagacaggagttttcttgctcaaatcagcctccctgagaattcagaggctagggattttatggataattgggtggtcaggggcctaaggaatgggtgccactgattggtgggggataaaatcatagggctgtgaaaaagggtcctcatgtactcagtcctcctctgggtaggggccacaggactggttgagttgtgagtcccaggtccaagtggagtcagtcaggggcttgatgtgcaggtctgaagatatctcaaaagatcaatcttaggttctacaatagtgatgttatctataggagcaatagatagaatagggaaagtcacaaatcttgttacctctggtcacatgactcctgagcagcaaggaatcagagaaaggcaagctggtagacaatggctggttattgtttagctacacctacattttagccgaattcagacccctcccataatcctaatcttgtggcttttcattagactcacaaaggtggttttggtccctgagcaaggaaagggatcattttaaagagggaacttcccctcctttcttcccccctcatccttctttcaaagtttaactataaactaagttcttcccgtagttggtttgacctgggtccaggaatgagtgaagacagccagcctgtgaagctagaggcaagatggagtcacccatgctagacttccctcgctgtcataacctttacaaaggtggttttacctttgccccctgcaaaggccttcactgttcaaccaatctaaagtgattcttaaaccactccactcttatccttcttaatcttaccacagtttattagatacttattttttttcatctgtctctttcaatagactttaatctccacaagggtagactatgcccactcatcataaaactccaaacatataacacagtgtctggcaaatggaaggcacccataagtatttgttgaataaagaaattatcacaaactccaacttagtgggatctgaattaatgatccataacccacaatcaccaaagcatgcacatgagcagttttctgagctagtcctgctgaagcaactacaggaaggactcaagctctaaagcatttcatcactgtcaccatattcagagatggcctccctggtgcctgccaagagaaggtatctagctccaggccacagggccccttgtcactttgctgtctacttgggaattcctcacagtgatggaaagtttgagctgggtctcctcctttccttcaggtcaatgtcactgttccgaagctagacttgcagttcactgggaagcatgacaccacagcacctccagctgtggacgcatcatggacaagccaggctgagaggagaacttctcattacttgcagcacagcaacattgggttcaatgtatgcccatgaaaaacctcatttaagagaatgccttggaaaggtgccaaggtccccaaactaattaactttcatctctcctggccctctgcaccctctctccatgaggaacattaaacatagaacatcagcttgagaacactctatttaaagcaaaagtccttctaaagatagccttgaacgtccatctaaatcatcctaagtccattttctggcccagaatccacaaggccagcgcccccgatgggccctactatggtggcttatatccataaagaatgtctttcacggttcattggttggattaatctgatataaagtgtctaaactgaaaacctctgggttcggatcttgatgagttttggcagaacagcaagtaagtgacagtagatttattaaataacaaaggaaaaggaaagtgattaaagaaaaattaaaatgaagtaaaagtgggaaagttcaatctcataacttttataaaagaagattatatcggccaggcgtggcggctcacgcctgtaatcccagcactgtgggaggctgagatgggcagatcacaaggtcaggagattgagaccatcctggctaacatggtgaaaccttgcttctgctaagaatacaaaaattagccaggcatggtggcacatgcctgtagttccagctactcaggaggctgaggcaggagaatcgcttgaacccgggaggtggaagttgcagtgagcagagatcatgccactgcactccagcctgggcaacagagtgagactccatctcaaaaaaataaaaaaaagatgacgacatctttgtgaggaggccacacaggctctggtctacctgaatactaaaaaatatctcccccccgggtgtggtagctcacgcctgtaatcccagtactttgggaggccaagatgggcggatcacgaggtcaagagatcgagaccatcctggctaacagggtgaaaccccgtctctactaaaaatacaaaaaattagccgggtgtaggggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaatatatatatatatatatatatatatatataaaaaattagctgggcatggtggcaagtgcctgtagtcccagctactcaggaggctgaggcaggaaaatggcgtgaaccagggaggtggagctcgcagtgagcagatatagtgccactgcactccagcctgggcaacagaacaagactctgtctcaaaaaaaaaaaaaaaaaaaaaatctccagaacttgctaggaattttgtactcaagatgggcaatttaacatcttcagtgaattgcaggggggctcaggtttgtcattttctcaatgtttagggagagatgtgctctagcaattcacacctgagtgctgcccagcaagatctgatccctaatggaaatcacacctagtaattatctattcaaaataggcacacctacctcaacctcctctttctaatccactgaaatccgatgtaggaaatataccaatatgtacattccttaataagcaaggataccaataaatacagcaactgcagccccattattctgggcagaactgcagagaagggcagtacacttaatgccattttactggaaatggaagcaggaaatcggagggcattgctaatcaatccctggccctaccattcccagcttcgcagacgcttgacttattagcatctgagcatgtgcacatcctgggaattcaaccataaaacattctccatctcctacagataaaacatggctcaaaaaaaagatggtgatccagtgctttggggtcaatggaaaatatgaactgccccctctggaagcgctttttttgttgttttttgttgttgttgttgtttttcttcagcaagtgcagcctggaggggagatgccaagctcccagggcagaggctctggttcttgagggcacatctagaaactaccaggccaggcaggaggtaggagtctcactggttgaccttgccaggtaaacctgccccactcacccccatcttcagatggtactgaaagcaaggcttaaatgaaaaatgggaaaacaaggcagaacaagatgagtgtgacacattttactggcagtcttcttttgttatttttaaaaatgtattcgtaggccaggtgtggtggctcacacttgtaatcccagcactttaggaggctgaggcaggcagatcacaaggtcaggtgatacagaccatcctggctaacacagcgaaaccccacctctactaaaaatacaaaaaaattagctaggcatggtggcatgcacctgtagtcccagctactcgggaggctgaggcagaaaaattgctcaaacccaggaggcggaggttgcagtgagccaagattgcaccactgcactccagcctgggtgacagagtgagactccatctcaaaaaaaaaaaaaaaaattgtatttgtaaagggggacccccagcctagcgaatttgcctgacaatgtgcaatatctgcctctcattctgttccttaatccaagggactaaaaattccacataattattcacatctccattatgaattgctttttactctctgctgcttgtcatcaaggtcatctaatcaatagtcttcgtttcagagagaaaaacaaaggaacagaggagttaagtggcttgagagttataaaaccttgttcagtgaaggctccacaaacagctaggtccttaacctgagcacagccataaagtgattctgctgtttaaaaaaaagagagaggcgattgtgggtttaaagtaattaaatatctctatgtttaagtgacatgtggtttgaatgattactttcagaaaagccaagaaggggaaaaatgaactcagaattattgctttgggcacagaaagaagaaataggtttaataccagggcatggactagttgctttgcgaggggcaaggattaggagaaaaggtcccaggcatctgtacagcagcacctctagggccaggagcagatgggctgggggtggggggggtagcggggggtggcagttatcactaagggaaatgtacatcaggcccctgggagcttgccccatgactccacagcagaggaggctgtgcagcataggcaacaggcatggactctggaagtgcagtgacctccactgtggttctaatcttccccttactggcagtgtccaattaggacagttatttacacaacctcaacaatcccatctgtaaaatgggtattataatactgacctagcagactgttgtgagaagtcagtaagatttctcctgcaaagtgtgcctaacacaagataggtggtcagtaagcagcaaccttgagccagccactttccttctcatcttctttactgtccagtggtatttatttgcagaacagtagaccacagtgatgatgtttctgtttacaaagatgactactctgaagagggaaacccaaaactccatgcattaattccacaatcagtgtaggaatatagcaccaagctctcactggcaccctatccagacccagaacacagtaaatgaagatcctctgagcttaatggagaaccccaaagcaatgcatgagccacttggagaaggggcataagctacataaatataaaatcatagtaatgaatgtgggcacaatcactctttggtcactggcaatgccttgacttgtgaagtgccagaaagccaaccagacacccaggaattacccacctcctgcatggccacgtgtcttccaaacctcgacagctatgtgtatgtgtaatcaaccagttcaaagcccctgtagcaggaggcagtgctttgttgtaaaacaaaactgagatgaaataaccgtcatcctttcaaatctcctctgagagtttggtatttgaggcacattctgtgatgtacttctctctgacctcgaacactttgattctttttctcaagttcacataaaagactgaaaactctcagatcggtctactgtatcgagagcctcgactggatctgaattctttgctggtgtggagaattagttgttattccagatagttaagaagtggagataaagggccattacattagagaggcccagcccattgggaagtcgggccatgtctgctccttatttaaaaacagattagttcccactgctccccagaggcttcgaagggtacacttagatattgtaagttccatcctgacatccctccctcccattcacaatacacttgcagaatttgagaatgtggcttgtctggaaggcttaaaacaaatgcttcaattttccattctccaaatgaaaatcaatggcaacagagaggtaaaatcaatgttcagcactctgtagggaaacctccaccctctgccccacgatctcccaccccacagaacaataaatcagaaccagccatgcagactagcagaaaatccctgagggcagagccctctgcatgcttaaagactttctgtttgtccccctgtcccctaagagaacatttttcttaagaatgcctatgagaatgttgctaaaacctaagtcaggaagaatagcacaaggttgtaataaaaacccttcttccgcaaacaaacccatttaccaatgggatcctgggcatctaagaccagagtgtgacttaactgtctcccaaagggtctactttatgatcgaggcttacagaatgcttaggcactcaatgatcactactctgaggacaaataacctgctttctgtcatcacagattggtctgtattctctacaatttcaagtaaatggaaattgtatagtatctccccctttttgtgggaggtttgtcttctttcaccctgcctaattattatcagattcatccattatgttggatgtatcaatagcctatttctttttattgctgaatagtaatccattatgagatagaccacaatctgtctactcattcatctcttgttgacatttgggttgtttcacagtttttatccatcacacataaagctgatatgaacatgcaggagggagtctttaaatgcacatatgctttcattatattttacaatcaaatcttttgttgtacatgttttgcaaatattttcactcagagtgacttgtctttttcatttttgtaaaagtgcctttagaagaccagtgatgaagtctaatttgttgcttttctttttgcattacagttcaggctttttgtgtcctacttaagaaatcttagtcaaactcaaggtcataactcctatgttttcttcgaagccttcttccaagacttctaaaaaagcctaagctcttatatttaggtctacgactcatttcaagttattttttgtatagtatgttatataatgattaaaatgtataactatattgcttgagcccaggagttcaaggttacagtgagctatgatcgctccactgcccttcacccagatgatggagactgtctcaaaaaaaaattatatctataaataatttgtagtatcattaaaatactcacttataaaaattaactaaagaggatgtaatagaaatttttatatgcaatataggaaccacttgatcagttttgacaaaaacacaccaatagacaaaacccatgatttgaaaaaagaatggaagaaaatattccacaatattttaattactgtttttagagagtgtgaccattgcctatttcttgtttctttttttctctacttttaatgttttctataacaagcatcaactatcattacaccaaactaaattaaaaattattttaaagtagcttaagagaaggcttcctgactcccagctgtcttcacactgctcttttgtgcataactggcccttttagagaacttgaaagatgaacatactacaaaaatctgtcccttgcaaccccactctacattgtttaacagcaggaaggtgtgaaacaaagaatttccaaagagaattctccaaagagaatatgagtttacctgaaaccaaatacaaatgccaccctaatcaaggagaagaattccagcaggggagggctggctgccttgcttggccccccactgaaattgcttgcctgccggccctgacacactgcagtcacagatgtgtgtgtcaaacagcttctctgctcactcaatctccacagacaaagaaagctaatgaaattctctcactgacgtgctcactgtccttctgtcttgatctgcttgcaaagatagcctaagtctggagcctcataatcagctaaagcctggcctggctaactctctgtgtgcactcatgactgtctggcaggtgagatttgcctcttaagctgctgcagaggccaacttggctggcaagagtgcctacagatgtttcacagagagaaagattacttccctgattgatgaataaatagagttgtcaacatggtctccctggtcagaggggactcctggagtataatgtggaaggacagatgtttcttctgggaaggtgtccaagacccttcaaagaggtatgcactcaactgatatcgtggactgagtaattcagcctctaagaggaagacaaggaaggctggacataacaaccacaacaaacacactcagggacttcctggaccaggccacctcccagatcttgataaaggagtgggcacaccatctcagccagtgcctcctccttgggctttttccattgaaccagtgggcccaattatcagaaatcccatcatcttcttagtctacacctgctgtgaattgcaaagggggcagcagaaatgacactgtcatcctcacgctaaacctcaaaggcttcctcttgcagaaactgcagacgcaggtgcaatcaaactgggtagggaccaaggcacctgtagtgaattactttttagtcagtaacttgcaactttggagatttctggctgaccttccgaaatgaagtagataataataactattatcataattgtctcagtaattgtacgaacagctgctattatttgacaatagactatgtactttacacaccatcattttattgaacactcaaacacacacacacacacaaaatactctgcaaggattcataaaatttatcatccataaaccctccctgtaagaattactagaggatgtgttccagcaaatgaaaaagaggaatggtagaagcactgtcattaaacctatttaacagataaggaagcacaaattcagaaagataaaataacttgccaaggccacttggaaaaggaaatagccaacctgggaattgagcccagatgggtctccttcccaaatccatgctctcacccactgtaattttatggtcaccaggagatgtgggagatgaggattacaattttcaacacaagcaaaagtgttggtgcttccaacacagaaacacggcatgcccagaaaaacaccatttacacctggatatgcctgaatatcaatgaggctgctgaataggtctcaaaccgatttgagtttaaaaccaaaaatgtcttgtctaacacttccagaaagggctatatcctgcattgtaggaggaaacatgcaatggactctccatcttacacacacaaacatacacacacacacacacacacacaccacacacacatggctaaacaacctagagcaccatcccaaagggtatttgggtatttttaattcatatggccacatcttccctccatccgagaagaaagacattgcatgtagcaggagattctaggctagttttctcagataatatataccttaaaaggaacttcaaataataaccccccccccccaaaaaaaagtggtatttttttacataccactccccaatgaacttgactttccttgagggtaggaatagggtctcttgtttacctctgtagccttagtgcctaaggcctcaataccttttcgttgaatgtcaatgaatggatgagcagacaatgacaggtagaatgaagacatcaacatattgtagtagtgaaaaccataagctttggaggcagacaatcctgggtttgaatcatgctgctgcttgcaaacaaattactaatgcctcactagcttcagtcctctcatttgtaaagcagagacaaaataaataccaaatttacaaaatggctgaaagaactcaaggaaacaggtgctgagcacaatgcttgcacaggctgaagtattccagggatgcaatctagctttactaccaggaaaacagttcagtctggggacagagaaaagcacattatgataccttgcatcttgctcttgtagagacaaagtctgattattttaaaaacaaccttgacagtgacctcagagcaagatgaccctggatgctaggtctattgttgcaggtgccaggcttagagaggccagaggggtatggggtgggggctgctctagatgctcacctcatgccaggagcaccatttctctgccagaccatgatttcagagggcaggagctccctaggcacattcagaggaaaccatttacaggattgagggaaattaaaacatacccccagaggaacagccaaggggaccagcattgcttggacttcaggaacagagggaagggataggacccattctgcatggtcccagctcaagctggagatataaagcaaaagttctcggtggggagccgatttaagtgggaatctttatttatctaaattcagaaaggttgctttatttgtctgaggtcatggtacagtgccggtgagcagcaaagcatactacccacttgggaactggacatgggcaactccaaagccccactgcgacacctctcaattgtacaggcagcacagggagaagtgcagaatatgcactgaaattgccttcctctcatccctgccccatctgactcccttcttaaagaaagcccgtttgcatgtgtatgtttgtttgctttcatgcttcaggtatttttgcaggaccaaaggcagaagcagtctgaattgaaagcctgtatccatcatttgtgaaagcctaaatccactggatagatgatgctgggagtggaattaggggtaaaagcaatggctttaaggaccctgaagaagatgggggatacttccccctgggctggggaaaagaggatatcaggggctgtaccctgaggaaatagcatgttcccagaaggaatggtggtgtggtggtcctgagaaggcaggacccaaaaaccaaggatggcaaagatgctacatccaatggggacatggaagcagagagcccttgggcctcaatggacctcgaagaatcatcacagtgaggttgttagtgcaaccaggagactaaacacttggcccctgctttcttagttgtaagtttcctgggtcgtggcatcactctgggaggagaaaattctcaatcatgaccaagaaggaattttctgctcatctgttcagatcaggactcagagtcaaaatgaagtagatttaaaggaaataaagatggacattctttgtaaacctgtgtttgagaactgagattcctatcatagtcagagtacaggcaccaaacaccatacaaatggcgaccctaacactatgctctcccctccccatatccccacgtcaaagactggaaaccctcagatctgccagctgcagaatgcctcccagcccccagcccccggccttcctgccttacctggggagcaggtgcttgcggctgacacacagggcggtctggtagtcctgggtcacacacactttgtgagggctgcattttaccttcaggcaggggtccttggatgggtccagggctgaggcaaaaacaagaaggagggcagggtttaggacctccagggaaatttaattttttttttttttttttttttttttgttgagacggactctcgctgtgttgcccagactggtgtgcggtggcgcgatctcagctcactgcaacctccccatcctgggttcaagtgattttcctgcctcagcctcccaaagtagctgggactaaaggtgcacgccaccatacccggctaatttttgtatttttaatagagatggggtttcaccatgttggccaggctggtctcaaactcccgacttcagatgatccacctgcctcgacctcccaaagtgctgggattacaggcctgagccactgcaccgggccttaatttctatttctacttaaataaacagataggaagtaaaccaaccatgtgtttgccctcggtgctgttctctgaggctggaggggaacagaatgaaagcccaagccaggggaaattctgtgtctatcacacattcttcctcaacatcaggggagcaattcctttgtgctttgggagtttcagcatcttcagctcaggcaggaattacttttaaaaaatcctttagaatctcacatgatccaagaaacaagagctacttttccctctttggttatgaatctggtgttgctttttatgacttcattcatgcctaagtttacttatttcctatgaaaagtccttgaggacagagttttttgcttccattcaataaacactatgtgcataaacaacctattttaagtttttgaagaacttcaggatatgtaagacagttttgtgccgcacaaagttacaacgtaacagggagggggaaaagcttacacataaatatttattgtgcaaggcagaattagataaggaccatgacgggcatataaaatgataacagagcccaagagaaaaatggagatcaatttctagggcaaggattggtgaagcattaatatgtgaattggatcttgaaggatgggcaggattttgaaaagcaaagatagaaaatgcaatccagtcagagtgaaccggcacagagagtgtagggaggcatgttcaggcaatcataagatactcaatctgactattaagtgtggtttgtagggaggcagtaatgagacaagagggggtgaggggagttgattccaacaaagtaactccagaaagggtctccaaagacagcagttcatatattgcaacatttcctggaataggctgagcagcaggtcctcagctaatcagcgctctgcgtgctgaggtgcacatgctcatcattggcacagaagaggcctcggggaattctctgcaaaacaaaagcaattgtgccatcttcaagctctggggcctaaagcctattaagcagtaaatctttcataactgctctccacagtcaggggaggtgatgtctccccatgtcctccccatgcaaacatttggttaaacaaattggcatcctgagcaggtatagcaaaacttctacaagaaatgacatggtcaaaaaaccaaaccaaaacaaacacaaagaaatgtcacagtgccctcaaccactggactcttagccatcctgactcctcagcatgtagaggacatcactgttcctctcctcctgcccaggcccagaatctgcacactactttcttcaaatgcctgctgcgaatttctcaagggtcctgaacacacaacatccaaaagcatttctgctacttgaacagcttaactggctccctccactgccgcagcttcagcagctgtaaacagaagccaggctgcattctcaggcccatctggaaagtaataagacccagggcccggtcctaggggagtcacctggtagagtctactccccaagggatgtgactctgatacttggagcttagcagaaagaaacaggctgtgagataaaagagaggctgatttgagccccagggacagagtgttcattcactcagagctcttaagctgaaggcaacctctgcaaggcaggtggcagggccctgtgtctgccttcagagtcttccaaggctggggcttccagaaacttgcagcaagagcttcctggtcctaagtggaactcttttggttcctggggatgtctgcataagaagccaggagactggtgcagtctcagcccagtgcactgccgcccacgccaaccctggggctgcagctcagccaactttgactcactctccaagaatcattcaaaattgagtcaacaattaagaatgattaccagatgaccactaatgatgaaagtttctcaagggttctgaacacacaacatccaatggcgtttctgctgcttgaacagcttagcaggacatgtcagtccttcattgccccttctcacacttccacacaccacaggatgaagacatttatagatctcaagaaacctggggactagaccacaggcagccccagtcatagttatcagctgaggcattttccccaacagatgccaagtgctgcagcagagaacttgagattttcacttgagtggatgtcagagacagagaaaaacaggttggcctagggtgatgggtgtcaaaatctgcagtactacatgacaagctttgtggcagaatttgagcttatttttgcctctgtatccaactttgttaacatgccacactgtcctccgggtggtctcaacggacagtgcaatcacaaggatcatgaatcagctgagcagatccgggaacagcacagactccaaggcagagtagcttctggaacagcacggactccaaggcagagtagcttctgggactgaaccctgcctctgctgcttgctaaccttgctatacctcactttcctctcctgtaaaaatggggataataacagcacctgctattgcttggtggttgtcatgaacatttaatgagttaatatctgtaagtacttagacctggaacatgctaagcacctcatatgtgtttattaagttttttgtgtttgtcttttttcccagagtaaataatcagttttcataataacaaagaaccatagttaacactcactgagtgcttttgacatacaggcagtgaactctgattggattaccacatttaattttcatagccaccaaaggaggtagctgctattaatgtgcaagtcttaaaaataaattgctaatgagagatgcaggacaaacctggtctgtgactccagaacccaaactcttcaccagtgtatgcttgaagcatgagaatctcctactatcttctttaaaaagctgattgcggggctcacctcatgccaagggcccaagtgcaccatattcttaagaggctttgggggcagaatgagacttactgggtaaaaggagggggcagccagattacccagtgctgcagaggatggtccacgattccctctcagtacaccccacaggatgaggtcaccagccctgatctttccccagaggctggggtgcccagctctggacacctgagccctcagcctaccccctctgaatgcagccatcccccaactgagtcaaaggaaccatggtctggtcaattttgttcctgtagttttgccatctgtcaccctaccttaggctaactcctgtagaccaccctccacttctggaagctaacatttctttaaaaacaaaaaacctccaacccaaaatactaataaataaaaactgttcgttattaaactccctacatacttaacaatttgcatacagaaatcaagtctgctaaaaatcaattactggggtctgaatacttcaaacatgtatgcaaattatttagagtaaatgaacttcacagagcaacaaaacagtaacaaatcaagctgtcagcatttgtttaatcacctcgccgcattttgtttttgagaaacagcaacactgggattgaaaggggatgaggagtgtgtcatttccatttaaactcaggcctcccaaatacgttttacctagcagcctcaaggctcagggtgatggatgctcctgaaaggcacccagcaccagtactggaaaggactgtggctgcactttgaaaagggaaggataagagatccgaataataagtggcatttgagaggccttttaataagtaggggaaactgtaggtgagaaggtaggagaggcagctgagcgtgacagccctgagcagagttcaaagtttccttgtcatggtgctattgatttcctggggacttgctccaagtttcaatctctctccgcatacaaggagtgagaggatgcagacatccccagaggatgacaaagccctgtgtcttctctacctcttctatcaccaaacctgcaggactcctgtggacccaaacaggacagcatccctagcacagagcaggcgcccaccaaaggttaattttatctttcccacctatatgcagaactattcaagagtcaactggcacccagcacaaatccaattatttttttcaaaatgactttttacagaaacctttctcaaggaacaaaccaagaatgaattaatttaaagagatttgttaagctgtaaagcattgaattcaaaagccagttaattactggttccatgtaactttttttgattaattttatttttaagctcactacttggtctcaattaaggtggtgatattttaattatcttaattgtttctgaacttgtttttcagttcaacgagttattttttaattagctacattgattttaaaatcctgaatcaagcctttgcactcttcttgagcacatcctataggctaattggcaaagggtcatgacacctagcacagcagagcttgataccacctcagagatgctcagatgagaagaaggttccattttgtggggtggcccaaagggttcctcacctgggggaaatcacacacatttgtgtttattcaattaatatttacagagtatcattcagcgtgaagaatctttctgcaggctaaaggtgaatacaaagaggtgagcaaaaagatgttcttccagctctccaggggttcaccgttgaacataggagacaggtgagacaggtaaggtacctaattcagcctttcagggggtcaggtgagacttcctggacagactgacatctatggaaaagtaggtttaaaccagataataggatgaggaagaacactccagataacaggaagttgtctttccaggggtaagaaagtttgtggcaggcttaaggaattcaagtgtttcatgaggctggcagcagttggagcaagccggtgagtaaaaaggctggagaagaggctgagcctggtcctgaagggccttggagccacagggaccatgctggggagccagggcctttgagttccacagtgccttcaacccagcatgcaagaacctgtgaccagactaaagtcgggggagaggggcaggaagagggaaccctaaatatgcattttatgtagaaagtggcacttagtaagaacagacacactacatatattctcgtccgccaaatgacagaggacatcagggctgaaaggcccagtggtcaactcttagaaccccttttctcctgccaggaacctccttcctccctctccccaggaacaccaagccacacaggattccgggaggcacaagatacctgttgagaccagtaagcaaaagattaatctaaaacagcagcttgaactcctggcccactctggtgagttccagaatcttcctcaggccagaggccactcgatttgcaaaaagtccaccagttaaagatgccttgttgtctcgctgttgcttttaagactgctctctgcctgagtcatgcgatcccaaggttcacgtgaagagcagacactcccagtgattcattaggagtgacttaatggacgactgacaaagaaattacaccaaactgtgaaaacctcgtcaagctatgagcaggaacatttattgcagcttgtctgtccccatggtaacccgtgcatgcatcttgcctcccttgtctccagagaggcttgttcaccagctgacgacagagcctctcagaatataaaatagaagattctgcccataggatttttgctgtaaccagagaagaatggcagcttggaaagcctcctcacaattctttcctttcatattcaaggggctggccaagttctccgaggccaaacaaagggcctattagacatgtgcctggatagggcagagagcagagtggcataaaggttggactcatgcatttaaggattggggaattggtggggagggacacaggacagacagagacaaagaggcagaggagagaaagatgagtctgaccaaagatagccctcctgggaagagaccttttctttcccctttaaactgaggtcctggggacttctttctgtgtcaaagataaaagcatcttctctgttacattatttgtgtatgtgtgtgtgtgaggtgggggagagggttataaattgataacagccttttttgggggtcaattttttggttgtgcccttaaatgataacaattgttaaatgtaggtagatgggtgtatagcagtttatagtatcctctcaacattttggtatacataaaaattataacaagagaaaagggaaaaaagaaacatcctatgacccagcaagtgaacatattaggcaaaaatgttcatcttaataatctgtaataagggaaaattataacactttgaatgtccatctgtgttagtctgctcgggcagccataatgaaagtaccacagactggtggcttaaacaacagaaatttattttctcacagtgctggggactagaagtctgagatcagggtgccagtaaggtgaggttctaggagggccctcttcctggcttgcagccagccagctttttgctacgtccttacatggtctttcctcgatgcaagcacttggagagacagagagccagccctctctcgtgtctcttcttataggacacttatcctatcagctcagggctccactctttggacctcttttaaccttaattactttcttagaggccccctctccaaatacagacatcctaggaattggagcttcaacgtgggaatttgagggggataaaaacattcaatccagaacaccaactgtagggaaatggtttagttaataacataatacattttttaaacatcatgcaactattttacagaaactagtagatctatatttggtaacataggtagatatttatgataaattaagtgaaaaggcaagttgaagatgagaaaaccaatttgaaacggtaaagtaacttcccagcaccataaagccttaatggcaaagccagtactcagaaccagacctgccttcttccaaaagaagcgcctttcccttccctacccttcctctccggacagccacagcctctgccccactcacagaccagggccctcagtttctcctgattgccctctatctcatatcctgtctgcagcaaggagacaatgacaagccatgaccatggccagggtccagagcaggtgtccagccctgggtgatcttggcatgtgtctctgagatgaaggagttaaggactacccactactgagagtgtctgggaattgcttggcccctctgctcacatgcaaagcaagacattatgagcaaccactgataagcccaacatggtaatttacatgtcctgatcattagaaaagaaggcgttaagaggggtctgccagagcagctgtggaaatgtgtgtcataaaatcaacaaccacaaaattttattagcctgggcagccaagcctcccttctcaaagctatcatctcacattttccctgctccccagctgctctgacaaggaccctcactcagcatttccatcaagaaattgatttccctttgaaagtgtgatgggagtggaaagaggaagtagaaggaaagggggaattaaatagaaaggaaggggagggagaacattacatactctgtcacccaattagggggctgacatggagacaatgacaacgaccaactatagaataatgtactattatcctaattcaacaataaagaaactgatacagagatcagatcattcttaatttaccaactggtaactgacagagaaatgttaagcctgtttgtggtcacacagccagtgagcctggattttaatcttggcgagtctcacaccaaggctgatacttgaagccactaagccactaatgaaaataacttctgatggggataaaggtgatgattaaagtgtcaagcagcaatgtatcacacccctctgtccaccttccccaagattcatgttacccagaagacctcataaaaaaagacttcctgtgaaaaaaaaagattgagctatcagaaatcaaagccaaattgctggctatcttaataagcttgtattacttttataatgaatacaaaagtgcgagctgcttttaaaggcaatgctgctgtcctgtgaacttaactccctctgacttaagaaacaatagtgaccaggtgaactgactgtggttccttccgtgaggggtttctgtgaagtgtgcgtatgttccacactgctaatggggagatgcatgaagcccagcgcagcatgggacagggcagtgtaggcaacaggagctgagaatggcctggcctctaagtagagaaaaagatatcatccacagagaagtcttcaccttctcatccatcacaatggccagaatttattaaaatgctataatagtaaaggtatttgggttctatttcattataattgacataaattattcataagacatttatgaacaaaggagagagatttactcaaaatacaaaagaaccaattctataacctaagagaataagagggcataaaaagcatagtaaaaatcaaatatttcctggaaaaaagtgtacttaaaagatcactgtggctcacacagtctatcttttgtacctgtgcttcactttaatgcaattaaaatttctataaaaacatggagcttttcccaggccaaagacatccagagaattaactcttttggtgctgattattctgacattattcagcagccatggttgttgatcatgtaaggattgggaaactcagcaactccaagaatttctgccaaatttttagtgtacctagaagataagaacccaaagcatttggctcggagagatgtaagtttgagaggagagaggcagctttgccacttcttgcctatgaggtatcttgatgggttactcaactctttaggattcagttgcaggcaaacagatccactttactgagatgttgtgaggatctgatgggataacacatgaaggttttctagcacagggcctggcgcacagttcatgctcatttattatcctcatggcttttaccagctctttttagcttgctcctaaaatacagaaaatggatgtccaccaagggcaagggaccctggacacttcagaaacacaagatcctggagccataattctgttcagtctttccaatctcaaaatggtaaactctataagaagaaacattaaagcttttcaacatcaagcatggggtccactttgtcccgaaaacttctgctgactaaccacatccacaccactgatgaagccaccctacaacaaacaagtagctcatgcctctctagtagagctgtactctgccttgtctctacccacagatagtaagggctgggaataaaggatgaaaatcctcttcctctcctaagttttgggcactaggttcacacaacagagccttgtacacaaacctacgctcatgctctttttgttttaggagaagctctgtgggctttgaaatgtcactattgaagagtcacagagcttaattgttaaggtatcttaagggcccacattcaagcactgttggtaagaggctagaaaaaaagaagagcttggttagggaaacagaatctggcaaatattgttgatccaagcagacaaggagtccagggaatttggtggcaaggggtatgttggggacaaatgggcaggcagggctcagcaaggcaggtgtggtgtataaggttggggctttctgatcctcagcccatgaatgtcttctgccctctcctacagagcctggcagtgacaggtgttaattgaacaggaaagtctgtagggaaagcctaccccagattagaaacagggatctcaaatcacctctcagagcctcagatgaagaggtcacttctgcagtatggcagcctatggaacacagcttcagtggagcactctggtgaggtcatctctcaacaagtctaaaaatcaactaaaggaagggaaacaggtaggcctacaccatatgcatctagcacagcctggccacttctttctcttgtgttcccataatccaatctaatccttgcttctcagactatatggtaggccaaggagaatgcaaatctatattgaatctccctgcagcatctattttaccagatggtagtaggtaatctaaaatttatattttgtattttgtaattttttttttgttgctgtagagacaggatctgtctatgttgcccaggctggtctcaaactcctggcctcaagcagtccacctatctcagtctcctgaagtgctggaattacaggcttgagccaccaagcctggctagaacttatttatattaaggtaatcaatgatctattatggaatagaatgcaaaatgtatataaacttgtatagaagagacttcaagaacgtacgtctcacagtggattctgcccccgaacctcaaaataggtatttgctcttacttgtcattaggagctctttggtagaaaagtttgagcagtgctgaaagtatggaacaagtttaaagggtcctagaatgaagtggtaagctctccagggtactgttacataagatggaaaatcaataccagtaaatgtacacacaaagaactctcataagcaaattccttattcttgcaggaccagaaagcagttcccattaaatctgactaatcaaaaatatatcccatgccccctgaaacagatttccataccatctcttcccttgaatctcaatcccacaggtgaaaggtcctagagtttttcagagaactgactctgcaaagttcaaagcttgtttgagagccttgtaagtgccaagcactgggtgaggtatttaaatgagctacaaagcatttgcagttccccagatatattaaaattaaagctgttactactttcatccctctcactgttaatttttcagaaacatttggctgtgggtttataaatggatatttgaagactattcatttccaagccctttctttctccaattagagcgggttcatttctgcttctttaggatggttcccaaggttattaaatttcattcctcaactgataacattgaagccatcatgacaaagttaatgttgattggagctgaagtttcttggggcatctactattagaaaccacctcaagctgagagaaaaatggttgcatcccccactataggaactggtaagtgccgtataacttaagtcttatgtattcttgctgtttttacgttttgtgtgtgtgttctgtgctattcagtcatgactaaaatacttcatcaatgcatctaaataagctaaataattcgcagttcctgccttgctcacaaccagctctttcccacctatctctccaccaatgtgccactcaatggctaattacttcccttacattagctaagataagggctatcatgctaatataaaacataaatcagggcttaactgcacatggaagacagttgcaacaataaataatggaaaaggacctatggggtttcctaagacaagcataaaacaaacacaaggggcaaaatctttctttttttgttctatagcaataaatactgatcacctaacaggtaagacacagcagaaagaaagtcatctttggttactataatggcagcaaaattctttccaccggaggggttgttgacattctagtttttgttaaatttaaggattctaatttttttcttttaaaggagcctcatgactctgtcttctacagtctggcttgaaacttcccttccagaatgtggttcccatttcctgccaatattctccttatcatccaatatttaccctgccttaatttatacggacaacccacaaaccctcaaacatctgaggtgctttcatgtctcttgagccttgactgcactgctcaatacaaaataccattccattcttacaccaccctgtgaggccaaaagaaagaattagaatttgccggagataatccaactagtaagtagccaatctgggatgtaactgtaagtctgctaaatccagttgaagctccaagagactaaagacagtgtctatcctcttcactgccacatgccacctctcacccaacacagtgtctggaatatcttgggggttcaataactattgctgagcccaggtccatgggcttaaccactactctagcctgctctgtgaggccaggggccaagttttgctcactatttctgaatcccaagtcccctgacatgtgtctgctgtaaaggacatgttcagttaatgctgaaaaactctgtgcaaggggcatctctggatggatctaataacttaagatttccaggtcacaaaaattcagagctgtgagaatccctggagtatttccagaccaacacactcatttttcttttattgttttgtttcacagaataaaaacactcatttttaatgtaggggagacttcaatttgtcaattcaacaaacatttatgaaactcattttatatgtcaagtactattataaccattgagaatttagagatgcttaagacagagaaagtcctagctcttaaggaactcatgacctagtagagatgtgataagaaagaaaagaggggaagagaaagaggccaggcacggtggctcatacctgtaatcccagcaccttgtgagactaaagagggaagattgcttgagcccaggagttcaagaccagcctgggcaacatagcaaaaccctgtctctacaaaattttttgaaaaaaattagccaggcatggtggcacgcacctgtagtctcagctactcaggaggctgaggtgggaggatcccttgagcccaggaggtcaaggctgcagtgactcatgatcacaccactgcactccagcctgggtgacagagcaagattctgtctcaaaaaaacaaaaaaacaaaaaaagaagaagaagaagaaaagaaagaaggcagggagaggaaagaagaaatagataaggaagagaggtaaggggaaaacatgagataatgataagacctaagcagcacattttaagagtgatataataaggccgggcatggtggctcatgcctgtaatcccagcactttgggaggccgaggtgggcagatcatctgaggttgggagttcaagaccaccctgaccaatatggagaaaccccatctctactaaaaatacaaaattagccaggcatgttggcacatgcctttaatcccagctactcaggagactgaggcaggagaatcacttgaacccaggaggcggaggttgcagtgagccaagatggcgccgttgcactccagcctgggcaacaagagcaaaactccatctcaaaaaaaaagagtgatataatagagaagctcctaggtggtcactctagattaagtggtcagggaagacctctctaaggaggtgacatttaagccacaatctgacaagacagagccagtgttttgaagatctgctgaggaacagtgcaatcccaggagagggattgcaagggccccaggatgggaaatggccttggagtgatggataaagaaaatatagcaatagatctcatgacttttccaagaacacactattggaccaggaccaggaagtatctttagaatgatgggttctcacatcaacatgtgcatccttggtgcaattagtctccagatatctgttgaacatgttgaagtctaactgaggttcatcagcaccaatgggctggccttgctccagatctgtactcagctttatgatcatcataatgccctcacagacccatggggctgcttcaacacagggttcttaagtgaccattgctcagagtgccaaagctaaaggcgaacaatctgcacagaaaccagatcaccaacttcctggtcacagtctttgctcctataagcaaatcaccaacacgtgtgatagaaattatgtaggaagggccgaaggagaatgaactgtgggcttcattcaaaggagaatgaactgtggaactgacacagccagttccaaatctgagctcagctccttgcacactgtgtgaccttgggcaagttacatagcttctctgagctttaaagaggagtggtaacatctccctgatatggtggtcaggaggactgggtgagacaatgtgtcaaatgcttaacattgatctttgcaagtcctcggtaagtgttagtttcaactctttcccacatgatccgttttaagcattcctttcagttgtagcagcccaaactgggccccttttcctctccagatttctccaccaggtcatctttaagccaaattacagtcctgaaattgtgttgcctctaatgtctatttcccaggagacctcctgtgagctgcccttggtgccagaatggccctgctatccatagcagtcccccgtcccctgctggtgagtccccttctcaatgggcctgtactctactcttgcaactccagaaatcagaaggctgatcacctcacttggcctctattgttgcccagttagccagtgtggggaaaggtgaaaggatggtttaacaccctccactcagtgaggtcacgctggaaactgatacatggcactccatcaacagcagaaaggagatgaaatacggggataccctttctccaaatactccttccccatgcaaatgtgtaacagagatttttggcaccagatcccactggctgggactaaaacagccatcaggctttttgtgatcctgaaaaagctaatgagaagatgtgtctctgtgtaattcaaacagtatccatttcatggacaatcgttttttaaatgggcaacaaatctccctggcatgttcctttctctgacaaacaaaggctctgtctggtctctttgtgggctgtgtccaatcaacaagggcaagaggcccttgatgcctgttcaaagccctgttagagggcagacccactgggcggccttgctccctcctgaaaagtttctctcattggaagccaagtcaacatctagaattttcaacttggactgatgaagcaggccactgatttcaactgactctaaacggcaagttgaaaacttttcagactacgtttactcctgtttcaggcagtagcattaagggatggagtaagacaaaaccacatagcatcaccagatagggtagcaccacaatgtaaggggcccctggggtgcattcctggctcctcaggtcctgggggagcagggtaagtgcctctgaaccctgagagtggggagggcccatagcaatataatacttttgcaccaagtattgctgcaaaaatgaggtgacatgtgaacgtggtctgccctgtgaagctggcctctgctgtcctggcttccaagggtcatgaataaaataaacaaccacactgcttaaattccaaaaactcttcaaaccatccctctctatctcagcagagtttgcgcattcttatcctggagcaaaattcctcatgagaacacatcgccatagcaacccctcaccttttgacctcaaaagggaaattaataggagaatagagtttactctgaagtagtttgacaaccaataattcatgtgtgtgtgaagcagtgaccttcactgagcacctactacatgcagagagtttcgctgagcacctactactacatcatttggggtggtgaatatacatgttgaaaagggagggcctatacctgtgctcaggtaattgcaggcctgtgaaaggtatctggtaggtgcctggtatatatgacctcaaggaatccgtacagcaaaaccatgagccaggtgttcccttcatcctcattctatagccaaggtaacagagaaacttgttgagagaagaaccagaatttgctcaagcacctacagctagaagggatgagcaagaattcatacataagtggatccagagccctcctgcaccagaggccatgaagagtggatccactgagcccacaggtgtgtggtgaccagcccatataatgcttttaaaataaggtgttagcagtaagaaattaaggaatatcacacaaaaatctatcataaatttttaggttatttttaatagaaagatatggccacacttgggcttgcactcccccatggctgcctccatcctgttattatttccttctccccctttacactctgctgccccggtcccttcctccctcctgcactcttacatgaattgcccacttggtcccaccggcactggtgtttgcactacctagagctccataagaacacatcttttcttcataaaataaacaaccacactgctcaaattccaaagactcccaagacaatttggatgggaatgctccaggaggattagttttcttcagtttaaaagcagttcccagtccctggtacttcactgtgtggcaaacaacatgataacttcttttttagcttaacaggctgtgtcattattcttcctttgaatttttgcatctgagtaattaatttagcaatcctctgtcctggagaattttccccctcctactaggttggaccctgcttttttctttcagtcttaagtgtgccgtctaaatgctgttggattccagaggtgactcccagagcaagaaagggacctcttcctcccagtgcttttgctgggctgggtctttagcaccatgtatccaaaagctggcaagtgaggaaggcttctacatggtttctctctccatagagttttctgttaatcacttggtcccaatcccattccccaggcactaacctctgaaatgatatgaatgagcagaaactatggatgaaaggttggtcactaggattctgggaacagtttttagatggtttaaaacttgcatatggggccaggcacagtggcttacacctgcaatcccagcacttcgggagaccgaggcaggcagatcacctgaggtcaggagatcaagaccagtctggttaacatggtgaaaccccgtctttactaaaaataccaaaaaattggctgggtgtggtggcgcttgcctgcaatgccacttacttgggaggctgaggccggagaatcacttgaacctgtgaggcagaggttgcagtgagcagagattgtgccattgcactccagcctaggcagcaagagggagactccatccccccaaaaaaaagaaaacttgccacaaaactttatgggcatttttgtgatgtggggtcccaaatgcccaatccccagtaaaaagacagatgtgccagctgatcctgcctctccccatcctggtgattccatcccagtgactgtccagagactctgaaatgtgaaggaggagccccagggcagaggggacactggcaatgattagactggggttcctgctgtctagccttttggcctccccttagtcctttcacatttccaacctggggttttccagcctctcgcaggctctgggagctttggataaccttcctgtgacaattgagtcacgttctgttgctaacgtccaaagaactccttggcaatatagcctcacactttgtagagaacttcaaaagggtctctggttagaaaccagttttgggacatggaacatgtcaattgaaatgcagccaacacctgggcaagttatcacactgaaccttaatactgtgaaggctctgagtgattggggtgagccgattctcctcaacaccacagcccacagaaagctgctccctggagatgaaaaatactatgtatatcactggaatgggtgtcatgaaatttacacagaacactccacaaagtgcagctggaaagggggcagtggctgtgccacagaagggaaggagtctcgggggcaccataacaagggagggaccatggagaaaggacaggttgggggtgtgagaagacccccaagcaaacctcatccacttcacagggatgaggtgaatgacctggtccacagaggatgggatctcctaaagagatggcaaattgccaacttctcatgtggcttctccaggctccacaggggaaatatggctgcccatggctcccagctccagtaacaggaagagactgacatgctcttattcctaaatccaaattctcagtctaaatgatcacgtatacctgactggtcctgcaggaatcagatgctccccttgaccaaatcagctatggcccagggaggggaggctggtctcaggaagcaaacacagctacaaagagcccacccataggtctttcttcttcttcctttctttgatggagatacaatattcctagagaatgggtaatttggaggcgggaaaatacttcaaagaacatgaacatcagaaggagttacatgaggcaagaaaatacagacttcttaaaatgggatcacttctactttaaatattctaggccatagaataaataccttagagttgacaatgtcaagtatatgttgtctcacaagtctccaagtaaagctaattaggatcatttaaaaacctaacgttttctgggattttggtacacccatcacctgagtagcatacactgtacccaatatgtagttttttatccttcacccccaccaaccagccccacccccgccagcctcccacttctgagtctccaaagtccaacatatcactctttatgcttttgcatacccatagcttagctcccacttatgagttagaacatgcagtatttggttttctgttcctaagttatttcacttagaataatggcctccagctccaacaacattgctgcaaaaggcacaattttattctttttttatggctgagtagtattctacggtgtatatataccacattttctttacctactcattggtcaatgggcacttaggttggttccatatctttgcaattatgaactgtccacttttaattctagttctctttctctttctaccacatctgcaattacttcctccactgaagtcttgagtcccttgaagtcatttatttttactttaatttttttgccaatccatgtctatattttattggaaatctggcatcttttctttaccttggtgaacataaggaggcaaataagtctttttttccataagttattgagggactggtggtgtatggtaacatgagtaagttctttagtggggatttgtgagattttggtgtacccttcacccaagcagtgtacactgcaccatatttgtagtcttttatccctcacgcccttcccactcttcccaagtccccaaagtccattgtatcattcttatgcctttgtgtcctcatagcttagctcccacatatcagtgagaacatacgatgtttggttttccattcctgagtacttcacttagaataacagtctccaatctcatccaggtcactgcaaatgctgttaattcattcctttttatggctgcatagtattccataatatatatattatatatattatattatattatataaatatataaatatataaaatatttaaaacataaatatatataaatatatgaaatatatatataatataatatatatattatatgttgtatatatatatgggacatagaacatgtcagttgaaatgcagccaacacctgggctatatatatatacacatatatatataatatataaaaatatataatatatataatatatattatatattatatattatataatatatataatatataatatattatatataatatataatatatattttatataatatataatatatattttatataatatacaatatataatatataatatatgttatatatatatggccataatcaaaaaatcaagaaaacagtagatgttggtgtggatgcagtgaacagggaacacttctacactgctggtgggaatgtaaactagtacagtcactatggaaaacagtgtacagattcctaaaagagctaaaaatgtaactaccatttgatccatcaatcccactactgagtatctacccagaggaaaagaagtcattattcgaaaaagatactcacacacacatgtttatagtggcacaattcataatagcaaaatcttggaaccaatccaaatgcccatcaatcaatgaatgaagaaactgtgagatatatatatatatatatatattacatatattttatatatatctctctaatatattatatatctctaatatatattacatattatataatatatatatctaatatataatatatataatattcctagagtatatatatctctaatatataatatatacgctattcctagagaatggataatttggaggtgggaaaatacttcaaagaatatcaacatcagaagtagttacatgaggcaagaaaatacagacttcttaaaatgggatcacttctactttaaatattccaggccatatatatatatgggatatggggcatggaacatgtcagttgaaatgcagcagtaaacctaatgctttacacaaactatactcagggcatcccatgttgcccaggagcctctaaactctctctccaggtaaggctgactaccttgcctgccaacatgaccccacacttgggtttctttgggctccaacggaagtaattgcttaggctataaaatcatcattgctttcatctacacattttttatgatttatattttgtgtcatgcttcccctggtttttgtcttacttgtaacaaaattgtgagctcctattttatataaatatttttacttcactcagagcagccagtaccatacttttgctgacgaaatgttattaacaagttcataataaatgcatgcttgataacatcctggctgcactgaaaatgttgtcctctccaaactgtttttgtattaaaaaaaaatccaggatttgcctgtatctaagatgtgagcaagatggaagatttttaaaacgtatctttttcatcaagtattcaatgctacagctatccaatttccattacgtaagaataagatccaatagctgtcatattctgggtaagatctaagagttgtcactccctattctcatctttggtgatatattgtgcatagaattatctcagtgtgaattcagatccccagcaaaatatttgggctagctttatatctttactttcaagctggtaagaaagttgtttttctttctttcttttcctccctccctaggggtaaaagatgccccttatcaatgtaccattcccatttgttctagtctctaatgctttctttttttttttttttttcctcttgagatggagtcttggctctattgcccaggctggagtacaatggtgggatctcggctcactgcaacctccacctccaggattcaagcaattctcctgcctcattctcccgactagctggggctacaggcatgcaccaccacgccgggctaattttttgtatttttagtagagacagggtttcaccatgttagccaagctggtctcgaactcctgacctcaggtgattctcctgccttggcctcctgaagtgctgggattacaggtgtgagccactgcacctggccttataatgctttctgaaataagactatgaaagaatgtgtgcctaaatcagagatgatttttccctttccctgcctcggtagtcatttagcaacctctaaaaacatttttgcttgtcacaactgtgtgcagaggtgggggtgatgctactggtatctagtgggttgaggccagagtggtgctaaacattctacaatgtacaagacagcttcctcccctacaacaaagaattatgtggcccaaatgtctgtagttataaagtcgacaaactctagcttagatacacaagatgtgctgggagaagctattgtttaaaaacttctctggggctacagtgatttctgtatgggagacaagaaggaaataaatgaacctggcagttgttggaggcataagaaaagaggacaggaaactgagacatgtccctaaagaatctcctgagagcctacttattccacatcagcgttggaagggtctttaagaaattacataaaccaatttccttgtgacgctatttgggaatggagaagcagaaagggaaggctgacttttccaaggttctttagcaagttagctgcagagctgaaactagaactctggcctcatacccctagcccagtgttctgcctactgtatcatgctgatcctaatgaaaacagaaaaggaaacattgctccaaaaactaccattggcctttaaattaattaagagagatgggaagtgagaagccagtaaatttattcaacaacaaatatgtatttagcacctactatataccaagcactggttttggtgctggaaatatagcagtaaatggaaaagaaaaatcccctgctgccacaggactctttctagtgatataggcaagagaggtggcgtggctgccagggaaaggcagcaaagataaacagaagtctaagatacatctggtaccctccagggctcaaagacctcagtgggcaaattccctaagtacctttatacaagatattttaggatgatgtgacatttgacttcaggctctaaaaattccataggtcactaactagttcattactaggcaatgaaagaagagtaataataacatcagccaacacttcctggatacaaatgtatgtgcaggatgctatcttaccatctcactaaatcctcataataatcttttgaagtagacatcattatcccagtttatagatgcaaaaacttgggtttgatgacataaaataattagtccaagttagcggaactcaccctcaggtctgtcagccttcaaggcctattctcttagtgaccaggctagatcgcgcaaagattttctaagcttttggagctaagatcaatcactcagtatggcagctacttcaggacaacatgtgactctcaatttccctgttcctttaccaaggcacagctacagtttctctataagatctcatatcatacaaacacctatcttaattatatatattgctcatatttctttctgtttaaagtagcttctcaaaaaatttaaattgttagcagaccacatatttcacacactggagtaagggccaccttgtttgaaatgtaaatgcttatatgctgttaaactctgaaagcagagaggtatatgaagagttcatttgcacttttgagcactaccaggcaagactgattgcttgctgccccataaattctctccactagattaaattttgttaatgggaccaagaatattcaaaataacccatttttctatgtgaatacttgatctaagtcattacttctctaccagattaagtttgtcttttttttttcttatccctaccaagaatctcatcaagctcagccacacaccggtcagtggggaggctccaattccaggctgtagctcttggacgacacttctagacacaccatgggacagaaggaaacccagtgtcttgaggggaaggacccagtcctggaaagatccaacacctgctgaatatagagcccttggatcctgaatcaccagcagtgatagccaggtagctcactatgggccttaggtgaggctctaagatgtgctggcttcaggagagacccagtacattcccagctgtggtggctacagtgagagactcagggaggctttcttttgtaccttaggtaccaacttggccacagtgagatagagtaccaagcaagctcttggaatccctgcttccaggtcatggctcttggacagcatttctggacctgccctgggccaaaggagagcccattgccctgaaggatgagtcccaggcctggcagccttcaccacaaactgactaaagatcccttaggccttaagggaacatcaacggtagcctggcagtactccctgtgagcctgtgatggtggtggcaatggggtgaggctgttctacctttggaaaggggagggaagagtgagaaggactgtaccttgtggtctgactgccaactcagatgcagtaaaatagaacactaggtaaatgtctaaggtttttgactgtagtccctggctcccagatggcacctctggacctgcccaggtcctgggggaactcgccaccctaaagggaaggacacagacctggctggctttgctatctgctgattggggagccccaggactttgagcaaacataagccatagccaggaagtggttacagtaggccttgggcaagaaccagtactgtgctggcttcacatctgacccagtgtggtcctaggggtggtggccacaaggatgtttgtgtcactccacccccacctccacatggctcagaacagaaagaaagactttgtttgtttgggagaaagcaaggaaagagaccaagagtctctgcctgctaatccagagaattctgggtcttgtccaagaccatcaaggtggtacttctatcagtctacaaaaccagagcatgactgagcttaaggtgtccccctaaaggatatacagtttatcacaacacccaagtctttgcaaatatctgaaaagccttcccaagaaggatgggcacaaacaagcccagactgcaaagactgcagtaaatacctaattcttcaatgcccagacacagatggacatctacaattatcatgatgatccaggaaaacacgaccttaccaaatgaactaaataaggcaccagggaccaatcctggagaaacagaaatatgtgacctttcagacagagaattcaaaatgttaaggaaactcaaagaaattcaggataacacagagaaggaattcagaattctatctgataaatttaacaaagagattgaaataatttaaaagaatcaagcaggaattctgacttgaaaaacgcaattggcatactaaagaatgcatcagagtcttttaatagcagaattgatcaaacagaagaattagtgagcttgaaggcaggccatttgaaaacacacagtgaaaacacataagaaaaaaaattaaaaacaataaagctcacataaaagatctaaaaaaaatagcctcgaaagggcacatctaagagttattggccttaaagaggacgtagagaaagagataggggtagaaagttcattcaaagtgataataacagagaacttcccaaacctacagaaaaatatcaatatctaagtacaagaaggttatataacaccaagcagattaaatccaaagaagactacctcaggacatctaataataaaactcccaaaggccaaggataaagagatgatcctaaaagcagcaagagaaaataaacaaataacatacaatggagttccaatgtgtctggcagcaaacttttcagtggaaaccttataggccaggagagaatggcatgacatatttaaagagctgaaggaaaaaatttttaccctagaaaagtgtatctggtgaaactatccttcaaatacaaaaatgaaataaagacattcccagacagacaaaagctgagggatttcatcaacaccagacctttcctacaagaaatgctaaagggagtacttcaattagaaaaaaaaaaagacattaatgagcaataagacaccatctgaaggtacaaaattcactggcaatggtaaatatacagaaaaacacagaatattatagtgctgaaactgtggtatgtaaactacttatcttaaatagaaagactaaaaggttaatgaatcagaaataataactacaacaacttttcaagacacagacaatacaataagatataaataaaaacaaaaaaagctgggggacaaagttatagtgtagagtcttagttttgtttttgtttatttgtttgcttatgcaagcagtaagttgttatcagcttaaaatgatgggttataagatagtacttgcaagcctcattgcaacctcaaataaaaaacatatgatgaatacacaaaaaacaaaaggcaagaaattatatcaccagagaaaatcaccttcacttaaaggaagacagaaaggaaggaaagaagggaaagaaggctggccacaaaacaaccaggaggcaaatagcaaaacggcaagaggaagtctttatttatcaataataacattgaaagtaagtggactaaactctccaatgaaaagtcatagagtggctgaatggatttaaaaaaacactgaaagatctgttgcctataggaaacacacttcacctataaagacacacatagactgaaaataaagggatggaaagagatatttcatgccatggaagccataaaagagcaggagtagcaattcctacattaggtgaaatagatttttaagataaaaactataagaatagaccaagaaggtcattatataatgttaaaagggtcaattcaacaagaggatataacaattataaatctatttgcacccaaaactggagcacccagatatataaagtaaatatttgatctaaagaaagagacagacccaatacaataatagctggggacttcaacaccccagtttcagcactggacagatcttccagacagaaaattaacaaaaaaaaacataggacttaatctgcactatagaccaaatgaatctagtagatatttacagaacatttcatccaatggctgcagaatacacattatttttttcagcacctagatcattctcaaggatggaccttttttgttaggtcacaaaacaaaacttgaaacattcagaaaaattggaatagtatcaagcatcttctctgaccacaatggaataaaacttgaaattaataacaagaattttggaaactatacaaacacatggaaattaaacaatacgctcctgaatgaccagtggatcagtgaagaaattaagaagaaaactgaaaaatttcttgaaacaaataagggaaatgcaacatacctatacctatgagtatagccatgggatacagcaaaagcaatactaagagggaattttacagctttaatggcctatatcaaaaaagaagaaaaatgtcaaaaaacaacctaacaatgcatcttaaagaattacaaaagcaagagcaaaccaaacccaaacttactagaagaaaagaaatagtaaagatcagagcataaataaatgaaattgaaacaaagaaaacaaaagatcaatgacacaaaatattggtttttctgaaaagataaacaaaattgacaaacctttagccagactgacaaagaaaaaagagagaagacatacattggggaaaagatagtctcttcaatacatggcactgagaaaactggatatccatatgcagaagaatgaaactagacacctatctctcaccatatcaaatcaaaattgattaaaggcttaaatctaataccacaaactatgaaactactaggagaaaacattggtggaaagtctccaggacattggactgagcaaaactttcttgagtaagcacaggcaaccaaagcaaaaatggaaaaatgggatcacacgaagttaaaaagcttctgaacagcaaagaaaactatcaacaaagtgaagagacaacccacagaatgggagaaaatatttgcaaactacccatgtgataaagggattaataaccaaaatatataaggaggtcaaacaactctagaggaaaaaaatctaataatctgattgaaaaataggcaaaagatctgaataaacatttctcaaaagaagactatacaaatggcaagcaggtatataaaaaggtgctcaacatcactgatcatcagcgaaatgcaaatcaaaactacaatgagataccacctcactctagttaagatggcttttttccataagacaggcaataaatgctggcgaggatgtgaagaaaaggaaaccctagtatactgttggtaggaatgtgaattagtgcaatcactatggataacagtttggaggttcctcaagaaactaaaaatagagctacactattatccagcaattctacttctaggtatataaaggaggaaatcagttaactgaagagatatgtgcactctcatgtttattgcagcattatacacaatagccaggatttgaaagcaacctaagtgtctatcgacagatgaatgaacaaagaaaacatggtacatatacacaatggagtactattcagccataaaaaggaatgagatcttgtcatttgcaacaacaaggatggtcattacgttaagggaagtggctgggcacagaaagacaaactgcatgttcttgtttgtgggagctaaacattaaaacaattgaatgtatggatatagagaatagaaggatggttaccaaaggctggaaagtgttgtgaggggttggggggaagtggggatggtaaataggcacaaaaaaatgttagaaagaatgaataagacctaatatttgctagagcaaaaaggtgactattgtcaaaaaaattaattgtacatttaaaataactaaaagagcataattggattgtaacacaaaggataagtgcttaagatgatagataccccatttgtccccatgtgattattacacattgcatgcctgtatcaaaatatctcatgtacccaacaaatatatatacctactacacacccacaaaattaaaaattaattttaagaaatttcactaaatgcctatctgcccaggcacacacacccactggatctagatgcccacatcaagggcaggagagtcagagcaacataggagttaagactacaagttaattaactgtgccaaatcaatgaatactttaccggtaaacctcatcccaccaacatttagagaacatcaactatgtatcagaaaatacaggtggtttcacatggattatctcatttagtcctcatcagaagtctgggaagtaagatgtgttgttctcattttaccaatatgaaaagctgaggttcagagttttgaccactgccccagagcatgtggctaggacacagccaggccaagattcaaagctacaattctgaatccaaaatctcttgtctttctcctttcacccacatcttcactgtagcattcatttctggcagaaagccacaaataaaatacaggcctcacttaagtatctcaaaattttacagggaaaagagatatacccatgcaactacagaagttaacattcacagagtaatgttgtccttcagtatccatgaggaatttgttccaggacccttgcagatcccaaaatctacagatggtcaagtccctgatataataaaatgatgtagtgtttgcatataacctccataatccacctgtttgctttaaatcatctctaaattacttatgatacaatgtaaatgccatgtaaatagttgttatattgtttttatttgtattttaaccattgtacttttatttttgttttctcttttaatatttttgattcatggttggttgaattgggaatgcagaacccttggacccacaggcctgactgtacctatggtgttccaggcactggaccaagcactccacaagcattatctaaaagcaaccaaatgaagcaggtactgctatggactgaattctgtccctcccaaaatgtgtatgttgaagtcactggcccctaatgtgatgatatttggagatggggactttgggctatcagggttagatgacgtcatgaagtagagctaccatgatcacatcagtgctcttataagaataggagagacacgaatgagcctgttatttctctctctctctctctctctctctctctctctctgtggacactaacagaaggccatgtgtaaacactgtaagaaggcaagttgcctgcaagccaggaagaggcgctcaccaggagctaattatgctgcctccctgatctcaagactttcagcctccagaactatgagaaaataaatttctgttatttaagccactcattatatggtattttgttgtggcagcgcaagatgactaatgcaggtgctaccactgttatcattttaaagataaggaaactaaagctcaaagaggctgtgagactcacctgagtgcacagaatcataggctgtgacttggggcctcctgtgggtgactgcaaagcccttatccttaatcactgtgctgtgagactatgcccacagttaaccaggtgagagactgtccccatagcagggatataaatacacatgttctaggggttcccagtggggacagtgtcctatggagtgaacgggaagagcctccaatggaactcaaacataagcaagcctttggagacagcaagcatcctcaatgcacccgagactacatgctcatcactggactgtgtcctgacaatctgctcttctcccatcacgctcgcctctgaactcacgctcttgtcttgacagcctcctatgacccatattcaattctacacacatggaaaggcacatggtcctctctgccactcttgcatatctttctccctgatggtgagctccttggggaccgaaaggggatcttgctcatatctatgcccccactgacttccatgggcctgatacagagctggcacttgatcaacttttgctgagtttaactgagaagcgaccttcttgaagccaccacatgaaagggccagccacgctaccaatgtggaggatcaggacccagctggtattgtgggctctgtaaatgtctgctggatcaaggaaattccacccaccagttttaagcaactaaaaaccatttatatgtagatatcttcaatttattctcagacccaagtagttgttgggaaaaaaaattacaaatgaccaaaagtaaaaataataataataaagacaagagaggaaaacctcacgctggcacacggtatgcattcaatgaccgttttttgacctgcagaactcgtttcctatgaacagatcccacaactaacaattcctacaaagagaaactgatgctagtgtgaattgccattcatatctgagagggcaacatcagtatcctcgtacctttctaataaacatatgttatatgtgtgcctacaatataaaggttactgtgacttaaaattccattgagagtaccagagcagctgctcctgtcctgttcatcttacatacgaaaccaccatgaacaatttgcctctgtggccagtgaatggcctgagcacctggcctttgaatgcaggttgtcatacttcacttgagtgaaatagctttctcaagaaagtcaacgattatttcatttaaaccccttccaccaaacaatgcagccctggccctcaacacccaactcacaacatttctaaatcttccagacagacaaataacaaaataagattctaccaagttttaaaaagatggtcagaatggttctcaagcttaacccacagaaagtgcctgatcctgcaagctggtttatatgaaaacgccagtactttcctgagcccctccattcattttgatacctcagtgatggcaggataatgaggatttggaaaacaagaatcacttgggtctatctctccattaatagacagggcttgatatggtgagcgaaagagtcacaatgtttccaatctatctcagttgccatgtagaaaaaccaattatccagaggcccctctcccctgcaggaagatgagctctctgtgcatcaatatttcatgcactgtcatctgtgcattatttaataaagcaattgaagggatgagtctattttatttttccaccttcccaccagagacactaggcctacagtgcacacagtgctagaagttggtgggcaatcctagagatatatttgctgatttttttgaggccaaggtgctgtttctagtcttaactacacactcccaatgtctaatacactccttaccccagggacacccaatctgtgtctgtgctaatggaggtgagctcacttcagaatccagtaagtgggatgcaactgatcaccaggcatttactgagtgccatacttgggggtacaaagcttataacccagggtccctgcctcctggaacctaaaggctgtctgcaaagacaagatgaaaattcatggacaggcaaaagacagactacaaaccagctaagcacatggttgaccaggacacaagtgatgcacagggcctggcatgtcaagggcacagaagatatccatcttttttatcccctacccaatatctaactccctttcttcttgcccccaatctcccattgtgtatggtgttagtgggaatgcagcttccatgatgcttgcctctcatctcataagtgaaggtaccagatatttcttttacctgagtcctggtattgctgtgggcaggtacatggtctgaactcaacacgagacctctttcttggacctccaagtcttcaaggagtgactcaaagaaaatctcaagatcaaattcactacagccaagaaggtagcccttagagttgaccttttccaatgtatggccttcagcagggccctcagattctgctcattgtcctagccccctggtagttctgtgaacctgtcatcgtaataaatcaactttttcttaaccagagttggcttctgtttcttgccaccaagatgctgactgatcaagcaataaagaattgtttgttgaaatagagattgaagctgtgatccaattgctattccatttcatcaccagcagcctgaacatgtgcttagggtaccaaaaatatttttctaagactgtgatatttcaaaaacaaaaactaaacaccaccaagctgtggactagaatgatgataaacatcagatacaatacaaatcggtatttcttgaatttattttgtagttcagtattgtttttagtttgaatggcatatgaggtcagaacttaaggatcctaaaaatttcagcctatctctgctcagtgtacaaatatctttgcatttatcaaatctccttaaccagggtaatgactccttcagggaaaagtctgagcaacacttatcctcctaaatgtctagcttctatatacctggcaccatccatgccttaaacagttactaaaatctgtgtatccttgttatcatttaatccttgcaacaatgccacgaagtatgtgtaattaccattttataataaaagggatagaggtccagaaaggaaaactagcgctaacttatgcaactgatgaaaggcagagctgagatctgaacctgctttaagaaattcacaagcatctgtgtctaacctaaccaagtgatgtcacatcatgcttactctcacatacattattgtggtacttctcacatttaaatcaagtgagcaagcccagggaacaagaggaagtttaagacatatctaagacagctccctgtttctgcctaagctttccttctggaaagagggactctttctgcaacttcaatgcaagcacttttgttgctcatgccagcaggtaacaattgcacatctagctgaaatcattcctttccaagcttaaacatacttctgtcccctccacggggaagagacaagctgacctaactcagtggtaaaattggctttcatatgcttcaagacaattactagatctccctgcaggcttctttccctgaggctacaattcctaattatttttcatacatgccctaatttccagctccacaaccaaatctgttgccctcctttataccatgtccgagctgtcctttgcagtcagcggtcctgacacatgagcagtgcaccccagtgcctgggcttgtccatcctctcattctggactcaggtgtctgcatccgtggggcagagataaaaaggatcatcccagaatgtgcaggacagtccccattccaaaagggagcatttgtcttgatcagatattttgttccaaagccagttcactggcaggcccaagaacccacaggttggtattgatcagggaagaaacactattatggtttggtgtcagggaagtcctggcccttcaccagacccagtgttctctaatgaatgactgagacagaaaagaggggtccagaacccatgggaaagagcgatggcataaaggcaccatatgccccatggagcacccctcactctagaaataaaaccttgctagaggccaaggccaccaccaccttcttgatgttctgtgtagcattacaggcccaaacccatgtacccgaccaccacacatctttgcagaaccactctcactcattctgtaaaaatctacagttcagtcctgccctcaaggagttcacacaactataaaaagaaaggtgccaaatgtcacaagacagaaaaatgacaaattactatggaaatgagttatgaagagggagaaattactacctgcaccaggcatgaagccttgtggaaaagagggtgttaggagtgggccttggaaaatgggtagtacaagacatgtagaaactgtgggtagtaaaaccatgtgatcaaaggaccagaggccaccattgaagcactggtgggttggataggtaggaggccagtgaggcttttgagtaaaattgtgatatgattagagctgattcaaccccttgataagtacaaaagttgtagtctataattagcatttaagctgcttaggggcaaagcatacagttgtgccagggaatggtacagtaggagactaatacatgttggttatgatttgatctgccagttcctggaattgctggattgttctattaagtgttattgtcagtcaatatagcttactagttaaaagctcaggctttgggttctaatcccagctttaccatttactagctttttaaccttggataagttacttggctttacttgacctcagtttatctttgaagtagaaaaataattatagctatctcgcttctcactaggttgtcaaataacaaagcaaccaatccatgtaaagtgttttgcagagcacctggcatatagaatgtactcagaaaagctcctaaaccatcccatccagccccaccaatctccaccaccatccatttagacctgtgcatgtgggtacacctcagcacatgcaaatacatctttatggcaagcaacaggcagcgacttcttggggaaaatgcataatttgttcaaatttcacaataaaaatttatctgcaataatagtaaaggcaggaggcttgcactgcccacatgtatttttggctatacttatgctaactctaatgctacagaaagaaacttctagacctggatatcaaacccagaggaatgccaacaatataaacttttactttatcttcctaatgactgaattaatctaaggcaacaaccattaaaactaccaaccctcttgcttacaaaagctcctaagatgaaaagcactgagcaaatcccacagtgatgttttatttgtctttaagtaagaaagaccgtgttccttaatcacacaaatggccggtatatcctcaacccccttcagcatttgccatcaaggtcatcttgaacaggctcacaggtaggcattctcttggcagtgaacacaatagcaagggggtggtgccatgagttggcagatcccctagaagcagggaagactcttggatgtcctggaggatatttagaccttgctaaaatagacttgagatgttctaatggagagactcaggatcctgacaggcttctaatgcttacaaaaatctcccccaccacaatgtgtgtgtgtgtgtgtgtgtgtgtgtaggtacatgtgtatatacacacgtatgtatatttaccttactagaaaggtacattttattcatcggtaattaaaaatgactctaagaacccgtcatacctgttaagtcctcagaaagatgaacccttcatcagaaaaggcaacaactcaaattgatgttctcatcaatacaaatcaactgtaggggccagacaggctgaaggctggcatggatagaaaagaaaaatgatgctaataaactgcatatggagctaataagcggtatctagttgatgaaatgcagcatcaattgatgccaaaagaatcctaaagccctggtttctcttcttataatattctcctaattggcatttgtggtggtggaggtctggtcagggcaggcagaagggcagtgactaggtctgagtacataacagtacaactgtaatccactaatccatttgctttctttttttgaaagttcagatcatgtcctcctctgccagaaaaatttcagtagcacccaaaaactgggactgtgccttacagacaggagtaaatccctagacacgaaaggaattaattaacagaaaatgggatacagtatgctcagggaaaagagatgaatgaatggcctcacagagcagcatctccccctcaataatgaatgctgggtgtacttttttcttagtagctgcagaaattcctcccagagaaaatctaccacgtgaagttaaagacaacatttgctttctttgaaatcagggcaacttcagccagtgggcaaataggtgtcctgcagtacaggtctgctgggggccatccccaggttatcaaaggcatcttcaaaggagtctggggttggaggagaccagaggccccttcacttagaaaacagcccttggcaacagctgggttaaagagctcagggagtccagcttggggacagagaaagtgagggcaagggaaaaccagagaggaaagtacaaaaaagaagaggtgggaatcatgcagtcgtggcaaagagaagatcagatcagaatacatgcttcaggaaaggggcttcaggaggttggggggtgcttggaaaggaggaaaaagaaaatggaattttctaagacaacaaagtttaaaactccctttaacattaacgcacattaaaaaaagtattcctccgcaaaaatgctgttggactcaaagataagaagaaggggagccccaagcattcactttgaagagtctttttaagaagaaatgtctttggtgtgatccagtcgagagaaatgaggagtgggagggaaaggagatctctaggggagagggggtggggaaagagggaatcaaccaaaaagctttccaagtagggactgagaaataaagctggggaagtccatgccctcctgtcctaaatagaggcagtatagctaggaaaaggtgaggacaagggaaatggaaggacctcaaggaccacatgttgagaggaaaatgtgcctgacaccggcttccttcaggaaatctcctccaaagccctggcaggtgagcagagaaaagatgaatctctgaggcaatttcacccctagcccatctcaccatccagatcaatgcaagtgacacttcctccaagaagcctcccagatcatcctgttgcttcaccaagacactgccctaaaattggccaatacatttgtttggttatttcacattgattctcctgctagaatgtgagttccatgagtgagggaaatttgtctgtttagctctcaatcccctgtgcttggcacatggtaaacacatactttgtggaacaagggatagaatttcccaacaattccagttctcagttacatgagtagcactgttggggcagcaccttcttagcgggcaaaaagagaaagcctcacatttttgatgtctggtaggcaccgggcatgcgattgcaatccattcttacaacttcccatgaggaagcatctttatccacaccttgcttttaaggagaccgaggctcagagaggccaagtgacttgacatttcacatgactgaataccagagcaagaagtgaactcaaatgctgaagtttctttctctacagagtctgcgggggaagaagggaaaacaaatgacagagtctagtaccagcccaaccaactccccttcctctggggccaccctcacaccagtcctgcaccctcaagtgagaagggggcagaaataagaaatgaagatttgttcagactaagactgccagtgacctgcatctgggctggcccaccagagacactttgtttatatggcccagtagaaggcacatccacaagagcagtgatcttttctaccgtgtaaaccactatatcccctgggataggcttaagatagtagtacagcataaccttaataaatggctaagaatccctccacatccccaaggactagcacagtgcctggcccagaagagcaggtacttggataacaatggtgtgttgggtagggaatggtgacttcctccgtttccaacctggctaatacatgactgactacagagtatttctaaggccattcagcctatttaaactctgatgttatttttcctccgacatcaaaaacaagtttttattacaaaaataggactgtgcaaaaaggcagaatccatccccagtctgctaagaaccacatctatagtggtttaataaaaataaagggactggtttctacccatatccagtgaaaaacaacaaaatatctgtccccttctcccaatttgatctaaaaataaaggcaccagctctgaattcctctgagggcatttgatttcaggtctgattttgtctcacaaaaggcacagccatttgctctcccttaataggacataatgctaccaattagttaacttacacatttaagctgtcacacagggtgaattacaggctcccagggctggcagaccttcagaggtcatccaatttcccctctgctttatcagaccaccctaggcacttggaaaccactcttttcttaggggagggggtcccatcacccacttacgacacctttttgtttaaccacctttttgaccaaaaattccccccggtagcagcctcaatactgcctagcatgacaacagattgtttgccttgctctatctccagcagagattgaggggaactcattcctgaggttgggtagccaagagtatgaggtataagacctgctccaagccccacctaatgacttgccagtcatgagacttggggcagtcccctgacttcacttaaaacaaaaatggggggattaataagactgtccctactacttcctggggcttttctgaggattaaatgtagatgaggtcttctacccccttgtgtcatgtgctccttgaagaccaggccccaacccctcctaccttgccactgcacacatcactgtgccctcactgatgccaggcaacagagcgccacaggaggtatctcctttcatcctcagaataacactacaatgtgactgctagcatctcaaccttatagtgaaaagactcagaaaggttaagccacttgcctaaggtcacacagccattgagtagctgaatgggaatctacctggatctggcagaggcaagcatccggttctccacccctctagcacctgcctcctaatcatctctgtacctacctgcacggcatggctggccaggagcaccaggcacacagcacatgcaagcacttgttgagccaagtgtaacatgttttgtacagcaaaaagatgcacatgtaagatgctagtattaatattatgttttgtaaaataatgtttgtaactctaccctcagtgggtttagataagggggtcatgactggggtgggggtgggtaggtgacaaagaagagatacttgactctctgaagcatcagacacatcacctgaattatcttattcctcaatggctctgagctatacattagtatcccatttcacaggagggaacatgaaattcaaagaaatttccagcttcctaaactgaaaccagtgagttctagtcctcaaagaccctgctactaagagactcaggactgacaatgacctgtaccagggggtcgtttgattccttgggacagttccgttcaccaccccaaggacatctcagctatggccaagaacccccactgtttagttaaaagaaaaccaggtgagccaattctagaatattcaggtcagagctgtgaggaggcctcatttcccctcttcagtgttttccttcccagtctctgacaaacagtctcaaaatagaagcccccagggtttaggcattgggatagtggaacaacacagaaaggccatgaaggagctgttcattcacctggtcctcacaatgaaaaaatgaaatgatgggtgataagtggatggcttggccagctttgtcttggaatcgaatccaatcttacacacatatcatgagctgcctgtgaggttttgggctgggcaccaggcagaaagatggggaataaaggtgacaccaagatcatcagttcaagggccttctagtctggagttccaatctcacaaatgactctaacaccggtcctaaaacaccaaatgggaaacaaggatgcagactaacagaagtgaaaacgctcgatggaaggaatagtatcaagttgggcaccgaagaacatacaagatttccaacaggtagcaatgagaagcagcagcatgggcaaacagaggcaggagaggaaggtggaggggtggtgtacaagggtctagtctgcagatagaacatgaagcactgggctattaagtttggactttattccataatcagtgagagctactgttagtttctgaggcaggtagtgacacaaaggtatctgctttagggtccttcattctatcagcaatgaggactaggatggactagaagcaccaatcaacagggggctgtggttctgctcacaaaatgaggctctctcaaatttctgcctcagaaatgaaaactctaggctgaattcagggaatgggagaaacagtcacagggctggacttggaggggccccacggccagtttcccaaacccagaagtctgcagcttgccatcagctctgcccctctcatttgctgtatttgaattaaacattaaacagagctggaaacagggtccccacgggcgctagaaactttggagcattagctgacaaacaggcttactgctgtgtaaactcccagggcaaatgcaaagtgtaagctaatcttgccaccatcaccagttctctgagctgaggataatgtatgataatctaaatcgggctgggcagatgcctgcctgggaaatctgattaggatttgcttgatgattccctttcatcccccaggagactgcagggcatggtagacaggacctggccatgaagttgacatgctcccagtggtccaggccccaaggcactcctctgctgaacctccactggtagcaaaaagggacatgaagacaacaatctgcaaatagttttgcagcagtgggcctaaaggagcagatccccaggttgatcaatgcacagctaaagagatcaaggcctctttcttatagagactgtgtaaagtgtgtaggctcaatcgtgccacttttttgccctgcatccttcaatggataccatcaattctggaataaagtttaaattgctcagtaggacccatctctctggccttcatcagctgtgattttcctcacctaaaacttaatgtccagataataaatgaactgccagtagcttccctcatctacctcacacaccaccgggtctttgctcctgcagtgccctccatctgaaacgcccttccccaggctgaatcttaactcattcttcaaaacaaaactcagacatttccttttctgggaaacttttcctaaacaatgtctcagctcttggttattcaacaaatatttgccagtgtttcctattggtatacaccaagtacctactattataatcccttctttacaatgagggagaccagagagcttaactggctggagttcacatagagacagcctggattcaccccacattcctgactggatttcggagcccttgtctgagtgacctccctcctcacactaaacctctgggtcagcagttctgcttctgggtttgcctgccagactgtgaactccttgagggcagagatggtctgacccatccctctggccagcatggggtgttggcctgctgcaggtgctcagtcaagagtccctgagctaaaggtcttcacttgctcaatagaagtggccacagtaccatcaggctaagctcctaagctgaaactctcctcccctctagacccacatgcccgcagctctggccacctgcctttcagttccaggtcaccaatctccatggaggcctggtaaaggagcgtggatgggttagtgcagagccacacccacaatttgaaaaacaactcctagtgtgttcattaggtacaaggcacctgcactggtgttctctatctgaatggcaataactgaagcatgagaacctcatgtacatcccctatagtctctaccgggaaggaacaggtaactccacatgcaaacacaggccattttgttacatgtaaatatatccttccaagcatccatcaatctcattaatctttatggtatactcactatgtggcagacactatgaataaaaagactaaaaagtactcatccccagtcacatttggcaaagaagaatgagcaggcactaaggtccgcacatggtatgaagcaacatgcatggggtcacagaaagatgaatggctaattcaacaaagaaaaaagtcaggaaaaaagtctataaaaggggcatggaagacatcctggcctgaaaaccatggttccctgtttagaaagttattggccttaaagaggatgaagagagatcagggtagaaagtttattcaaggaaataacagtgtaagtgtctgggtcagtggttctcaaatccaacttcacaacaaaatattgattcctatatctcaccttctgaaattagaatcttggtggttgtgaccaagattctgtacttttaagttctccagaggacttttgcagcctgtttggcactggtctaggggtgggacctggtagccactgctgtgggtcatcagctacctggagaacactagaggcagcccagggaaggctgagagagcctcaatctctcgaaaggctagctgtgagtccagtttccagccctcgctggctgtgtagacgttggcaagttgcttagcctctcaggaactcctcatcagcaggcaggaaggcacagaggtagagaatcagactgcctggattaaaattccagctccattctttcccaggaggatgacttgcttaaagtcacccatccccctctatgctttagctccctttatttgtaacacagaactgtgactattatctatcgcataggagacaatccagccaacacacttagcacagtggctgatgcccgacattattgactgcttctgtgctattatgattgtcagcaacaattgctaaggtgtggccttaggatttagtccagtgaccacaagcaggaggattctccaggacaagaacaaattttaccaatttttaagtgtagttttgctttcctcaatgaccatgtaaagtaggcttttgcagtgagcatctgagcttcagctttctcccaagggcatacggctctgtttaagaggctagccaaataagcacacagtagacatgattctgataaccagagtcagaggaaaccaatgaggcacaagcctggttcaggggcatctcagctcctctcatggacagatcctagcatccagccacaggaagccttctctcccctgggcccacacatgttactcctgacccagattgttgggtctgtcctcgccccagaatgtcccatcagctcctggaatctgctgcccagcacgggcaaagcttttccatttgggagaaggtaaagaccaccctccctaagctgctgggcaagtagcagaggttctggccagagctctgcagagtttcaagtaaaataaatacccatgtccatgagtcgatgaaatcacaaggggcatctggaccttcacagcccagtgcagagaatattggggcagccacatcacaacccagctcaaggaatgaggatggaaggcacagagcacaagacaacggacttcttcatgaggatcagaaacaggtgcatgcatcccagcctctctccaactcctccatcaccccctcctgttccccaccctcaatgccccctctccctcctgacccttgctctcaatgcctctctaggaggccctggaattgcagctccctctgagccctgcccctcaaatgttctcaagcttggctccttctcatccacatgtccccgcctcagagatgccactcctcaccacactgtccctgtcattctccatcactgacacctgctgattccctgtgcagaacttaactacgcttgagactatcttgtctgtcttgttgaccactgtatccagcacctagcacagcaaatggggcagagagaatgaatgaaatgacaaacaaaaggaggaacagggtgaagtcagggcagagagaggaaaaaatggaaagggtcagttgggagagggggagggaagaagagttggagaaggtgaaacagaaaagaaactgcctcttttatatcctgggtggccagagacttttttatttcttattctctttcctttggaggcctatgaagggattacacaggttacactccattcatttcaaatttacttgctccaagactgaggccagaagaacctgccaccagaagatagccaccagctgcccctcaccacctgtcaccagagctgagctgcaggtcatgagctgaggcaggaccctggaactcctctcacagatggcttggttctagcaccaaaggagtctcagcaattagtttaatttgttgcatttctctttttaattcaggaaatagaaacggacgaattagctacacttgtatgactttaatacctgacagctttgtagccatcacttttccatctagggccttctgaggctcctaagtcttaataaaataaagaaataaataaaatcttcagaaggaatgcagagaacatggtgggatgggcatgagattaggtgatggactaccgtggtgccagggtgccgagaggaggctgtctcaccaaggggcagaaaacagatgtgagccaggctggcatctaaggaggcccctgcaggaccacagagaaatactgcacagggaagatgcaagctgtgtctctgctagataaggcctttcaaagtacatcttggtaattgaaaacaaaatgaatgtggtattgctacaagacaggcagtaacaaaatacagtgctccatcctgataagccatgagaaacgaagtcttctaaaggggcagaagcgggaaaggcagcgtatcgaaacaaattccctttgagaccaaatttatctgtgccacagaatagagatggttattgggaatccaaaaaaattcctgtcctcacaagcacaaagccttctgaaaatcctgatctggaggtgggacagctgaatagacttgagtcaccccgtctttaacaactctcagtcccatatcccccttcagatattttcctctctcattgtcctttcacagccaaccttcttgaaggagttggtggagaagtagtactgctgatcattgagataatgtacatgatcagtacatgatcacagagatatgctaagttgagcagaacacttttatgagccacccttccctttgcataggcccgtttggggtatagggggattgcatcaatggctagacagtgacataagggctaggactgctcctgctcagccatctgttttggatttcatccactgtcaccagcattgtcttggaaggactcaattccactcaaagaaaacatcttcaaagccctggaccaaactggacaagataacatcagtaactttcctctagcttcacaaggcaatgggaaggggacagaagacatggggcttaggaggacataacagttattgtgtctttatgaaatttcatttgctgggttggatttatataagggctatctgacccaagtggagccaagacttccagtctgtgagccaggtgttctctgcactcctttcaattatctcaggattcccaaacgtccagcctgggaggcacaaggcagtgagctaggtgctggtctccatccagtgtatagctactgtcttcactgcctcgcttcctccccttggcttccctccctgtcactccacttcacaaaactgttctcaccagaggaccaatgacctccaggccattaactccaaaggccacatcaacatcttcatctggcctggctctcagagccccttggcccctgatcatgtctccctccctcctgaatgtgttactccctgtagtttctgtgatattgtgacattgccccatccagtccacgtcccacctctctggcagctccttggtctctttgtaaactctcatccctcttgttattccttatgctttgctgttccttggggtcctgccctaggttatccctctgtcccactccctgaaaggataatgcagcatgccgcccactccatggctacaaataccagcctcatgctgacgactcccagacatttctctaggcccgacctcaaccctgagctccaggctcatctgtcagcagcctgcttctcctcctccccagggtgattcactggaaacagagcagcaagctggggccagtgtttacctcatgctttctctttctgtgttcatgtcttctttctacattccttatctagttaacaaagccagaaacttagtcatttagagtgttgtcctttctctccccacatctcaattcacccttctaccctctagttaccactccaatcagaccccttctccagcaacctatcataatttctcatctatagcaaatacctccttactgaggtgttcctgggttcaagcttaatctccctcccatttgccattgttatctacccccaacgcaactgtaactcatacatgtatggagtacccagcgtgtaccaggcactgtgctgggcactatggacacaacggtacgctcactctaggcatgctcctggtggctgtcactgctaaacaagacaggaaccattaaaattcaatatgttaataggagaaatctgtgtatagttatgtgggagcctaaaaaagagaatgataaagctgttcaggtcacttcccctcagcaactctcagtgatttccctgcagatgccctcaaaaagctaccagtagtggtgttctgacacatggaagggttatgatccattatgagatagccaagtaattagttagcataaattagtggaagtaacaatggctcaagaacgggagtttttagaaggttatccttccaccccttggagcaaatataaggttgtctgataagaacacatctcttgcttagcagcagtgtagagaagaggagttacaatcctattaggtgagcatcagcccaggcaagtccacaggacatcctgagtcaggtgaatcatggcagaagaaaggttgggagctcttactatgctatccaagatcccacgtatgtggccccattcttccctatcttacacctgcccccaacttgccgcttgctccagccacacgtggccaccactttctgcctatacagcatatcttatcttatggcgctttgcttattgaacttctcagatcttgcattttttactcattgaaggtttgtggcaacctgagttgagcaagtctattggcatcatttttcaaacagcatgtgctcactttgtgtctctgtgtcacatcttggtaattcttgaaatattttaaactttgtcattatcattatatgtattagggtgctctgtgatcagtgatctttgatgttactattgtatttgtcttggggcactatgaaccacatgtatatgagatggtgaacttcatcaacaaatgttttatgtgttctgactggtccgttgactggctcctcccccatctgttttcctctcctcaggcctccctattctctaagataaaacaatattgaaattcggccaattaataacactacaatgggctgtaagtgttcaagtgaaaggaaaagtccaacatctctcactttaaatcaaaagctataaatgattaaacttggtgaagaaagcatgtcgaaagccgagacaggctaaaagctaggcatcttgtgccaaacatttagccaagttgtgaatacaaaggaaaaatgattgaaggaaattaaaagtgctactccagtgaacacacaaattacagaaaaccgaaacagccttattgctggtatagagaaagtttcagtgctctagatagaaaatcaaaccagtcaaaaccttccttaagccaaaacctagtccagagcaaggccctaattctcttcaattctttgaaggctgagaaagatgaggacatttcaaaagaaaagtttgaagctagcagatattggttcatgaagtttaaagaaagaagccatctccataacacaaaagtgcaaggtgaagcaacaagtggtgatggagaagctgcaagttatccagaagatctagctaagagaattggtgaaggtggctacactcaacagcagattttcaatgcaggcaaaacaactttctattggaagaagaagccatgttggactttcatagctagaaaggagaagtcaatgcctggcttccaagcttcaaaggacaggctgaccctctcattaggagccaatgcagctggtaactttaagttgaagccagtgctcatttaccattccagaaatcatagggcctttaggaatgacactaaagctactctgcctgtactctaaaaatggaacaacgaagctcagatgacagcacatctgtttacagcatggtttactatgtatattaaactcacggttacgatacctaccactcagaaaaaaagatccctttgaaataatactgctcattcacaatgcatctggtcattcaagagctctgatgaaaatatataggagattaatgttgtgttcaggtctgctaatacaacaccctttttgtaggccacggatcaagaggtaatttgactttcaagccttattatttaagaaatatatttcataaggctatagttaccatagatattgattctcctgatggatctgggcaaagtaaattgaaaaccttccgaaaatgattcataagtctatatgccattaaatacattagtgatttacgggaggaagtaaaaataccaacattaacagatatttggaagaagttgactctaatgctcatgggcgactttgaggggtacaagacttcataataggaagtaactacagatgtggaggaaatagcaagagaactagaagtgcagcctgaagatgtggctgaattactataatttcttaataaaacttgaacagatgaggagttgcttcctatggatgagaaaagaaagtggtttattgagatggaatctactgctggtgaagaggctgtgagcattgttgaaatgatcacgaagaatttagaatattccataaacttagttgattaaacaatagcagagtttgagaggattgactaattttgaaagaagttctactgtgggtaaaacgccatgaaacagcacagcatgctacagagaattcttttgtgaaagagtcaatcaatgtagcaaacttcattgttgtattatttttaaaatctgccacagccaccccaacatttagcaaccaccaatctgatcagtcagcagccatcaacactgaagcaagaccctccactagcaaaaagacaatgactctctgaaggttcagatgatggttagcattttttagcaataaaatatttttaaattaaggtatgtacattgatttttaagatataatcctactgcttggaatagtgtaaatataacttttatatgcactgggaagtaaaaaatgtgtgtgactcactttattgcaatattcactttagtggaatggtttggaaccaaacccacagtatctctaaggtatgcctgtactctgtgctccctaaactttggaatctttgtcatactgttctccctctcctgaaatccttttcccaccctgtctaccagccttcaggtccttcaggtcacatgtcacatttcaggaaagcttgacaaaccacttgcctccccagagctccttttcatctgcagccttccttcccattcctccaagagactgaggtcaagatggagcagggctgctgtctaatccagacactggcaatgaatacaggtctatgtatattttctgagcaaaccaaggagaactcattttgaggtccacctgtttcagagccttaggaaataagcctgtcccagacaaggagaagcaagccttgaaagaccttcctgtcagtgtctaccctttgtatctggggatacagaatgttcctggctgtcttctattctcttctccattaattcttctgtcttattttcccagctagaagctacagagggccagaaacaacaggatatgggagaaagaagattctaactcttcttggctgggatcttgagcaagttacttaacctctctgagtgtttcctcttctgaaaaatgagaaacataaaacatcccctcacatgggttttatgaagaataaataagttaacacacagctttcaaagcccagagtaagtccttagttaatatgtatctaactaatcttctccattctcttttttcataatctttgctaagcaaaccacaggatctcataccactggtttccagagaaggcctgctgtatgatggaaattctgtatcagtagactctaagacacaaaccgtactctagggtttagctaagaagtctaatgtacttggactttgaacataaaaacttttgtttgaaataaagtagatttcatccagtacctcaaaaccttcgcatgaatcataaatttctttttcaaaactgcagtatgtgacctgtagtatcaatagatcaatcatactttccaaattacagacaatatcagtggcccatcaggtaaaacaggcttggagctattttttcataatagaaaatggcacattctatgtgccatgtacaccactgatgaccttcactgcctttggccaaggtcactggagacgttaatgtgtggggaataatttgaaacaatacctaaagtctactagtcttaaaactaaggtgctcagctccagaaaattcccaatgtctgcattctactttccaacaaactcaccatctgtccttgcggaaaagatacaggaaacaaataatgaaaaagtaagcagtatgaaaaacaagcggccaggcgcagtggccgggtgcagtggctcacacctgtaatcctaacactttgggaggctgaggtacgtggattgcctaagctcaggagttcaagaccagcctagtcaacacagtgaaacctcgtatctactaaaatacaaaaaaaaattagctgggcgtggcggcgtgcacctgtagtcccagctactcgggaggctgaggcaggagaattgcttgaacccgggaggtggaggttgagccgagatcacaccactgcactccagcctgggtgacagagcaagactctgtctcaaaaaaaaaaaaaaaaaaaaaaagaaaaggaaaacaagctcagagagtctccttcccagggctgtgtgctgcatggagagacggagggaggaatgagttgtgcaggagagcctcacacacatgaaagcctggcaaatacccagctcccaagacctgaagttcaacacggcagagtcgtgttatttgttagtcacacaccaaatcccagccactgctaggtgggaataaggaaaggcatggagttagcttacattagaaggatttttcccactcctgagactgcctccctggcatctgcctgtgtgggctgtgcagtccctagcatgggcaggggcaaacaaggccacacttcctgcacagcctcctaaccagggcactgaagggttgtaaacaaaggagaaacatgatgtgattcatactttgcaaagatgacacactatctatcaacagaaagatggacaaataaatcattctgtacacaatagactatggcccagcagctaaagtgaatgagctagaactgcatgaaccaacaacacggaaaaacctcaagactatgtcaaggaaaaaaacagtgtgataccatttgtacggggtttaatatgtgcaaaataatagtatgtaatgtttacttacagatcatagtaaaaacatacacatgggcatgaaaaataccaaattcagaattgtaattacttctagggaggcaaggagagaacgagatctgggaaagatatactagggtcctcactgacaaatctctgatgttttgtttttgtaagtaaaagctctgaagctgatagggctgtattaatgctggtaggtagatacaaagttgcatttttaaacagagaagaaagtatcaccctgatgtttgtgtggcaaagactctggaggggaaggggaaagactggaagaagtataccaattaggagactgctgcaactaggaggtttaagagggtcatgttaaactaggagatcctaagaggtagaggaaggggtagaccaattaggaggttgctgcaattaggaggtccaggcaagagacagtgagaagtgaagaaacctgggatatgcctgggaggtgacccaaagccttggggattgactgggacgttaaggggaggtagaaagtgatggaaggggagaaggaattttgatgtccagttttctagctatagtaactgggtgatggaggccctggagcaggcagaaagcagtggagaagaaacatacagacattccagggatagatcagaaccaaccacccccagcaccattctctagcaaattaagtgagatacagaaatctccacagactcataatgggcagtcaccatagaatatcacgagaattataagtcatgcttggtgtccgcctctgatgaaataacctaattaaagaagggatggaaagggtagagctgaagccccaagtaaagcagccagcccttgcttcattctgccctcaaacctttgggtacaactagcagagaaaaatgagaggtctgaatggtgtccatgaatacttgatagctcaatatagctttgggggtgcaaatggctaagaaacatgaacagcgtctggctgccccagagaagttacattagcggtaataacatggagggctataggtacagggtgccggtaatttatttcccctttaaggatatgttaggaaaggcagatttaatagtgtggaaattagaatgggtgagagatgacgtggcaatcatgtaggtaacctatcaggctaccctagccccaaaatggctggggtcagctctcctcccctagaggcagctctgaagccctctgaacagcttcttcccttcgccctaagaaaaaatattgcacacctcactctgttgggcagaatggcgaagcatttaattgcttatttaattcctgggctgctggcagaaggcagggagagcctgggccagccactccaaacagtatcacccacaggtggaaaaagagatggctacaatagcaacttttcttccttcatgctttgcagattcaatagctcatcatgaggggacagagtagcatggtggtcttgatcacttttgttaatgaggtattgactgtgctggggccagggcattagtcaaagaagtgaaagagcgtttcagggaaagggaacagctcgtacaagggcgcaggagtgagagaacatgcagcctgttagctgaactgcagcaattcagtttcctcaaagcagagtggcgggtggaaagtgccaagagctgagggtggggggccaggcaagagcactggtctttgctttctcaggactcggccctgtgccacgctatgctgggcagatagaaggacgacatggaaagccctgccctctaggagctgacagagcacagccaagtcttcctcccctcctccaacatcctcctctttcccgggcaccagactcctgcttcccataccaggccccacctgatttccttctaggagggcagtgatcaccccgtggctccaccctctaccccagagcattcagtgagcactctcctctccaggtccacgaagactcagtgaaagctcccatctgagcctcccataagcaccagccctgagccggcagctacaagcccatttctggtcagagccttcagataaaggatgccatcaccatgcacagtaccacaaaggaccctggtcctgtctggtcaggctccacaggtttaaccacaatgaaaacaacgtgctgagagcagccactctctctcttcaatgtggttctgattccctccacatccaacacgtgagtgagggagaaagaccaaccaggcccccaatccctaattaaattcaccacacggcaaaggggtcatccatcacttcttttgttttcttctcactctaacaatgtaaaatgaccctcttaaaccaaactaaataagctcgtttggcctgtccttttaatgccccttcattgaaagcatagccaacatatgtagacaggtttccaactccctctactcgcttccactttgtttctctttccaacttttaggagcctctgcctatttagtggtttggcttccaggaaggcctctctcacagatactcacctgccactttgccttgatgggcagtgggcagttcaccagaatctcatagacatttacgaagataattttagggctgtggttttgcttaacattaattgttttttgaagatatcttaacaaagcatgcaggcagccataaaatgagttctgagttccagcgctgacatcattactgcctcactaagcagaggaagatgtgggagctggggcagtggatgaaggatggggcttaggcatgacggccaccctatttggccacaggctacagtaggccagccttgagcttggactgctgccaatgtgcatggcatgatgtgagggtggcccacagctccagatttggaaactttatgtcagtcatcacccagactacctactccaaggcaggtgactcagcccaggcaggctcctgcagcaggaaatgcaaagataggtatgagtacatgactggttggcagcaccagggaaacatccctccaggatggctggaataggctgggccaagccagggatgcagatgccagccctctgggtagtagtaaatatgcagaattgtgtgcaccccacaagtctcttagagctactgtcacaaagtatggcccccagagtcactaagatacctcatcctgggcatgtggaagactgaaagagaagagaataactctctcaggccacccaagagcaccagtcaatcaaattagcatctaccatgtgcccagggcaatgcgaaatgctgtgaaggatctcaagaaatagaagacccacttttgctacccattacctcatagatcattgcctcaggccctctgacacccctcacctattctgagtccatctacgtgccaccatctccagcaccagctcctttctagtgcaacctaagactaatgtacagcaacagtctcccaactgcagactccaaaccccagctctccctgcccaaaccattccccacatggcagccagagagcacttttcataacataaatctgtcgcctagccctctgcatctgcctgaaaacctttcggtgggttcccattgctgctaggatgaggacagtactccacaaggtgcatggccctgggccatctggcttcagctggtccctctgtggcatctcaccaggctttccttactctctgcaagtggtcttctttgaccccctcccatccactgccttccatcacagagtatttaaacatgtgatgccactggctgcaatgctattccttctctgctttaacctatttagctccttcaagtctcagctcgaatgccacttcctcaaggaagcattccctgactgcctccaactatatcagatcttgcttttataaacttctggagcactgtgtgcctctacttgacacatatcactgtttaaaatttacatttatttatgtgatcatttggttaatgtttcccactgaactataagctcctggagggcaagaattgtgcttgtctttatcatcatgtgaccagtactcttcagggtgccccctgcacaatatgagcttagtaaatatttgttgaatcagaaaatcctggcatcaaagggcttgcaatagctggtctagtttcatgagaggatccatatctagcttcaattaaattgacattcagcaaagaaaataacctagtcaccccggagctgttgaagaaatccaggcaaagaggttgaccaaagtcccctatgtgccaggatacccacctgaggaccatcaccttaatcttgacaacacgatcaggatcttacactctttggatgactgtggaggctcactgattctgcgaagactccagaattcatttagacatgaatctctgcattcatacaaccaaaacctgctctggaactcatatgtccaggagcttcagggccctctcacatcagaacaaatgactgtcctgagtaagctgctggcacctgcttgttttgcaccattaaaaagatgtggctgaggaagatcgagatactctgggagatgagggatgagggagcagaactatgaattctgctttgaaaggaagcagaactatgaattccagctctgcagtgcactggctatgtgaccgtggacaagtcactgtgccactctgggccagttttcccatgcacaacaaggtcaggttaagaatcacaatatctacctgccaaggctgcatgaggattaaataagataatgtgtgtgacatgcctgccacaggaaattcaaattctagtttccattagaagagaaaaatcttcatactaagaataaaatttggtaacacattgtattcctttaaaaatttttttaagtttctttttttctgattcatcacagtaatacattttaattgagacgtaatgtggaataggagataagaagccattaaatgggttcaaatctagttccacttcctaacagctgtttgaccatgggcaagttacttacctaccagagttcagtctctacatttactaaatggctatgatagtatttcccaatttatatcctagttgtagaaattaaacaagacaatctatataaagtacctgatacagtgcctgacacactgtgaggactaagtaaatattacaatcatcctcctcactgctactggtaaaacttcttaaagtcagaattgtacaaaaataagaaaggcaaataatttgtaataccacccccctatagacataatagagtgtttttttcgttatattgacatcagtatttttctgttatgaaattggggtcatgtgatataaactttgtcatattctgaccttttcacttttttatgtcataattgttgtttaaaaacaaatgtaaaaaagtttcacatattctattctataaaagtatcaaaattaatccatcataacagttcaccaacaaatgtttcattaaatgttggttttataaataatgctgcaatgaatgcatttctgcatatgtccttgtcctaatttcatttccttagaagagactctgaaaggataaattactgtttaacaaaacatatgtattttttaaaattctcaatatatggctaactgctttccagaatttatacctccatgctttctagcatagtgcttgccatattgacgggctggataaacagctatcaaagggagaaaggaaagtaagcactatcttttcaaaaaatactggctaataacagaaagattgtttcttgttgcatttttcacttctttgaatgctaatgaagttaaactttttcatgctaattgtttatctacagtctacgaaattttttgctcatctctgtctatttactagtaagactttaatacttttattaatttgtaaatgctttttatatagtatggctagcatctccttgacttatttgtggcaacgtttttcttaatttgattggcgtgttgtttgatttttgacaggttttaattttagtgtatccaaacttgttttaagattattgtctttatggttagatgaaaactcaaccatgtcttctattacgtgttctaaatttttatacataactcttctgaataaatactaaacgactgaataaatgtattttggtgggtagcatggaatgctacgttaaagcatttgcaaaatctaccttaaagtatctgcaaaatctcccagcaccatcaagagaacaatcctttatgtgatgctgccataaccgtttgtcaaagacctaccaatgactatcaggatttatttatgacttgtggattctagttcactgttctgtccattaactttttcactgtttactgagcttttaaggaggaaaaattcatcttcctcagagtctgagtcagtggattctgtcacattgtgacccaggagaacacagggtgctgccaccttattgcgatgacagccacctgtcttagaaccagcccacacgttgacacaatgaaccctgtgttcagaagaacatggcatcagtctgacacatgcctccaatatcatcaataccactcaggccagcaatgaccctccttcacctcatggattcccatctcagctgtggtttttgttctctgcgtagtttctcttaagttcgggctggttagaaaagagcctcctgggttgcatgagtcacaacagacctagttttgagcacaaagttgacgaggatggtgctcacctctctgtggccgctactgaaacctcatgagctctgagtccttgctttacctgacccatcagctgcattaaaccccaatgatctcctcctcctccttgaacatttattttgcttctaggacaccacattctcatgagtttcctccccctttcgagcaatttcctctcagcctcttcttctactgtcttctcatttttccaacttcagaatgtcagagaacccagtttttagtcattaggcccctgcttctctgcctaggtgatgcatctcatggtgctaaataccaactacaagctgatgactcccaaagcttttacatgcccaacctgggtccctcccctgacattcagaccactagactcaaccatcaacacagaagcctctaacgcatcctgatatgaacacccatccttccctgaaaatcagcacttcctgctgccagccccctctagactccagcagcaaactcaccaaaacatagccagaactcagcagcatcttctcgcctctggcatcaccactctggcccaagcccctagtgccctgagcctgcgctagagcagcagcctctaagtggtctccctgcttcttccatttagtctgtgatcccatgatatcactcaaagtgaagagtccttctgtattagtcatggccccatggcttctctgttttcattgtcaaatattttccaccccctccaccctccaccagatgtccctgtgattcctcagacaggccagatgcacccttttgggcctccgaacctgctgcttccctctccccaatgtccctgcctcctcacttcattctagtctttgctcattggcagcttctcagtgaggcctttccctggccccatctgaaatatcaaacctcctaaaatgaataaaaaataaaatgtcaactcctcactttatacccccacttccctgccttactttttctccttgacacttacactaccagactctgtgttttactgatttagcctgattgctggctgtctccctcaccagcatctatgctccagaaaggcaggcattcctgtcggtttactgttgctagaacagtgtttggcacataataggtaggtacttactattcattcagtgaatgggagtaaatggatgaatttacaaatttgaatccctctttttttcaattttaatttttttatttccattttttattttaagttctgtgatacatgtgctgaatgtgcaggttacataggtatacatgtgccatggtggtttgctgcacctattaacccaccatctagttttaagcccctcatgcattaggtatttgttggaatccctcttctataaacaaggaaactgaggctttgagtagtttaaaaacctcctgaggttggaattggaacccagagccgattctagaataagtcttctgttaatgacactgtgagtatgaattgaaaagttgggccagtgacactgtgaatagaccctgatgtacttagcaagccccactctgttttacaacacagccggggatttgtccactggcatctttagaatgtggttttcttggggaaagaaaataacaacaaaaaggaaacaatacagacatcaaggcaactgtcctgttgagttgtcccaggaagggaaaggcatcagcaagacaatgtctcacattgagtgaaggatctgattgacagaaaaggagaggaattaattcatcagaacaaaagagaccagaaggactggaccagcagagaagcatgctgcccatctaggggctccatggatggaatgttgattacaaaacaaaacagtcctaataagattacagctgataatgaatccactacaaaactctggaacgatgttaggattttaataagcatcccccaaagaccattcagtcaatttcacaaatacccattctcatcacttaattctagtgggggagaaggactgctctacctacctgtttccaaattaataatgtgcttcattcctgttatgcttcagaaacaaagccaccgtaacatttccagctgtttggggaagaattttaatattctcaatgctaatataaacagaaccttattaactaagtcccagagatgccccgtttgggatgtaatccaagccctggtaccaatgccaacgttaacatttgaaaatacctcatgtgcatacttcatttgaacaattacagcaatataagctttcctctagaaaaatggaaagaaaaagcaaagataatgctgcaccacactgagaaagactgcttaatcccaacttggataatggctacagtaaacggtacacactgtctcttcttcatcattttcataccaatactctatcaactctgaggggcctatactaaaaatacacccagctctattccatgcaggggaaaataaaatgagaaaacaaaacccatgagacttaaatgcacattgaaactgcaccccagcaagccacacaactctcagtccaaccgaggcccagatgtggcactggtaccaagtctcccagcccactagctttgcagcctgtgcctgaacattccaacctacaggggtgctcaagcctgctaaggaacaatacgtggccaaccatctgagcagagcatgggctttgcatcattggatgcaatcatttcccaatcatactgatcccattcttatgactcggcctctagggacatcccagactcatgtagctgtagcaaatcctcaccacttccaatcccaacacaggaaaggctatgaatagaatgatgaaaaggaaaaactgaaagaaagaagtcatgggggaaggtatggtttgtctacttgttcaaaatctggacaaaacacttgcttgtgaatatactgctaatacacaattttttgaatgtttttcttgtgttggaaatagaaacccagaaggtttcatgcaacatgacaaaccagaaaagccagactaatgcccaggacaagctggtattccactccatttgagacctggttttatccatcctgatatagttgtatgcaggaatgtacatacacaaatgtacatgatatcaatttttggtgttcccagcatgtataaatgcctccaggagaaccaatgagtaaaaattgtgttgaacagcccttagaggctttcagttcaaaagtcatttcctcagtttgtaaatgaattagttaggtgttcacaggctgaaacagctccttcacttgaggaactctgatttgaaaaggaaaataacagcaaagcattcttttcctggaattaaaaatcaggtcacagtaaactcaaaaataactttgtaaaggctaaggatgggaatagaagagttcttctataaataatcactagcatccatattcattgtaagccttttaaactcgctggacaagtagcttcagaaaatctgtggctgatctgaatatgttactttaagaacatcatacatattcacgtccttgttgcattctaatcaacaaatcaaagcactcgactaattaaatgttgattgcttgttgcacaaaggtgaaagtcaaccttcttagccaaggtttgggttattctaacaaatgatgatagttcagctttttcaagccattttgtgcttaatgagtacattacccttaatgaaacttcatttaggctaatgattaccttggtttaccaagtaactaactgatgacagcctgtcttttaatgctctaaatgtggtaactgacaccatggacatgagtaatagatttcaaatacttttctgtgcttggccattggcagtcaacagatgatctagtgtgtcccagcgcccaggtgatgagctcagcctcatcatcgagggaaaaagtggcacctgatatgagatcttcactgataaggttcacgagagcttcagcatcaccacccaggtgtgatgagaacatttccccaaattagggtggcaaggttaaagacatgtcactcatctcatgaagtgaaaaaggcgatgaatggctccaggcctaagcagcttatcattaactccctggggaagtcccagggagctgcttctaattaccaatgttcactatatgatttccttatcattactgctatttacactttttttcttaggatgacattaccatgtttacctgaagggtaatgtgtgctttagctaaatgagaaaatcatcttctctctataatcctcgagaacttggcatacggggccacgtaaatgaatttaaagtatctcaccaagtcatcaacagaagttatttgctttatccggcttacaactttttgatttatagggtgctttctaacgttgcacatgtaaacaagaaactacttagatcaggagcaatgtcactcttgcataactgtctctacttcatcaattaatcaagctgattggaggacattatggaaaatccctcttaagtaatgtggattagcaatgtagatgtgccaccacttccaaagggaggggaaaagttgaattctccctaaacgtggaatgttggcaacacacagagtaactctggatagtggatatgcgctggggctctggattctgacagatctggatttgtcctgtactctgcatttgcttggtggccttgggctggttatccaaccagctctagccttgttttactcctctgtaacgtggaaataactactcctaactcttggtctgttatgaggcatcaatcaatatcatgcctacaaagtctttagccctggcttaataaatgttagatgctaatattatttttttattttgttcagaatatttgtagtgatattaagccagtagcaaaacagcttaaaaatagaagacagttttgtaaacctgatggaacaaaacctaaaatgcttcatgcatccccactctgtgtctgggagagcgcactgtctcagcagaaatgactcagctctgatggaaaactgaggcagcagattggaaagagggaaacatatcagttggtttctaggacccttcaataaatggcaccctcccccacctaatagtaaaggtagaaatctaagagccaaccttaaattcacctcatttctctcattccctttgttcagcccatcaccctgtaccatagattctacctctaaaacatactcccaagactccccctcctctcttgcacttctagcacttacccctagggcaagctgcaatattacaagcagcttgtaactgaccttcccacttccaaccccaccaaatgcagtctccatccaacagccagacttgtctgcttcaaacccttgagcagcttcatcctgcctttggaataaggtccatatccgaattgacctccactgacccctgcaatctcatatcccgctcttttcccctcactgtatataccctagaagcactcgcctctgcttctcgagcatgcttagcttgttcccacctcaaggccatgtgcaagttgtttcgtctgcatgaaaggccaactccaccaccctttgcttggctggctccctctttgtcaagatccagctaaaagattttctcctaagaagtgataatcccaatgactccaaagaagatgatttattccctatcaccgtacgccatttgtttctttacaagtttgctgaagttgatgctccttttgcttgtttaccagttgatctccccactagactataggcttcacaagagcaagttcattcactgccatgttgtcactgtgtagcacagaatttggcatggtacttggtaagaatgaattattcaagcgctgtcaaggagtaaagtgagatgtggatgtttctctacatggtttcagaatgaaaagaaaagccatgaatgggaaatatgaggcagcctattgcacgtcagtgaaaggaagctgtcgtgctctctaaagagctgtgtgccctgtgggtagtgagtttcctaggcctgagaatgttcaagcagggacaagtcaacagtttacaggaaatgaataattggactacacaacctggtaggtggctttcaccctatgactccatgagatgaaaaaggctctgctcttggcagtgatgaattgtctgagtcgggtggcaggaaaggagacagtggaactatgcacttgggatgcagtggctctcccagctgctgctgtgattgcagatgtccctgtgacctcggatcctgaaacatgcctcttggactcagttttagagaagatgcatgatcaagtcacagccaccactgaaggtcaaacaacatttcttacttgttacaaacagactgaagagcatctctgtgccataatagcctgagctggtcactggggagagaaacagtggaattaaagaaaaaaggaacatctaactgagttttgcatagcacttacatgtactcggcacagttccaagcactctgtataaattaattcatctagtcctcaccaaagccctatgagaaagaccctatcattgccaccactgaacggatgagaacatttagacacaaagagaggtcaacatataatgcccaaggtcaaatatctacaatggcaaagccagggtgagaagccaggcaggcagatcagaaaacacactggtaaccctcacactatcctgcagcacaacgactcaaaagcaagattcaatatgtatcattctttacaattcctctacaagaaccattagctgtgctcaaaaacctacttaacatccttgttaaggctgccacactgggctggattccaagaagccaataataacccctaagtggaagcatacttaagtttaggttaaagaaaagggcttctgagagtgcaaacacaaagccacagagtggcctgagaattccctccaagcctctggagcttcatgcccccaaggccatgccggcctcctaggccacccacgctgggttcacctgcctatctctacccagctttcaagttataggagcctgccaaacacggaaagagaaacaagagtccttagcatatgaaaaagccaacaaggtgaaattattttagaagcgtacatgactgaatgggagaagccagggccatgactcagtggaatttttcaccctgcaatttactagcagaggcacaagaagcaagagacttgccccaccgtgtgtctgtttcttcacttatatcaaccaactgctccttagggctcctgtgaggtatcagtagatgtatttaggaaatgctaattgtaattctacaaattaaagttgcttttaatatgttacaaccagcatatttaattcaaacaggagaaacttcacataaatatcatcatagctgacatttattaagcattatctatgttccaggcaacatcttatgcgatgtatttgggctgtttgatttaatcctcaaatgctccataaagacaggacaagtatcaagtccattttacagtcaaggaaactgagaaccagagagatttaaagacttgtcaaagggacacgatgatgatgaagtggcagaccccagatttgaaatcagccaggtgattccagaggccacatgctgaaccacagaggcaccagcctgtgaagaatatgagagtaaggcatgcttgcccctggaatgtgtacataaatatacctatatataaaagtgcagtccttggccctgagtaacagattttcccagctccagtctcaggtctccagaatgtcctcttgcccaggtcctctggtatccaggtacagaaccccgagcagcctgtctgatgagttccttccacgcctgtcaccagccggcactgctatcactctgccaaggtcactgacaaccccagctgcccagaatgagcacctgcaggcctggaacaggcccaccagcagggagccttttcagtggggggctgttctaagttggaaccaacacacaagcacctgcattctcttgatttagtattatgtagtagaagggatggtgaataaatgatttacaggtgcacatatatttcctccatgaattttttcaatcaaactttttctaactgcaggaagaggtataggcttcagttgcaacactgccctgggtttccatatgctttacctgcaggtaacaataggtcccctgggttgcctcctctgccagtgtgagatggtaaatggagacaccactgtgggtggacttaatagagccctgtagcaggaacagagacagtggaggaggtggcaatatgactcagggacaaaagacaggggtcaggaaccaatatttaccgagcacatgtgatgtgctgggccctgtgctagatgcttctggggtgctggagggttaaataagaggatgcatgtaaagtctcagccccgagcctgctctgctcatgctccacaaatgctacttgtggttcctgtgatttactattgccattggttattatttttaattagtatcataccctatgagtccacaatcctacacggtttacaatcagagcacagctcattcatttatcaacttaaaaaatcagaaatttcatcctttactctccctggaaggcattttaaaaggttctaaacatacaatccccagcaacattaatcaaaatccctccctctcccattcatctccctcacacccacaaaagagccagcctcactatgagcactcccaaaataatcccaatttaaatgtctttttctctttgcccccaattattttgactggcttaacctctctcccaaccagaaaaacattatttttttctatttacgagtagaaggagagaaaaacaaaaaaaggctggcaattacaggattctctttgttggatggcagagcagggagctctgtggatatgctcatatcaataacttttgccccagaattattataatatggatgactgtgtgaactggaggatgttgtccttgtttttagagatgaggagatgaagcctgagaggtgttaagaaaggccacacaactcatagatgggagaaagactgaattctgcttccctaaagagaccacgccatccaaaacaccatttcatatctgaaattcagtggattggataaagaaaatgtggtacatatacaccatgaaatactatgcagctcttaaaaagaatgaaatcacatattttgcagcaacatggatgcagctggaggccactatcctaagcaaattaatgcaggaagagaaaaccaaatactgcatgttctcacttataagtgggggctaaacagtgggtactcatggatgcaaagatggcaacaatagacagtggagacagctacaggtgggagggaggaaatggggcaaggacccataaatgaactattggatactatactcagtacctgggtgatgggatcaggtgtaccccaaacctcagcatcacacagtatacccaggtaacaaacctgcacatgtaccccctgaatctaaaataaaagttgaaattattttaaaaaaataaaactaagcagaattctagttttatggagtaaaggaaggaacacagaatgtggagttagctctgtctgactgtaaaacccagtttcattccttcttgatgaaacaatcaccaatcagcaagtctcctagccccttttgacctccatttcctcatttgtagaactgggataattaagtgcttgttttataggagtgttgtaagaattcaaagaacacactcaacaaatgttatttccacccttcaacctaatgagacatctttttaaaaaatttctgtatgtagcctcttgaatgtggcagcaacaatctttctccctttcaatatcaaatcccacaccatggtaggaattacccacaaagactgtttttactatctcctatctccaaaatatattttctgttgggtaattcgaagctattaaggctgccaaaaccctaaataaccaggccatgtcagagccagcatcgcatgacctgcatgctataaatgaattgcttgtaagcgcaagtagatgtggaggtagtttgattttgctctgatatgactcaaactaatagaaacaccgtaaatatccttcccaaagttggaagcaggcagcattaccattggcagtaaatgtgaaaccattttcataataatttgttgagccaagaacctcgagagtggcttctgtgacagatgagaagtcactgggtttgactaaatcagactaaccacatattactagacagtactctgcctccattatggccctcctgagaattcggtctcagcgtcagtcaaatcaggacaaaacaagaacccaaccctttcgcctaacaatggccaggaaagttacattatattagaaggtagaaaattgattcatacagtcaattagcatgtggttactgcgatcaagttttaaaagaggcacacaatatgcttggtatacaaatataaaaccacaggaagtgcagagaaaaataaactttctcaaacaccaaaggtaataaatccatatttatgctcttgggcattaagactcaagtactttcagtgctctcaatgttccaccatagtcttttcaaacttgtgtatttgccaacacaactagatttgatattgattttttgttacaaagccagaactgcaagatcttgggaccaaatgtaagatccagagtggtcccttcttctccttgcatttccaattctataaaatttcagggtgacacttcaccctgttatacataggacaattgagcaaagtgatgaggagatgtcagttgtataatatcagctaaatgagtttcaatttcattccatgctctgtcagcttcccttcttcttgcacaccctccctcttctatagaacaggaaaaagaaactgggccaagttttacgtgaattcatctcaaagaaacactgaaaatgccacctaaagaagcagagaacttccttgctttcttaatattttccaggctagaactggatacattatttatctagggaacccttaaggcaatatcacatcttagtctttggagaactaagaatgaatacacaaaaacatgtgcacttgtttttgaaatgctttagaataatcggttttatttcagagtcatttcattccattatttaaaagcctcctaccaatcctttttattaactcaagaaggttcaggagagacataataaaaggcacatttgtaatacaggtcagatacacggtctgggactagggggcatctggagaggtgaaggtgagccttttccagtaagtcatcattgtgagtcccagagctgtcattctctagataacccagtcaccaggcaaggcacacaggggcagctgggatggaggtgaaggtttgcccagtgctccactgcacagctctcatcttctaattctgttatttgtattctccctagtccggctttatgccagttagggaagagagatatctagacccaaaattgtcagtaaacttggccgcatgacatcactggagtccaggggctcaattctaaggttgttcattcccccagtactctgtccaaaagccaatcagctataattctctgtaatgagccaaaacaatatggaaacacagttgtcattctcagcagccaacacaccagcagcagagagacaagctggggtcataactcagcccttcgtatacctgatgcccaaagagaaagaagactgagaatgatagttctaagagaaacctccgaagcccccatctaatgctatttctttgaagatgaagaaacagaggtccagggaggtaaagaaacacagttccacagtctagctcctactatcctggatcccattggtgcataggagttaagagcaggatcttcagagtcaaatagatctcagatttctaccacagctacccactagctgtgtgaccttgagcaagtctttaagtacctgtgaggcttaggtcctacaactacaaaatacagggcacctacctcaatagggatgttactgtgatattgtgaaagaagaagtacatatttggtctcggcccctggtttctgagacaaagctcctaaaactcttatggataagggtatagaaagattctatagatacagaatgttttgttctactatttggtctttgaccctggcttctagcaggcagttcctaaaacccttggaatctctggagtgatgagtgtcttttgtacgctaatgagttgactggcagttgggggccccaagatagcttcaagatggggactggtcaccagaaagaccaaggaatgaatagagggttgggactttcagtcccaccccaacctctcggctggagagaagggctgcaggttgagttgatcaccaatggccaatgatgtgatcaatcacgcctatgtaatggagcttccataaaacccacaaaagcagggttcagagaacttttggattgttgaacacaatccaaaagggtggtgcaccccaagaggacatggaagccccgccccctgccacacaccttgtcctatgcatctccttacctggctgttcatctgtaccctttgtaatatcctgtataataaatgggtaaatgagagtaaagtggttccctgagttccatgagcaggtttagcaaattaatcaaagctgagaagagggttatgggaaccccaatttatagccaatcagtcagaagcacagatcacagcctggggcttatgactggcatccgaaggggggtccatcttgtgagagtgagcccttaacctgtgggatccaatggcaactccaggtagacagtgacagaattaagttaaactgtaggacatccagttagtgtctgctggagaatcaggtgttggtggggagaaatcctcacatattgtggtgactaaaggtgagttattctgtattgagtgtgttgagtgtgttgagagtagagagaaaaaacagggctttttttttaatgcttcagactaaaaatcagggacaatcaaagtgtttcacccagtgtctggcaaataataagtttgcaatatattgcaactaatacgtgaatgatggtgcaatttcttagaatccctttaaaccataattctttccagattagttttattaattcaacaaacataagctgaatatgtactatgtgtcaggcactgtggattcttctggacagaagcagacagcaggaattgtgcatcaactttggcctgatttgcctgcatagtgcctgattaacaatcttatcttggtcaggtgagaagcccatatggttacttttttagtccatgactgacctagaggccctgggccaaaggcaaggagacttagtcctttcaaaatgcatttccagaatttcctaaatttgtattttgtgtgttgccagattgctttaccctgaagctgagcttccttgcagtagacaatgtcagaggctcacttcttgcacgtggataacagcctcaagcggttggctggacaaagacgctgcacagtctattgaaatagaaaactggggagagtagggtaaacataaccccaagcttagcctctgacctcccagactcaagctgctgctgaccagggggcaggtgctcagccaggtctaggggaggtcaaggccatgagtcttggtttcaatgcactgcagaggcctctgcaaatcactgtggatcctttcaggaaggagaaagcccaatgcagcagctggagaccataaaaggtgataatctggggcatagtcatgggtttcattcttgatgagggggaaaagagtggagaaatcaagtgaaatcatccaccccagcaccactgtagtcatatctaccctttactgagcacttgctttcagagtgcacatgttcattacaactatccccatttactcaggaggaatctgaggcttagagaggataagcaactaacccgaggtcacataacaagtaagtgcagaaacagacttcacacccaggaagtctcatagattctgcacactgactatactgacaacaacactatcaagaactcatatttttagacttgatgagccaagctctgtgcagagcaattatattctctcattttacgccatcaaacctctatcaagcaagtgccattgttatccccattttacagaagaagaaacaaactcaagtcacattacacaagtgggtgacaaggccagggtctacctctaaccaccacgctcgcaagagcactagattaggaatcaggagacctggttctagtactgtcttcaccactcaatgaccacatgctccaaactaattcagtatgttgatgagcctctagttccccatctgtaaaataggggaacaatacctccttcttggagtttgagtgagactccaatagaagggtgcagcacacacacacctgggagaatggttattactgtgatgataatgaccttcctcccatctggggttgctgttgtatacagcaaggccctggaaccaaatcttgccctggtctcatcattttaattcattgtactcttgaagcaagaacagtgtcaacagaagtactgccaacaacaacaacaaaaccaatgtgcatctgttcgtgtctgcatttaatttataccaacactaggaaacttagaccaaagaaaactgcaaccaaaactcaagtgcaacggcctttgtcattataatattccttaatacttagcattatacctagcccagggtcgaacacataataagagtgaaaatatttccaaatgacagtaaatagttaacaaaattactattacttactgctatgaaccagacattgtattatctcaacttatctccccaacctataaaaaagagattatttttatttctattttacaaaggaaaaaaactgaagcttggaggggagatatatgttggccaaagtcacagagctggcaagtggtgcagccagaattgaaacccaagtttgtctgaatcaaatacagagcccacctccctagagtaccaatgccaaggcacaataaaaaacatccagacaccagaaagtgatgtcacttctacaaggctgaatccccccttacagaagcatgtggctccatcattcatttagaaagaaaggatcatgtttatctgcttcaccagtatttctctacagccaagcagacttgtggcacattgcaatcactcaacaacaacgatgtcagatgactgattgaataagcatgtatcagtagctgtggtctataccttcaaaccaattgggataaataataagacaaaggcatgaaaagataaacagaaacaatacctcacataccaagtgctagtgtcaggatacaaatgagaagagataagggggaatgagcaagagatagtggggcctgacgtggtcaggaaactatatttgagctgaattttaaagaaagtacctgaatgagtagagatgacatgaggcagaatttatagtatatcaaatcatgatcagtttgctgtagaaatattccactcctatgcatattttttaattcacaagtcctacccccaattttttaaagtaaaagctcaatgtaaccattacaagggaaaagttaatatttactccttaattgggtgcagaccaaaggcataccatgtcctaagcatacacacacacactgtgactcaataaatgaaagataaagtcttgcccacaaaagatactggataaatattggctagtgtgggtgggtaggtggcagggtctgtaatttcaatgggagaaaacaatatttctgaacacttactatgtgccaagaaccaaactttctataggttttcacatctaagacatatgagaaggatgtttttacctctatagaaaacaggtatattccttccaaattaatgttaagaacctggttttcacccaggcaatgaggtgaaatgtcttccaggcagcctcacccacttggtgaaatcaccctgtatacaggtctggccttcagaccaggaaaggaagaactgtgctctgcagggtccctatggtcagatttttccctcccacctagagaagacttacatcaactaagctttgagggacaagaggaaaagccacagcaccaaaatgtctcgtcttcaatgagaattagaacagttgtgatgacagtaccttcctggaatgtaaattttactggatgataattttacacattttttataccaaaataaacacagatatgttaagaagtagaattccaaatgtgtatgagtttttaagatgaaacctaagacttcaaagaaatttaaggtttatgaaagattgcttcaggccatactcccaaacctcccagcaatagggttcatgttcccctaccatgagcagtttgtggtagaaagttttggtgaagctctgagtttgtcaatttttgtagattcaggaaccacaaggtatcctcaggataactgcacatttttgatctgatgcataacggttcatttcagaggttaatcctcagattctatgccagttaaagttcttaggaacacataactacctattctagagacaaagaaactagtgtttaaagagatcagtggctggcccaaggtcaaactgtggcagaactgcggttcaatccaggttcaaagtcaaagcctggcccctcttttacagaagcaaatgatccagggggcataccaaatgtccaatgaaaggatggctcatcatgtaatgctccctatgacatgagttctgaagagagtaaggatgatcaggcaatccatggcatggcagggaaagggggcactgaggtagaccctaaatgacaggagggactcagacagaatgggtgacacattcagcaggtgaaggctgtcttgaggaggggtctcaagataatcaaatgagatgcttgtatatggccctgcagagctttgggcacaaagaaagcatgcaagaaacattagctgttatggctcattcagttcaacatccagacatttataaaatactcacccagggcagccattatgctagtgatagcaaatacaaattgtataatatagcaatgtttctttcaaggatcataacagtaaggccgggtgcagtggctcatgcctgtaatcccggcactttcggaggccaaggcgggtggatcacttgaggtcaggagttcaagaccagcctggccaatgttgtaaaaccccatctctactgaaaatacaaaaattagccaggtgtggtggtgcatgcctggagtcccagatactcaggagcctgaggtaggggaatcactcaaaccagggaggcagagactgcagtgagccaagatcacaccactgcactgcagcctgggtgatagaggaagacttcgtctaaaaaaaaagggctcatgcaatatgttagtaaaataagcaagtatgaaataagagcaagggagattaaaacaccacccaactctacctggaggaatcaggggtcgggggtgtgttgtgaaaccatcactcggaaaggcataaaagaggtgatcttttggctgactttcaggataagtaggaaatcacaatggaaagaagtggccaaaaggcaaggttttaaaataggcataaggcaggaattaggaggcttgaggacaaggagaggagcccagaggcaggaggtgggttaggaggcaagtttctgaaggcctaggttgggagaagggagtggagagctcagacttgacactgggaacagagaacaagacagggaggcccatgagaagccacaaggaatcaagataaaccaacaaagacaacaaaactcagttgactgaagaatttcattcatgtactggagtctcttttcaaacataatgaataaataaacatgctcccagtgacaaagcagcactttgcttctatctaaatcactccccagagcccgtggttgtaggagcactgagagagcaccatctcatccagcattaactcctcttcttgcagaggcccctgtgctgggcagcactaagccaaggggaaagagacagagttcaagaatgtgctggagtctgagaacaggccccactttgccttgcctccacccagggacactggactagagcctcccccaccacagcctccgtttcccatctgtaaaacatggactctgcgattgcttccagctcaaatgctctgattctaaagatgggatttcctcttcagggatgggatgtaacacgcctctgtgctgcttagaggttgtcatctacatccaaatgtcggtatcacactgtggtttgaaataaaaaactgcttggcaaagtcagccactgttactgaagtaagtactcactgtacttcttatattagtaagaacagcttgataacatttttactgatcatctactatgcaaagtacttaaaacgcctgactcagtcatagcaatcttttgtggtaaggactacaacactctccttttactgatgaggaaattacagctccgagaagctaagtaatgtatccaaggtatcgtggttaataagtgacaagcgggaatagaaatcaggctgtgtggctccaaccctactcctatccattatactgcactatcttacttacccaaccttaccgcatctatatttctacataggtatagatggttagaaggagaaggagaaggagatttggcaagacccagctcaggattgccaacactcaccctttcctcccctaaggcagacatggctaatcaattacagaattcttccccactgacttgtgaccacaaatccatttctgactaatcagagttcaagatgaagctcgatcctttatcttcatctctgggataatggaatcccatcagaggggtgtaatttgtttaaggaagcacagcttgttagtgacagggttggaagtagaatcttggtctcttgactttcggtctaatgggttgatggtaagatctccctatgcaaaggacagtgccttttctaactgaccagagagaaataatagaaggtataccaaagatgaccacatcatcaggtgccagaggagactgctctaaatacagccctaacacatggttcttggacattgcaagttatccaattaatgacaactgtaaaacagcattcctgctttgttctgattgaaatgaacaatttgtaaagctgagaaattaacttcctttcaaggtaacaaatatttgaagttggaatcccagaaaacttgtgaattaagcaaaagaacaacaatgccacttatttaatccttctggaaagactagattttattcacgctttgctgggaaaattgacaagttgtatgactcagctacatcaaacaaatgagccactggtctcattcctgagacacagcagaagcaagctgccagaattgagtcctatagtagctagtcagattcttcccctacatttaaggtgtacaacaagcacaggtggtcccaaacctgcccaaggaggagctccttctcatcagaccaccataccagacaataccaccaaaggtaactagctgccaggtacctgggcagaggcggcatggtgatatgaaagaaaatcatcaacaaggaaaaaagcagtgcccaggctggctccaagcaggctgaagtgggacagacaaaatgcagggtccccaccaaggcactcctttgttgtaagacctgcaagggggaaccttaaggaggcatatgagaagaaacctgttttatacaaagctctcttccctaggatctcacctggaatctctccaaatagatgacggctgccaaatctgcacacaggaaatgctagcatcaccctcttaatttgtctagtagccttttacacaaatacactgtgttctttgtgtgaacctgaattaatgatgctaagatgacaaaaatcactcatttaaaattatttgcagagtggtaagtaagcaggattctggcagtgggtgtcaaaagatcctttcattaaatgttaactcttccttgtgagaggtggagttcagtggaggcagagggattggaaaaagtaagagtatcccaacacttagcaggtcctgccctggggaaagccagacatctccgctgctagaatgggcctaatgagccaggaattggcattgctgcaaatatgtttctttataaaaggggattcattattccaggactcgcatttctgaattcatgaaggtaaaattacagcaattaagaatcatgcctttttttctccaaatgaatagaagctcaaaataccaccaaacaaaactccaggtcaaatttcatgagaaagtataccttattgccagaaaacacacagatgtgtgaagaaacaataactggcatagtgcctttgcccaatgttctagagctcatcatgatcaaagtattcactgaacatatgtctgtccaggctgtgttgagtgcttaggaagctgaggtcttggccctggctgggcccctagtctacttcactgaagataacctaggtggctatttttcctggagagacatgatgattttatagggcctccatggtgtcttttagagctgctttgcctccttagagtgagcaggtcctgaagaagtaattagaaaatgtgaacctttctagagccatggccttcaggattctcttgatctagtctctaagccctgggcaacccatccagtactccatctgccccagaagtagattctgaaagaatagcccagggtatctagacaccatgccctccatctagtgggggtcagttgcatctcctgacccaggagggtggtgtttctagatagagcaacaagaacccatgtttcagagggaggaagatggggagcacagagacagagcagtgcagaacaaaatcaaatgacctcaaaatcatgtcctccacatcccatattgacaactcctcatttccaaaagcaccattttggttaaatctgtggaaaaagaaaacaaccttctctcattttggggggcatgtacataactaatcctttcacttgagtcgccctgcctggcagtgccccccaggatgcattttgagtcactctctatagcacctggctgtgaagccatgaatggatcatcattttctaagtattatcacacgcaaggaactgtactttacatggatttagattacttaatcctcaaagagccctgtgaggttgtttgtattttaccccactttatagaggaacaaaccacatcacataggatgtaataatttggcccacatcacccaggtctgactcctgagtctagtctcctaaccactatgaactccactgccctctagtgtaattgttgggtttctctaaacagtgaggacactaaggacaaggactgagtcacagtcatctgtttcgtcagcaccttagataggaatcactgctcagcaggcactgagcaaatggtcactaagaggctgtgtcagcgaataggtaggtgagtgagtgaataagtgaaggttgctagtctccatactgaatcctcagcctttctcgggcacacacatggttccagagcagaaaatgttaacattctaaagaaagtctagtgaaaaagtcccccaacttttattaagatgtgtgactttatatccatgttttcaaagcatctttgcaattattcttagaatcactcatttaacactccagcacagtaagccaacagccacagaaacgtggccagcagaaatatatctgcttaaataggtgtgtctcactttgagaaaaactggaatataaaaacccaaatatctatgtagaaacataaatgggggaggcattccaattttaaaaggattcacaagtttcctctaaatagcctgttgccttggaaatttccattttaaatgtctgattttggcaccttccaaaaattccatcttttaaatgtctgtccatcctaaggtaaatgaccaatgagttatagttactaagaaaagcacatggcttcatgttataaaagtccaggcccatttcagaaactgccatgtgcatccagctgcaaaaaagcactcgaagagacagcactcctaacccccctaaaatgaaaattattacaaggcaatatatatgacacacagaggtcttgtttcaaggaatctgtcccaacaaagcaaataaaaaattcaacagatctatatgttatgagggtggttgcctcatctccgggtgtcgaaaacagcatgaaattcctaataaccgagacctttacacaacatcttcgatgagatattttcagtttcagtcaatgactgagatgacaatagattccaattttaggaacttaactgtattattacagccatgagggtccaaatatcagaaccattcattatgatatgtgtttagactgtaactaagttcattttcttggcatgaatattcattatttttctttaattgttaaaataaaagtaagtgtgaatgtcaatcttctcttccaagaaaattagcatctgaaatatttctgtggagaaacaaggcaataatgaaaatgatgaatgaatacttctccttctgggaatgtacacaaccagttattcctcccacagcatctcagggaagcagcgcccaccctccacagggctcaggcactgggtttgtttctgtctgatgagaaagccttgatcagactccatctgaaaaggtcttcctggtatctggcttctttaacacaccaattgtcatgcttttattactattcccatcacagaggacagcatgaagcctcgagttttcttgttttatttaaggtactcaaaactctggcttttatcatgtcacatacatacgccatcaggagagaggacaaagcagctgcagagtatcaagggatctaaaaacacacaggctgcctgggcaaatccagagtacactaagaagatctgtttaagtgcttctatttgattcccgcccccacttcagagtaggtggggggaacctctctttgggtaaggccaagcaaaatactctcaggggctctgtcaccaaacagttcagtttcagtatcagagcttaagtgggaacaaaggctaacaccagtagctaataagagcatttagtaaatttgtacatttgctttctgtgtatacatagatcatcagggataattatctataggtttaaataagaccctcaattaaagcattacctctcctggataatcagactcttaaaagaagagcacagatttaatacaactataagagggagacccccttcacatatctgtcaagtggttagccaacatttgtttggcctctactgaaaaagaaaaaaagacaatgaaattctaaaaacaggtgcttgaaaacagcaagcacatcatttatgtgtgggtttaatcactttcatgaagacagacatcctaggtaagtcaaattcattcaacacaaattaattgagcacctactgtgctccatgtactccttttgacactaggtctggaatgtgctttctcaaagggggccacactgtccctcaagggagtgaaaactggtttttgagggatgaaaacaaaatcttacacttctttttacatataaagcacagatagacaaatagcatctaaacagatacacagtatattggtggctttaaatttcagaaaggggagaggcaattaggaaaaaaaaatttaagtcttcttagggaagtgataatgaaaaaaactgttgagacacgctgatctagaatggcaaaactccctactcttacggagctaatagtctaccagtgacatacagatgataaacaagtatccatgctatggcaaaaataaagcagggaaaggagataacaactgggcaggaagagactgaggatggagacaggaacagaccaccatttccatcaattaatttgtcacttttctcccaatcatgatatgagaaaaatgaacttttgatgacaaattaaaggggtagcccctataatccaaggcagccctgtacataatgtgctataacatgaaaaaaaaaaaaagtaaaaagcatgacaatgaaacaacaggtgtagctatgggggattgtctgttctctacgtattaaaaacagcatgaaattcctaataactcagcttttgaaatatcatcttagatgacacattttcagcacttcatttgtgccctttattttcctctttcctcacaattgactacgtagttggctgtcttaattccagggaccatccatctgagactaatgattcaccatttggggcctgcttaatgactcccaatgttatctccacatttgtgagacccaggtttcaacacatattttcaacaatgagatgaaattattctcattttatcacatgttgataaaataatgagcaaaaacatgttctaaatgttcaaaaaattgctcaaacatgtaaggttgtacaagcaaaggtgatggtcttgccaaaaacatgaaccgttagctgacatgccctgccagagttcagaatgtctgcctactcaggaacatctgaaaaaaaaatataaagctagtggacaaaagggtcatttgtgggcatcagttcataatgtacaaaataaagtttatgaaaaagttaaatctgaaaaagttggaatcaccttagtgcacgcacctactaaataataagagaatggttaagagtcatttcttgaagtttattcctgaggtctttttcccctaactaatgatgccagagagattccaatttcctgcaacactctaacattataacagatgctaaacaaacttactctccaagggagaggctggttctttggaaagaggaacagcatagctcagcactgtttgttaagttcagtctccctgtagctttgccacaacttttctacagggaaattaacaagaaaagctctcagcttaatatattattggaacttggctacaagcttattaggaaagagaaatcatagggaaatgcagtccatcactggatgtctccaatataaatctggaaaatggtgagatgctgaacagacagaggactgcttgccatgtaggcagggtatacacatacattgtgacttaatttacatttattccttggagtaagtgacatgctttcaaggtacagactccaaagttggggtccataaggagaaaacagccaaacagaaatccttaaagaatgttagctgggaaaggaaacgggtgtaaaatcaaaatggcagttcatacctaattcccaaagtacctacctacatgcagctttcagaaccagggagaaacttgaaaaagcatcaccgatcaacctgaaagtagcaagctgaagttcagaagctgactctattgagcttaataaaacagaaacctcatacacacggcttcatgaaggtgtctaagcctctgccagattcatcttcccagttaaataaaattgttacttctaactgtttaataacaagaagaaactccccagggagacccgcaggcagcatgggagccttgtccttctcacaggctgctgcaatgacctgggaagacaattagccaggctcctcccacactccaggtctatgttttaatggcttcaatcacagggggctggaagcacaggcccggcccaatttaataggcagtcattcacttgtggtacatttcaagtgtaaaatagctcacttcattttcttggttcctgtttatgcttctaaagttactcttggagagaagattaagtaccgttctccccaaaagcatgaaagcccttcatgttcaatctctttgcagggctgtatattgaaacacgtccaccaagccagcccaagagccgcacacaggaaacccaggtgatcctgaaatcggccatccccagaaaagccagtatacaagcagagaatgacaagaattagacttcagtggccaagtgcagaactgggctcagtttccatctctaccattttctggttggatgatcttgagagagttagttaactgctctgagcctcacttttattataaaatggagacagtaaatgcaactacctcatagaggttactgtagaaataaaataggataatgtctacaatgcttggcaaagtgactgtcacacagtacccacacaaaattgttagctattgtcataaacatcttcattaggtactaacgagtattaaagaactttcaagtttcactcagcccctactcaggtgttacctacaactatttccctgcacagaaccttccctaaatggatcaaacatgttcacccatactcaaacacaaacttagaccttccgcactctcaaatgctagggcatgccacacgatgcctcgacatacacacttgatgtagcagtggttctccacttgagcatcctttagaatcacctggaaggcttgggaaaacacaggtttctggctctatcatcagaagtactgattcagcatgtctaaggtggagctgcaaaatttgcatgtctaatactgctggtacagggatcacattttgaggacaactgtgccaaagaaaggagaaagacaagccaacttcaagaactgagaaaggaatatgtggaaacaaaagccttttgtgagaagctcagaaccaaaagaagtctagccctcaaggacactaggtctccccccagagagcaccagaaatggtgcgggcagccttcttcccacttggagcacgcctcaccaggctcctggatcttggactgttgggctgacccaaggccacagctcaacagggacatccagacccaacctaaatcctgaaaagagatggggtttttgacacaagactatcagtgggctgcacaccatcctgctcaattatcatctcttcctcctctgtgttaaagcaattctgcagcacagtgattcttcacagggagattgatgggcatctttcatgctaattcattcctggagttgggaagcctttattttcctcatgacatgaagaaaacgatggcagacatttccagtagaaatgccactgcattctttataatgtcattcagctgctgccagaattaaactattgaccaaactaatctgtttaacacccacgttgtggcttgatctccttgccccgaggggtgaagcatcatgctgcaaaggcatccacatttattctcagtaagtgatgctggattgcaaagtgccatgcatacaggctgggtttttaatgccatggaagccccacagaggccacctcatcctccactgtgctttacccacttcaaaccatcccctacctccttgagggttagatccaaacccctcaatatggctgatgaggcccatatgaccagactttcattttcacagcttccagtctcctctggtctcactctctacaccctagggaacccctacccgtaggctcaggacttgcccatctctgggcctttgcataggttgttccctctgcgtggaagatggccctcccctgctttctctagatgtttaatttctacttgtcctttatccagtttaagtataactaccgtgtgccctgtagtatcttatacctcacatgttatagtaatcatgttgctgataattatttgtattcagattataagctttgtgaggccaagatccatatctaataaagtacctaataaaaaatgtgatgtaacaggtgctcaagaaatatttataaatgaatgcatggatagctagctctgacaactccctctttcaaagccttcctctgttatccatctgcaaaatgaggaattttgactgaggatttctaacaagggatttgtgacaaggggacaaaacaggggttccagagaagctgcaagaaatgaagttcaaagcatgcagggaatcagaagaccctactccaggacctttctgtcttttgtgaactacagtacttttcccttagcttcaaggcagtggagaaggatgcttaatggcaatactcctcaaagcatggaccctgaaatcctggggttccaagaaagtgcctcaacatctattgtagaaagcaaggagtaggccagtcttagaaactgtaccttaatccatttgaggtactacgttctaggtgagagttcatttgcaagaaaagtagactttgctgcttacaaaaaagaaatttgaaagcaagagcagaattggtcactgacttaggatttaaagtacatcatcatcagagggtcatgaaatcctgacaatcctctggctctggtatgctcgaaacagataagagtctttgagcatttggcatctcttgcccaactcactaccaggcattgagaattgcaaaggagcctaaaagccttctactctggtgaaaagaacaaagcttcctacacagcaaggtctatagagtaaggaaacagggaataacccaaactcaataactctcttagaagaaaggtcacagcttcagatcagaccctggggctttgcaaacaaagatgagggcaagttatcgtaggagcaaagggaacagccaacagtgccaataactccagatacagaccaccaatgcagatttgtgccataagcttgtacctcttagacccttccctcctctgaatctttcttgtcctatttcttggggcctcatgtgaggcagatacatctatgaagaggaaccacaaaactctgtgatctggacatttcctcatccatatccaatgcagaaaaagtataaataccctttctttaataaagctaatcagcccaaatatgcaacaatgagtaaaccaaacctgttttcttttctttgcattttctcctcttcatttatctgcaaacaggaatacagggctttctgaccaatgccagttgatctgagcatccctgaatgacttaagccccaggactcatacatgatacatggctggtacaactgcagagatggcttcagccaacatgaatgaccaaggaggctgtcattgtacacagtttgtaaagatggctcccaggccacagggcaagccttaaccatccaagtgagacttcagactgaacacagaagtgaatcacaaaacgacttctttccaggacccacccaatatgagacttaaaaaactaatcatcagccagatgcagcagctcatgcctgtaatgctagcactttgggaggctgaggtgggtggatcacttgaggccaggaattcgagaccagcctggccaacatggtgaaactccatctctactaaaaatacaaaaaatttagctgggtgtggtggtgtgcacctgtagtcccagttacttgcgaggctgaggcatgagaatcacttgaacccagaaggccaaggttgcagtgagcagagattgggccactgcacactagcctgggtgacagagaatctgtctcaaaacaaaaataaaaacaaaagaaaacaaaaaaaacctaatcatcttctcaaaatattgcttgaatgttactcaggtggaattgcagtacaaaagtgcaaaattttaaaaatcacctccaagaatattttaaatatgttttgctgaggggcagaaagcatgtacaaatataatattttcagtttaattactacatagtagctcttacccagataatggatttacctcggagcaatgtcagaatttaggaacaatctaaatatacttctgcaatcccgcattggtcttgattcatgaatttgttagaacttaccctgggtggcttccagtaaccagccgagctcacgcactgcaaatacaggcactgggagcaacctgggctgcccagtccaggccttcttaaattctgattaggggaatttgtggtcagactgcagctgctcctggaaaagcatcatccccagtagacatacaatgggaatcttcaacctatcttgactgggatacagcaggaaacttacagacagaataaaatgatgaacttatttttgcctttccatttatagttaagaacagtaagataaaggggagaaaaaaagaaaataatgtatattgatcttggcaaaagtatgaattgggacatgtgaatgcatgtgaaggaaactcaatgtgaactagctcagccaaggaatacacctccctagctcataaaaacaaacagctaaaaggggggctggtctcgaggatgactggtaccagaggctagtctagtaccaggtcctagagacacctctggtagctctcaggcccccagtcactccttttgatcaggagacagaccctatgggaagatgacactctcacttgaatcacaagattaggcaagaggagagacccatctgctagaaaggtggatggctaatgtctggtcagaccaaacaacagatgtccataacagggggctcagacgagagatgtattaagctaggagcagccttgtcactgtgctgtagagcagcagtccccagcctttttggcaccagggaccagttcgtggaagcaaatttttccacagaccaggaggtggggttgggggaagggggtgcacagagatggtttcaggatgaaactgttccacctcaaatcatcaggcattagattctcataaggagtgcacaacctaggtccctcacatgtacagctcacaatagggttcgtactcctatgagaatctaataccgcaactgatctgacaggaggcagagctcaggcagtaaggctcactcaccctgccgctcacctcctgctgtgcagcccatgggtaggggacccctgctgtagagtagtgacaatgaaggcagcctttggccaatgaaggaaaggcaatgcaagactcgcccatgctccactcttaacaaaaggggccagtcagagacaagattggatactctggaaactaagcttgccccatctttctttatatgcaaacatcttttggcaacaacctaacataaactcagagccactgagtgcacgtaagatgcatgcttggttgtagtctcttgggtagctaacttcttaaactttgtgcaagagccttgtctcaaaccaatagcatccctgcagaaagacagacccagccagtcagaaaaagacattcacacccaaggacttggggattctccttggaaagaaaaatcgccccatcagcttcctgcaaaatgaatgttagaaggaaacagcgagagcaaaacaaaacaccacagcctgggctgtctattaaaaagcaaacactcataggtaatgtttattttattccttgtgtttatttggaaattttaaacataaagagtctttactacttctgtaagaagaaaagtaaaacttcattttaaaaaatatatagcatcagaattaaactgatatgtattaaattatttcctatttatctatcaactttggggataggaatttcagatgtcacattgtttagtccttttctatatccttttctgaaaatattataataggacctgtttgatcattttgaatactttcaaaatatattaaacctgatcacatcacatcatatctttttattgaatttttttgttgagatcattgtggattcatatgcagttgtaagaaataatccagagacattccattttcctttacccaacctccccagaaagtgacttcttacaaaacattccattttcctttacccaacctccccagaaagtgacttcttacaaaactaagtataactgtatttgcactatttgtgtatgtgtgtgtatgtatgcctagttccacaaaattccatcacatgtataccttcctgtatccactaccatggtcaaatacaaaacagttccatcaccacaaggatccctggtgttacccccttttttttttttgagatggagtttcactcttgtcccccaggctggagtataatggcatgatcttggctcactgtaacctccaccttcccgggttcaagtgatcctcctgcctcagcctcctgagtagctgagattataggcatgcgccaccacaaccagctaatttttgtatttttagtagaggcagggtttcaccatgttggccaggctggtctcgaactcctgtcctcaggtgatggagacccacttcagcctcccaaagtgctgggattataggcgtgagccaccgcacccggctggtgtcacccttttataacccacccaccttcctgctgaccctgcccccttgttcccctactatccctaacccctggcaactatcaatcttttctccatttctaaaatgtgggcatttcaaaaatattatataattatacagtctaacattttggggactgacttttttcactcagcaaaatttcctgaagattcacccaggatgttgcatgtatcagcagtgcattcctttattattgcaaagtactattccatggtatggatatgctacagctggtttaaccactcactcactgaaggccctctggcctgattccagattgtagctattgtaaataaagctgctaataaacactcatgtgcaggttcttacatgaacatacattttcatttctctgggataaatgctcaagagtgcaattgctgccctgtatggtactagcattccacagtgactatgtcactttacattcccaccaggaacacaggagttattcagtttctccacaaccttgccagcattgggtgttgccactatttttcactttagccattctgttaggtgtctagtgatatcccactgttacactttaacttgcatttccctgatgatggtgaacatcatttcatgttcttacatgccatctgtatatattctccttggtgaatgtctcttcatatcttttactcatttcagattggcttgttttttcactcttgagttttaagagttctttacatattctcaacacttgccacctgtaagatatgtgatttgcaaatattttccagtctagtttgtcttttcacttcttaacagagtttttcacccttttttaaaaattttttaataagcccagtttaccaaactttcctcttatgaatcaggtttttggtgtcaagtctgaattctttgtctaggcctaaatcctgaagatttttaatgtttttttcctaaaagttgtatagttttaaattttacatttaagttcatgatgcattttgagtgaatttctgtctatggatgaggcttcggtccagattcgtttctttgcctatgaatgtccagctgctcccgcatcacttattggaaaggctgtcttttctcccttgaattgcacctttgtcaaaaagcagttgagtatatttgcctggctctctttctgggttatctattctgtttcacggatccatgtgtctatccccctgccagtaccacactgtcttgattactgtagctatacagtaagccttaaaatcaggtagagtgattcctcctactttattcttctttgtcaaaatcactttagctattctagggcctgtgcctttccatataaattttcagaataaccttatccatgtttaccaaaaaaccttgctgcaattttgataggaatttcattgaacctgtatagcaatttggagaaaatgaacatctttaccatgttaagtctccaaatccattaacgagatatgtctttctgttcattcaggtcttctttgatttctatcatcagtgttttttacactgtaaatataatacaatttgtatttgtcagttgaaatagatgtgttattccgcactatcatggatggagggaagatctttgtttcaggctacatggaacatactgtggttaatcccagtcctgctcattgtatttgcctacttggactcctttctagacctgcatcaccatttgacaatattcagaataccgatcctaaatatcagcagtcctcaccctttttggcaccagggacttgtttcatagaagacagtttttccatggaccaggggaggggcaggcagggatggtttcaggatgattcaagtacattatatttattgtgtactttatttctattattacatacatatgaaataattatacaactcaccataacatagaatcagtgggagccctgagcttattttcctgaatctaaatggttccatctggggatgatgagagacagtgacagatcatcaggcattagattctcataagaagagcacaacctagacccctaacatgtgcagttcacaacagggttcatgtgcctatgagaatctaatgctgctgctgatctgacaggaggtggagctcaggcagtgatgcaagcaatggggagtgactgtaaatacagataaagctctgcttgctcacctgtcgctcacctcctgctgtgtgaccctgttcctaacaggccatggaccagtactagtccatggcctggggactggggacccctgctatacatgtcttaagtgtatatctaaatatttctttttctttggagtaattatacatgatattaacttcaattttcacatattcattgttagtatgaggatatgcactttttttttttttttttttttttttggttattgatcttgtatcctgtgactttgccgatctcacttactgattctaggaggctgtatttcctttaaaaaaaatttcttgggatttactacacaactatgtgatctgccaataggcacagctttatttcttccagtgccctttatttatttttcttgcctcactgcagtgaccacaatttccagtactaggatgaataagagtggtgagagcagacattcttgccttgttcttcaaggcaaagggtttcctcagaccaggccatctagtgtcacctggctggaaaggacagtctgaggtccatgaggatgagaagacatcctgagtgccctctgccagtgtccccagctgcccaggtgtctctgggtagggaaaaggagttttgagctcacagggataaagaggcttcccataccaggccacttattgtggggcctgttctgctgatggcccccagacactgtggcctctctcagtagaggacaggattctcaggaccagcagggaggccagtatttcccttagcctcttaccctggggctgggttcagcctcttaccctgctggggctgctttcttctgctgggtggtgggtcaggaaacaccatgcctgggccaccttctcctgttgggcaaggggaggatgtagatgccctgctgctgcatcgcctttccagcactggactcccaaaccagctcaccttcttaccactttcatcattctcttttggttgcctcttgtgctatttccagcgtttattatcatatttaacagagaagagcagaaagaaacaagtctatacgatcttgtccaggccataaatcatatcatatcccattgtatctttttaaaagttagggtgagtgagatatttctttcaatacaattctaaataatatatgtagacgctggtccctacaggaaacagaccttagttcctcccctcctccccttgagggtgggctagggttagtgacttgcctccaaagaagagtagggaaaggggaaatcatggctttacagagaggcagcctgaaaaacaccatgttcaccaactgatcgaagtctggagtttagttaattagtgatgtactaatgtgtttcttaggtttgacaagtatattactaaataccaaacattcttccaataaaaattgctcatcagagagatgaacatcttacaacactgacattaaagggtttttgcctaaatattgctgacctggaagtgcctcactgagcacatattatttcatctcagagacagtactgctacggaagtgacaaaaccaagtgcatgctttgtgtctgctccttctagtaggcagtgacctggggaccagacatttggggctgaatcattggcaaagtgggagctgaggctcccaggaagatctagcgtcactttgtctttcctgcatggtttctttgatgtaggatgttgtaaggaatgctgaatactgtcctaaaatatccaggtcagggagccatggccaagtcctctgacctgttggatggcaagtgtaaaccttcagagggagtgtgtcacctagagagacaaggtaaaagggtgtttatgttcagattaccttatggtcatcaggaaaaacaatgtggccggtattcattattcactcatgagtcataagtagaacctctgtaaaataactgcacgcaaaaccttaacgccttatttcaaccactagtttcaacctgagtcctggtaataccaatgatcacaagtgctgacaagaaaaacatgcccagataaagtgtggctacatgttagagaaatgagtatgggcagaaagatgcctacgtttggaggtatgtatacaagtgaaatgttggtgggtatacacacatgtgtgagcaggtagatgcacgtgtctgtgtgaaaacactgctctgtgtgaagatttgcaacaggggtctgggtatgaatgccacagtgtggcagacaagtgagaactacaaagagtgtgtgtttatacataagagtagtacagatatgaccactaggagtataggagtctgttagtgtgtaaggatggaatgtgtgagtacaagaggcaggcagctcacataggtggttcggcttctgatcatccgtacatgttaatgtctgtggggggtgtatacatgaacatgaaagtctgtgtttaaagcctctcctttgatggaggccccggataaatgaaactatgctaacattttgcaagtccagcatcatgctcagacacaggcagggagagcctccactctgtgcctgatctgactgcgtccctcccagggcggtggggcttctgtagggcttagaaaaaaatgaccagccagagctcatgctttgcctttccagcccatgtccttggtccctgagatcccagaattttctgcccaaatggccctgagccaccttccatgactatctggcctgtcctccaggtctatccttttgaggtggcctaagctgccagtgagggccctctaggcccaggagaggccatggggcagtggtttgcagtgacgagggggttacaatcagcaccttgctggctgtctgccggcatgcacaccaggcccttcatggagtaggatgaagccaatggtggtcagtgaatgggagctcttttcacacagccacaccccaagcattatcagggttaagctgccaaggaaggaggacagaacacatgttattgtttaacagtgggttagcctgatttatgatttagttatttagacaggaggtatgtgaacctctgcttaaactctccctgtaggccccacaaatgttagaggcaggctgtgcatagatgtacataagagcatgcttgcccaggtttctttgagctctaccaaacctagtctccagcccttaggtcctgaggtatagagatgtagactggggctatggtcatatctgacctggattggggagggaatggtttagaatcagctcatacaagtacacactctgcagaccctaaaaactggttcctttcccttatcaattccccactggtcacacatatagatgcacagcaggaaaacatctactgagcacagaaatatgtcaggcctgggagcttcctgaactggacaagatacctgaatataatgaagagctcatttcagcaaactatacttggtcactggtaaacccatagcaccctcacagcccccaaccaataccattcagatctaattactctggggtgaggaccaacgcagggatgagaggcctgttatcgaaaaccactttagcactgctccagctcacagccacactgtcctctataatgacttcacccaattagcttgctagcagtctgccttttgtaaatcagcgatgccaatggaatgaattctgcaccgaaagggaagggcaagcaactggtaattgcatggaaatcattaattgcctttcaggttaagtgaattatcattatttcctccatttggtggcactgtgtgcagatgaggtcaagcgggcagcccaccatgagctcccattcccagcattcactcattcagtgaatggaagagtggcagtgtgtgcctctctgagaggcagaggactaagagtgctgggccctcccctgagagccccccatctacttagtcccaggaaggaacatcccacagacaggccatatatggaaaatgtacacatctatgaactgctttcactcctaaaatgaagcctaaccagtttgtttaagacctctgcctggactgaggctctgagtaaatgatgctttactgacgtctcacaagaatgtttaattctcacaagtttcacagggagctaagctgagcaaatactccattttgtaaacaagacatgtggtgttaaacaaataattagcctttatttctggaaagaagaaagaatattttgcccttattcaaagagtcaacgtgttaataactcctacaattcagacagcagaagggaagaagaggatgcagtctctaaggcactggttcttgagctttagtgtatgtgaggatcacctgcagggcttattaaaacacagatgttgggcctcattccctgagttcctgctgcagcagatatggttggagtgtgggactctaacaaggttccaggggttgcagatgctgctggtctgggggctacacttgaaggcactgcttcaggaaataggtttttttaacctcaaattacctacaaaaactcaaacttattttaaaagcaatacatcatggtggttgagaatatggacaccgggatgaaggagatctagatttaaagtgtgattcctccctttacagctgtgtgatcttgggcaagactggttcacctcttcaaaataagctttctcttctataagttgaaatcaattcctcacagggctgtagagagaattaaaatgaactaatatatgtaaacccaagctacttatattacactaaacaattacttcagttaactaatgactgttatcagtaggtcttattagtactaatgaagtgttaacaaattattttgcataatatgcctccccaaagagacaaaccctattttcagtactggctgaaatttgcactcacatacacactgcagtccttgaaaccacttgttcctttatgctaaacatgctccttacaatcttgctcacaatgtgaaattatttagaaaacactctttcacagaaaaactaaatgtaagttctttaaaataagtgctacacataaaaggcaactcaaaatgaatctcatttatgaagagcaaagcaaaaaaaattaccacataaagaagcacaataaaagaatagtatgtcatgaccaaatagagtttacacaagaaaggcaaatattgcacaaaatcagtaaatccatcaaaccagtgaatattaatagagctcacgtaaaatcatgtaatcattccaaagacactgaagaggtactgagcaaaattcacccagtcttggtaacaacaaaaatactcaataaaataggaacaaatatatacttccttaacacgataaaatatatttttctctattacaaagctaagatcacacttaatgggggcaacactaaaatacatgtgtgatagtgagatatacacttgatcttagccaaaaggctaaaaagtgattgatagtgagatatagtaagaaatatacatttggtcttcattcctgatttgtggcacagagctcctaaaacccttagaatgtgagtgatacatgggagagaagcatcttttggtattcacagtaagatccttttaaccccatatgagtttatgctaatgaaatgactcctgaaggatgggggctggtttccagaggagccaaccatgtgattaaaagattttaacttgcagcactaatccccaatttccagggagaggagaggggctagagattgacctaatcaccaatgaccattaatttggtcaaccatgccaacaaaacaaagcctctataaaaaccctaaacaataggatttgacaaggttctgaggtggtgaatgcatccacatgctaggaaggtgatgcaccccaactccacagggaaactcctgcacttgggatcattctagacccttgccctatgtatctcttcatccggactttcatttatatcatttataacaaaccagtaataaataagcaaagtatttacctgtgttttaagtatttacctggcaccgtgacccattatagcaacatattgaacatgagacgggaggtgtgggaactcctgaatgtatagccagtcatcagaggtatgggatttgtgactggcatctgaagtggggggcagtcttgtaggattgagtcctttaatttgtgggatctgacaccaactccaagtggatagtgtcagaattgaactgaattggaggacaccagttaatgtccacagagaatcaaaggattgcttggtgtggaaaaaaaaaattcagacattttgtattaaaagtgttatgtctatagagaaaaagtttttccctttaacagacaagaaaaatcaagatcaaaataagacaagggaattcactaccatcattgttaacttacattgaataagggaaactaggaaaagcctaaaaaggtataaaaatggtaagaagcacttaaatctaggactttttaaaaacaagttgattatatacttagaaagtctaaaagaataagctaaaaaaactataataaacccaacacagctcagaaagctagcaaaatacaaaattgacttgcaaatatccatagcttccttatatgcaaacttccattaagtagtagacctatgtgaagagaaaattccatgtaaaatagtacatatgaaataaaataccaaggaattgactaaataagaaatacaccagagctataagaataaaactttaaaactcttctgaaggacacaaaagaaaatttgaacaaatcagaagacataccatgttcttggacagtgtattaaaccattcttgcattgctataaagaaatatctgagactgtggtaatttataagaaaagagattggattctctcaaggttctacaggctatctcagaagcacagtggcatctgcttctggggaggcttcaggaagcttccaatcatgatagaaagcaaagggaagcaggcatatgacatggcaagaacggagcaaggtgggaggagatgccacatatttttaaatgaccagatcttgccagaactcagagtgagagctcacttatcatcaaggggatgggctaagccattcatgagggctacaccccagtgatcccgacacctcccaccagatgccacctccaacactgaggattacaattcaacatgagatctgggtggggatatctatttaaactatatcacacaggaagacaaactcacagagctgtcaactctccttaaggaaatttgtaaatgtaatgctctcctaatgataaccttgtttttaggttggagattatacaagtttatccttaaatacatttagaaaaatataggactataaaaaaaaagagagactctgaaagagaaaagtcatgaggaaggacaagcatatcagacagtataacattatcgaacaatgattaaaatagtgtgggactggtactggaatgtgactataagacaaacaaatagatctaaatacaaagtccagaaactaatccaaatacaaatggaaatacttcagtgtaagtgaagatggcatctcaaatcagtggacaaaaaaatgtatattcaactagtgacacaaggacaactggatagcatctaaagaataaagttggttctatatcctacatcacgtaccaaaataaattccaaatggataatgagattgataggaaaatcctattaaattgaggggtggtgggagcaaagttaaatttaaaaaataatgggagaaaaactagaaaaatctcttattaacctcaaagtggaaaaggcctttaagacatgcctgaaaatccagaagccataaaattcgaggttaataaatacaaacacataacaatgaaacttttacttagtagtacacataagcaaagtcaaaagacaaacaccaccacaggaaactgattcaaactataggtaaaaggctaatatctctctatataaagagcttccagaagttaacaaatgaaagaccaaggacccatctgaaagatgggcaaaggacatgaatagacatacttactgccaaggctggttggaaacaattattcccaaatactgactgctatggtttggatgtgtcccctaaaaatcatgtattggaaatttaatccccaatgcaacagtgttgggaggtggagcccagtggaagatgcttatgtcatgagagctccaccctcatgaatgatgaatgtcaattataaaaggattccagtctttaagttttatctcttgctctctgtcaccccttttgcccttcagccatgggatggcacagcaagaaggcctcactagatgctaaccccctgatcttgaacttccctgcctatagaaccatgagccaataaatttctcttcattatatattacccagtctgttgtattctgttataatagcacaaagagactaagacattgaccattatggaatggggacaatttcccaatagccatcaaaattaagaatgcatacatcttctgacccagcagctcctcttctgggaattcagcatattgaagaactggcacaggtatatgaaatgacatacatacaaaattattcattccagaactgcttatgatagtaaaatactgggaacaattcaaagactcattaacagaggataggttgaataagttatggtctatttaacactaaaaaaccatacaggccagcatggtggctcccacctgtaatcccagcacttcaggagtccgaggcaggcagacctcttgagctcctgagttcaagaccagtctggtggatatggcaaaaccccattgatatggtttggctgtatcctcacccaaatctcatcttgaattgtagctcccataatccccaggtcatgggagggacccggtcggaggtaattgaatcatgagggtggggtttttgctgtgctgttctcatgatggtgaataagtctcatgagatctgatggttttataaagggtagttccctagcacacactctggtgcctgccaccatgtaagacttgcctttcttcctccttcgccttctgccatgatggtgaggcttcactagccatgtggaactgtgagtccattaaacctctttttctttataaattacctagtctcaggcatttcttcatagcagtatgaaaatggactaatacacttgtctctaccaaaaaaatacaaaaattagctagacatggtgatgtacgcctgtagtcccagctacacaggaggctgaggtgggagaatcacctgagcccaggaggtcgaggctgtagtgagctgtgatttcgccactgcattccagcctgggtgacagggtgaaaccctgtacccccaacccccaaaaaaaccatacagttgtagaagaataaaaaagttaacaattatctctatgcacaaacacaaaaaaaagacatattatttgcaaaaagcagggcggagaacattgtgtataacatgttcatatgtcttggagaaagagaatatatatacaaatgctaactaatgtgtgtattaaaattcctctggaagaatacaaagaaactaataacagtggtgacagggtgagaaaattgagcacaaagagactttttactgtacttctttctattttcattcctgaaccaactgaatttattccttatttaaaaactatattcaataaaaaaataaaaaaccaaaaggaatgtgatcttttctgggattattttttagaaaatgttatccaaacgtgtcctgggaagtgccttgtcccacctacaactgagccgctgatttttccttggctcgttcttgagccccatgtttcctttctcttaacagctaatacctggggaaaagcacgctgaggccttaagatgcccataatcggcggctattttttaatctcttaaaattacaatgaaactcacccaaacgtttcaaaggcaggctagtattttatattttaaattcagtatcagagcctttctatttttatgtgttttcagtctcactttcctaagaccaaagacatcatcgagaagataattttctgaaattgatagaaaaaaaggtgagtatttaaatgggaactgctgtattcacatatgggtaccatccagaacaaactgatttaaagtttctaagataatggaagacttattcatgtaaaaaacctcctacctctctgtgttaccaaaagaccctaaattaatcaacgtaagaaatgattctgtccaaatctactattacatttcacaggaattctgcaggaaaaatgccataatttaagacactgatggtgctgctgattcaattttctgcttgcataaatatctgctaaatcccttattatgactgaacatggctagctgcaggtatgagacctccagttctaatcactgcagccaccagaactaatgattccataacgactcgaaactgataaactagcaggccagcctcacccaccacactgttccgcggacttgcattaacagcactagcagggagagtcaggatctatgggcaatgaacagggattaaaggattatttaaccagataaaagcaatgaggatgaaactatttctaataaggtggcaatggccctctttcccaacagtggtggcagtctcagtaaatattccagagaagagtgttgcagcttaggttattattgatgaaagatataactctaataaaaattcagtgagtataaaaaatgtcagagatggttttgtatcatgtgtaataaagaaaggcacataaaaataacatgttgcctataaagagactatattacattcaatagaggtactcaaaaacacaaagtcagggacttaaagagtctgctagtggcacagggatccacaaaaaacaaacctccaaaattcaacgtgtagaaaattcagatttatgctgggacttggagagactgctctgggaaacccactgtctttaaggtaactgtgagcctgttgcttccactatgcgattttcaaaatgaagatatttaggaagaaaacacataacagaatttgaagggggaaaaaaccatttttgaggcaactaaaaagaaactgtatatattgaagctgaattctagatgcttccaaaaagccataataccaaagtggaaaaattaatttctgacagaactataaaacacagtaatcaattttgaatttgaagtcaggagaatgtgaaatctgtgggccttaatttagtagtatcccaccagacgacagagtcccacttgacactgaccaacaagattttgttctaccctcaatggaaagtgctcacacccagaaaaaaaggaactggggctaccaaacatatttatgactgcaaataactccacaaggcaaggtgctgggcacctgctggtacctgggtgccctttttcccacccgatgctctctgccatgccagtttctgtcaccttggcctagtgccctccaacataagaaccaaagatccaaccccctacagggtggggagggcagactctttcaaagatctttgctggtttttaaatactaattttattacttaccaatgtccaggacaaagtttacctctacctaataagagaaaattgctcatagaaatggttgaaaattttaaaggttgattttaaactctgagtaattcaaaataatcctctacagatttgaataaaaaagataatgactctctccctcccacccctatcctccgcaaaattaacaaggtattagtgaacatgaccacgtgtcccactaaaaggagaaaataaatattattggcattaagcttccaggtgagagctaacataattaatagtaaacacatcatatttcactaggattctccttgatgccagtattaaaaaaatcaatcatcttttcaacttaatagccaatctgaaaagtaatttgagaaaaataattggttttagaaacacatggatgtaagtgtatctttctatgactttctggaactttacaaggccattcctagtactcatataacatttataagaaataattatacctcaaatgattattatgccaattgttggttctaatcaatagttaaggacatagcagaggagggaattcattaaatattcaatattcctccttaaaaatgaaagcaaaattgagggcaataaaagcatcaaaaacttagcagagtcagaaaagcacaaggtccagatgaaagtgcccaggcatggagggcttccgctttgcaaaggtgcacagagcattctggaattgaatcacagagacatccacaacctcaagtctcaagggatgtacggttagatggcccaatcatgaattctctgcagcatgaattttctcacagctgcatttgttaaaaaaacaaaacaaaacaaaacaaaaaaaaaacaaaaaaaaaaactgtcttgagatattctttaagcatgggatccatgattaaataagtttgggaatcactgtatatactgcctgtctattaacatataaaaggctttgagaagtccagcaagaaagatatctacctaatgtttaaactaatgttgtcccagcttctctgaccaacatgcatgcctataataactataacacctattaacaggacaaggaccatctttaggaaaggtttctctctggatttcttagttgtcctctatgtcctacttgaacagttagtgatgggatgtcaatccccctacaagcagcccatcattatagtcaactctatctactgagaggaaacagcagaatggacacacttcaggttttaaagtgaatctgaccaatatttgaattctcactatccacttaatcactgtgtacccttagcaacatttttaattacctctgagattcagttccatcatctgtaaagctggggtaatagtaaccatttactatgatgctgtaaatcttagagacactatctataaagtgaccagtaaactgtctgccatctattactattgtcattaggatatgacatttccttctatcaagataaagttgacctccctataacctacatccattgagactagttctacctcctggaatcaaacataacatattttctcccactcccacttattacattggcttttcccaaattaaacatcctcatttcaactttccatcaaggcttccagagcttccactgccatctccacatttcactgcttctcatatctccaattttgctattcgctttgtaatgatagactctaaatttgatggccctgacaggggtaaggacagtgtggcctgaggggtcttcacccttggaatctgccatgaatgaccactcccacccactactctagatctcattctgtcacacattcagcctaaaattgtccaagcaaccttgcccaacatgtggccgtggcacatgaggggtagaagcaagaaccccaaaacaagctgaaaatcacagagtgagtttctgacagctgcaatgagtcacatgcctggagcttctgctacactggttcttcaggtaggtctttagattacctaaatccgaagccccatcccagacctgctgaatctaatctccgcgggtggagcccaggatcagcattacagcacataccctcacatgtcttcaggacacttctgtaccacaaccctgcagtttggaggacatctaaagttgaagttcactcaacctgcaaaactgtctgaaggatgaagagacatcaaccagggtaaagaagaaaccacggagggaaggcagaacatggcaggcagaggctatgaacaaggcatggataaaaggcccatgtgccagagtgaggaaagggcagaggagggcactgtggaggggagctggagatgaaaatgggtgcctggcccagggcctggcaagcagcaagctcagttcttgcaccgagagctggaggagctcttccaggtcactcagttctggtgcaggtcagtggcaaacatgccaggtttagactcccccttgattcagatgccaccagccatgcagaaattatggccttgctatggtgagtacccatatcatcctatgattatggaattaatgcaaattgtgtgatttctttgcaatctgtcttctgcttatgtatccataatcaaccatagtgcagaaaacataacatatatctcttctggaccccagctatacaaccgattatcaccaaatagatttgcagagcactttaaaaaaaactgcttatcttgtcgtccattttgtgttgctatgaaagaatacctgagactgggtaatttataaagcaaagaagtttatttagctcaaggttctacagactcagttcaagggcatggccctggagtctggtgagggctttcctgctgcatcatgacatggcagagggggtctaaggggaagacaggaaaacctgagggggtggcctggcttcataacaacccgctgttgcaggaactaatccatttccacgagaactaatcagtctcacaagaactcactacctgggtaaaagcaccaagatattcacgagggatctgccccccaaaaacccaaacacctctcattaggccccacctcctaacatcgaaacattggggatcaaatttcaacatgagctttggctgcgacaaacaaacttatctaaaatatagcagttttagataaaagtttagatgcaaaaggctttgggttaactgttcttacctatttccctacacataacttagaggtgaaggattagctaccaacaaacttttaacattaaaaataaaattaactattcttttgatctcattactaagtgaggaaatatagagaagaatatactttctaagccctcttttcccttaaaaatctatagcatcttaatctttacaccctactacttagcccctgatattataaagccttaatatatcttctattttatgtgtatgtatcaaattcattcattgatctgttcagttagtcaacatttgttgagcacctttctgcacttgggtcatataggtgtaagtgacccaccatcctgtcctcgaaacccacagtctggcagaaacacctgtttctatgtctagctgtgaagcagaaggcagaagcaacagctacttctgtggctccctcagaaccattcattgatctctatcatgcagtaaattaatacttacaaaattttgagatgactggtgatcaaaaacagttttgaagtcaactctgtgttcaaagcctagccctaccatttcctcgttctctgaccctgggcctctctgaacctcagtttccgcatccgcacagatagagatgagtgagaatagtcccagtcttacatgttcatcatgcatattcaaagagatgattcatataaagggcttagtaaagaagctggaatatagccagtggtcaaaatcagtagacatcaattaatgtataagctattaacaattctcccttaggctttgaggaacatttacagagattatggttttcacaaagcattgttcctttcccatctgagaatcttggccaaggaggcccagaaaacatttcttatgttatcaaagataagttgacttttcctttaaacagatgtcaaagatcatgatgagatctggagcccaaaaccttagtgtcaccgtgtattaattctctacaaactattttgaagatgaaacacaatctattttctcagcaaacagaaaacaacagacaactggaagcgttaaaggaggcaggaaggagtcaattttcccatcagcaatgctattctttgtggacattcatggctcaggcaaataacttgcttgagagttaatgtaagtaaaacattaattatcaaaaatgcacatttcctttgatgtagtggtttcacttctaggaacttatctcacagaattatttatagatgcatgatagatttaattacagcatattgaatgaactatttttggtaataaccaaaaactagaaataaatccaacaatggaatcatggttaaataaataacagtatttcagaagtacacgacacagaatactatgctataaaaattatgtatcaatagacaaatttttatggagcactaagatgtattacatgaaaaggcaagtatgcagttaaaaatgaatatgcatacatacatactgatatatttacatagccaacttctagaaggatgcaaaaaggctattaagaatagttatctatgggaagaattattagagataaaaagcaacaagagaaagagttttactttgccttttatgtacttttgaagtatttgaatttttatgctatgtgcatgtttattttacctaaaaaaactttacaattccaagctgtcagttcaaaagccaaaatgccttcccaaattataagtaacactgagctaaaaagaaacacatccagaggaaattacaattagacattccttgaaaaatttgacaatcttcaagataaaggcaagtagtatttttagtacagattttttttttaagaaataaacagttgacaatcagctactcttcttattatgtgcggcatagtatagcagagattaaaacctggttgaggagacacacttggattggaaacttgattccaggtgactgtaaatcaggggtcaataatctatggcccacagccaaatctggcctgccacctgttttatataacccatgagttaagacttctttttacattttaaagtaggtgaaaaacttaaaacaatatttcataacacatgaaaattttatgaaattcaaatttcagtttccacagataaaattttattaaaatgcagccacacccactcatttgcatactgtaatggcagcttccctctacaaggccaaattgggttgttgcagcacatatggaccccaaaggccaaaaatatttattatctgacctttcacaaaaataaatttgctgattcctgccctataaactgacttaattgagcctccatttcctttcctgtaagataggtacaataatagatagcctcaactccacagagcagttatgaagcttgaaagtaatgatgtatgaaatgctcagcacgtactagttttttaatattacttctcacattttaacattgaaatcaggattttttttaacagtcaatggcatgtctgagtccgttcatagaagtgggggaagccccactgcacagcctccctgaatgctccctcagctacatcctccccactgcctgccaacacgagctgcttgcccctgtgtgcagaggcttgggaagctgaatctttccaagagagcctcaagaggacacacggatggcttcagtattcaggaacaggctgtattatgctacggagaaaggaagtaaatgaaagtagcctcaaaggcacatcataagagggagtaccagggatatttactagtccacgaagatcagagcaaacaaatgttccaagctggattacttgggctaaaactgtacaaatcacacttgcctgtattagctcactgattcttccaccaattcagcaagttaggtagcaacactcctattctacagacccagagaagtctgggacataccctacacaccagctgatggcatagcaacaccagaaagcggagtctcagcttctttccaccttaccagcattttcttaaacttgagcttgcatcagaatcaaccagagggcttgtttcaacatagattgctggcccccacacccaaagtctctaatgcagcagggtctgaggtgaggatggagaatttgcatttctaacaagttctcaggtaaagaccacacagctgtctgagggccacgcactgcaaaccaatgaattatatcactaagccactgaaaacgtaaagtcctcacccctcctcatctttcacacctcctattcctcaaagtgaatcccaaccaacctcacccacacaataaactattttcttgttgtgttgcctgtttgttttcaggaaagcaatcatacttgtcttcccattgttgtcttgatgggactcactgcaagactaggagccaggagactgcagactagtcctgatcggccagtaactagctggggggtttttggcaagtgacttctctctagccttggttccccctgtgtgaagtgagaaagccacatcagattatttccaagagcttccttatagaacacaaggctgatgctccgatttgacagagcagcctccctgcctgagtggtcaccttcaatccatgaaactcatagatgggttcccctcagtaatgaatgaactaaagaaaactactgggtgagacctgtttatgtaggcaccagcaaaatggtgccacagatgggcttttagatgcctgcatgagagagctcacagtaaaatgtttagatagacagcataaaaaaattataaagcaaaaagtaaattcctcatacccctctcagcccattcctcagagataatacattacaatttggtactgattcaggtattttatatgcaaatacaagcatttgtcagatacatactctgacataattaggatcgtattcgacatattatttgcttttttatttttcttcgagacagagtcttgctctgttgcccaggctggagtgcagtggtgcaatctcaagctcagctcactgcaacctccacctcccaggttcaagcaattctcctgcctcagcctcctgagtagctgggattacaggcacctgccaccatgtccaactaatttttgtatttttaatagagatggggtttcaccatgttgtccaggctggtctcaaactcctgacttcaggtgatccacccgcctcggcctcccaaagtgctgggattacaagcatgagccactgtgcccagcctaattcactttcttaattacaattctcccatctccccccatgctatctggaaatttataccagcaggataattttccatttggtacatttgaagaatcaaactcatagaggagagcatggttctaagaaaaatggtacacatatagagcaatacagagcaacggagaaaaacgtggatggcagtcatgatcacacagcagccactgagaatattgtatgcaaaagttcctagaatattgtatgcaaaagttcctacagcatgagttacttaatgtcaggcattatctttcctgactgatccctgccctgtcatacttcagcctgaacatccctgcagacagaaacagttcttcctctttctcttccagggcaggccagctcattgttgaccagatataaacactaggcacatagtttccaaacacataataatgcctcttcatctgagagtggtagggccttttctttggtgtctgagatagcatgatgttctaaaaatgtaagaagttgttacttgatacactaacaaaactacaattaatctggcatgcacttcaattttcaaacaacatgagctaagtcagaagacaggaatccctaagagcatgccctttggggctgtggcatggatctgtggatacggctccacacttcgaagctggacaacagcacactggtagggacacgcataggaacttgtagggatctaacctacccctccaggtcctcggtggttactctgtaaagacaatgacttcctatgccattctttattcacccgctacttgcctccccaagcacctgaatgtcaggcaaaagcacttccttttctagaggacaaaaatccctctacatgagcctcacagtgagaagtcacactgcatttggaaacgtatgtccgcatctacagctctggatagacaaaagagggcaccaacatcatttattcccctgcttttcttaccaaagacaatagaattcactcagagcaataggttagttctaaattcatgaaactgaagctctacaatgagtgggtaggttgcttttctttactaggaacacccagtaattctgccatttttctttcttactcccttgtatttgcaatgaatgaggctttgattgtaaaagattgacctaatttacttattagatattcttgcaaagctgcatagacataactttggtaaactgaatctacctcagacataccaattaggcaggctgtttgaggaaattctatggggagtcattgtataaaacaaattatcacctctcaacagtcctgccttatcacagaactgcctaaactcaaggtcagaaacaatctcaatagtatctctgtcctcatccagtgttcaatttccccgacatcaaaccagccatgtggctgtctactcttacatgtacacatcccaggagcggtgtctcagtctcctccatggcagcctaccccatcctcacacagcttgggatatgaaaatgccatacttggattgagccaaaagccatccctttgcaactcccaccctctaattctagggctaccctatggaaccaaatagaatcctcaactccctgtgagcaacctacaaatatccaggtatggctattatgtctgaaggagttcaaatgtccacacactgcaccagcttatgttgaggctgcccccagttctaggtgtcccaccatgctacccctgcttttaaaactattcataaagcattcgaaaccatttctgggtgaaggaatctgtgccttgctatgagaacagaatgatgaatgctcactcttaatctgacagtataattttatcattacaaactgggaatttctcctcctgcctaatcactggtagaaagaacaactcaggattgacctcgctaaaagcaaaaatcataattattagcagatgcctgacaacatttacatggcttatatccaaaaattatatttttcccaagggtatatttttctcctacaaataattttatcttagcagggtcaccgcaaagagatgtggcttaaaattaggcattctgtggatttctattggtattttttatggctgtttcataatacctgcttgaaaacattacaaaatgaaactcctgtatgtacgcactgtggtaacgtgcccaaattcttccaccatgagaaaccctttccactgtcaaaaaaaaatttataaactccacctccccttgacctctccaaagatagctatcatactaatcattctgttagttgctgagaattttataatgacaagatctaatatggatttgctaatgtctttaaataagatgtggattttattgagcacatcagcatccatacgcgtttgagaaacatatgtaaatatgtacgtatgtgtgcaaggaaagcatttcccacccgtgtaaagcccacactacactgtgaagctccacataacactgcccttggctctggtggcctatagggaagaatactgacattcttaatccatcatttgcctgtggggtcgaactaatctacagtgttagcatggaggaaggtaactatgcagtcaggcatcaaagctctagtttggattctgaatgtctaaccaacaagactggctctgcctgccacttggctgaagagagaagaaccatatgcttccattaattgaaagcacagatcatctgaactccttgttcctgccaggaaaagcccagaactctctgttcccaatgctaatcagttaccagcaacaaaacaatcagagtattccctgatggagatgcaggccaaccattcttcctgatattgtcaatttcgtccatgtatcaagccaggcctttagaagacagtgcattctgaattattgagttaacttatagaactgtactttggcactaagcatcattgtatactgaaagatcttggatgaagtaatcataaaagcttactggggtattcactgctagatactggcgggaacacgggccaccctgacaaacccccttctgagaacccacaggaggaaagcatctctggcctcactactatgaatacctgtatttctcctgaataccagcctcgtttacacatcatgggaacatagtgctctgtgtgtccttctctgctttgttaggaagctctgagcccagttacagaagtatacagaaactcactgcgcatgtgatggagtaacaacatacatagcatggctttgctatgcctttaatttacttatactcaaatgttttttcttatactcaaatgttttcatctattcgtgttatcacttgacacttacatatgcctacaagttgttttttggtgaatgaggcaaagacaaaaacaaaaaaagacatatcgggttatcatgtatttggttacagattcaaggaccactgagtgacagttcaagtaagttcctgcagggaaagtgagcattcatggacgtgaagtgaaggcaggaggagaactcaagtgcattgattaccatatattgaagttaggaagggaaagggggagctagagcagagttcagggcaagggcctgagagtgacacaaccctgggcaaatttaggacctgaatgtcacagtggctccagtgggctcagaggataatttttcacctaattagggattgtcttgccttggcaatgactgcaactaacattttccaccttctctagccctttctaccatgaattttggagccaaagaagaagatgagcagtgcagggccatctactgtacacagcacccatcctctgctaagcggttcctcctggccaggctgccagtgcccatggaattacccacaccctcctggcagcaaggaaactcagcacctcacatcatcactcttgagatcacatgggttccacttttgttctttgggaagtggcatatgtttctaaatcctggtggcaccatattctgtatggatttttgagtatgagacttgtgcatgtgtgcatgtatgagggcatgggctgtgtttccctcttttaaaggctaaaccactccatctccaggtgatggaggccacacagaaatagcaattcaggctcttaggcttattacaagtggctttaggccttgtactggtccactgtgtgctgctgtaatagagtatcatagactgggtaatttataacaaacagaaatgtatttggcttatggttctggagtctgagaagtccaagatcaaggggctgcatctggtgagggccttcttgttgtctcaggacatgggggcaggcatcacatggtgacagagggcaagaggtcagactcacagcctcaagtccttttacaataggtaggcatggctccattcgtgagggtgaagccctcatgacctaaacagctcccctacgccccacctctcaacattattgcattggggattatgtttccaacacatgcttgtggggggaacacattcaaaccactgcaggctcctgtggtctctgagcacagtcccaacaaagacaacttctgctcaggcagtctgtccccaactctgcgaggcactgcctccaccccaagggctacgcagctgcaccaagtcagagggaccccaaggacgcatcaacctccagcgcacgcgtgccacaagcaaaagacaagaagagaagccacaaacagcccaaaggcacatttaccgtcttgctgtatttttttaataattgattttccagcattgaagaattaagtttcacacacaaaaacaaatgttcatttccagctgcttttgagcaatccgtagtccttacaatgctgacccaagccctcataaccatcgtcagctagagttgggtcagggctgctctctgccagtggcatgggtgttagtttgtcccagtcccaccactcccagtgttactgcatcaggcccatcttgctatctgcaatcctgctctgggtgtttcaaggtgcctagcagaatgagacttgagagacaaagggaaaaagtgaaacagcctactaaagtaatgactgacatttccttcatatctcttaacaaaagtatttttaaaagaagcatcccatctgcattgaactgaatgtttgtgtccccccccaaaatttatgtgttgaaatcctttctccaatgtggtggcattagaggtagggcctttgggtggtgattaggtcatgagggtgaaccctcttggatgtgattagtgccattatcaaaggaacctcagagagttctcgagctctctttcccccaacatgaggacacaaggagatggccatccacaacctggaagagggccctcaccagcacccagttatgctggcaccctcatctccaacttctggcctccagaactgtaagaaataaatttctactgtttgtaggccacccggtctatggtgttagaacagaagccccaaaggactaaagcatgatcagatttcacttctgcagcactgagcgataagctatcaaaaaacatttctccccaccagatgctccccttcctctctacctccaaacatctgcccatcttcagaaaggccccaggtcacctcttctaggatccttttcctgaccttcaaccaggaagggctaattcctggcctgagccccaactctgccagcttctgtcagggcacctcaaacacatcctttgagtgattttatttcgtgtgtgtctcttggctctgtagaccacaagccccctgaggagagcactgtcacactcccctccacagtcctcaccaagtctgtgagttcttgattcaatgattaactgatcaatgagctcacacccttgtggaataggcagagacatcaaaaaccactaagatccttcccaatatgaaacaccagaagaagacagcagtactctatctcctgccaaagctttcttgcctttttcatgtgcattctgagattgaatcaggagttttacccctcatgccacatgtgtaataaatgtcataatttctatgttacagataagaaaactgaggtacccacttaggtacacacagctattagagggaagagctagaaaatgaacccattctctgagactgcaaagccccagggcctttccactataccgcattgcctttcatcaggcatggtttctggggcagaatgaacatttaacaggtttccagcagttaattgctacacagtacaattgaggagcttaacaaaacaaaacccccatctcaggcctgaaagttgtagaggacgcaggtgatgcctgcaggtttttctccaagcagccatttcctgattgggaaaatgcaataatccattctacattctcaaatgagaaaaatttaacagcattattgattgattttaaaattcagctgacatttttttccctattgagaattttcccaaaccaaggctggttcattaggactcaacaagtacaatataattaattcagggactgttgttctagcaggtggattaacaggaaggttttttccctccttttatacaactaacaccacattttatgagtttggggaaaggtaataaacatgtctttaaaatggattcgttcgtgctgaaagaacctcttaaacacagtattagaaagctgcagtgccccataattgtagggagaattttaccacccttcatcattcactacgattccctccaaagggtggagcacaacccagaatggcttttgctccttggttctaggggcacagagtcctgagagccctttgtgaagtcagggtgaagccagaacacaaactcatagccgaccccagcactcagtgaggaaatggaacctacacagttcctgacagaactgactgagcaggaagaaacgctctttgtagagaacataccacatacctactccttggccctttgcaaacatgatctctccacaaatggcctacaagacagctgtgattagacccactctacagataagaaaacaaaggcttataaatcattctactataaagacacatgcaaacatatgtttactgcgacactgttcacaatagcaaagacgtggaaccaacccaaatgctcattaatgatagactggataaagaaaatgtggcacatatacaccatggaatactatacagccataaaaaaggatgagttcatgtcctttgcagggacctggatgaagctggaaaccatcattctcagcaaactaacacaagaacagaaaaccaaacactgcatgttctcactcataagtgggagttgaacaatgagaacatgtgaacacagggaagggagcatcacatactggggcctgttgggggatggggaactaggggagggatagcattaggagaaacacctaatgtagatgacgggttgatgtttgcagcaaaccatcatggcacatgtatacctatgtaacaaccctgcacattctgcacatgtgccccagaacttaaagtataataataataaaaaaacactgaaaacagatgaaaagtaaagacacatgaaagtaaaaaaaaaaaaaaaagaaaacaaaggctagataagtcaaatgactcaaatgtatacaataagcttatgggagaggcaagatttgatttgagcactttcaactcttgctctttcctctacagctcacagtgtcccataggattctgtaggaagagacttctttggccttttttctttttattctgagccctctccaccctcgatagttaaaaggcccatttaattccattggttttatttcagttacaatatattcataactcattagccaaactgtaacctttgaaataagagcatcatgcttcaaatttttcatttttcctttatgagaaaacatatatggaaaactattctgcctgaacttaactaccacagctcccaaggacttcagcaactatctcatctaccctttttatttcagagatgggtgaactaaagtccagaaaggacatgtgatttgcccaaagttgcacattttaacagtggcagagccatgtcccacctcagccctcctcctggcatcccgcactcttcaggccaagcagtttacatttaaaaatactaagaaaaagcagccccaatagcaaaacagatggagtcaagagaaacatccatcagtgggggaataattgaattaattgtgatatattaatacaatagaatagcacaatataaaataattcattagatctacaactatcaaaaaagttacctcaaaagcaatgttaagtggaataaacagattagagagggaaacattaatttctattgtaaaatatataatgtaacattgcctgtatacatatacatgacataaaaacataaggacatgaacagaaaagcaaattaatgatatggtcacctttagagaaaagaaaatgggaaagaagaaggggcacccatgagattcaaattttatagctgatgttttattctctaaaataagcaaacaggcaaaggcagacaaagacaaaagagaaaacattcaatttgatcaaacatcaaggcagagagactgagttaaagtaggagcatactaatatttgaattaatagctttctgtttcttccctggagtactgaattagaatgtttaaaaatcaatactccaaactttttttaaataggactatcttattgtcacaatgaagaaacagaagaaaagatggcagtgggaacaggctaattaggctggagccgagtgtgcgtgtctggggcagagagcaggttaatgtgaataagatgagtagttgctgttggggaaagcatattcctaattatgtggaaaaggcaaaggtgagagggagaaaccaaccagaccaaacatgagcgagccaggagaaaagtattaagatgcttcccacaaacgaggccagctgcctctgaaaatccacagctccagggatcagataaggtgaacaaattcttaaaaaaactgaaaaactttcaaggccctataaatgctaatcagaggttcttttagggtgaggctaaactccacattatgaagaaagctatggggacttaagatttctattaagcctattatgtaaattttcagattaatctagagaaggaaaactccccttctatggaagatttttagaaataagcaatcttgactccccagacaccctttaagaccttggcaaaacacaaatgctgtgataatccactgggctggtggttccagaaacacagctggaacatgaaaagaactccctccttttgagttttagaatttttgcctcaaaatagttcagggctttggtcaggatttgagtttgtcaggatcttggtataatagactggaagtcaaagggtgaggtctttcttttcttctattcacgagaacagcatgagtgaaaggggcccctgactctttgagttttatttttatctggagatcaatttctacaagttcacatgctgctttgaagatcaccagcaacatctgaggtttatctacagccagtctgctctggaagaatgattagtattcactccagaataaaaagcatcatctttaaaaccaatgtctatacactttatctaaagcgttcattgattccactttaaaggaacccacttgtctcaggaaagtcccatgctaaatctctccagccattagtcctacagtggcttgtctcctctagtggaacttcatagccaaataaattggggaggttctttcctgagtgcaccctggctccagcagagaacctgttagtgttccatcactttgagacaacttcatgtaatcagaattttattctaaagtagtatagtggttatatacataaattaccttccaaaccctccagtgcacaaaaaatccttttgttcagcaaaagtactataaataagtttccattttcttcttctaaaagaactagtcaggaagctttgaaacaccttgttagaattcactttgctgtatattcatcccctattcaatgaatccccaaagcattacctttattttatttttacaacagctttgtggttcaataaattctatctttcattcccctccagaccctcatcaagtcatctcacttaaaggcaaaagatacaatctttgtgacaatacctttattatttgcattgaaggtaattgttaccagcaagtgttggttgtacagcatcagggagcctggtccacataccaaaggcacagactgcataaggccaaggcatagcaaaaaacatcacctcaactaaaactgacctgtcacctgtataaacacttgacatattaaggatttccctgttacccagaccaactctactcacttccctaccccccagtaggaccttggatggatgtctctgaggactgataactgggagtgtcccccaagagacgtcttccttagtgttgtccctattatccagttcagtgcatttaaacatcaggcatttggtaactgcttatggaatgaaggaaggaatgaacacattaagagcctgaacctcttcagctccaataatggggatctggagtgtaccagtacgatgccccaacactagttaagacaagcccgtgtcagtgtagctccgagagcttcagagcatcacaacttggaaggccaccagaaaggaacaaaaggagaagggaataaaaccagagtggaatgggaagaaagacaccaggagaggctgctaaataggaagagaatgaaaacaatcaatgacttgctgatcacttgtcaagcacttcctatatgccaggcatattaattcacttcatcttctcagtgctattgttgaaagtacttatcattattgccattttcagataggaagatttagaatcagagaagttaagctactttcccaggatcacacagctagtaactgacagagtcaaattctaaacttggagaatctgactccaaaccctaagaccccagactgcacttaccaaagtgtatcatgccaaatacattacctcctctgagtatctgataggtgtgtagtggaaaaaaattgaaaatatggtcacaggcaaatttggaaaatgataggttaaatgggtttctttactgaaagacgcctcagagttttttaagttgataatgagcatgtgaatcttcaagagatgagggtatatgtgtgtcccttatttgaccatcaatggttttcttggggaagcatcttgctgacccagatccccactgagaagcactaacctcatatgcgctcctgagtttgtcaggcgccagttaagggaaggtgctggcaaggcaaagtggcagaggcaaccaaaagctctggaatcaccccagagctctgcagcctcagccagccctctgaaggtccatccgggggccttcatttctcctgactatgcaagataagaaacccatttgcattggcccatggctctctcaaactgtgcagtctgcccaactctctctgcacagtgtctttctttgtggacttcacaagcgaaatttctcacctgagttaatcattgccttcaattctgaactcctgtccatcctttctgtgaggagatttggcattaaatcattacaagacaaaaggatatactacttatgccactttaccctaatctcaggaagaattcttagaaaagtctgaagttgatggccattatactccactgacagaaacattaaagattcacttaaagataacaagttaaagacattctgagtctcatcattggagagcaccaggtgagatacttttcttctaactgccttagagtcaattacatgatgatagcactcgctccatgaagccctgttgttcaaagttcagtaaatatctttaagcagagaagcaattacagctaagtaactatttcttgaatactttgagtcttctaactattcaccacaccaacacgacaatcagaagctgcatgggcatttcagaggtcaagctggagagctgaattgataagtctgaccaccggtgacagccagagcccagggctccaaggcaatgaatgatgccatgaagaagttacccaagagtcctagaggagtgacatcatttagcaagtatgtttttgggttcctaattatagctgttgtcaccaaaccaaattctctaaaatactgccctcatcatgtcactcgcctgctcaaagactttctatggcaccccactgccaagaaaacaaagttcaaatttggctgattggtatggaatgtcccctcaacccatttcaaatccacctttctgactacactattaccagaattctctatgctgggccttccttcccctcctctccctctatattccaagcctactccacacccacctccatcatgaagccccttccatccccatcctaaaccatatttgtcatctgaaactctgaagacactcttcaacaagttccatttctacaaactaaaacttttccctaaccacaaacccattttaactatgtttgattcttttttcagctgaggagaggaaatgactcctctctttggctgtcatcttccactggagttcagtaattctcctagtttctggaagatgaaacgctctacatcttccatgcctgtggtttatatttcaccaagtggtgtcagcgctgacagagtaacctcccatttttattgagccgcacacaatgtaattgatgacatctgctggggctgatattttaagtgaaggctattctcagctctgcctgtgctcctcatggttctgtatataaatagccaacggcagctacccctgaggtacaaagtggggatactcagctaaggtccttaattatatcccataaagtcataaggttttctgggagggttaatctgagcagacccagttttcaagcctgcagagctagaaaaagagaacaggatggggctctgctgaatatagctgccatcattcctaggagagaaaaatcctcgtttgaactgtttacctgctcaggtttaaagacggtgattttgtggttcccaaaatttctgtgttaactcccaaaccaagggaagctatcatttatatcccaagtggcaaatgacacctaccttgatgtattccttctccaatatgcattagtaaaagtaaaaatgtcttccctcgggagagtgtattcatttgcaagctttggcaaagagtaatttttgacagttatttaggcaacatttgatccttatagcacaagaacctatttctagttcttagctaaaaagaatcagttcacagtgactgtcaattgagttacctttgcaagcaaaagcctggtagggttgtttgcagaagggcttgtttatcaggcacagacagggaatttgttgctctttaactaccagtattcttcatagataaagttttatcctattaaaaagttttaaaatttttgatcacttttaataaaacatttctaaactaagttacaaatgccttcatatgcttttgagtgaatcattgtgatgattcagtcattgttaggattgtagaagaataattccgttaccactctaaggctgctaagatatgtatagtccagatagagcctccaaaggaaggttttgctggacaccttgccctttacaaaaacatatacagttctccatctgtagattcacatgcttccctgaacacacctgcatcacagccattaacagatcccaccacaattattgactgatttatttccctactccccactctgagctcctgtagggtaggcaccacagcatttttctctatccccagtacctggcttggtgcttgtgcatacagcgaaagctcaataaatgtttgagaatgctagcatgcatgaatgaaaaaattgttacactacttcaaagcctatgataaatgtatatatggcaattttaataccatttttgcttacgagaaaaccagagtccagaggtagtgacccattaaactgaccaagcagagggcagaaaggagcaccttcctccatgtcacatgtcaatgcctccctcgatttcttcgtatcaagttgaccatcatgatcacatcgaatactcacattacagaactgaagctgattctcagaagaatgaacactttgagatgtggtaggtaatactgtttcattgtgttttggcattaattccatatgaacatatgaagtgcaatctaccatcattttcaacagcaccacacatggaacaacgggggaagggatgtgattcatggcaggtcctcactgtgtcttaaataactcacaggaggacactgttagtgatttacaacagctatcatgagagactggtttgatgcttgctgggggaatgggggtggagaaagccttctgtgggccatgcttaaacccaagtagtcatcgagctaactctgaaacaggcttctatttagaaaccatgaagaagttatttaacaaataaaatcgcagtacccttgacagtctcccaggattaacctttttctagaaagaaagtttcattgttatggctcatgtgaattagggaagcatctccaggcatagtctgttccatgaatgaaagcactgcattcagccccacaattcaccatgttaatttgataatcaaatttcactttttttttaaaacaaaacgaatcaatgattatattggtcaagccaattaaaagaaattgtttaaatcagccctagatataacctcagacaaataaccaatttgataaaataatttctatcaccccagtcaattcagtccccaaagtcaataaaataacaccgctagctggcccttgtgggaacattaactcagcatgcaaggaaggaaaaatgagaccacatttaccacagactatacagcaagaaatattgcatccattaccttggtcaaagggcttgttgggattccagtttctgaaataatcatcctatataaggaaaaaatagaaaacaaaggtcagagttcaaaaagcttctcacataactgcataaaaacctgccttccttttcacctcccaaaacacaaaggaaaacactgaaagcttagaaatttttcccaaaacaggcattaatgtgtaataaaaaaatatcaatttccttttcaaattcctgtctttcaaaccgtatgtattcaatactgggaatagtaaaaacatttcagcccagtatagaaacagcgctgctcttcttagtttgacatataaacccagacaccttctaggtgcaaggtgtatttgctatcaattatactgtaggtgatgccttgctgctctcagttatgattaagcctctgtgtttgtaacagctgataattcaactgtcaacatttcttttacatacagacacgcatcttgtggtgcacagttccagtttttcaatactcacaaaacctaaaaagagacagccttccaaatgttagaattaaccaaaggcgtacatttagcttaataccatttgttctgggtatggaaagatgaaaaaacaaaggctggccagtctggtctcttcataaccatgtctttcctgcatttgggttgcatcaatttatgctctgaggctaggcaattcattactttaaaattgcaaggatctcaatcactcaattcttcacagctatgttaacttcttccccactcctaataaccctttccttcctaacagccaccatgtactccctttattctccccatcagcactttgaccccattgtttcctggcacacccactgtatcagcaaaactgaacagtttgcaagttgaagaggtgtcacccatgcacattatcctcatagcatctttaaggatttgtccctttgtagttaatattcaattgctttgctatatgtgtttttggcaggcagtctgcatgctgcagttttagaaagctgcccaaaatgaagcctcaatatctcttctggtaaagctaatttacatcaaagcgcacaattagtttaaattattgtccatgctgtgttctgatgcagtttatctctgacacgatctcctgtgaattttatcagcctcagtgtcattcaattatgtagctttattatatccttgttgagttcacctaggcccttaaatagattttaggaaactagctttagagtaaaatcagaacatattgtttcttggccagtgattccatcttccaaggcattaggaaataaacagcttcctctggatccagaggattcagcactaaattatttttagtttcaaagaattgcccactttgctccagctttagttttatagaataactggccttctcacccatctggttagggagtctttgagctctttaccatgaaatatcactaaggaaatttaaaacagtctctctgcaatatctttccccatttataagtttaaatacaatcccaaacttttggaattgtgctgtcagaaactcggcagccactgttaaatgatattaagttaaaagttggatggcagataggaaatttagcacccaatttctaggtttgatgaccaaagtgttcttagccttagacaaccatgttaccaacattttctgctattctcaagggcagaagagataacccaagatgaactcattctcacaagtggagaaaaaaaggatcaaccgttcatccttccaactgtggtttatcaatgctctctccacatacagaggatggcatcacatataatggcaatgtgaaatcttgtgaaatattttctacttgaacatgctgttctaataaagcccttggaagctcaggctgtgtgtccaacagggaagggctggaaccaaagacaagttcctttaactttaatttcacaggccacattctctttgatgtcaaagaaaggtttgagcaagtctcaagaactggatattccctaatgatttcaacatattttataacttggatggaatttgaagcattcttctggaccttgccactttttcaggttaactataattaccatttttacctatttcttagggaaaaatcacagttttaagtataaggcctccaaaagtagctatctgcattagaatatttaaagctcattgcaaatgtaacaatactgcctaattgctgccaaaatgtgaaagtacaccttgagtgaaaactcattatgcaaaatgagtccttcaaacaaccccttgcccagccaggccaagcagggaagaaaaatgattctctgcatctgattgcttttgccctgcctcaggaaagtggactgccaaagcaaaaaccaatgagccagagctgataaacctttgtgtatcactgctttggctgcagctgagagaggaaacctcacatcaggggccaagatcatgaacacatgtgaaggactccaggcaccagagcccacttgggggatggtcactgagcatgggggaggggtctcttagcagccactgctgcagtctatgtcaggaaataagtgctggagtatacgtgatcactcctgcacactgtcctagctaggttcaagggcttccacacacggtgagtataagcaggctgggctgcatcaattaagtcactctgtgtctgggagaattctggtgaggcacagtcaaaactcaagtggagaaagccaaagataaaagacaaaagaaaaaagaatggctcctctagagcttcacctcctgaaaatttgttcatccctgagacccacttaacgattggggtgctcaaaggacataaggatagttgtcagtggtcctgaaccaacaccctaccaataccaaggctgggcatttcaccagggcctaagactcaggtggcagagccaggcttttaaaaaaaaaaatcttattttctatctaaataaaaacatattgtatctattttacattgtcctgaaatgaacagaccccatgacttgctatgctgtcaataattctatcacttctaccctgggaagtagtgtgtctgccccggcacgatcccagtgctgtgtgggccccacacttaagccctgaagctgacaaagtgcaggacattaacagcccttgcctctgaccttccctctggcccaataaagttatggcttgttaaaattcaaactgtggtgaaagacatattggatagatcaaacttgtcaggcaaggcatatctatctgagttagccttttgagtggcaattttatcatctaatgataaagcttttttaaagacttgcaaggagcccagcaacagttaatttttaaacataaacccaaatagaaagatgcatatctaaatatagtcatttaagttcaatagctcccattaatgcattccacaggttgaggaatgaaggatggcagtgttactacatgtctattttatgggttacactgaagaatataattatgtcaggcatcttctggacaggacagagaacggtcttgctgtaaattctaactaacccatatgaggaaagactgaatccatttcactatagcatttcataaatgaatattattcaacccttttttagagattgttaaaacctgaaagaccctgtaaatgtaaacagaggcccaaacttaagcatactgacttaggtctagaatcacatagtattccaaggcagcaggaactctcatgaaaagttgacatggccaggcccagtggctcacacctgtaatcccaacactttgggaggctgaggtgggtggatcacctgacgtcaggagtttgtgaccagcctggccaacatggtgaaaccatatctctactaacaatacaaaagtagctaggtgtggtggcacatgcctgtagtcccagctacccgagaggctgagacaggagagtcgcctgaacccgggaagcagaggctgcagtgagccaagatcgcaccattgcactccagcctggacaagacggagcaagactctgtctcaaaattaattaattaattaattaattaatttttaaaaagtcaccataaagatcatggtaagaaagtgacaaaccatccatgtccaggatgaaggaggagggttggtgttagtgggagaggaagaaacagagactggtagcaaataagactccagttattgttttattttctacagctgatcaacaaagataaaactatatttctccatttatctcacttattaaatattccactaagatagtactgaaacctgtgaaattattggcactcgatggctggtgcaaaggaatttaactattaatgctttagagatattctgttcagataagcatcaatgaaaaagaaaatatgttttacatatacatatatacacattttatatataatatatattattaaagatatatttattatatattactatatgtttttcatacacataaatatgccaagaccactccactctataatgcatcttccaatgaaataattaagtctgcttaacatgaaatgacaaaatattcttgctataatttgggtgattaagtctcttcatcacagatgatcatagccaacagcccattttgaataagaacctgaattttcttttactataccatagccccaaaatgactgatgcaatttagctcaaatattcaccagggatttgcctttcaagaggtgcctatttaatctccaaggaatgtcaaagctgactctgaggaaaagatggggtggcagaaccaaatgaaaacccaattgccttggcacccaattatgaagatgataatgtaattgtatcagcttcagatgctacagatcaaacacatttagttctcatgaaaccgatcgtttctccttcatacatattttagctaagctgtttgaaccctgccgtttcatctgatgattacctgagataatattaatacaaattaccagcctagaaaataaatgggagcctcatttgtcttgaccaggagggagcaatagagacataaactgaaggaagcaaattaaaaggagggcaggtagtcattttggagttgtctgtgggctgattgcagatacacacaaaatggagaagcacttccctgcaaggctaagtagatcagaaccgagtttgtagatcccagatggaggcacactccactttaccaaaactgcaacctttagaaagagatcaatgaagggactgtagccaaactgctctcaagagaattcagtgcaaactggttctatttatcttcacactacttgactggggggaataggaagaagatctggttggtgggtgggagaaatgtccccgaaatgataatagaagtcaccagaaaagtgagatttccagaccattatgtaaatgcttctgttatataatgtgacatttgcctgtaattttgtgtgcaatggaaatctctgctaatcaaactattataaggtacaaaacactccatttattaagaaaggagctagcatcacacacaactaccctacctctgagctgttttcattcacatctctgggcaaataatttgctgtttgtctcctccccatctctggtgaggagcctcagtgagaatccttctgaatgaagtgacccagcttgggcagtgacttgaggcttctcagccttccatccaaagctaccactcgtgagaaccctgtacaacagagcctgggagttgtctgcattaatacatttctgtgtgcacaaatcacccacccccacccccccaccccccaacacacacacgggcctaggccgcttctgagcagggatgggtcttactcacctgcacatcccctaaggcatcactcaacagcacacagtaaatccttgctaaatcacatcaaatataagtaagcaattccagtttgtaagcaattccatctctgtatccctgtgaaattcccataactattactagtgtgtgtaagtacaggtggttgtatgtttatacacacactctaaatcaccttcaccctgaatagagcaattctttgataaattggtctgacatttggtttaaagtcctccaggtcttagacaaaatgattcagaaaataacaatgtcagttgctctgctctttcaataaataacccaccagtaaaacacagataataactgacaatcatacttgtactgtaactaatgagaaaagataaagcagcaaatggactgtttatatgcatttgataaattgcatcccttggatataccaatgaaaaataaatgtgtgtggtactggttcactgaactaaaacaaatatttactactgagatttcagatttagaatgaaatttacattttatttggcaactactttaatgctatgtctacatacagttgaaaaatcaaaaacctacctcaacttcctgagtacgaaagcattataaatgagaaaaaaataaaagaatcacatcaaacaataggaagaaatgtatacatttttgataattgcatcaaattttcaaattatcataacattagaaaggtcatccagatatgctctcttaattcacctaccatcattcctttgaaaaggtcccaacaattcactaagttcatgggaaaggacatgaggttatggggtagaataactgaagtgggatgaaatctgagtgtggtctagtgatctatatcattgctgccgaacagctagcaaaatcatgattaaatcccaacactcagccatgattaccatccacaagaatttcaaatgagtaattgcctgtgacattggtccaaagggtgaaattcagtaaaaaccccaagatgacatccaagaccaagagtagtataccttctacatttctgcaaagaaattcctttgccttgcagtttcaaaatagcttgaggggtcctcaaacctgagaaagatatggatttatgttcctaggaaatatgtaaaatgaatagcattgtcattgctcctctagctgattcaaggatcatcaccaacacaaagagctccctcttcttagggactttctgtctgtcctggtcagtccatccaagctggggtggagagaagtaacccactggcttgttcttttcccaagggaaagaactgagtctgaggtttattccccaaaatatgccctgtgtttgggcttttcttctggggatatgaatgggcatatgatgctccatttgtactctggccaagacatgtgttgtctcctcagactcaaaaccatccacaaccttgactttattagcaaaattatcaaattgagctggccaagagcagccttcttaatatctaggaaggaaagaataggtcagcaccaaggagttaaagtcagagaagatactgtaaacatggcaggctttgaagcagatgtgggttcaaattctggctctagcactcaccagctatgtggccttgcacaatctactcagcttctccgagtcaatttctttatccataaaacaagaccacttgcacctaccttgaaggatggttgcaatgacttgcaataatgatgcaaagtgcttggtatgatatctggcatacagaattaataaataaaaggtacacaatttcatgtccatttcctgaggtttacagtagggggatgtcccaggaacactgagagaaacattagactttgtggatatgttttaaatttcaataatgcaattcttgcatatttgaatcttgtcaattaggcccaagtgaagggagaccaattgcaactggaaaaaataattatgaaatacttaaatgcatgtagttttattagtctcatgtatgaagagagatttttaaaaaatcaatgaaatttgaaaacttgagctacaggcatattttgcgtaaagggcagacacgtactatctaagattcggtcacacctctctattaaatagaccccatctattaaaaaagacaatacttacaccagtgggcctatttgtgcattgagtgtggcattttaaaccactgaaaggtattacctatcatgtaattgtaaacaaattaattaaagtttcaattatgattaactatatcctgataagggacctgaacctgctctgaacaggcaaaatttctgtgtaatcattaatttacatgtagaaaacagatggaggaaccctgaaagggtatgtctccttggcacaccaaacaaagccattgccatcttatagcttatagcacgtaaaccttcatttcagagaaagtacaaattatactggcctgaggcccagccttgtccgagtatcacaaatcccaaattaattaggtccagccatctttctgagaatgcctgctcccttcccccaccatagctggcaggcctccatgaacatccagatgctaccttgtagagaataaaacaccagctattaactaccacctcaccatccctccccacttatcctctcaccaaacacagggattggcagaagcagtggtttccaccttggctgatggctggggatgctgtggggcttttcaaactctgatgcctggcccagggcaggaggtgctgattcagtggctggagtgtagcctccacactgggatgttttaaaagctctccaggtgattctaatgtgcagcctccataggaagtcacacactaaatcacagtgactgaggtgactgagggaaggccaggcccaccatggagagcaaaccaggtacagaacatcaggggccttctcccccagcttctggagctttccagagttgtatccacctaccactttcagggtctgctgctctaagagtctccagctcattagacagcacctctgtccacctgctgctgaggcaagaacccaggccacaggctggactcctccctcttccttccctctgccgttcaggcaacaacgaagtcatcttcacttgcactcctgggtctctttcacaactcccctctcctctgccttgggtcaggcctccacaatttctcctcacaacatggccacgtgccctaaccagcctccctgcctcccctgagccctgcccaggctgttcacactgcctcaatagtgaccttctaaagggatgttctggtcacatcaccctcctgcttaaaatgctggagggactcccaggtcaaggccaagcccatcagcccagctcacaggacttctgtgccccagcacctgctgagccttgcagtcaccttatggccacactagcttacatggtcgagccaccaatgaactacgttttaatcctgcagcagcctatgctctcttcgttccccaaaactctgtccatgctattccttctgtgcctgaaacactcctccttacccttcttttgttaacatttactcctctatcaaatcccagtttagacacttcttctcgtggaaagccttccttgtccccagtccctctgcactcgagacacccctgctgtgtgatctgcagccccctgggctgcctgaacagagcactgaactgctcacactgtagaagctggctactcctctgcaactcagccacacagacggcagtccctagggccaggggctgggtggcctcactgccgaacctcagcacagcattcatttggcaccaggtactctaacatctactgaatgaataagataacaatccaacctcggctggttttttatgccagtatcttggactgcagctccacaacttcttcccctttgtctcaaaactgatggttctatgacctggaggtttctgaggaaggtgaaatagataactcccttttagtgactaactggggcagtaacaggaaactggaaaccaatggggatgacactggaaggtctcagagggatcaaccaggctccataggaggaggacaggtagatttctgcccaatggccccaccccacatctactaatgccctgagtctcctcagggaccaagaggacttcatgatttggaacaccacagctgagccaaaatctgatacaagatttaggacttgcatcaaatcaaagcccaaatcaaaacatcaaagtaatagtaatattaatagtaatcatcgtaataatagcagctaccacattttttttttaatagacagggtcttgccatcactcaggctgaagtgcagtggcacaattgtaggtcactgtaacctggaactcctgagctcaagtgatcctcctgcctcatcctcccaagtagttaagactacaggtgtacaccaccatgcccagctaatttttaaattttttgtagagatggggtcttgctatattgccctggctggtctcaaactcctagcctcatgtgatcctcctgcctcagcctcctaaagtgctgggattacaggcatgagctacttttgcaataatcatctgagacaagcatctcagtgttatagttgtggaaattgaagcttagagagataaaattactatacaagttcacacagctagtgagaagcagaaccaggatttgaactccatttttgcctgacttcgaagatcatgctgtaaccactacatactactgcttcaatggcatcaatgtgaacaccagagaccctggagagaaggcatggggctgcctgccctgtggagatgcaccatgatacaggagataccaagaaatgggaggtgacagcacagatgacgggcctctcaagagattctcactaccactaccaggactctcattatatctgaagcctcagctttcctatctgtgaaataggggatgaaaacacctgcttcacaaggtctctaagtaagtggacagccggtctatctgtcatgtgtctgccccaagaaagcaggcaggacaccctggattcctgatccacccctaccctcaggcccagcctcactaagatggttttctgggaagaatcatggcctttggccccaaagagagcagccccaagagcaggccggcaggagatgcacaggagtctcctgcctttgtgtgccctgaactgagcactcacacctgtttaccaccagcactcctggtggccctgtgcaaagtgaaacatccaacaccaacatccaagcaccatgctgaggatgtagtggctttagcatgaatcatctctctggaaaactatggctgcaggcttggcatgaagttttctttagctgcaaagtgagggatgctatggctcctcctagccctgccattcagcagcttctcttccaaggaacatctgggaaagaaagcaataaaactcctttcactgtgtccctaagactgtcctagctgccaccttgcagccctgtatcctgaggctccagcctttggatccacttacacagcagacgctcctcaccaaagccccagaaataaattgagtccaagactttgtccactccaagcctgtgctgtcttgatctgataattctcctttgaaatttgcaattttggaagtgacattttccccacggtaagaggtaaccagagtaggcaagcctaccacaaatggacccacattcctgagccacagttttcctgtacaatcaccaacaaggcttccatggagaagagtgggcatcccctctctgagcaacagccactgctaacagcagggcccaccacatgggtagaacagtcctctgagattgactgaaggctctccacagaacccacactcccaaaggctgcggggtcaaggagtcctgagctaccctgcctgttacccaacaggcactgacgcaactctgtaattgttgtaacacaatttctcctccccagcactgacagaaagatgcctgatagaaacaaatgaccacgaggcacttcagccaggctccactcttcataacttgctcagctgaccccttggacagagagatgacgtactgatgtcatgtggacaagacggatggtccagagaacctacaagagaattgtctttagaacaagagcaatgcacatgagtccccagatagtagtcctaaccccactattgaggaccaatgtactagtctatgccatgaacaactggctgtcctacttccccccagggggaatgctattatctggtcccgcttatttagggcctgggcacccacagagacagagtgaggctaagactaggaaagaaatggagatcaaaggctctaggacctcaatgcccgatgacacatccagatctaacctataagcactggggagcccctggagggcttatttggagggtgactccaccaaactggtattttctaaagcatactgcactctctctgtgtgggacaaattagatggagcccaactgaaaccaaggacaccagcgaagactaacaactacccttaccctcttgaaacccatggtctagccagaggagaagtaacaagaaaggtaaccagattaagcataacatgacctggtaactatcacttagaaaaattagctatgggtacacagaggaagaagtcacaaattattccatagaaccagggaagattctactgaggaagtaccactgaagctagttcttgaaggacagttttccagaggatggacacacagtggagcgagagaggacattgcattcaggggatctggcaggtgcacgatcatgcagtctttgccgcagcagctttaatctatgacaaaaggccgtgaagcatgagcccaggtgcaacaacagagaagagacaatgggagatgctggcagctctactcagtgtctcctgcacctctcagtctgccctttgctctgtgactaggaaactctgtagctactgcagctggctgccggagataatgcatatgacaattacaatccctccactttagctggaaggctaagccatgacactgtatctatgccacccaagggacaagaagcaagctcacaccctggcccttccaatccagcagcaagttttgccatgccacctgttatggacatgtgtgaatcattatgaagcataattaaaaccaactagtcttctgcctgccctctttccctcctaaagagacatgctgagagcttgctgtacctttcctttgttaaataagtaaacatctttccctctgaaggtgagctcatagggccatgccatgtgcccatgaaaccaggaccctggaggtcccccgcacagccagtgatcatgattcatggcctctggctctcactcggcctttgaaaggtcacactctagtttgcaggggactagagaagcggaagaggaacaaccagggttcctaagtcccatcttttaaaataaaaactctccagggtaaaattatcaggtaagatcatttatatgataaaaaaaatacacatcaataaggacatatttatttcttgtaaggagcacccagctgacagaaatcatataatacttctatgttttcatttattatttggggaaacaataggaatgttaataacattgcaagtcccttccagtcctaacattgtatgattctaaacatgtcaaatgataaatcaaatatgcctaaaagctctgtgtaaataaagtaggagcaattttcagactagcaaggactggaatgcactgaaagaatacaaggcagactaaagcaataagctgcttttgcttttctttttatttttgcttccaaattttaaggacctaacatgaacacaaacagtaattatgtcctagatctttaaaaatccctttcctgttaaataacttatgaatattaaagaaagattccagttggatttttctcatgatgcccagaactactaaaacagaatctcttgaacaaattaccaagaccaaatcctttggcaaaattacattctcttgcaagtcgaagactctaggggaaagttacataggaagacatgagaagaaaacagaaaaacaatatgaaagaagactaaagatgccacagtgattacttcatccaccttgtaaacacagccccggtgcaccaatcccctcctcccagcgctcagaggcctgcaaaggaaggacagacacctccaccaatgtgctggaagcctcaaccatccttacatagtgcccatgacccactgtaagaagaagagaagggaatacagaaaaggattagagaaaaatcaaaatggtaaagatagttatgggaatatgaagggtttcttcctgtttctactttactacttttcaattaaaaaaaaaacatggattacttcttaaattcatatattatctatatattcattcatttatttattcattcaatcattgactcattcatttaaagccctctggggtaggtataaggaagacagcatcaccctaacattataatctgggaaactacagcccagaaaagtaaaatcatttttacatgaattcacatagcactaaaatctacagtataaggtccacgtacaccagtggcatagactctgagaaaagtatctacatcccagacatgagaagtaaaaatgaagagcttcttgggccatgatcatggctaaagtccaggaatgtttccaggcagctgaatggaaccacaaacccttataattagcctgtttctgggatggcaaatagtgtcacccattcatttatttcttttgtcctggcatttctgtaccctattaagaaatgaaagatctgaaataagcaaggagtgaccctcagctcacccaccaacacatagcccatggcccatgccagaaatatgcaggagaaagccccagaaatcacgtttacccacaaggcggtgacagctcctgcaaaagatccaaattgtggctcgatttgttcaagcattcggggctcagctatctcatctaatttaccagcgagacacacaagtcacagctagaactgaaggcaccctgtcagggctgcctgctggaattatttgggaacaataccgtgtgggttattgtcgagctgcccatcacagcctcggatgtccgtttctcacacctctcttcacaaaactcagctcttagcccagcttggagctaaaattaacggttctgtttcctggtctaaaacatgaaatatatgaacagctatggcagttttttaactggtaacttttcttgatgtttctattgccattgcctaagtgactctggacaagcatttaaccttcctaggcttcagtttcctcatctgaaaatgagggcaatggtgcctactctatcgggttaacgggaggattatttgagacttacatgccaaacacccagcgcataggatgcaccaagaaatggtaactatattttgtagttgaccccagtatatcctctgccttacgctgataacagagttttaaaaatataccgctactttcctctggattagtatatttgtgatgctgccattctgactctgaggagatttttaaaaatcaaatctgggtgatagctgcattggaaaagcggcagccgctgctctgtgcaaaagtgtaaataaaatgccacttaagtaatcacattactcacagcttaaggtatgcagctcagagctgcaagcaaacacgcatgtgtgatggatttctcattatctgttgactgccactgcagtccatccagctgtctgcaggcgtcctgcctaggaacgtctacatcaaatcctgatgggcccacactcctgctatcagtgggaacagacccagcaggaaggaggtgatgccttcataataaggtgataaagcaaacagaaatgtttgtttggagaaaagctgccaggttcaaagtcagccattaaaggtcccttccttagcttccaaatgatgctgggactctccaacatcatttgggccagagaaaatctccagtttcttcctcccggtccctgccatgaagagacttggcctcctcagaagctatggtatcatctacttttgactcagcagtgcccagtgccagaccaggcaccaaaggagaaaacccagaaatactgcactagactctagctcctctctgaagtggggctctgaaatcccaggggttcccatttgactaaagctgcccagaaaagtgccaagaactgactgcagatgcattaggtgcttagaccttttacactctggatagatacagaacttgtggagaagccacttcacaatccaactgcaagtgtgcagtgcagatgtgggcatctacaggggcacaggctggaaagtcctcaggtaaggatgcgaggctcagttcctcgtgttaaatctgatcctctgaggcacctgccacctttccttggggacggagctgcctccaagtgggtatctttgattggggtaaggtttatccttggagactctaccccttttgcctctacctcccagtggagcttctgtgccctcatgatcttcctccctacctttgctcctcaacacttgctcctggatccttcctcagctcccagttcactcacatgttataagtgatccaagcctgaagtgacaaacttctactagggtgtctgcctcctgaatttatggcatgcctgtcggcctcagtcagaaaaggatggaaagtgaggacacttaagaactagcagagaccaggcgcagtggctcaggcctgtaatcccagcactatgggaggccgaggtgggcagatcacttgaggccaggagttcgagaccagcctggccaacacagtgaaaccccatctctaccaaaaaatacaaaaattagccaggtgtggtgatgtgcacctgcagtcccagctacctgggaggatgagacaggagaatcacttgaacccaggaggtggaggttgaagtgagccaagatcatgccactgcactccagcctgggtgacagagcaaaaccctatctcaaaaacaagatgaaacaaacaaaaaaaaaaactagtgtagaggtaaaagggaatgaaaatattctgcaaatagcattcaaggaagagacagtgaccaagaaaatgagcatagtcgatgtgaaaacattttctactacagacctgaaataggcccagtaggcagcagagcaaggacccaggtcctagaggaggtaatggtaccttgccattttctaagcagaaaccaagaaactgtaacttgagcctgtgttcacctacaacaggaagcaaatgaatgtttactgaacatccatggcctgccaagcaccgcactctgtgctttatgtagattattccacaatatcagcacaatgactttgcaaggatgatggtggcctctacattttgtagctgaggaaactatggctcagagaagttaagtaacctgttccaggtgacaccaggcaggaaacacaagagccagcagtcacatctggttctgtccaactgctccttctgtgcaccacgatagcctactgccccaaattggctacagattccaccaagttctagaccatcatctcccaaagggtgaactctgctgcacccgactcagacccatacaaccagcagggactcagaacaggtattggttgaatcaaagctgctacatggagaaattatgactcctcttggcaactaacaattcttttgaaggaaaaagacaacccttgataaagcccagggaaactgagctttctgtgctaaaacatgagtgaacacaggatttagaaggagaggggagaagaactgaaatcctaagagacatctggaaggaagcggacggaaggacgaggaaggtgctgggcctggctctgcactagagtaaggtcaggagaaagccagtccatgggaagggccctcgggtggcagagtgacctcatgaaaggagaaaatacatgtttaattacaaattttgagactgtctgttgtggagtgtgtgaggtaagacccatccttagtctcccacacaaaatctttagtgaattccactgggcgcactaacacctgtgtgcaaatgactcctctttgggaaaggaggggtgggttcaaagaggtggcaagttctgtgactgtgagggaagctctgggaactacaagatgagggaacagctggtcccaaaccaaccttgctatgacactggacctctgcatggctcctgggtagagatgggcagcgggcagaggataaagcagaagtctcgctcatacagcttttgtttacacaagttctggggagggccagttctcaatgtatggagaacaactcgctaatgtgcatcagcccacagttcgatatgtgaattgccccagactaatgtgcctctgtccccagcagcagcgcaagcacagattgggcccaacagccaagcgggttgctcgcagacacacacacgttaagaaacctggggcccgtctcactaaaattagatgcaaatttgattttggtcattgcttgtcttcctgctggtccttgcattcttcttccacacaatgattatacctgatgacagaactggagaaaatattaaataaattatgaacacatgctcaaccacagcagcacagatcttttgtgttattaacattgtctctctgctctttagaggaccacattattcttgaatctttcacagctaaaatctacctggaaacataaatttccctcactgtaatgtgaacaagtcccttaacaacagcagcagttcattaccaaaccattttgggttagatttctccaagaaaataaataaccagtttaaagaccgtcagaaaaatggcccactcatattcagcttaaacatggttatttattagaaatcatcaagagccactcacacctgtggtaactattagcacagaaggtcctcagtgaggtttctacttaaagacaggaaaaagacatgaaacatggagctgccatggcattccattttgaatagatccgcatttcagcctcgccttggcctttgtgtctgctcttggtaatggaagccttttgcaccaattgttcaggcatggaagagccctagggagatatttgtaagaggggagaataccacatgtagagccactactctgtgccaggcagggctcaccctccaaagtggaagtcagcacaattgttttttttttctgtaaagggccaaatagtaaatagtttaggttttgtaggccatatacagactctgtcacacattcatcttctttttaacccctcctttaaaaatcattctaaactagctggcctcagctggagcaggcctgtaggctgagtttgtccatcctgctctaaacagactacatctcttaatgttcttcaccaccctaggtggtcaatgctgtttttaccattttaaagataaagggaatgaggtgctgagatgttagggaacctgcttgagttcacacacttggctaagtgtcaaagcacaaagccagacaggatctaaatctaggtccattcgtttttaaaggtcagacacttcccactatatcacatggcctcaaaaacattctaaatttggcaactctcttctcagaaaagagtgaatttatactatgagtaagaagggatgtagggaactaatgtttcttgaacatctatgtgttgccctggccacgagagtccacagggctgccatggatggttgtataggtcactcgctgaacaagaatgccaggtcaggaaactaacgcaggctgaaatcccatctgcactgcacacagtaaccaagcaccctggagcaggtctgcactcacccagaagggcccctccttctatttcttactaggcccatggtggctgcagcagccctgctagtgtacctcccagggaggcagaatgagggaggaccagcctcaccaaaatccaggggagactgcagcctagaacagcaaagggagatagaatagagtctgagtgtgtcaaatcacagagcaggagggtggtaggtgaagccagtgacagggacccaggtaccaagtctcggccacaaggagaacaaagttcccccaacaaccttaggatagaattttgcagtaagaagacaaatagaccactgtttcacacacagtatgaattaacctacatcattatctcaaaaggtaacagtggaaaacaggtactttaaaggaagagttacacaaattctattcagttcaacaattattagctctcttagtgatcactttacaagagcttattaaaaggcaacaggaggtgctggagaatttccctaatatcttgatgtttatattctacaggtgccatccttaacaaaaacacactgttaacctggaagaaaaataggtggcacccagggtcacactgcttttcagttggtcctgcaagctcccaggccacagttcttcagaccattgcctccaaagtcatcagccaagcattatggggacatacaagtccccacttggctgccatggtgcaaactgtttctgccctaaagctccctgtcagaagacagccggggtccagtcccaagactgactgtatgtcctgctcatcatgcccctcctcctagactcagaccttctggtcataacttgcaggaggcaaactaaaccaaacaccaccagaagcgcctccacacagaggcatgctcctgcctcagggctcgacgagacttccttgcagtgacaatgctggcaaagggtccttaagcacccttgaggcttctgttctcccccatcctacccaactggaaaaaatatactcagaatcgtctccctgagattgcagagggcaaaaatttagtgaaattgataggcactggttaacaaatggaagaaactacactttccatttttaatctccaactttaaggacaagatttttctcagatgcctctaacagtttctgcaattgtctctagatagacactagtgaagagagaaagcaaattgctccctgcaattactaagctctgaactcctaaacagccaatttttatgctgtcattgtagttgtgtctatggacagctggttcaggctagggcaatcattcccagagcccttcactactgctaaatgcaatgtggaaaattacccagaaaacagctgtttgtgctttaggcggtacctacatggggagagaagcaatgggcgggtagaagtcacaagccataaaattgagaaaatactattttcaagttaaatgcaaagggaagtcccattacaagaggtaatcaataatcaagaagaaggacaataagaaaagaccctctggttaaagagagaagggaagcagcaagagtcccctccaaatgacaaataagtgagctgtaacagttccagagagacttaacttcaccactgttatggtcccaagagcattgatggtgctcactcagcaacagggagccaggcacagtcctcagcttctgtgtgattttctccttcaatgcacacaactccacaatgtagaggcagcttctatctcaattttggtaaagttccgtggctcaatgcacactgctactgacttttgaaagaacaagtaatggcagcatacctattctcctttccaaccataagccaagaatctaagagacttagaacccttggacatacccaatcctaactctgtcccaggtcttgacaataagctgcccacaacatagaaagaccagcacagtgtcctgaatcctacacaatgcttccccttctaaaggctctatcttcccaggcacagccaattctcactctctactttgaatccctcttacttgtgaacaattggccagtggggtataaagcaagggtctttaatcagtgaatacagagagggtccagaagcagccagagaatcaaatcgctagcctctcctaggttcctgagacctggcagtcatttgctgccaagcctggacaccaggctacatttagatggaaaatctggactcacaaagatttttacatacagaattctaagcaaggttattgaagtccctcacggtttatccagaacctccaggctctcctaactgtaccaggggaacaggacacaatgccatctggaatgatgttttagtaaacaactttaaaagccactaaggtgactgttgacttcattgatttatttctgtgatggagaactggggaaggaaaagctacccaatttttcctcagtactgaactattcatagcagaaagctcgaaatgtggtttgattagcttaatgcaaactgcaaaaagcaaggatacatcctcaccagcagagcagtgcagtagagtactgagctatggggtccaacagaacccagcttgagtcttggcttcaacaagattattgactacgtaaccttagaaatgaactgaacctcacttatccaatctatgaaatgaggttattaatgaagcaagcttcatagagtttaccaagtcaaaatgagttaatccatgtaatgtgcttagctaaaggactgatgaatgctcattataagtaatactcttgtttaataaatgattataaattatatgtattttaacccttacctcctttttttctttccaaggcctgctcatcatataactattttaagggaaaatggttaaaggaaatacttgattggcttgttgcttttctttaaaacacggcacattctggttccatggtctaaaatatgatccaaagagtcagtgactctttggattttacccagtggaaatgagtcctttaaaaagaggtctaacatgtaagccagaggcaaaggtgggagaaagtggtacttttttatcataaagaagcagcaattcaggggagaaagacaacaagtttcccagctagagatgtgttggttgaagctagaacaaagccattagagctgtatatcctgctcaacaagaggaggaaaaccacattttcccagatcttgctttaaaatgcatacgggaatgagcatgcaaagaataaaattcataaagcatctcccacctcaaaaaaacaccaaaaagagagtgaaaagccaagccacatagtgagagagaagatacttgcatcacttaaaaccaacaaatggcttgcatatagaacttataccaatcaataagaaaaagacagataatccaattaaaaataagacacagaaagtatgaataggcactttacaaaataggatacccataggccaaaatataccagaatgcctaaaaactaaaagataatggccataccgagcataagaaaagatgtggagcaactggaactcctgcacactgctggcaggagggcagcattaaagtgctacagctgcttcagaaaactgtttggcaataggaactgaagataagcacatgaacctcacagcccagcaactccaaccctaggattttacccaatggaaatgagtacaggaatacaaaaagatctcaacagaaatgttcataagcagaaatactcaaaattaccctcatttgaaaaaactcaaatatccaccaggaatattaatcaaatggacattgtgttatgttcacacaactgaattttacacataaaaaaaaattgctatgcattaccagagatgatattacctacataacagtgactgacaaaaggccagacatagaagaatataaactgtgtgagtccatctatccatctatataaagttcaaaaaagggcaaaactaacatatgatgaaaagttagaacagcagtatcctttggaaacaagggaggtgaaaggagtcaggaggagaatacaattaggggagcatgagcgaggcttttggagtaacagtaatattctgtttcttgatctcagggatggttacatgggtgtgctcactttgtggtaagtccattctattcatgtactttgcacacatgcgtatcacattttaataaaggtttgagaaataagtgaaacagaaacaggctattctgatgtcttgatatgattgacatgggccactgcttagttgtaaataaagaaatactctgagccagaaaaaggtatttccagggaaaccttcatatggcagaacggacaggtttcctaataccaggtgaactgctgaaggcgtacatcccacagttagggagaagcggggcccttgtctagtctcaaccctgacaggtctggaaagccagaaaggcacaagggaagcctagtactggcacaagtagtaattaacatattgatcgcttactaagtgctggtatctttccaagtgcataaaacatctcaattgatgtaatcctcattactctctcttttatttttcaagtgaagtaactaagcacagaggaatttgggggttggcctgaggacacacagctggtaaaagccagagcctagattcacctggtagtcttgatccagaacccacatgcttaacagcacaattgaccacctccctgaactacctggtgatctatagaataggaaatccatccatctgcctcagcagaagcatgcatgccagcccagaaaagagcagacagacactggaggagcagagccaccagggatgggcaccaaccacatgacaggcaacaggctaagcaagctctctgtcccaaatttgatttaattctcacaacagtcctctaatctagctatgattactggccctatttgaaagatgaaaaacgtgaggctcaaaagagttaactttacacagccagggaggggcacaggcaggttgcaagtgtgtaattccttcacctgaaaggtcagtaagatctcccaggtcctacaaaccagaatcagaacaggccctgacatcatggtgtttccatggcaactccaggaggccaccacaactgaggtcaggtatgggcaaaggagttcacacctataagactgctttatatgtccaggctagaaccaaatgcagcaaataacggagctcccttgagcaaggagaggggtaagctgagctatgagaactccatgcaaatgaaagctgatgggaggcttggacatgccctgcctggagtggtggagaggacctctgttttatctgtcccacaggcttcccccttcttccaagcaaaccatttacgtaaggtccaggcatggctgaccacacccccagccaggctggccactgtgagctcacactccttgccacagcaatgcatcaaggaatggatgcatgaccttcacagcttggtaaaaacccttcctgtttgcatgtggatgccagagagaaagggttctctctccacatggccctattaggaagaggctggcttggaactgccagagaagatcttcccagtcatgtgataaaagcatctctgagaataaatccaatgtgccaaaggagctgcagccaagagagaggagaaagcgagtgcaagcctggatgcagccatgcctgaagtccaacaaagaactttcaaattacagggaacaataactcggctttgtatgtaagccagcctgaactaaatttcattcatgtgtaaccatgagaatcctaacacagtagaggtctctggatgagggatgaggaaggaatattttccaaagcaagaaactgcagactaaagggggtgaagctgaacagtcttaattacccctgaggagagtttcgaatgggaactaccctaagctaaacccctaaaagtgttgctcagcatccagaaaaggaaggagcttggtttcataggaaaaccctatgctgtccattcactggtgtagttaaaaaaaaaaaaaaaaaaaaaaaaaaaaaaaaaaaaaaaaaaaaagttggaggagccagaccaaaatgctggggcagctaccatgggtgtggatgtgatctgaaaagatggagtcacccatcaccttccagagaaaacaattgttagaacgaagcccttcccaggacagaactagtgcatagccagctagtcttctgcacatgaatctctacagcgtaatgcactgacgcatctttaagattttcctttgattttcattccatacaggattcagccactgagaaagaacaaaatggtattttactacctgtagatacacatcctaacttttaaattcgtatattcagataggaagggagttggcaataagaggtaattaaacccataaatccactgatttatcactggacaaacacgaaactggcaccatgacagtaaactctttgcaggccacatttccctcagagtcgctgctgcaaacacggcggaaaatcctgatttggagtaagaaataatttcattttaatcttgtttatcttcttgtaatcttgtttattactagggtcactagtaatcccctgtgaccagtacccatctggcacattcttttaagaaaactgtggccactgctgtttcattcaattctgcagttggtttgttgaattttttttttttttttttttttttttttttttgatgcacattgtaggccattgggtattgggcttatttctttaaataaatctaataaacgaacacacagcaccatttatttcaggaatattttgaaagcacaaataagactttggcagcttttattagagcacatgaaatgctgtctccaggggagttcacagagcccaacaaattagtttaatctcaagtggaccatgatgaaggaaagtgatccaccaaagcaatatgcaattagtactaatattctgcaattctgtagcttgcatcatctgagcattttaggatggactacatgctttaataaattctgacaatgccctctagagcttcaaatctcaaactttagcctgcatcagaatcacagaggaagtgaaaaaaaagaggcagatccctgggacttacccacagaaattctgattcaggaaacctgtcatggggctctgaaatcccaccttgcccctccccagtgtgagtgtgctcctggtatgaatcatgaatactaccataaagaaaggtaataccactttccctatacacagacaagagctcggaataagcagaagcttgacacttgctgtagggcagcgccatccaataaaactttcaacgatgcaccgggcgtggtggctcacgcctgtaatcccagcactttgggaggccgaggcgggtggatcatgaggtcaggagatcgagaccatcctcgctaacacggtgaaaccccgtctctactaaaaatacaaaaaaattagccgggcgtggtggcatgcgcctgtagtcccagctactcgggaggctgaggcaggagaatggcatgaacccgggaggcggagcttgcagtgagccgagatagcactgcactccagcctgggtgacagagcgacactccatctcaaaaagtggtgctggaaatggtccctattctgcactgcccaaaacagtagccactgggctaatgacctcttgaaatatcactagtatgactgaggaattgagcatttaatcttatttaatttcaatgaatttaaatttaaatggccacatatgtcttttggcttctttatcgaaccatatggtactagatgaaacagcagcatctaagaaaaaataattgagagttagctgtactagatcatatttatttccatcatgagaaaaactacagcaatttcctatattaatagatacaggcaaaatggcttggattgagtacatactgtgcattataagtctctcaaaaaccctgtattagttacgttttataggtgaagagactgagatccaagaagctaagtgatctgcccaaggatgcagggctggccaggacacagtcaagagttgaacacaagtcctacaattccaacacccatgctgtctccatcacaacacactgcctccatgtagatgagctcaactgaaaacacaaaggccaaggccgtggaagttgtcacctcccttatctcaaactgacattttccattattttccacatatcagctggcattcctacccagggttctatacataaataaagacagcatcccacagagaagggaagatgttccaggaccaggatttgaccctattgcttctcctactttccatctctcccctctggttcactctgctccagtcactctgatctgctgctgcagcaacgtttcaggcacattcttgcctcagggcctttgcacttgctgttttcttatctgaaatatttttccttcagatatccacatagcttactacctctttcttgagatctctgcccagctgccctttacaaatgaatccttccttcactagctattaaaagaagaccaaactcctctttccacccccatgatctcctacttctggcactgcccttctccctttatttttctctgtaggattcatcactcatttattgcctgtcttcctctactccctctaggacatcagctgcatgagggcaggtatttcattctggtcactgatgcatcccagcacttgacccacgggagatactgcacaaataccctgaataaatacctagatatacaaccaaagttcacctgcatggctgcaatacagctgttttttgttctttatgcttttctgtacttccccaacattctacaataaactatgtcccctgcagtcacaaatcgacatgcctttcacataatgctactcagtggtcactgtgttgctctaaatgtcactgcctccatgaaagctcactttatatctaccctacttgccactgttcctccttagagctctaccaccagcagcacagagctaatattccctggaaacagagatgagcatgtctatgtttcatcaaaactgttggatcgaagagctcaccacagggccagccaatgaacaattctccacttatttcatttaagaaaaatacaactttatcacttctgacaattttacaattgcaatgaaggctgagaattaaaggacccagtatttgctaaagtagccacgtgactttttcccccagtacaggccaactacagacactgtttataatgctggcatcagggagttaagggtacactcacttcactgaccaagcaagtttagttaatacatttttactgaaaaaaaaaaaatacatattattgggtgtggtttctgatttatgtgaatcaaatatgagtggagttatatattaaaataataaatacacatggcatactacttcattttacagtgtttttcctcatttatcaccttcctgaatcttctgaacaactcagtagggggtggtttactcttattcctgttaagaagttgctatgggctgaatgtttgtgtctcccccagattttttgttgatacctaacccccaatgtgaggtgtcaggaggtagagtcttcaggaggtgattaggttgtgagggcacagccctcatgaatgggattagtgccctcataaaagagaccctgaagagaccccgcattccttctgccacatgaggacacagtgagaaaacagcatctatgaggaatgggccctcttcagatgatgaatctgccagtgcctggatcttggacttcccagcttccagacagtgagaaataagtatctgttgtttacaagccacccaacatatggtattgttgttaccgtggcctgaacagactaagtcagaagctgaggaaacaaaagcacagaaaggcaatatgcatgcctttctcaaatatcaccaagtcacgcaaggggagcccgcattcaaactcaggactcaggttgcattaaaggacgtcatttctagtcacgagtgatgagcaaagcagcaaggctgggcgtccaagtaatggagaggctgggatgggtgactgcaaagcatggcatggccgactgaacgcgaactaaaggagcatccaggctgtgaaattgtgctcccggctctgtctgtgaacattactgttggacaagtgctgcccagtgaatcaggggatgaaaaggctttcccactgacctggcactaatgcaggcctcataagtaaatagcactcatctgtgacaagcaccgataaatcacagtttagggctttcctctggaaggactggtggagatgtccggactagcataattcatcatcccagagagacaggttaaaaggtacattcaatgctatgcagaatcttgacacaggctcacacaggtgggagactggggacttgggatttgaagaagcccatgtatggaatagcagagacctaacagcaggcttcctgagaccaggctacccaagccctcctgcaaaacggggagataggcacagctaatcccaatgaactgcaatgtactttgcttaaagaattttagctggagtgcacctcaagaaggacagacaagagtatctatgtgtgtatatatgtacaaacacacaatacatacatacacatgcaatagatacatatgtgtatatgtatataaacataatatgtatgtatattttctttttgccttttcttgaagttaagcttcaattaaagagggatgtatatacacacacatacatgtatgtatgcatatctttatgtgtgtgaatacacacatacatgtatatttttatacaaataagtgtgtatgtgtctacttatctccctttaattaagactgtcctcagaatgcgtctcctttggaattactgagtaaactatgattcattcactccacagcatatcatgatacattagaaaagatgcttccaaagaatctgaaataatgagaatattttatgaaattataactgaaaaaattgggatttttgttaagcatgcacaacaaaaacacagtggaagcaaatataaaaaaaacttaagggtagctacctcttagtgataagagacatttcttcctttatgcctttctatagcaggcatgaattgttttaacaacgataagtatcagactatgttttaaggagactatgaggtgtgtctctcttttgtgaggggaggggtcccttctggcctagtagagggcctggcctgcagtgagcattcaaatcctcgaggaacagggtggggaggtgggacaaaggcaggaagaaagtaacggagagcctggggagacatggtagggcacaaacatgagcagaccaaggattgtcagaagttatctcactaagatctaggaggtcagtgaatgtcttcaatcgaggtgcacagggcagacttctggcacacttaattttaacagaaggaggaaaatgataggagaaagtacaaatcgggtaggaatggacatattttcatcagaaaagagcgtggtacaatttcaaaatctcatcaagacaggaaatgtgaccatacaaacatgattcaaaggcggtattttactgtggcccagagaagtctgtctctggaatcagacagacgtggccccaacctcagctcacccacccactagctgtgaaactgtgggcaagtcactcaaactttctgagcctcattcttctcacctctaaaacaggaatagttgtatgaagattacgtttaaggtacttttaacagtgctatgtgtgcagtgaggacccagtgaatgccaggtgccttttcctctcactgtgatgggctgaccataccccaccctgagggcaggttctcttgctttggataccagaatggggtctcctgagagcatgtttaatttccatttatttaggattttgttgatattgtattgatactaatttctaattcaattccagtgtggtcagagaacaaacttcataacatttcaatggtttgaaatgtgggtcttatttatgacactgaatggtttctcttggcaaatgttccacaagcacttattaaaaataagtacattcttcttttgggtgaactgttccacaaaaatcaattaggtcaagatggttgattgcatttttaagatcttctgtattcttactaatttttaatctgattgtccatcaattgctgagagaggagtgttgaaatctccagctacaagagagaatctgtttatttcttcctatacttgtctggttttgttcaaataatttgaagttctgttactaggtacatacatattgatgactgttaggttttctgggtgaactgactcttttattcttatgaagtacctctctttatctgtgttaatatgccttcttttaaggtctattatctgatattactattgtcactcaagttttcttatttttatagtttgcatggtatatatttctccaccttttaattttcaacctacccatttctctatatttcaagtaagcctcttgtagacaacatttaggtgtcctccctttcaatccagtctgacaatttctgatttttacatgaatgtttatttacatctaatataatcattgagatggttgtattcaggtctgacatattcctatttgttttctatttgttccatctgttctaattctcatctcctttcttcatttaatcgaatatttttagcataccattttaattcttatactgtctattttggctacatcttttactatttttagtaactgatatgatgatcacaatatgtatccttaattaaaacagtctaggcagagttcctgttgtactacttaatgtaggaaacacaatcattctatttatcccctccccacatcctgttcctacaggctattgctgatgttcatatatatgaatacacttgcacatattacataatatatgttgggtttatacgctataccccttacaaatccaataaagttttttaagtttttgatccaaattactgtcttttaaataaactgagaagaaaaatatatacatatatagtcctgtatacatttatatttatatataaatttatgtttacatataaaatacatatatttcattcattcctgtagattcatgttgccatctggtacaactgtcttttagcctgaagaacttcctttagcatatcatacagtatagttttgctggtgaaaaattttctgcttttatctgaaaatattttaccttcatttttgatgaatatttttgcataatgcagatttaagagttgacaggttttaatgttctaaataaatttaaatttaaaatattttgttccattgttatctggtctccattatttctaataaagagtcaggtttttaaaatatcattattctcactataaataatgtatctttctgccctctctggctgctttaaaactttctctttcttttggttcttagcattttggctataatatacctaagtgcagatttctttgtatatatccttctttgagtttgctgagcttgctgtatctataaattaatgttctcgccagttttaggaaatgttaggccattatttcttcaaatatttttcctgtccgactttcctcttctttctctgggattcctattacacatatattagaccactttatattgtcctggaggaccctgatactctgttgacttttttcctacttttttctctttttcagattgggtaagtttttattgatgtaagtctagattcagtgactttttcttctgccatttccaaactactctggactccatctgataaaattttcatttcagatagaattttcatttttaaaatagtttccatttttctgctcagaatccccaatttgcgtattatgtctccatttcctttaggtctctgaacatatttataacatggttttgaagtacttgtctcctaattctcacatctggatcatttcagggtcagtttcatctaattgtctaataaccatgacctagacactcctgtttcttcacatgcctagcgatttgtattgtatagaacatactgttggccacaaagagtctctaggttcttttatctttcttttaaaataatttttatttttatgttccaataggcagttaatgtggctagactccaagtccaaactgtctcccctgcaatgagtcacagctgaaactgctcagttcttccagacttttcctgttgctttttgctggaaaccttggagtctcacccattcatgtgagttcagagggccgccaataacttgggtagagtttacaatgattttagtgctccccttctgtggttccgtcctttctgaaatgtcttccctccctttccagttgttctagcagttcttaactgcctcctccaattctgaaacccagttgtaacacagctctcagctgtgacctccagcagctccgtgccacagtgaatggaggtcaccctcacacagaaagccccatgaacacagattgtaccaagtgcagctctcttctcacaagggtccattccctcccaggttctggtggccactgggtttttttcctcaaagagaagaggcttctttaggagtctagtctaagaccatgtggtcttaataaaggaagaggctcatccttagccaaacagggaagaaacagagacatccctgggaatcttctagtctcttaactgaccccttagtctctttgtctatgcctccattggaattaagaattcttttacagccttggagctcccagtaggaatgcccaggacctatagagggacctcctccaccttcccaggaaagggggaatgcctctgctatactcacacctgcaggatcttctcctccagcctggacaaagagcagatcccagtagatgcctgtggctgtcctggacctatttgtcactgatattactcaaagcagcttaccaactgagaggcatcatgacaataatatttgtgaaactggggaagccacagggaaactatttttgggcaggatgcaggtagtaccatattctgccaacaccagttgtgaactccttcagaagcatgaacagctccatataaaccttccttccaactccaccaacagttccccttggcctactctagaacagtcagtcaatactaaagcagtatctttgcatctcctgtttctagggtatgaactccggttgtgatcttcaggaactaccagcaaacatactcattaagcatttcgtctcctttttttttttttttttttgagtatgttctcattttgggcaaggactactcagggcgcagaaggaagaacaatgacacagtttactcaactaatattggcaaggtgattccatgccttacaaaatttcctgtacacaagcagagacaatttacagaataatgaaaagcaagctgatttcaggttttctattttaacaactccagatacacaaattttctctaaacagtactgcttcagagtcatcaatgaataatttaaatactgggaggatggcaagagctgtgagtatgatgactgacatccacgagcccactccaggtggcccataatgctgagggtcatggcgcttctaaaacaatgtgctttcaaccattataaaatgaaattggttcttgaagaggcatcttataaacagcctgaacttactgccaaataatattgcagaacctataaacagttgtccagaaattcaggctggtccactccacagaaacgagacgttttagaatcagaatgtaaagggaaagagaaaatcaaattagatattaaatagttttgaatgataaattgtaggagaacatgcatattgtaggagattcctttgctttacatgaggaattaacattgaagctcctttaaatcagtttataggctgggcgcggtggctcacgcctgtaatcccagcactttgggaggccaaggcgggcagatcacaaggtcaggagattgagaccatcctggccaacacagtgaaaccccgtctctactaaaaatacaaaaaaaaaaaaaattagccaggtgtggtggcacgcacctgtagtcccagctactcgggaggctgaggcaggagaatggcatgaacctgggaggcagagcttgcagtgaggggagattgtgccattgcactccagcctgggcaacagagtgagactccatctcaaaaaataaataaataaataaataaataaataaataaataaataaataaatcagttttagatgccattaaaagcctaacccaactatatttcttctcccatggaaataaacatatatacacatacatatacgttataaataatttcaggagtaaggtacaccttctaaaacgtccttgaactctgcatccacgaggacttccggactcaacgttaagaaactcaaaatagtacatcttttgcttcccactgctgtctcagtctttggggagttataaggctggggttgttccattcatttccacaatagtattttcagatgtggaacaggtacagggctggcacaaagtagggactcaatacatactagcagtatattttattatttaatcttcatgagaatccttctgaggaaggtaatatcatttccatcttacaaaaccagctcagagaggtttagtacttggctgagacacacagctagtgaggagtgcaaactgaattggaagaatcacgggactctgattttaaagtgtgcacttttttaaggctttttgtgcctctggggttattgtacaaagaggcaagcatttttgagtgggggttcctttgtgactagattaatgatgtatatgtagaaaaaagagacattaagtaacaatgatttacagaatgcctatgacatgtgatatgtcagaccctcttgggaaagcgagacctataagatgtggggaggggttcccactgttcaagcacctgctacttgggaggcaagatactagatgcctcacatacattttcttattgaatgcttatgattattctatgtgataagtctctgtagccttaactcagagctcagtgaagataagtaatcttcacacatagacacacagattttaagtggcagaaccaggatttggactcatttttgcgtttgctattaacaagtaattacagcgattgagaatcaggtcatagcatggtcaaccgatgacagaggatcaatgtattcagcagacacataggctgtgtttagtacttgtcccaagaggaaaggagcaggcactgggtggagaacaacaatgcctggttgagaaggcaggcaaggcttcaggaggaggggaggtttggtttggttcctagggaacctaggagtgggctcctgaagcaggtggtgaggacaaaggcctggagaccaggctggggcagccaggaggggcccacagagaaggcgtgtgacgcctgggaccctgagcaggaattccagcaactctttgcccttctcctttctttgtacacactcccttttcctgtgggctccctgctgtccttctccttgtgccaggaaccggtttggaaagccatcccccttaggagtctctcagtgttgcagagaagaaagaaagatggtgatgacgtaggcatccttcacttcacactgaaaatctatctacttttagatgactttttccccaaaatgcaatgggtttttttttttttttttggttctgttataaaagcaattcctactcattacagaagaatcaaattctttagaaaagcacaaagaagggggaaaaaatccaccacctcatcacctggagaaaaccacagtcaaaattttacatccataagaaacgaggttttgatgttcaaaggcttgaacccacatgtaatactcaaggtagggaaaggagcaatgttctgtttatctctgcattcccacagcacctgaccgaggccctggaacacacaggcttgccaataaacctgtgtaaacagcagctcacaagccctgccccagctgcttttcctctcaggcttccagaaggccctcaaatgaagggcatatgctttgccaagtttatcagtttgaagtgtgccagctgaaatgtaagctgagttgtgcggggcggggggacaggaactgcagagtgtgtggggcagtcaggaataggatttttatgggaagaggaaattaagaatgtgccacagaaggtgccctggtgaggtctgcaacatgggaaaccagcaggtttggtaagggaggcagcttccccccactgggtgagcaaagcagattgtcttttcaattgaggagcaagaccccctgctgctctggaccagtggcccatgtaccatgtgaataccaccagaagggcctctctacagagaggagagtggatgcactgcccaggctctaccgtgagtggctgtgtgacatcaacaagtcacttaatctgtgtctcagcttcctcttctgccagtgggggctgtgactgcacctactttgtatgttcggcaggggagagtgcatcagcttcctagggtggctttaacaaagtaccataaactgggggcttaaaccgcacaaacttagtctctcagtttcggaggctggaaatccaaaaccaaagcgttggcagagccacattccctctgaaagctgtaggggagaaccctcccctgccccttcctagcttcaactattaatttacccatagcttcaattacactcatcattccaattttattaaccaccctcgaatttgctgtagcccttattcaggcttatgtctttacactgttagtaaactctctccttacataacacataatgacccaccaaactcatgcttatcccatgataagcatctagtggttgtcggccaccctgggtgtttgcctgaaggcagtacttcaccctctgccttgaacagcactctcaccccgtgtgtctgtgccccgtgtctcttctccctgcataaggatgtctgccatataggattcagccccatcctgcttatcttatcctaacttgattacatctgtaaagacctcatttccaaaggtggtcacattcatagatgccagaggttaagacttattcaatgcatggcctagagactccctgagatagggctggagaaactcacctggccaccggaagtgctccatgggatgtcagccactctgctgtaatcaacaacaccgacaggtttcgggatggccattcttaacatttaatctacaccatctccttgtcctcacagcttaacggccatttaattatgatctccgctgtaaaaacacgccttctcatttaggctgcacccagtcctactgccttcacacccagctcaactccagttcctccgtgcaaacttcttcactcaaggcagccagagttcccctgaactagaggcagccatgctgtgaggttaagagagcctcaggtctccttcttgtgcatgctctttccaagatctcggagcaggccctagcaatgcattcacatggatatatgtttgcatacgatgtgcaaaagtaagatcttttaacaacaattagttaagacctctctctttctatctcaccttgttccaggtagcactggaatccagctaagaggtggggatgtattcaaggaggattcagtagggtggactgtgtagttggtggtcacttctgtgtatagttagaattactgctagtcaccatggcgtggaaatggctttcaggaactcacagtaacacttaagaatggggcgagaagtcatgtgacaagaggaacacgtcatacagtgcacagcactggaagtccaggaaggtggaggagaaacaagttctgaaacctataaagccagaatctaacctgtggcacaacctgccagttatcagacacataaaaccaccatgggggtttggtgctcgttgctgcctgtttaaaatggaagttctcatccaataggagtgtccccgataacgcagcatgtacaatcacaaatgctcatgctttgttcctctatctctgggtgggagtcacatgacacagaattaattagattccctgtgcttgaggggagcagtatgacaagcggtgagcaggggacatctgtgtaggaagttgtgtgctttcttcgtccaattatcaaaaataaaaagcaaatttcctcagccatgctagaggaaagactgaattatcttttcaatctctcagtagagaaagattacaaaattgatgtcatataaagagacaaccaaaaagtatacagcaaaaaacataacatatggggaaattttattataaagctgtgttgggcagttaattcacaatgtaaatctgttttcttttttttttcagacccgaccatgtttgtaatgtgcatagctttttaaagtttataattttgtgattatttattttctcagcctaaacaacacataattttactcctaagcgtgtatatataattctgtggggattttttataaagaaggccactatgtcatacaagctttaggccccacaaaatctgggtgcacccatgtttgaacaactgcaatctctgagtttactgctctctctggaaaatccagtggtctcagaatgcactaagcacacacagaaccctccggtaggcccatcctgatgtcagactccacccttacccaactctagtccttgctagttgctagttgtttatctaacctatttgagcctcaatgctcttgcctgtaaaatgaggattgtttatatggtagtgtacatatccaacgcccagtaaatatttgttaagtttccacacactaggagataaagatacaattatgtacaaaagcaagacatgatccttattctcacaggacaaagctggaggcaggcctttgctgatggaagagcccagccacttaactgccgtctccaaaatcatttctaactaccaaacatacatacccataagccacaatggcacagttttgatttacctacttttctccaagaactgtttatgctctcagccagggagaaaaaacacggccccaccatacagctaaagctctcagccaacatgttctgccacaccatcatgagccaattcaattctgctgcactatgctgaagcttctcttctcaccattttttttgtgttctggtccatggtttttacccattgtgggtaacactcataatggtttgcaaaagttgtctagcaaaggaagaatctggcacatgatgctaaaatgccaatttcccagataaaaacctacagaacacagagcaaaggccagcaggcttttagtcattggtgaccacttcggtgacttagagagcacatcataaaaactgctgcagcctggatggactgccctgcagttgtcagaaattgagagtataataggcaaagatggatgcctgacatggccttgaggactttgcctggaagggtgactgccaacatctgaagactagaacgctgtgctgcaggggctcaagtgtcatgaccttgcatagtgctgactcagtgagcactttcatttccaggaacacatcctgcactaaaccaggtatgcatttccataatgacaaaacaaggtaaatgtccaaaagaaatgaatgtgatgccatgagccatgaagattaaaatgatgatatacacaaagggctgagcacagtgcctggcagttagtaaatgctcaacaaacagcaggtgctgttagccttcctattatctcccctattgaactttactacagagcaggagcaatgtcctatagttctttgtattcccaactggacttcagccagtgcagggcatgcaaaagtactaaaaagatatcatctcattaattctaccaagatttttcagacacacaaagcctttggactaagttgactgattctcatccttaccagtcatctgcctatttgatctcagaacaattcctggctctgcctctcctctgctctgctctgtatcagagagaaaagcatttctcattctcctttgacctctggctgcagcaaggcagctttgtccagtgggaggcccagatggaatgttggaaggtagaaaaccagaagccagggcatttctccccagcttcccctgctttgaggggcacctcagcagtgagagagcagtgccatgcatctcttccagggccccggttccaaaggacagcatatctgcggttccagctcctaccagaaggccctggctcctggcctctggtatcatcactgcctcctcccgtgtgacccctagcccaggggtggtagcaatttcttgctcctctcagctctttcatctcctgtgtaaccaattccctgtataaaatattttccatttaaaacacctattatgggtctgttttcctgattggaccctgacagatacaccatctaaagaagaatttttatacaaccatcctatggagtactcagcagccattagaaacaatgatacatatctaaacatactgatgtataaagatgactgagggttatggtgaagagaaccagaagacagtgaaacagtgttatacccagagagcagacgttgagaagtatgcacatttacacacttaaaaaaaatgactggagaaatatacataacattttgactgtggttatctccaggtggtgagatgctggattttttcccccttctttgtgcttttctaaagaatttgattattctgtaatgagtaggaattgctttaatatcagaacaaaaaaaaatttcccattgcattttggggaaaaagtcatctaaaagtagatagatcttcagtgtgaagtgaaggatgcatacatcattgccatctttctttctcctctgtaacactgagagactcccaaggggaacagctttccaaactggttcctggcacaaggagaggggcagcagagagcccataagaaaactgtatggataaggagaagggcaaagagttcctggaattcctgctcagggtcccaggtgccaggcacctcctctgtgggctcctcttggccgccccagcctggtctccaggcctttgtcctcaccacctgtttcaggagcccactccagctccctaggaaccaaaccaaacctcccctcctcctgaagccttgcccactttctcagccaggcattgttattctccacccagtgcctgctcctttcctcttgggacatgcactaaacacatcctatgtgtctgatgagtacattgatcctctgtcatgggttgagtgcgctataacctgattctcactcactgtaattatctgttaataacaaactcaaaaatgagcccaaatcctggtcctgccacttaaaatctgtgtttctatgtgtgcagattacttatcttcgctgagctctaagttaaggctacagagacttatcacatagaatgatcctgaggattaaataagaaaatgcatgtgaagcatctagtatcatgcctcccaagtaggaggtgctcaaacagtgagtaccccccattcaatttatagtttctacttttccaagagggtctgacatatcacatgtcataggcattctataaatagttgttacttaatgtctctttttccacatatacatcattaatctagttaccgaggaaccttcactcaaaattgcttgcctctttgtacaataaccccagaggcacaaaagcctaaagagagcatagactttcaagccaggatcctgtgattcttccaattcaggtggcaccactcactagctgtgtgtctcagccaagttactgaacctctctgagccagttctgtagaatggaaaagacattaccttcttcaaaaggagtcttaaaaggattaaatgagaaaacgtaggcgcaaagtgcttaacacagctcccagcatgggcagtctctataaatagaagttcctgtctctcccatttaaatgaatggcaccaagcttttctgagctcaggaaaaaagtaagcagacctcgctgtaattataaacaccacagcataatggcatccaggtggaaccatgctagtgtcatcctcatttaagaattttatatcgtctactgagttattagctataagaagccattccccagaggagactacagttgaaataattgttttgaagaaagtagggtggatcaacatgccagaatcattaatcatcaaaacagcaacatatacttgatgagctggcctctgtggaacttgctttctgtgacgaaaggagaatttgcacaaaaatctccagccctgtcatccaacaactctttggcatttttcctatatctgccctgttccactcaaacaaagtgggaatctgcatctgaaaatgacagttccaatggaggatggacctcatcattaattgctgcaaagctgcaagggtttaatgggtttattaatgaattaataatttggagaacacttactggctattttctactgaataacatccatgtaaaactgcaaaagccacccaggaaatgagaaactatgatgctgaacagaagaaaaagctacctcccccagatgcaggtaacacacagctttaaaatcaatttgaccctcatgacaaaggaacagaaggactgctcaattccctaacacaggcaccctctgtgagggaacaggccttggggaacccttctctcattcaagagcaaacctccggaaggccagtctgaaaatctatgtgttttcctcttaaaaagcacatttccaaatgggtactaggatctcaggccacaaggtagagcctctgagtgttggtttaacaaacagagataatccaaaagggataaattcaaagtcatctcttttccccattggcttcagaatgtcatggtttaattttaaccagaacaaaagcactgatcccagaaaaaaaaagatgaatcttctggatacctactatgtgctaagcacctccctacattctcttgttgaggggtgggaaggagggtgactgcaaatttctgtctgttcctgagccaccatgctaatgtttggttttcaatctggaccgcatattaaaaccacctggggagtattaaaacataccactgtcttggataccttacaaatgttcttcttccataaataattacaacaagcatatataacagataaggatattcccactctgttaaacctcagtttcttcatctgcaagcataagtaatgtgtccaacataattttaaataatttcaaactatctactccgctcttttccttcagtctaatctttacacacacataagcacatgtgtacacttttattgacttttctccttttgataaatatcatgtatactctgaaaaatatataaatatgtaaaaattttaaaataatcacctgaaagcagaactcccaggaagaatcactgttaacattttgatgtctgcctagtcagtctttttgtatactgttttttaattatgaaagaataggataagtctgtacccagtcttttgtaacctgctttttacacttaataaagcatgaactttgcttcatatcattaaatattctacagcatcattttagtggctgcctagcatcgcagtgtatgcctgtgccctaatttacttagctcgcctgaattaattaggctttactgtctgacaaaagttagtcttccatttctatccccaaactagaaaaatcaggtacccaggtatttgaaaatgtggagacactttcattgcttggcacgtagctccattaatatgccaattctttcgggtacttctttttcaaagagatcctagtcacatctcatttcaataaatgcctggaaaccccctaggggatggctcaatattcaaactcaactcccttaaatccctagcagcagagctggcctgaaagagcttaccatgcctggtcccaggcagcctgctgtcaggagaggtggagagggaaggaatgtcacaggttccagactccagggtctggcctagtcttgggacctcagagggtcatggatctgcttgatctcatccccacagcactcaaatgagagagacctcctccaggagggttggagaataaagcaaaaaattgctgaggccttcaggaaaaccatgccataaacagtcaaaaccctttgtcaccacactggtgaggaaggaccagaattttggttgttttttttaaattttttgttgttgttgttttctcttaatttaaattcagatgctgggttacgaattatattattccaagaagtgccaatgcaggagcccacagctgtcaggaatctggggtggtttaggttggaatgtgtgctctttcaggagcagcaggcccatccttcaagcacacagcgagtagggtacagtggatagggtacagtggacaggaaagcacccacaggggctgtgtatagaggttctgaaaagagatgctctctctgccccaaaatcctacttctatctctctcccatcatccccatccagtaaattgtccacttgcaggagattcctttgtgttaggaggacttctctgaagactaaatgctactggaggaggaatgcccacttctgtgtagatctgaaggatgacagctaccatcaggccacagtcaaccagggacaggcccattttcctactggcaggtaaacatgaatcccaaccaggagtatcctgggttgctgtcttccccgtgcagctcctacagtaaaagaaaggctagacccaggagaacacaatgccacctacttggggtaacagagggtggggttaagttacctggaccaaaatgtgtccctaccatccattcccaaaagtgcctgaaattcccacagttagagtctctcctaaaagcccagtggagatgtgtgtgttttaataaacataaagcattatacttttggagcaacacataagccagtccctgctatactcattaattctattagccttattgataggacactacaatcatttagttggaagtagggatgaggtatgggcacacagaagagccagacattgacaggacaaaaagattaaagagaagaaaagtaaagcccagcattttgcttcagaaagtgtcttacctgctgcaaggggtggtctcaggaaatcatcagggcacaggccgggcacctgtgacacccacccaaaacaaggacaccagcagcctcagaagggatccataggagagtcacaggctccagcctgcctcctacctcctcttaaaatgaacctgaccccattcttctaagctcccagaacatattgctactttgcacaaatatagatgctctggggaaaacaatcatccaagtctatccaagctacaacccactgcttggccaggaggccaccctaccctacccagctgctgcctatagttcttccagagctccttggaccaagggcatttacaaaagggttgcattcatgcatgacaggaaaaggaaccattttcctacctagctctttctgatcatatactgcaaggctccacatcctgggggaaatgaagaacccctttataaatgcttcccacagaagagagcagcagcagaactgacatacgctcacaacagggagataaggagactctggctagagcctgctttttgtgttcccagatggtcctgcaccacacccacctgcagacatccaagctctcctcccatcgtcctctcagagctccttgtctctagatcatctcaattcagtttggcctcaagctctgagctctaccccttaggctttcctgcccaggggctttatcccagttaaccctccatttctccccagcccctccccagcctgacagtctctgaggacaagcagtgcccatctcatttccttttcttggctcattttaattaacaaggcaaccaggcacatcactgctcatcagtgaataaggaccagaaaacatcattctctcacatgatactgggacaattcttactttctaataccagttcaaaggcctccaaactccagcctcacaaacgctaccatctctgcactctagtatctccaccagcttctgtgggcttgatttagaagtgacacatgattccacagaaggaagacaggacttggcacataacaaacctgtactgcaaccccagttcttccaatgacaagctttctgagtctcattttcctcacctgtacaacagagataataaaacctgctttggggattttcaaaaaattaattagaaatgccatctataaagcacccagcagagtgccaggaacacacactctgttctctatgaaaagtagccagtatcagtatttgtcacctgtctattgtttatccacagctacagtccttagctatcggtttactgcctggctctatttaaaaggacatatgggatcctgccatatttaaaggttttagagtgcatggaccacgttttccatgttctctttactcctccactgcctctcatcctgagctcagcaccagcaccaagcaggtgctccataaattaggctctcaggacaaccccagccagttccatgtctttaattggctttactgagatagtagtgtttaaaactgtctgtccacctacatgcaccagctcagtctcaatacccagcagaaatgagttgtcttcaggaacatttgaaagagtggctgtatgcaccaaagtcagcttcagtatgcaccaaatcctgtagcttctctaaaataggaaccctcacctgtctgcttacccctgccaatcccgacaggtccctactcttctctgatagggaaaaaaaatggcaaaagctagaactagaactatgtcaaggaatagtttcactgtcttagctaaaaatccatctccttccactaggaagccttccaaggttcaccatggacagaattcaacactaatcctcagtgactctctgtatttcatattccatggggctgtactccatggaactgtaattctctctccatctcatctgtcattctcatgaggctatgagttccaaggatctgtcttcaactctgaaccacgtatggcgatggatagagaatacaggttcagcaaacttttgatgaataacttagcagccttgtgaagcagatatggcatcccacaacccccccaccatctccactttgatacatgagaagcagtagctaggagcaactgagcactttaccttcaatgcctctgttttacacaggagagaaaggagacctccatgccaggacatgccaccagagcacatcgagtggcctcctgctgcactgatggctcaaggctctcacaaacacccctttgaggtcatttcatgatcattatttgccatcttctcctctggacagttagcttcctgagactaggcacagtgtctgtctcctcccactgtgtccagcactagcaaggcaggcaggctgtaggttcccatgaagatctgctgaaatgatacagacaacttatccgtccctctctgcttctcagacttcatggtgcctatgaatccccaggagatcttattaaaatgcagattttgactcagtaggtcctaggggagttgggggcagggtgctggagagtcagcctttctgatagctcccaggttatgccaaggccactggaaagcagactgccttctgagaggtgagccgctagttgttgaaggcttggctggtcgttcacttgtgctatgacaaaatacctgagacttgggtcatttataaaggacagaaactcatttctcacagttctggaagccgggaaatccaagattgaagtgatagcatctggcatccaaggagggatgtaccgtccaaaggggaggaacactgtgtgctcacatggtggaaggacgagagccaaatgctactgtgtgaagcctcttttataagagtcataatcccactcatgaaggacatgccctcaaatcatctctcaaaggacccacctctgaatgctatcaaatgagcaacacctgaatttgggaagtgatgcattcaaatcacagcggctagctagaaaaaatccttttatgttctaaaaagaagtttgtctttcctgagcacttggggttgtcctttctttcagctatgatgtgagccctccctcctggtccttgatatcatgtgattcaaggaattcgagcaaagtttcagccctgaagagctaaaggctgagagctggagaacctgccagttgaatcccctctctgctagcttccaggcccacaaccaggacttgtgactcacagtttattattgacaacctggccttggcagcaggagtatttttggatgcctttactcttaaatccctggaattcagaactgtacaagttaaaccttattctaactacttttttccttgcagttttcatctctagctcctctgccctctgaatatttcattcatgcccaagacagagtcttaaattgcaggaaaccagaattctgcagatcaattagcctaactcacaacatgtaatttttcttatttaacagttagaataacaccatttctgtgttcagcgtgggcccgctctgtgcccactggaaaacaaatctacctgcctttggaggagatccatttaagaaccaaagcccccatggtgcctcatcatctaagaagggtgacactgtgaatccttctgaggattactcttttttccaagctgataagagctctgaatggccactcagctaggaagatcaagcagcccaccttcttccaagggcctctgggcacaacatggatggtccttgattttactgcttggctgaggcagaggggcatgtcttttggcagaggtgagtgcgggtatcctgggggagagtctctggtcaccaactacagcccttgtctccctcccagttttcactacagctagataagcacagagggctttgtaagaaatgttcagtcaagaagcagaaagagcctctgcttttaggtcctacagtgaaattgctggaagccttttcttccttgttccttccatctcctggccatggagtaagggtagtgagatctggtggtctccaaccttcagggacttcaggggattcgtccctgacctatattactgccgttttggtgcaatgcaggacactggagaggacatgggcttcagcagatcaggaataggtgagtttcaggaatggatggagggaagctccagtcagatgggaatgtttaaaaacaaaactgaaattctaacggtgtacacagcatagttaaaacatccttgtcaaaaaagcctcttggacacacgtttcaggaaatgaaggctcagctccacaggtattgttcttcaccatgtctgacacgtcaaccctacaagtcaacaggttgaagaaaagtctggcattcacagaaataaaacattactgcaaggccacctccttcctccagaatgtgaagcattcatgacaaaagagagaattcactaaccataatctacaaataaaactagtcacgatgggcatattttctcttattttactccatcagatgaaactagtttccaagatccgcatagctatcaatttcccccctcaattcatatttttattcttctcagtagacactttatttttgtaagctgtacccagttttgttttgatagctcaccagaacctggagtaacaaatacttttaatttgattatttaaaaagtctcattaatttttcaagccacacaacatacacaagcacaaatgaattcaccagacacctgcaaccagtgaaggttaatagtcatttaatgtaactgcatacgttacaagcaatcttcctgtcccactgcattttcaaagaccacataaatatgtaatccattcctcttttttcctatcgtaacattccactggggcgattctgatgagctgtccccccgctgcctccacagtaaagtgctgcgcagtggctgatggatagatactgggtttgagtaaagaggatttctgcagccatccataaacccagctcatttaaattggtagctgtcgactacctgagaagaaagaaaaggctgtccttaaataataaaaaaagcatggctctattgtctagaatgtcaagcagaattcctatttccaggtagcagcactgagggaccacctgattataatgaggggtttgtctgtcttctcagcccagtctcctgggaatccctctcagtaccttgagaagaggtaagagtgctcgagattcctctccctgtaactagggttctggtggatggtgagccagataattgtttagatggccaagtgggtttgaagtggaaatagaaacaaatccaggatgttactaggagactaccctttgattaatgggaattcaaagatgaaacaagtattgcctattgtttaattttcccttctttgaaagtaaagtgtttggggagaaagctaagactctaaaaaccagagcatatatgagacagcacagagcaggccctccttaaacttttctcttggtcaagataaaatttttcctaatcccaagacatgctgctgagggcagagacactcaataatgtggatttactgaccgattcacctgcttctctgtaggaaatcaaagttcattcattcacagacttgctcagtgacagaagacgtttaatagatgtcattctatccagggcatacaattcatgctttagcccctaaaatttgccaagcagtgcagttgaaagctaaaaaacataagtcactttctctatatcagcagttcaagtttgtccaatctctgccctcagagaaaagaggaggcacacacaaattccaagactatatatcatgaaggttatggagcctgtttgagacatcacagaaactacccagctgaattttaagctgcctctcatcagagaactgaggattcacagatttccagggaaattgcattttgagggaaattcttctaggtaaaaacccatataattcaatgatgaatatttcctttggcctttaattgatttacaagcaatgctccatggctagctttaggtgaaagatctattaatttaaaaccattcattacccctttctttcatctaacacatttttccaatatgcttattgttcactataagtaacagattgacatctctccaagagcaagtccttttaatacttgtaaatggtttcttggaaggcatcaatgataaaactagttatgttttcagtagagtgatgctaggatacacttttatgcaatgccataaaactatccttcttatttaagtagcatcagcaagacagtagaataggaaacccgagagctcacttcacaacagaaacaccagctttaacaacaacacatgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccaggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaacaacacatgatccaaaaagcctttatgagaactccagaattcagttaggaagtcacagtaccccaggcaactcaaaatcaagaacagctacattgaaatgggtaacaaaaagctattttattccaactgcatcaatccttctcccaagccagcacagctcatgatcaaaaagaagagtccaacttgtggattctcccttgggagggaaattgaagaaattgaaacacttccaatgttccagcttttcaggaaactgcccaagggactggtttctgtcctgcctgattcagagtgctgatgggaaactgacataccttggatgcctggtatccacagagaacaaaagagagctcagaagcttgtggcagcaccagagaacttgtagtatcacacagagacaccagcacagcttgccacaattttcagaaagcacccaactcatggcttctccactgggagggaaaggaagggtggaatgtatatattgtgttctggcttttcaagggctgctagaaggagtggtttctgttttgcctgacttagagtgctgacagacttagaaaactttggatacctgggagccagagaacagaaaagagctcaatgccagaaaaagcgccagaaaacctgaaatacctcatacagacaccagagggagcaagaggctacaagcgcctgaaaaagagaccagcaaatctctctaaatgggaaattacacacacaagcctagaaaagatttctctccccaaaaggttaagagacgcttggaatctctagctgggctgattgctgaaggtctttccctataagaaaaaccataaggactggggaaagtggttgtgttttcaaatgtgcaaatcccaacacaaaattataaggctcacaaagtaatggggaaacacagcccagtcaaagttacaaaataaatatccagaaattggtcctaaagaaaaagagttatatgaattatctcataaacaattcaaaatagccaccataaagatgcttaacaagctcaggaaaattgtgtataaacaaatgagagtgtctgtaaaatgaaaaagagtattttttaaccaaagaaatttgtgacctgaagaacacaaaaactgagttggaaatttcactagaataattcaagagcagaactgtttaagcaacacagaatcagcacactcagagacaggtcattggaaattattcagtcatagaaacaccaaccagaaaaaaaaaaaaaaagtgaagaaagcctaaaggacctactatgggacaccacagagaccaataggtatattataggtattccagaagaaggaaagacagacaaaggggcagaaagcttgtatgaaataataatggctctggtaaaggaaatgaacatccaaatccaagaagccaaatagatctcaatcagaacatacccaaaaaagtccacactgagatacattataatcaagctgtcaaaggttagacaaagagagaattttgaaagcaagaaaaaagtaactcatcacatacaaaggagtctccatgagactatcagtgtatatatcagcagaaactttgcaggccaaaacagagtaggatgatatattcaaagtgattaaaaaagaaaaaaaagggccagggcggtggttcacgcctgtaatcccagcactttgggaggccgaggcaggtggatcacgaggtcaggagttcaagacgagcttatccaagatggtgaaatcctatctctactaaaaaaatacaacaaaattagccaggcatggtagcaggtgactgtaatcccagctactcaggagggtcaggcaggagaattgcttgaaccccagtggcagaggttgcagtgagccaacatcatgccctagcctgggcaacaaagtgagactctgtcaaaaagaaaaaaaaaagaaaaagaaaactgtcaatccagatttgtgtgtctgtgtttttcaaaaattaagaaaaattaaaggctttcctagataaacaaaagctgataaaatttatcaccactagacccgccttataagaaaagctaaatggagtccttcaagttgaaaagaaagaatgctaaaaaacactggtcagcaacataaaagcatatataagtattaagctcattggctgaggcaggcagtgaacccaggagttcgagaccagcctgggcaacatagcaaaaccccattcttactaaaaaatacaaaaattagccaggcatgttggcacaaaacctgtagtcccagctactcaggagactgaggtaagagaataacctgagcccaagaagtcgaggctgcagtcagccatgattgtgccactgcactccagcctgggcatcagagtgagatgctgtctcaaggaaaaaaaaaaaaacacacacacacacaaaactcactggtaaaggtaaatatataaatattacaaatacagaatattgtaatactctaacaatggtaggtaaatcacttaattctggcatagaagttaaaagacaaaaatacaaaaataactataaaggtatgttaatggatacacaatacaaaagatgtaatttgtgacaataacaaaacagaggggagaagtcaaagagtagaatttttgtatgtgactgaagctaagctgatatcagcttaaaatagatattacaactgtaaaataagccccatgtaaccacaaaaaacctacataagatacataaatgaaaatgagaaaggaatcaaagcatatccttaccaaaaaaaaaatcaaaagaggaaaaaaggaacaaaaacactaagagacaggcagaaaacaaagtgcattttagtccattttagtatcacaggaaacctgagactggacaatttataataaacaggaatttattttctcacagttctggaggctggcaagtccaacactgaggggccagcatctagtaaggaccttcttgctatgtcataacgtggtaaaaggaatcatggtgaaaggaatcacatggtagaagagcaagagagagagagtaaaaggaagatgaactctcccttttataacaaacccactcgtgcaataactgttatttcattcactccattctcatggcctaatcacctctcattaggccccacctccaaacactgctgcactggggattaagtttttaacatgtgcattttggggaacatattcaagccatagcaaaaagtcaatagtaagtccttccctattggtaattattttcaatgaaattgaattacattccccaatcaaaagacatagggtagtttaatggattttttttaaaagaaaatgagactatttgcttattttagattttaggacacacacaggatggaagtgaaagggtggaaaaagatattccatgcaaaaagtaaccaaaggagaacagggtggtcatatgtattcatacaaaatagactttaagtcaaaaactgtcataagagacaaataagaacatcacatattgataaaagggccaattcaccaggaagacataccaattataattatatttgcacctaacattagaggagccaaatatatgaaacaaacattgacatgacatgggctcaacagaaggggaaaaaaaaaataacaagccatactttagaagggattaatatccaaaatatatcaagaactcaaataacagcaagaaaacaacccaatttttaaaatgggtattttaaaaaactgaaatagacctttctcaaagaagacatacaaatggccaacatgtatgggaaaaaaaatactcaacatcactaataagcagggaaatgcaagttaaaaccacaatacgatattacctcaacctgctggaatgactatcaccaaaaacacaaaagataagtgtcggcaagggtgtggggcaaaggaatctctcacatattatcagatagtgtaaattagtacagccattacggaaaacagcatagagggtcctcaaaaaattaaaaagagaactaccacatgatgcagccatcccacttccaagtatctacccaaaataattaaaatcaagatctcaaagagatatttgcattcccatgtccaatgcagcatgatctataaaagccaagaggtggaaaccacacaagtgttcatctatggatgaatggataagtaagatgtggtgtacaaatacacaagaatattagccaaccttaaaaaaagagaaaattttggccaggcacagtggctcacacctgtaattccagcaatttgggaggcagaggtgggtggatcacttgagatcaggagttcaagaacagcctggccaacatagtgaaaccccatctctactaaaaatacaaaaattagccaggtgtggggatgagtgccaataatcctgtctacttaggaggctgaggcaggagagtcgcttgaacccgggaggcagagtttgcagtgagccaagatcacaccactgcactccagcctgagtgacagaaggagactccatctcaaaaataagagagagagaaaatcttacaaatggatgaacctggaagacgttgtgttaaataatacaagccagtcacaaaagaggagatactgcatcattctacttacatgggatatctaaagtagttaaactttaaaaacaaaaagtagaatggtggtttccaggggctgcagaatgaagcagaagaaaaatggagctgctattcaatgagtacaaagtttcagtcatgcaagatgaaaaagttcttcagccatacaacaatatgcatataataacactgaatggtacaattaaaatttcattaaggaggtagctttcatgttatttgtttttttaaccacaattaggaaaaaaaaaaagctatacttcctgtacaagctggaaatctccaaagaatctgaacacaacccattttgcaagcaggtttccccaccccaaaatttcgtttccaaagggacagagagagcagaccatcaccaacactaagctgtgcagacaagcttgacggctcaatcctgaaaaaaaaaaaaatgaggggtttgcacttaccaaggaagctaaattgtcaatacacctgcagatcttgagtttgatatatgtgtgtataaacaaacaaaaatatgtctggaaatagatatggcaaactaacagctctgtctttccgagaggaaaggtttttgggatgggggacaactgggctaagagtttgtcaaaataatggcttaattatgtaattcaaaatagtgaaaataaaagtttttgattgaaaaaactatttaccaatcagctatggtattatctctcaatatatgtccttgatatttaaaaacataccagccctcccttgcatgacaccccttctcaaatcgggaaaatttcatctttctctcatcaggaagccacatggtttctggccactgagttcattgccctttgtgctttggggccagaacaaagtaccccaacaccctcctcatcaagagagccagatcttgtatacaaacacttctcttaagtcactgatgcctttgctaagaagaattctgcgtacatgcttcctaaaaactaacagcccagctctctgaagttgtctgccaaaacagaacttcaaggcagtaacttttaattatatcactcaatgatttatgaatcacccactctgtgctggacatagcactgctctcagtgctgggtacacagaaaggagcaaatcaaaggcccctgccctctcagacctctcatttgtgggggagatggacagacaaactcacacatgcatatgttaataccaggaaatattaagagctacggagaaaacagtggcataagcaatccacagagtgatgggcagtggtagtttacacggggcaaccagctatgacttctctaagtcatatttgggccaagggctaaaataaagagaaagccacacagacatgtgggagtaacacattccaggcaaaggaaacagcgagtgcaaaggccctgaggccttttggttctgattgatatcaacaggtcaacctctaaaagggctgcaccaattcccactcatcagcagcatctgggagtacctatttccctacatttttaccagcacttcttaccgtattccctttatttccataaaagataattactattgtgtcatatcttgtgtaatatccatagatggactcaaagcactgatgataggagaagaggaaatgaaaaaaaggcagctcccattcagtactccccgtaccatacactgcacccctcccaattgacagatgtttcaatttatcctaacatcaaccctttaagggaggcatgaggtacctacttctgcatccaaaaaaaaaaaaaatctagatcctgcagactttaagaaatcaggccaaaggcattcgattcttaggctataaccagaattgacctcaggtgagcctaccttcagaacctgagctctttctattccaccaggttgctccctagtccaggggcacagaagagattgcttggcaatcccatatgaaggacaagctccagcctgagaggagctggttgccctgggtaatttcttgcatatgcatttgatttttctttcactggatctttttaacagcaaaagccaatcttccccaatgtgccaggaatttatctacagctgaaggaagttactgtcaggaagatgtggatatgaataattaaggccctattaaacatgcacacatcttgtaataaatctcaaattagaatgtgccaagatcttgttaaacctgccaacacatattctcaaataaggtgggaatataatttggagcttatcaggagattcaacctttcacagaaaaatactatttgactgttcggaattttaatctggagattacctgaatttgtctcatctatcattccgctgtgtttatgcccattgtgaaaaatcaaacaagtaatttctctcaggatgtcctcaagtggtgtgtattttgatacatactgtactaaacctcattatttctgacatcatccaaaagagcctcactctgaatacacttctcttaaattctaaaacaaacaaacaaacaaacaaaaatgttcattcatcagtgacttaaacagaactttttgaaaagcccaggagttatgcttcctgatgtggatagggagagagtactgtggttaagagcacacactccgagtccgattgatttcctgtcccacctctaccacttacctattgtcaaatgggaacagcaggagtgtctgctgcacagggtagctttgaagacctgatgagttaatcacctaaaatgctgccttccccatagtaagtgccagctgtagttattatcattgggtatatcccaataatgaaaactgatgttaccaaaaactaacagtttttagtaacttttaatttttctgatataaaaaatacaggtttatttttataatcttataaacaactcacatgaacaaataagaaaatagattctagagtataacataacgaagtgttaaatatccctgtggcactggcagaaaccaatacaactatatctattttgccatcagggaaactgagataccagtggttgagactttcggttttaatcttccagaaaagaggaagctccccagcctttcatgagtctttcaatggtgtcttgctgcttcctgttccaataggccagtacattcttgaaacatagacttaatttttacacacaagctgtgtaacctcagacaaagcaaataaccaggctgtgcctctgtttcctcatctgcaaggtagaaaataataaaaacacatagctcttagagtcgcggtgaagaaaatgaaccaaaatcatagacgagtcctgccacacacatgcatgagctgctggaaaggcatgcccatttgtctgttctagagtgggccttcctaacatgggaaataatccagatcctcaagccaaagaaacagtggaaaaaagccacagcaaggggaaaaaatgaatacactgttcctacagagacccctcagattcttaagatcacactgcggaattaaccatccatggtccacgcccacctgtgaagccatttaaggtggaaacagcagcagctcatcacagcctttgctgctgcctgacatcccactgagagctgaactctttgccagtaattggagaacaaattgtgcaaaatgattggactgaccaataaatctgtgccagtaaaccactggaagggcaaccatgtgattctgtagaatctgtacatctcacccagatagatggcaaacttactgaagtccctgggtcaggggcctcaagttcccgggccatatgcccatcctcatctgtactctgaggacagagatggcgggaagaggatggactgggaagagtgaaagtttgcaaggatgacctatgccctccccaagaaataaatctctcatttaaatgacaaaagaaaaaacccagaagagaaaatatgatccatgtggtcttcaggggagagagcaagtcagatactaagacctgaacctagctcctgagcaggcaggccagaagggagttcacacagacaaagcatttaacgccgtgccaggccgacagtgttcacttaatactgacgctagtcactgctctccttctcaatgcagaacacagctctaacagcagccagtgtgctacaggccaaggcacaatggtaagtgttttatatgaattatttaattttctcctcaaaacaatcctaaggagcaggtgctattctcattcgcactttcctgctgagatagctgaagcttagagaggctaggagacatgccaggatcacacaatcagtacgcggcagaaccacaccaccaacccaagccatctgcatcactacttctaaacgacatcgtctctgtataccatgggatcttttaaaaactgtttttgctacctgcaattcttttgggaattggaaatggtatataaagtcagaaacagctggcacactttcaccaccccgccccagcctttggatgctgtgatggttaattttatgtgtcaacttgactgggtcatggggtgcccagacattctatgaaacatgattctggctgtgtctgtgaaggtgtatctggatgagattcacatttgaatcagtggactgagtaaagtggactggccctctccaatgtgggtgggctgcatccagtccattgaaaacgtgaatagaacaaaaaggctagggaagagggagctcctcttgcgtaactgtgagctggggcattggtcttttcctgccttcagactggaactgaaaaataggctctttttgggccttgagcctaccaaatcttagactgggatttacaccatcggttctcctgggtctcctgcttgctcaatctccatagtcacatgagccacttccttataataaatctatttatatatatatacacctatatatacacatacacatctatctgtctatatctcctaatatctccttttggttctttttctctggagaaccctaatacagatgccttgcatcacagaaatccaactgaagccttcattaacagtagagatttttttatgggtcatttggacactaagcatgcaataagccagtgtttaaaactaaattttagaggaatgtccaacctaaaaaagcactgctgtgaaaataaaatgggaactgatgcaaagcgtgggatgtagtggggagggagaagggaacacagaggagcggtgtgccctcatgcccctgcagaacctttctgcattattgttttgttggctcctctaatgcaccacatccctttgcgcacacacgctatcccacagtgcaagctcgagaagccatctgcatggctcactcagcatatcacccacaggtctcctcacctaaatgaatctaggtaaggatctgaaagagactgaacaaatggtagaaggaaatgctattttggggtcagaaccttctttgtagttcctgtctctcatttacaagacaggctcccctggccctcaaactaggctcagtgggaattaactgtcatgagctggatccagatcagccattattatatgtcccatgggaagcagacctgagacctcactctgctctgccaggcctcccaccaggccactgctcctgaaaattagctatttcatcatgacgagctgcccaaagcacaggagctaagggatgacctatgggcccaattcataatatttatgttcctgccactttgctgccctgtatctccactcagtacctttggctggctgaatcagagaccccccagacactgtggggatggaaactataattgcaattgtcagtggcgagcggcttttatggtgagggctacatacctacaatcctcctgcatttcccagctccttccaccagcttcggccaaaatgcagactgacactacctctttagattaggataaggccagtttaattcactccttaaatgcatcagcatttattttaaagccacatatctctcagatcacaagacacgaacctgctccaaacctatcaccagatgcattgtaaaaattcacacagaaagctagaagcaaaaattaaaagtgaatgtgaatgcaaggctgatacttaggtatgtaacttgctttaagttcttgatagtaaaaatatccactcatgcaactcaacaaatacatattgacaaactactatgtgccagacatagactgagatgaagagatgaggccatgcctacatgagctcaatgttctaatgcactccaccaaacctctctcagtttgccaggaaggagttgtgtgaatctttgcaaagatcttcccagtcccacattcaccttgataattatagctttcatctaaggaagtcacacaagccaagcactattcagccataggtattttcagcattccatttattgaatacctattatatcaggtaactgtgataagtactatgcacattatacgatttaatccacctgacatctctgcaaggtatgtatttgtactattattttacaggagaaggccggagagatgttaaatgactttccaaaagccatgtaatcagcaaatggtggtggagctaggattcaaattcctagcctaactgaacttcctgggcatccactgtgattcccaagagattcaaaggaggcctgctcttcactcagctgtacagcagtgttcatgctaccctgtctaaggccaagggactgtttgttcctctgggtgagaaaaaggagcaccaatgtaactggcaaggctgcagccataggtcccagccttccctaagtctgccttgtcatctctcaaataaggaaggtgaacaaagggatccataagacgtcttccaactccagagtcttctgaacccctgcaactggaagacttgccaaagtgtggccaagaagacctaactcattcccagggcatgcagcaccacaatcagaccctcactagggcccacaagagagaagatgactccaaaagacctgcgcattgggccattcttgcattgctataaacacctgaggctggataatttatgaagaaaagaagtttaattggctcgtagttctgcaggctgtataagcatggtgccggcgtctgctcagcttctgatgagccctctgggggcttttattcatgaaggaagatgaggcaggaataggcatgtcacatggtgagaggggaagcaagacagaaagaaaggagaggtcccagacgcttctaaacaaccaggtcttggtgaactaacagaactcactcatcaccgaggggatggtgctaagccactggggagggatccgctcccacgatccaatcacctcccaccaggccccatctccaaccctgggaatcacatttcaacatgagatttggaggggacaacaatccaaaacatatcaacctgccgcagcacatcccaggcaaacagaacactccccagacccatcattgaccttcaagttccaccctgatttcatctgacttgttgaaatagagccattatttacagattcaagttctactaacccagatcacatcgctcccccacattcaaagtaacacacacacctgaaagccagtgatagaaactcctcagcaaggcctgcaaggccccaggtggtcagtgtggcttcttttcccctctctggccctgcctaggctcccacgtcccagctctccactccaacctccccaggcacccagcttttcatgctcttttcctcctgggatccccacccttccctctgtctcgacactcccccccagccctcttcacaagactgtgcccctccctttgacctgagctcacaagttccctcttgtgagagggcttcctgcccattatttaagactccagccctgtttggtgcctcacagtaatatcacaattagtaattttcctgcttaggttcatcgctcatcttctcccaccccgagaactctgtgtgcttcatccaccatctgcgctctgcacccagcccccaacagagcacctagcacaaaaccagccgtcagtaacacttgcctaatgcttgaaagaaactgctttgcttatctcaacaggccctgtatgattaccacagcgactggctggccagcaccatggatgcttctccacttctatgggctggaggagggggatgtgccacgttttgtgcagatagcaaaggttctgctctgcaggagctaaggaatacatacaaaagtgttttcagatgatacagtgtcatgcaaatagaaagcactttcatatatatgtatgtgtgtagatactacacttgatcttatccaaaaggccgagaagcaactgtgtgtgtgtagagaggcagacagacagatgtctgctgaaaaaatgcatatataacaaacgttgaaatcatggtccaaggcaaaataggctaagtgcaaagtgagtatcacaaataatgagtgccgcaaaaatgagggagagtccaagagggagagatgaggttacccagggaaaatggacttcagtcaaactctaaaaagtggcacagattgatagatgtcaaaagccagagcagcataagtgtggccccaacccacttccatcagtatcacctggggtgttggtcaactccctgcctactagcagagccccagaagttgggcctgggagtctgtggtttttatcacatgctcaggtgattctgatgcacattaaagaaaagtcatcactgagcccaccaggcaaaagggcctaagtgtacaaagctgtgtaggacaataatttgagaggactaggaagcaacagctagaaatacatgttaaggctcgagagctaggtctggattctataggtaaagggaagacactgaaggcttttggataaaggagtgacttagtgaacatgatgtcctagaaagcttgggaaaaagctcaggagggactgggaaaagagttgaggaggagggagccaagtcaggaggccacaagacctccagcagacactggggccctccccaggttgagacccccatgttggccaccactagggaccaatcggggacatgaagtagcctccctggtctcatccatggacatctgctctggtcttcctgataagtccgggcctgaggatgttttgataaaaaagaaacacacaggatctcaaggcacaagtgagaaactcttatctgcaggccaagacagtaagagatccttcagaattcaagtgctcaggcactggtacttggcaaggatgtgctgtatgcccggcacccaagttgctggaaacaaatagtaactgtaatctggtcaaagccgagaatttacatttctcaggaacactgaaatatgcacattaaatctataaatacataaagatttctgggagcactaaatagaagtgtgagatttttccaaacagatgtgtctgtttgttgggagatgaatctcaatgacctctactactacttaacaaaaaaaagaaagacaaaaacaatcatgagttggaggctatataaacatcatgtccaatgcatcactgtgaacatgaagcaggttgggtagtttccatcttgacaagggagtttaaagggtgccccgtcagatccccatggagtcctattctctaggggtctctgccaatggaggcattcctctctccctccctgtttctgcctggctcttgtgctgtgagctgtacaaaattcgctgtcttcacaagagtacacagattgcatgagacagacttgcctcaaaacaatgcagatacataacttgaactccagctgacaaagtgtatgagggtccaaacaagtttcttttctgctgagattaatagaagaggtgacttttcgaaagctttcctctttcaaatatatgaacagggttccagccaaaaggaactatatcatttccacctgtctgaaggcagacaggctgtaaacattccaacaagatgtttggggagtcctttaagctccgtgcaagaaagtaaatggtttgagaaaggtctctctaattagctagtgcaaacggagagcaaaaatgtttcaattccaggagtgtgggagggtttggtcgcagaacgcgttccctgtgcttcttgctctggtgctccacattctctccaaagcagacaatgtttttctggccttgtggtttcaaaagataaccttcatggtaaaaatcaatagctgtaacacagtcttcggttcagaatgaagcaataacccaggctctaagatgaggtcccctgttgaggtcagagagatgctgacacagatgcctcattttctcctcacagtcctgctaacatttgtaatcgctgccctcttgcccgaggagaaacacctttgctgttttgcctttctctgacaggagagatgctcacagccttcagactgtggttcccaatgcaatgaaaacaggtggtactgaccgatggtatgatatttgcactttggtgttgcacccaagggcgtacccgtcactaagggggataccactagtgatgctcagaaaaagaagccaaatgccaaaaactacctgtggagagatttcacccctatgacatgtccacagacggcacatttacagagacagaaggcggaccagcagttgcctggggttagggtacaagtgagatctcaggaaatttgggaagacaatggaaatgttcccaaactggattgtggtatagttgcaaaacttgtaattttattaaaattcatcaactgtatacttaaaatgggctaatactatgaaattaaattacacatcaataaaactgtaaaagagatgcattcattgagtagttaatgatatggggaaatacaggttaaaaaacacagaataccaggtattaaatcatatgctcctgttttttaaaaaatatgcatcagcacacattggcttcagaggaataagagaaggcaatatgccaaaatgtttatagtaattgttctttatgtagtggaatgacaggtgcttttcactttcttctctatacttcctgtgtattccaaatttttatcatgaatatgcacttgctttcatcatcaaaaattgatgctgtaatttagtaatgcacctatgaaataattggccaagagtacataactgaagagttaatagccaagtttgagacgacactgcttacggcctctgcaattgagcagacacttaatggctattatgaaactcagggatctgaaagatttaaggcctccctcttcaagtaagcacacctccctcccctcatcaggcccactgtatgtgtccccagaaagggtcaggccttgcacagggaaagcaaacgttaattaacttgcatattgcatgtgcacacacaccagtcccctgttaacacactggaacaaatttcagcatgttcaagtcaatcaaatacaggtgacaggaactgaactacattataaagcatgagccctgcggtgcccatcgccaatctagaacacagcctatctgtacaaatgcttctttttttcccctgtgagaaaggctctttattttcttggaatacacagtcttaccgtaacagaggactcacagaccctaatgattttctctccttcaaaattaatatcacacactggctctctaggtactttacagtacttacagaattttctaaaataatgaatactctgtaccatgctaacacaggagtttctccatccttggtgttaagattgaggacaagggtcagctgaggccaatcctgcagtttgctggtttggagaaggatcctaaactgagcagacggcaagtttccttgattgcctcaagaggaaagcttgagggtggtatccttagctcatcagcatttttctaccattgacctgtgtctatcatagggacaggccctgcagcctggtttgcattccagaacccaccatcccctttcagatcacagctgctggagctgtgggcagcacagctgacccaattattctctcctctgacctcaggaatgggaatttacagtactattgctctccactgttaatcttaaataaggctctataaattccagagctgtgggacagacatttgctgccaatgtacctggtaaagcaggtaaatccaggctcaggaaagagcagtgcagagcagaaagcagagaacagagagagaagaggccaagagttgctttcttggcccccttaattctctagctcctggtaacagtctctgtgaggtcagcaatcaggctgcacaaactaccctctctgcctcctgattactgctccttctagcctgaatgagtttttgtgacttacatccaaaggaggcttggataaagaacctacaaaataaattcctctctgaaaataggaaatacttccctgggctctctgcctggaggcattagcaaaatgacagccagaggaattaaacatttttttcaggattggagcccaagagagtttcaagtgcaagtttcaaagaaaagggctcctagggcaggtgtccaggctggagacccagcagagcctccagagtgaatgattcacccagtggaggtcagaatgagagctcccccagggcaaagaccagtgacactgtctcccttactaaccactgtatcccaagcacctagaacagtgcctggcacacagtgggatctcaactagtacctgctgaattaactcatgggtgtataaatacttgatgggtagctaccttttgcaaaaagtaattctaggcacaggctcaagaagttacataaaccaaggcagaagcaaaaaagtacagtgtatctccagggagcaggtaacgaccccatttggcagatacatcaagcctatttgcagagctataggatgggactatgagggagaaagctttgcgtatcaggctaaagaagtagttttgtctgcaagggtgaacatcctgcagctaacatttccaatgaccaaaacacatttccactggagttccttaaacacatacttcctatgcggccttctcactccacctcctaggtatccctactgacccaggagacttgatggcatcttcctttctgtatcatgtaccatgaaaataataagtctactgaagctgtggtctacagacttcacaacatcctccacttccggacattctgactaaagacacctaataactcaagttacaggatcagagaggcagcatcagcttcagcatccatcgagctaaaggcaaggagcaagtatcaattcacactaagaccagagattcaactctctccatttttataacagcacgtatacaagtgtatatattcacatacacacagagagaattcagtttacaactgcatcaagctctgaccctcctaaacaaagacgtttttgagtttctccttgtcattgaagaagcattcataaacatctgattctctttcaaacaagtatgtccacaggagtgggagagtgatttggtagcaagaatacactctggccactagacctgaatgagttctcatcgtggcctctccactaattaacaatatgatctcgaaggcattttacctccctgagtctgtttctctatctgcagattgggactagtgacactcctctgtattatttttttattattattattatactttaagttttagggtacatgtgcacaacgtgcaggttacatatgtatacatgtgccatgttggtgtgctgcacccaataactcgtcatttagcattaggtatatctcctaatgctatcccttcccccacccccaccccacaacagtccccagcgtgtgatgttccccttcctgtgaccatgtgttctcattgttcaattcccacctatgagtgagaacatgcagtgtttggtttgttgtccttgcgatagtttgctgagaatgatggtttccagcttcatccatgtccctacaaaggacaggaactcatccttttttatggctgcatagtattccatggtgtatatgtgccacattttcttaatccagtctatcattgatggacatttgggttggttccaagtctttgctattgtgaatagtgccgcaataaacacacgtgtacatgtgtctttatagcagcatgatttataatcctttgggtatatactcagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggccgcataaatgtcttcttttgagaagtgtctgttcatatccttcgcccactttttgatggggttgtttgtttttttctaatgaactgtactgttatttcaaagattaagtcaaggaatgtgcatcaaagggactgtcaatgcctgacatgtgggagggactcaatgaatggtaactataatattgccactgacttaagttgtcacatcagcattagcacatggccagggcacacatacctgtctgctttgtaatatagtcagaagtgtacaccagattctccccacacagcacacataaccccagcatacagccagtgaccagaggaccaaagagatctaagggaagtaacaagttttatatcacagccaccagcatccatctccctttctataggttcctttgggaaaccagctgtcccctacatttagtccctggctttgtgactctaccccagttccaggatggagcatgtgacccaaacctaagtcaactaatgcactgcattttcctggccaaggtgattggtccatggatgggcacattttccttggacagggaaatgtaatgagatacttgccagaatggccgaaagacattttctactaaatgtatatataaaggcctttaagactggccctgctgcagccagctcaccccatgaggacagcctgcccaagaacagacctaatgcacagagaacagagctcagagatgggaagggggaacccagcttccaatggcatttatgagcctccgcatcaagctaaacctaaaaccagaactatctcttgagttcttggtagtgtcttaaagctcctttttttttcaatcagttttttttcaatcagtattctgtctcattacactggaagagtccagacgggtacacatagcaagggtgttcatggctgatgagaggttttgggggagcaagcagagacacccagataatgcttggtgaaccatgattctacttctaagccaggagccctgattcactgtagactatagaaaagatgctctgaagaagtggctgggcctgaaagcaaattggaagcccctgggatgagtgctgctaacctggggacagcaccctctaagcctgagagcctgaggtctgcccacggggtccagctcaggtgtgatgtgtgctcctgcacatgccagcttctgacttcctagtcttctcatccttccaggtaggtgggaatgtgatatttacaagggccatgttctctagagcacgctgtggaagtgcctcataaattctactttactatttcaaagaaaaaaaaaacacttgattaaaacacacaccagaaaaggtagacagttaggggcctttcagtctccagctgtcatcactgaaggagatcttgatcccggtttgtttcaagaaaggggaactggaacagttggatgacacgccctcttccactgcacaggtgcaatgcatcattacctgacactggccgcctgaacttttctactgagcccttccttctgaccccttcctggaactccccaataaacaggtcttcactgagagagaatgctggataataattagtgccacactctgaggcttcagaacatccagggctggctggattcctgacccaccctgccacttcctaactatgacctaaaacaagacattttacctatctgagccttcagttctgcacctgtgaaataagaataactgtagtacccctcaccaggttgtaagaattaagtgaggaagtcagggatgcagtagatcttacttcagttttacttgtaagaaggctaaagctaggcacggtggctcacgcctgtaatcccagcactttgggaggccgaggtgggtggatcacttgaggtcaggagttcaagaccagcctggccaacatggcaaaaactcgtctctactaaaaatacaaaaattagctgggcgtggtggtgtatgtctgtaatccctgttactcagggggctgagccaggaaaatcacttgaacttgggaggcagaggttgcagtgagctgagatcacactaatgcactccagcctgggtgacacagtgagattccatctcaaaaaaaaaaaaaaaaggaagaagattgaggcccacagtggctgtctgacttgcccaaaatcctagagctaataactgcagcatctgggactcacatcctggcctgacatcagagccctcatactctgcccacccctccacgggaccataggcctgatccctctggcactccacaactctgaagtcaacatgcacatctgtgatgctgtcttcactgtctctattcatgtactcgctgcaccatccaggccacagtctccccaagggggaacaacttcaagcattatgttctgcacgcgcttggcagacactttatgctctgcaaggcaaggtctcagagacaaaagacaagttctatcctctcctaatgtgcatgtttgctcagagtgccttgcaggcacagtataaatgtagttatattttaagatctgctcagaataaacaaaacctattcccagagactttactcttcataagtgtcaagaaaatccagcaaatcgaacaggtgtctcactgtacaaagagaatcaggacgctgccaaggaagatggcttaggcctcacggatgcagtcatgtctcaggtttgaaaaaatgatagcaaaaaataaaagcaaaatgaaatatgtcacttggcttttgagattgtgcctactagcacagaaggacgtgtgtgaactaagagttttacaggctgattacatattttaaacaaaaattatcttactcactcatttgttccatgagtttttactgagcttctgtgtgtcaggcactgtggtagaccctcaggctatacccctgaataggacagatacagccctggccctcttgctgagagtagagacgacacttcccagcatcccctgccagtcactcaaataggtttgcaaaaactccatgtttacaacgatgtgggtaacagctaatcccaggagaaaatcatttcatacagcaacatctctaaaaacttgttccttctaataatgtgtcacgggaagaaaacaaaaagcttttgtagccaaattacctgagaatgagtggttttaaagctggcaaactgttttctctactgcaggacttctctgatcctttaccatgtgactgtgctcggtgacttgccagagagcgccagggctgcggtgtgtgggtacacaggcctgcccaactccaggaaatgagcaaagccttgcaaacatgtatgtgatcagacatactctcagcaaagagcgttttgatggacggtgttccacagaaagcacttcagaaagacacctccgcggaggatagtgtctgagttagacctactgtggagatgaaatcccagcctcaccttggccctccttgctaggtatgccattgccctgatgcaccaatacagaactgccaggtttccttcagaacaagaatctctttcaatggaagaaaataaaattaaaaatctgaaaggtattttattctttatgtcactaaaaaaaaaatcttgtcttgggcatttctttcagctcaccccatggaatcggtcactatgaataattgaaaatataaataaaaaattcatttggtagcccagccaatctctgctgtgtccgtggagggtggtaagacttgttgtctcaagaggaatttccatgacctctttcctacccattcaggagcaaataaagtcgatttccactagaagaatgtcaggcagaagtgtgaacaatagtggtgttgaatgacagagacagtaggttcctggaagaaaatgagggtcttcacaggttatttaaaataaagaaatctggctagagtttcagactagaagagaagagcaggctgaaatggaagatgctcagttattcacagaaaattacctgtggttgaggaaggagtcagagaaccttgccctttggcaacaccggagagtagaaacttattttgtctgttctggtctccaagttcggtgccctttttgttcctcctggctctttgttccactctttgttcttacctgaccctttcagaagtacaatatctatattctcctttcccagtgaaatctgatctcaggaaatgagctgaacctcattcacaccaaaatgtaatgactaatgctagataaatgatctgatgccagatcaagtgttaaaccaaaagaactgtattcccaaagcaggctttcaggcatcagaaggctgctgggtgactgtctttgagcagaaggccttcaatcaagtgcaagtacatcccgacacttatccactcccacaggtgtcagagtaagccacaggggcctcagtcacaaaggggaggtctgggagggtttggctgtcccctctccagtgttcatgctgatgcagagactagctagacctgcagaccttcaggaggggacaatgagttagactgaggtcaaaaaccatatatcatttcctttccttccctactgaggaccctcttgtctaggctcacccagagcagaagaggtgcataggccagctcttctccccacaaggtccatccacacagtgatgccactttcagtgccctggagatgtccaagctcaacactcccattcaacagtggaagaagggccccaagaagggcagacgcttccccagggctgtacagaggacctgtggaagagccttgcagaaatcaagcacctcactgcttccaacccactcagctgcctcaactctagcaaccatcacagccacctgtgaagctcagcctctcagccccgttgtatgaaatcccagatccaacaggaagcatattcacacagttcctccttagggtcaatcccaaccctctacttttagggaacaagaagtcaatcccttctacaatacccaaggattcatcctgcaacatgttccctggtgtttggctattcctgtgtggggcactctgtttcagcatgagaatatcagaaagcctgtaaggtgctgggggctactgacattcccccagttaactgacttccagtggaagtgttaagtccaagaggtcacctctgggaaacccataccaggtgccatacaggagacttcagctccccatcatagaacaggatcagcaagtttcatttaaccaggctagggtccacaggaatgcccagtgaactcttttccccacagtgagtattgtctataaccttttgggaataagttttctgtacaaaaatataattgacacaataaacagccccttcccacaatggaaaaacctaatagaatttaattatcgcaaagagattctgggagaaaagaagttacacttctctctcttgatccctcccaagaggctcccatgcaccaggagtctgagccaaaatagctgcctgagaaaggcacagcatggcccatgctcaagtgtggggagtccttaattaaagtccatcctgtatgactttccctgatgactatttaaaaatcaaaacaaaggtcataaagccagaacgttttattctacttacaagtccgaagtcatttcacatttgcgtgaataaccttctgtgaagacaggtgtcacatcttaacttttagtgaccctgtggcacttgctgtcattgaagtgggctagatgttcacagcacacctcagggcagcagttcttaagcaaaagtgattttgccccctaggggacatttgccaatgtctggagataattctgatgttcacaaatggggagggggcggtgccactgacatttagtgggtagaggtcagggatgctgttaaccaacctatactgtgcaggacaactgcctgcaacagggaattttccagtccaaaagccaatactaccaaggttgagaaaccctgctgtcaagcaatggttttaaacaacattgggcataaggtttcacataaagtatttagtataaacgcaggtttctggattctaccgacagagattgtttcagttggtctgaaatgggaatttgccattttttaaaaaaacaaagactgttccccattccccaagggattttgatgcaagtgtttcctgtatttccaaaatgatgggcttgcaattccaaaagctaccaccaggcagcagtgctgttagcttgggtaacaaaagctttatagaaggttcttaggcagagtctcaaagaaccacacacgctctacttctccacgaaaatacaatcacaggtaagtagaaacatggactaaatatagaaagtgaataaactcacacaatatagatcaatatttaaaaagaatgcaaacaccagacgttaggggcacccttctaacaaatattcatctctgcctaatgtaacttgtatggaattgtttggagccaagtgatttcagagctggaaggactaaagtcatccagtcccatagcctcattttagcaaagaatatgactgcctttaaacgaccagtttctagaatttgagaccttgcaatgctgtgcccactcagtcccaatagtgagcacttcagaatcccttccctgatgagctcttcctgtttatggggtgagcctgtgtctgcctctgaaacatatccccagctgcttgcacctcttgcagtaaatactcctcctgcagagatgggcattacctggattccatacttcagtgttaaccaaatttgctctatccaagaatcacctagggcttggtcaaaatacaggctttccctctgaagagtcccacacagttgttctggagcagggctgaccatctgtatttttagcaaacaccctggtctaagtggctctttagctctggctctattccaaaactttcccaaaatgtggtccctataaaaaatcaactgggagccattccagaccaatcactctctctaggggctgagcccaggaatgtgtaacaaactgcaggttgagtattttacacattaaggttgaggcccctaacactctatatagaaattacttacagcatgatgccctcccagatcttaaggaagcctcatctctaaaaaggcagggaagagaaggctaccagatagacacacatgtctcagcattactgcaggcactccagcagacactgcaggcaccaaagagcactgatctctgcctcatctgggcctcagacacctgtgtgacagggctcatcactgccatcttatcagacaaaatagattcggaaaagcgaagcagctgcccaaggccatggggctgagtagctgagtcagggttcaaactcaggtctgtcccacccaaagcccctgtcttcctttgcacaggctccctctcaagaggcaattctgttaaggcctcaactctcctttctcctgcatcagatgccctttggcttcctctcccagcacacaacagaatagaccccaaagaatgagaagcccaggaagaccgggaagttgcatttccttgtgggcccctcctgccctcatgagctgggcacctggaagctggggtcacagaacaggagtttgctccccctccttccctgcacccctcctccacccatcctttatcctgaatggctaatttaaatggataggatttatttgactcaactctgcattgtctgaccccaacctgcttccagctataactcccaagtcaaaaggcaggaagtcagaacagggaggagaaaaagaccgagataatcagcccttgattaacattgagctgtgaatgcacagccttttctaaagctgcacagagggtgaacaggaggaatgcaaatgaggtggcagttacgaaaatgatgcctgaactgtaaagcgccatataaacaggaggtacattcaaatttaaaagaaacaaacagggaaacatggttttccagacaattctcctccgaggcttgcctccttctaccaacgttctcccaaaaaggagtttgcagctcagaaagacaactcctgatagcactgtgtgccaggcccagtgttagacactttaagtcaaacaaaaacgtgcaatacgtgagccctgtcttcaaaaaactgatgatctgataaagaagggaactgagaaataccccaaatctacatggtgtatgcctagtggggcagactccagaatgtgagagtcagaaaaagttactcagacctcctgcaggataccagccaacggcacctcctaatgggcctctcccttctctgttacctccagggtccttccagttctgcctcctaaacatgtctcaaaggcaccacttacctcccctgcagcgtcattaccttggtccaggcctgtcctctgtatcctgggtagccctccaccctcccttgcaccaagccatcacccacatcgtagctgaagtgatttttcttcaatccaatcatgttttcaaatcaaataatgtttaaatgcctcagtggctccttgtgaccacctggggaaagttcaaacttcttgttttgggacctgaagcccctctctgccgcccatgttgcccccagtgctctgagctcaaagattgtaattcctctaacagggtgtaatttctcacgcgtcagagtttaagcacactgcctggaatgtgagatctcacacaaccaccagtctccacctggttcatgcttctttgtccttccagtatcaactaaaacagcctcttaggccggacatggtggctcatgcctgtaatcccagcactttgggaggcagatcacctgaggtcaggagttcaagaccagcctggccaacatggtgaaaccccatctccactaaaaatacaaaaaattagccgggtgtggtggcacgggcctgttagctacttgggaggctgaggcaagaggatcacttagaacctaggaggtgaaggttgcagtgagccaagatggcactgctgcactccagtctgggcaacagggcaagactccatctcaaaacaaaaaacaaaaaacaaatcaaacaaacaaacaaaaaaaaaccagtctcttgcttcgaagcctccccagagcacccagagccacgcctcctctggcacaggcgtaacgtgatggctcctcttagaatgccctacacgtgcccttcctgagcattttcacactatatttgaataacctgttgaatatgtatgtcctcttgtataggaataggaatcacctggccatcttgttaaaatgcacattctgattcagtaggtcagcagcagggcctggcttgctgcgtttctatccagctctcaggtgatgctgctgctgctgggctgtgggccacacctggtgtacacagactggactttgctgcccagagacagcagggccaagtttgtcttgttcaccgagtatccctagcaccaagcccaagcctggtacatgttggcactaagtaagttcgtatagaatgaacaaatgaagaaggtaaacaggttagaggtggacattcagtaatatggggttcaagtaatagtttcatcagggccacaggggataataacaatgacaatgtctgcaaaatcagcaccatcccttacaaatcagacctgactgacaaatatttatccatttataaagttgattattggcctaaatcaaatccatacagcaagtgcatgaccaaaatggaacatctgaacttggtgattttgtaccctttaccaaagctaaacaaattgctacttgctgcaatcccagaggggtgggggtgggggtgcggcaggggcatagcgcctgtgcttaactgtgagttattaatgtgaaagatttgcatgtgctttttatgattatagctgactttgatgtctttgtgccctgctcagggcttcaacatacaactataatttatttgcaaaaaaaaaacaatgtgcatagaccaagtatcagaaatatgttgaagtagttataatataaaataaaactgcaacaattacattgctcctgtgttgccaagggtagtccagaggctctgaaaggatggagcacacggacttgttcaaatcactgtctagagaaaaatagcacaacatctctttggaaacctgactcttaattctgcaaactggtgatttcaatatcactgaatgggaaaaatagaggtaagcatttgcaacaacttcaataacccactgcagatcaatacagctctaacactgccctccttgccctaagccgtccaacaagctcagccaaacctccgagattggttacaaagatcacattgtttgactcaacacactggtgctgctcttacacaatgttggagaaactggtcaaaagagaacttttaggtaactctcccaactcaagatcgatagttctctgaagaattgaaaggcaggcaagctgctgagtccttatttacatacatgtggctctcaatagatgccttccccatggctgcaagaacaaatcaatagtttctctcaggaaacctcaagtacagagggatgggatggatataaaagatgtttggggtttgcatctctctttaattccaattctgcatatcctcagggtagtaactataattgccaaaagacctgcaatatttgaaagcatctatttaaatagtcaatattattgagttcctaacttcaagccagcccaattcttgggactgaagattcaggtttccagcttgatcaagtggagaaattggggaatgacttgctgagaccaggactagaggcggaagatcaagcttacagcatagatggtataggggaatatctttgtttcctagagtagtcacacaaatgaccaaaaactgagtggcttagcacagaaattattgtctcacagatttgaaagctagaagcccaagatggaggttggcagggctggttcgttctgaggccaggagggagaatctgttccatgccactctcctggcttctagtggtttgctcatctttggcattccttgacttgtagatgcatcaccttgatctctgccttcatcttcacatggtgttctctctgtgtcttcacactcttctctctctgcatgtctgtctctgtgtccaaatttccccttttcataaggacaccagtcgtactggattaagggcccaccctaatgacctcagagtaacctgattacctctctaaagactctatttccaaattctgaggtactggggatgaggacttcaacatctctttttgggaggatacaattcaagccatagcgtggagggaagggggatgttaagccccattctcagcatgttgagagtgagctatctatgaatgcctgggtgctaagatcagaagaaaaatttgcccaagagatatagagctaagagacatgttcctctagcagttcaaacagaaacagatgcttgagagtcaggtgctggtgtggatggcattgctgaagccacagacaggaatgagactgccccccagagaagttacagtgctatggacagaaggagagctgagaagaggagctgccaatgaggtggagaaaacccaggagggcaatctcagtgaagccaagggaaaagaaggtctgaagggaaacatcactggtctaattacactgtcccagttatctattactgtgtaactaactaccccaaaatttagtgacttacaacaactgccacttattatctctcacaattctgtggcaaggcttggctgagcaaggcttctgcaccacgtggcgtcaactgaggtagcttggaggaggttcatctgggagagggatgaactcatctggagggtacaacactgcttcactcccatgtctggcacctgtaggagtgagtgcaggggaaatgtctagaaggctggactcagctgcaatcatccaaaagagtgcacacacatggcttctcctgcttgttggtctcaagggcagggctgagggcaggactctttctagttcatgattcctcatcctcttgttttcagtggaagcaatcctcagctgcaagatgaatttgtggggcctaacacaaaatgaaagtgtgggagcccttcttcaaaaagcaggaaggaatcatatagggttgtgtgtgtgtgtgtgtgtgtgtccacgcacgtgtgcgtgtgtgtgtaatgtagcatcaaagtgggcatggaagtactactatgctaagatcaagtctgatcagttttcaagggacatgagtttctattttatcaacatacatgcttcccatgtgtttcacatgaaggacatatttcattcatgattctacatgactcagcggaatgtaggtagtcacaatgtccaactagggctcagtggcaggttcggcaaattccacatctgtttcagagaacagttataaaaacaatcctgacccaccaaggaccataagcacttgagatagcccaacagccagaagaatctggacgaagaaaagagcatcagagaagcagcatgctgggttggaaaggtagaccttctgcactggatccccacctcccaccagagcagatggtcctttagaaagagctcaggcacatccgctgacaatgccactcactggctgtgtgcagctgcccaaagtgcttggccactcaggctcctcgttgatgaaatggaaacaaaatgccctcttcttgctaggtggttgtatcatctacagctgattagcgggaagcaccctctaaaggagatattctcatcattctgctgattccaagggtcctcctgaaaaccacaatccgcttgttgtccatctcctcctgacaaggaggggaatggaaggtgagacagaacccaaggagtattgcattctccattcccagagtgggagaaaacgcctagattttactctccaggccctcccagttctgtttcacagcccaccagccatcttgcaaaggggcctgacatccagtgctgtaaatttgtagccaagatagttgtatgttttggccacatccaagggcagtacattgccacaatcatatggtaactaaacatttcaaatgtcaccacctttcatgcatcctttaagatagcaccctttaaaacacaaaaaggacacataatgttgtcatatagatcagaatagccacataatcatgatgggagtagggcccatgtaaactaaaattaaaggatgggcatgtaggagcatgaatcccagctcagcctctcatcagccttgctctagatggcacagtggagaacctacatgagaagctacttttctggaggctctaaaagatgttaaggccattctgtaagcaaggatatggacagagactcaaagggctccagctctggaatcagacaggataaggttggaatcctctctacaatatattggctgtgtgacctggagcaagtgtcttaacttctcttccccctcatgagtaaaatccagacttgccagcctgtttagaaggcttgagaaaattgtagagaaatatctagaataagagctgatatactgcaggccgccaaccagctgcagttactatcattgttattaccatgccagtaaatattttaatagactagatgttcttcctcaaggcacagaactaaatttcacccacaaaggcatctctgttaatcactctttaaatatttagcaagccctttaaacagtcaactattgtgggggcagaaaaacaaataaggcacaccgtgcctcacctcaaggtggttataacgcggtgactgctgaggatgccgcattcttggacatatgattgctaaagaattttctatctttttcaccaagttgttatcaatcttttttgcatatgactgtccttccctggaaggattaaaccacatctgttacagagctagtagagtgcctggcacagctcgtataacagctcagcaagaagccatggtggaaagacgcaggaggaggaaaagacgaggaagaaggagggaggagtggagggagaagaaaggtggggaagaggaaggggtggaggagaaggaggcatttaagtcagaaataacctgaaaaggcagccagaaccatgcagtcatagaccttgataagctatagctaaggagaatttgtcatctcttgtaaatgctagtgaaataacttctctagttcaaaacaaagataggcaaagagtgggtgatgtttcatgtgtggttgcagaaggtggacactgcagtgacccgtctccatattcttttctctctcagacacatacaattattttctatatttccaaaaacacacaaagtccttttgatggctatcatctttgcagttctggatttaccaagtaccactgcagtactggtcaagtcagagctgacaaactgaaagaagacagagatgaaaaacctttcagaaccctttcctaaaagtgacacaggagccaggtgtggtggctcactcctgtaatctcagcactttggaaagctgaggtgggcggatcgatagagcccaaaagttagagaccagcatgggcaatatggcaaaactccatctctgcaaaaaaatacaaaaattagctgggtgcggtgatgtacgcctgtagtcccaactactcaagaggctgaggtgggaggatggctttagcccatgaattcgaggctgcagtgagcagagatcacataactgcactccagcctggatgacagagcaaaaccctgattcaatcaatcaatcaataaataaaaatataaataaattgtgacacaggctaagggaacccactgccgccttcttgatgaatcagacacacagcccaatcacaaagcctctgctgaccccacacctgccaccacacacctcgggatgggttatctttacacatcagaaacaaatgtctctgctcagataacagagacctccccatcagttaaagtggcaccttcaacagagactaattactcagtccattcaaattctgtagctgctgccagctccctccaggaaactaactttacactctgaccaatagggactgcagtgatatacaaacaaatcaagagtctcagaacacagctagcacacattcatgacctagaactccttcctagatgggaggttcagcaggggcaagccgaggtgtcccctcttcaattttctgtccccagtctctccctggcagacccatccacttccagaagggtaacacctaagtttccattccttacccataccctccctctacagatacttgctggcctccccagcaccacatgacaaagctaaacaccacatcttccctcctcaacggcatcaccagcttaatttcctgatgtctgccgaaagtgggaaactctcacatttgccctttcctttccactgccaccattttcactcacgttctgaccctcagaagctctgaaatcacatctccctgactccaacatctttccacttactaccgctatccccacactcatcccgaaaggtgtttcttaatccactgctgcgggaaacccagtggtggttccccagccctcgccacactaagcaccaatcgctgctcctggcttctcccttcctagtctcctgcattcctatacttacatccttcaatgcagccaaatcttatcagaatagtggatgtggatttctgcccttgcgaggccctgccctcattggtcctcaccccactcctcaagaacacctcaaacctggctcccactgaggcttctccaagactccccaggatgacgttgcaccctcccttgacccccccaggcagcctcctcagtccctccctggggacacaccctgtcctgcgtcacctgcatactcgacttctctctgccacccccaactgtgagctccttgaactcaggactgagggtatctgcctccaagcacatctctcatggtgcagttttacacaccataggctttctatcaatatttgcagaacagactgtctaatcaatccacagagcataaagtttaggagcaagggcccggccatcaactgcaggtgtcaggtactttgtttgttgactgttttgtgtctcagccaccaaaatgtaaccttcctgaggacagagctgtgttcctcattccctgctgtatcccagcacccaggaaaggattggcccgtaggaggtattgagtgaatatttcattaattgaaaaacctgctttcaggtatcacttattgactgtatcaccttaggtaagtgactcactctaagttttgtttttttttgttttttgaaaaggcatctctctctctgtctcccaggctgaagtgcagtggcacaatctcagctcactgcaacctccgcctcctgggttcaagtgattctcgtgcctcagcctcctgagtagacgggactacaggcaagcaccaccatgcctggctaattttttgtattttagtagagatggggtttcaccatgttgcccaggctggtcttgaactcctaaactcgcaatccacccacctcagcctcccaaagttcaaggattacaggtgtaagccactgtatctggcctgtttttaagagttttggtctcactcttgtcatccaggctgaagtgcagtggcactaccatggctcatggcaacctcaaactcttgggctcaagtgatcctcctgcctcagcctccagagtagctgggactacaggtgtgtgccactacacccagctaatttattttttgtagaggcagggtctcactatgttacccaagctggtcttgaacacttggcctcaagtgatcctcccacctcagctttccaaagtgctgggattacaggaatgagccaccacacccagtcctgactctaagttttagttctcacctctgaaatgggagaacaggatagtatcatctcaaagagcaatcacaaggagttgaagtaatccaggatgagggcttggtatggggctgggcaccatgagtgtttgcagtgaccatcctggagaggtgctggactgtctcagcattcccaccacacctttttcactcagtttgcatcaaggacctgagccgttccagatgttttccacaacacccccccacaccactcttctctgatagcttttcttgccctcatgcctccccctctccttctctggctcagatcatagcccagcccccaggtggagtcctgcatgcctccctcacagtgtcaagaaggctcaggcagcagctgctgaacaccgcaggcccagtggagcagactccagcctggtagctcagccaccttggacacatcctgctggaggagaacccgctcctcctgggaagccacagactcggggagaggctcagttcttccagccgtcacttccactaccctcctgttggaaggaacctatgtacttctgagagaataacagatgcctgaacagccctgccctgagctcaccctcagagggtgggctcaactgagtcaaagcacaccaagctctgcgacctccttacacctgctctgcctcatcagtgcaggttggattaggctgaccatgccatttccatttgcctaactctaactcggccccagcctagcctatcaagcccaccaccaaaaagcccacttattactaagttgactgccaagtgaggtcaatttgtaatttaaatctgtgctgcataatgcataagagatcttggtataaattattcacccgcaaattgccatctggacatttaggaaacttagtgggaaatctaaaagggaagtgggcatttgcccagcatcaccttagtaagcagagagtgctcttttgttgctgttgtcattttatttgccaggaacccaagcagatggataccatttacctccattttagaggcagggtgcggtggttcaggcttgtaatcccagcactttgggagtcccaggtggatgtatcacttgggggccaagagtttgagaccagcctggccaacatggcaaaacccctgtctctactaaaatacaaaaaatagccaagcatggtggcacatgcctgtaatcccagctacttaggaggctgaggcacgagaatcacttgaacccatggagcagaggttgcagtgagctgagatcatgccactgcactccattctgggcaatagagcaagactgtctcaaaaaaaataatatatatatatatatatatatatatatatatatatatatagagagagagagagagagagagagagagagagagagagtatgcagaccaaccagggggccagctacttactatgtttcctctcccagccccagatcctagagccaagctccagcttaatatagctatagggcaccttctttacaggagcttctcctgtctcccaggaacacaaagggaagttggcctactgctgacctggccattagcaaagactcccttccctttctctcatgtctatacaaagaactggtttctgctctcccatggctccatcttccctatagaaactcccctgaacagggtatcagagcttacaacagaatccaacaagaggaccactcatggagtttgctatcttacactagtccatcctcttcttaggccaccgtgctaactccatccattcagctaatcataattgaacatctataattatgattcaggcactaaggacaaaggggtgagtagaacatgttctctgttgttagggagttcacagaccagaagggtaggtgctcatgcaaacaaaccactacaaaacaaattagccctgatgcacactttgttctaggcacagggtgaggcattgggggatgtgggaatgagaagtggaataaatacatgttcaaggtcagtgggaatataaaggagctcatgatcagctctgcttgtggaaggagagggtcagggaaggctacgcagagaaagagatgcctgactgggtctataagaacgagtaggagttgccaggcagacatgttacacccacatgcacatatggggaacggcaagcaggtgagtgtacacaaatgctttaaggatcatgatgcaacccagcttgtactgctgggacaagctgaatatagactacatatttcctttaaagagatcagtgtgtttccatttgtgacaaatgattctcatacaatctttgtgaagttggaaggaaatggaacttctctcattctgtcacagcagaataattggaacccttataattccctcttcttaccttctgttaataatccacctttcatcagaataaaatatcattaccctaaggtaccattccatttaaaccttatggatcttcctaggaatcaagaaatcattgccaggctcacttcaccctgagacacaaatgagaaaaaaaaagaccagaaatttgccttctgacaaggacttctggagtcccatttccttcctgaggactgtaccagtcactgcaaatcctgaaggtttttctatgcagaagtcagaaagcaccaagtgatgcaactagcctgcttagggaggaggagtagagtaaaggtgttttgtggctgctatgtgtccatgagacacatcactgagcaatgactgaacaaatcagtcactttcccaaggccaaaaaatcactccaccatccttcatacctgccaagcatccccaacaggtgatgttcatccaacaccactgcccaactcccagaagaggacacagccttgacccagggcatctcttacccctgatctgtacaacacgtttggctcttattaccttcatgacggaaaggaaggaaggaaggaaggaaggaaggaaggaggaaagaaagaaaggagggagggagggagggaaggggaggggaggggaggggaggggaggatggaaggagggaaaggagagacagaagggaggaggtggaggagtgggggaaggaagaggggaaggtggaggggaaggggaagaggaaggggaagggggagataaacttcctccctctgtaatatctccccagacagccgtatctttccaccaaccatgacaagaaattgaacctatccaacaggtcttcagcagtttcctgcaaacctggaatgttccaggtggctgtgcatctaagagacattttctgttggtttttgaaaactgtttatatcagagtttgatattctttggctaacccctaagactctgtccaaacagattaaacactcaaaactttgaagggtttttctatgcctcctggacaaaatttcaagacttacatgatcaagtcaagactctaggtaccctgaactccaatttaataggcacttttggatggtactgaaagtatgaactcatcacaaagcctgcagtatagaacagagcacagcttcttaaggcatcatttctgggatgaaggctaaaaattgtctatcacagccagttagcctcaaagggagtctaaataaatcgagcccactggggagtctgtgaaataagacctatattaggagcaatcttttgagcatcatgtccatatgaagtaagaattctccctctaactggggcacaagaccctcttaagaataaaactttggatcatttcacagtaatatgactgtatcttagaaagcaatctagggattgaactagaaatttgcatgatactctcatttggttataagacccctctctggctgttcgtcactaggaaagcaattgcccacgggaaggtgagcaagatacaaggcattctcattatcacctccctctctgattaaacaccaaaatatgtttgatccagagcatacaaaatcaattaagagagttaacacatgtaaagcatgttgaatcctgaatcaaaattagctattatatcaataaaaataatagcttccatttattgagtatctacgacagggcagacagtaggttagcacatgtgctctctaatttaatcctaacagccaaccctgcaggatagtgctaactctcacattttacaaaggtaaagaaatgcaaattgtgttagtttctgccttgcttgcaggcctttgctaatgaaaagtcatttttacttttttataaagcactgcagtccatactaaggagcaaatgcagtcagcatttgtatatgcttgcccaaattggataaagataaaaagtcaagaagaaatacataggcagatacatttcctgaactggattttttttcctctaggatggacataatatagcgtggagctttctctacatcacttgcacatctatgtgggttacctatccactgctgggagatggctgtggtccacagatttgtcctgaagcaacttcagagaccctcgtggtgacaaatgtactactaaatccccacaagggtgtccctgaccaattccatctcctgatcacccaagtaattaagagggccaacttctatttcaaccactcagagaggatttaagaccaagagcaattggtgccattagtctcttgttgcagatgcacaagtctaagcccaggtcagctgtcaaacataaacatgcaagatccaacatgcaatcagtttgccacaccagccatctctccctgtgtcattcctcatgggaaacacataaaaacaaacacacaggtaacaaggcaaaaggaagaaggcaggcattgtgtgctcagaacttgggaagagtgttggtttgagttttgcccttgctaaaatgttgtgtcacctcacatcttacaaaggcacacagtcttgtccacattaatccaacagtcatctggacccacatggaccttgagcatccctaaagtcgccagaaggcagacaggatccgggatctcacaacagtgctgctgaaccttcaaaaggcaagagtacttccaaatatacccttcctaggatgcacccttaagtcaatggaggtgattctctctggaacattgcctcctatttcaggaataagtccagcatttccaaatgagtctgcgcactttgatctctgcagtgcctcactttatttctaaagggctttattttaggaagatagtcttgataataatacagcacagtgatatttggggttccaccactcacagtaactactaatttcttttccttccatctcatttaggtgcacatttctcagaagactgtctaccatcccaaagaaagctggtagatcagggtttctcaaacttcctccaaagagatgactcagagactgggactggcttcctctgggaagccttcactcaacacttcaagtgaattgatgggtcccttctgtacatgtttctacatatcctctacttcccattagggcattatcatatgatgtctgttatggattgaatgtttgggttccctcctaaattcacatgttgaaaaagaaccctagcccccagtgtgatgatatttggaggtgaagtgttcgggaggtaattaggtttagatgaggtcatgagggtgctgccccattaagggatttgtgtccttataagaggaagagaccccagagtctcctctcttctctacgtgaggatacagagagaagttagccatctgcaagtcagcaagtgggcctcaccaagaactgaatctgccagcaccttgaccttgaaccttctagcctccagaactgtgagaaataagtgtcttttgtttaagccacccagtctatggtattttgttatagcagcctgagctatgacaatgttataatgattaattatctctctatatgccctactagactgtgagctctgtaatgggagagataaggtctaatttactcaccactgtatcagagtcacctaacagggtctgggatataagaggcactaaggaaatatctgttgagtgagtggatgcatgggtgggtggaagcatgtgtacgtgcatagataaaaattatggttttaaagaatatcagacactagaggaaatgctttatggcataagtaaaaatgcaggaaataaaattatttaaacaatgtgatttcaattatgtaaacatttacacacgattaggaatctggaaggaaatatgctaaaaaatgctaatagtggtcatctgggtggtaagatttggatgacttgttgccgttgtcttcatttcccatgtttccacaaattgcgtatattacatttatgattcagaaataagattacatttttaaaaagcaaattactgagaaaaaaacttgtcctcacattttaggaggttttcacctataaaaacagggcagagagactcgggaaagaagtcaagactctgggtgagttcatgttcccagagtttaggagctcctgcctctcccaatttcccagaagcatgagggaccctcaaacacaatgattttacagcgagcttcccccttaagtgttcctctcagccccagccactcagtaaggcgagctgttcagagatggaggtggaagaaatgccaccttttgaggacagatccaaaactacgagggatcaagagaccagaagaaaaaggctgggaaggaattccacccaaatcttcagagccatcaagaccaaaaccaagagaagcacaaacatgttcatcaagcattgagaagttcctcccaaaactcaaaagtacagaagaaggtcactgctttaaaagtgacttatttaagggttagaaggggggtggtgaaattatagataatgacaataattgtaataaccactgcagtttaccatttattaaggacttaacacagacgtcagcaacctttttttttttttttttgagacagagtctcgctctgttgcccaggctggagtgcagtggcatgatctccactcacggcaagctcctcctcccaggttcacaccattctcctgcctcagcctcccaagtagctggaactacaggcgcccgccaccacgcccggctaatttctttttttttagtagagacagggtttcaccatgttagccaggatggtctcgatctcctgaccttgcaatccacccacctcagcctcccaaagcgctgagattataggcatgagccaccgcgcccggccagcaaacttttaatgtaaagggccaggtagtaaatattctccactttgtgagccatatgacctctcctcaactctgccattgtagtgcaaagacagctatagataatacatgaaagaatgagcatggttgccttcaaataaacctctataaaaacagacagacagggcagatttggcctgagggccacagtttgcaacccgtggcttaacatgggcaggcattgtactaagctcctgacttagcactaatttaattcccacaaccctcaagtggggaaactgagactcaggaagattaaatcacttgccaggctatactgtcaaaaggtggcaaggctcaactcaaccctaggttagtttgactccaaaggggacacactttttcatgaggttattcagcctcagaggccctcatgacagtaatcaatcctccttcaccacatgaacacgtacggagcacatctttgtgccagtatcaggctgagtatgggagatcaaggatgaataagatccagaccttgccttccaaagttcataatttgagatgggcatctgccctgtaagtacctacctagctctccctccccaatacaagtatgtccccaacagaataaaataggtccagggataccaaaaactcacaccacagacatgcattaaatgcacctcatttctttacaaaaggattttatgctctacacaagacactgctaagaagtgaccccactcagaacttgtaaatattggcttacacatccataagtccggagtgcggaggccaagaaacaaactgcagcctgagaagctctaccagaaatttactgtactgagtcacagttcagcttgatggttaagggcatagaacctgaagacagacctggactggaatcacagctctgcatcaccttgggtaaatgaccaacctgctctaaaagcttcagctacctcacctgtatacaaaagttaagaatccttactgtcctagagctgtcaggagacaatgtagggttggaggacggggactagatttgtcttatccatcatcatatcctcagcacgaggcagataccaggtgcaaaataaatacagggggataaatagaaatggagactttttgaaataacttcagtgaaaggaaaataggacttactttgcaaagaacctcccaattaaagaagtctagcactggaagcaaggtgcaggtgtcctgcagaaccagcctgggcaagccagtcactggggacaggcttgagatgcacaaatccatgctcagaatgggcctggtaggcccttctctgcaggaagcagggtggatggcagtaaaagtgagcagtgaggttcaggtgcatcttctgtttacccatctctacataaacagcctgagatcccagggccctgcacctgccccagcccagcccagccctgctgctcatttccccctagaagctcatctcctgcttctgattctaaataaactctgatcttattaacctccatcacatgggggagtgaatacccagcctgccccttcacaggcctttctgactgaggctgcctcactggagaaggacagaggttaaataccgagatttgcaagcagttttccctaatacctaagcaccatctgcccacctgtggctgcttcatcaacctcaaagctagaggcaatgatgttggggagcggggtgacgttttttgcagctgtcatgtgccaggcaccatggggcttaacactcaaattacgagtgatttatctgccagtggaaagctaagtgacctgatagaagaatctgcacaaagccaaagaaaaatggagtcatttttacacagcctttggatggggtagataagcacaaggctgcagaacaaagagctttttgcatgagggtcccacagccctggtgatacctgaatccaggtgacaggagcacctatagttctgctttgcctccacctatagcttccccacctaagacaagggcaatttgcccatttccctaacaaacaactacagtgggactgtatgaaaagggcaaaatctgaacctgcccccccgagcctatattgtgggacagtgcccaatactcactgcttacaacaccacagcattagctatcattttataccaaggatagagcaggatttaagagccaagacttggaattagccaaagctgtgtcctagctgaggctctgtcacttattaccatgtggcctaaaggttcctcatttgtaaaatggggctaataatagtgcctccctcaaagaggtgctattaggatcaggtgacttagttgcatgcaaactgctccttcatactcactgcaggacactgtcatctcctcatttgttgtcccagatggaatgtgagctcctcacagggaggattcatgtccaagtgcccagcataggtgctggcacacaatagggcctcaggtcatacttctggtgaggataccaacccaagcttgtgggatgcatctgcagaacacccagctttccacagctgctcccctgctcagtcatcccctctcctcccaggctgcagttctcagtccagggatctccactaagaccttcctgaaagcagtgctgtggccagtaaacaagtgaggagagccccagccattctgtccatccacacgggaatctctgaccaacttgaattaagttggtttcttcccagctgtctggcacatgcccaggattcaaaggttcaccttccaaggggcagttctggctttctcaagcctttctaattgagtcaggtttgggaggaattctagagtctactccagaactgacagaagcaggtagcctctcttccctagaagtaagtttctctctttaaatagaggactctgagaaattgcccctaaaaggaacaccaatgctggggcaaaccctctctttggagggtcttggttagtcagctaaaattctcccttttgaaaaaacaattgtgaagcaatctgcctcctaatccattcataaatcagacactcaagtcttagaataatttccccataattcatgttaatcattccactctcgtaatatgaatcatctgtttaatggaaaactttcaccaagacgggcaagagccactggatcttgctttaaaaatctcttcagagctcagaaggttttctattattgatagaaaagttactatatttttaacaggcactttaaatattactcatgcaatcaaagctgtttttgtaactcaacttacacagttttcaaacatgtattatgtttgaccttattaaatattctgtagtaccgcttacacacaacgacgcacaaaagtacagtaccaaaacttctggcagcactggaaaaaagcaaatcctcatgaattgcccaaaagggtgcagcaaaagctctgagcatggcatggactcccaaccagtgccatgggaggcagggacaggggacaggttcccagaagagctctttgccctgaagttcagtgagcaggaaacagacaaaaatctgggatttttgcactttagtcaagaatttcactgaatcttctccaagaatactcccccagtgctccaagaataagacagcactgttcaaccttattaagatccaggatgtcacataggaaacaagacaattttgatgttttcaaaatagaaaatttggagctgtcttatcaaaatctataaaatagacaataataccaaaaatagctaccatttactgaacactcagtaccaggcattgtgctaactaatgtaaagatagaagatcttgtttaatccccacaaaaaccctaggaggcaagtgttatcttcatttttccgacaagaaaagacaaacttgcctgtgaccaccccaccaaaaagtgacagagcaggctgggagcaggggcctgttggactccaatatctgtgccctaaatccttccaccaaacttgcctaggaggtcaaagctggagtcctgccccaccccacccactatggtgtaggactacattcaggtgaagtgagttaatgccatttaacactaaccaactgcttgtcagaatagcttagctgcttcgaatgggaagggctttgagtcctgccaagatataagtgattaagtaggagtttagtcaaaacagatgcggcaagggagtctctcaccggccttgtgaaagtcagaaccagagggaaaagcatgtggctctaagagaaggtgagagaaagagaacaggggatggatgctccagctaagtgtggaccagttgtcagcaaaacaagaaaagtatcagaccaagtaactgagaagaataacaaacaactatggttgcaatttttaaatacaaggccttagactgcttcaattgctgagccagagatgaggagacagagtgcactgtgacaactgagtcaaatggcagtgattccagtgtttttgttttgtcaattcacatgttcacatatcttaaagtacgtgaagtatctggattacacttgctttagataagccctggattcagggaactgagtgcctatagttctgctttgcctccatcaatggctttcctgcctaagctgatgcccttcctttgctacttgaagtgaaacactgacaatcaccaggtggcaacaactggtacaaaatgcatgattgacaagaagagccctggtctggactctccgtaagcctttaccatccctgaacagtcacacccacccctgcagtcaacatgccgcaagaagcagcgctgttgagcactgtgcacggaagaatatgaagttcaggtttacagaaaccaagtcactgagtatttctagagcagctccaggggttcaaggccccagacaaggcacctgggggacactttcctgtaagaagtttacaacttaatgaaaaaaatataaataactcaatttgagacatgcctcaggaacattaaatttgaaagcaggcatgcagtgaataaagcaaaagtgccaacacacatgatctatattccccatggctatcccatgttgagccccttctagctccctgtttttctttgcccacactctttaatgctgacccacataaaccacacatcccaacaaagcagctcaggctaaacagtttggaaatcccctgatgcctcttctctttcacgttggaaccaacaccatttaggcaccaactacctgctgataactgggccaagttcttgggatgctaacataaaatgggcatccctgcccccaaagtcagaggagctattgctttggatgcagaaaaagggctgtagccaaggcgagggcaaagggggctcaggtccacctctagttaggaaactgcagtggaaatatcagcccatatgctctccacaccaggcttcctcaccccacttatactatccaaccgcccccaaaaggcagtttcactatcacatgaccctctcttcaaagcagtttccattagattaaccctgatcctagaagacacactcactagcccaaattaatccaaccacattccccctcaaacatctgtacctaacagtcacaaagattgtggtcagctaattatggcttttgaaccagatgatgttgagccagagctgggagagttgtttccaggcatgaacatatgaaaaaacagccagggaaatccagtttacttagtgaagcagaataacccaagtggacaaaagacatggggaggagggttacaagttaaggtacaatgacaactggaccatgccacacagaaagggagcacagggtcctgagagggaacaatgggcacctgtgacctgctttgggggtctggaaaggtttccacaagcaagtgagacctggaggcagaatgggagctaactaggcagcaatgggagaggctgatccaggtagggaggagggcatatgcaaaggccctgtgcagccccaaatacagccagctaggctagaggacagtgtgcatgggggacacacgcagcatttcacacacagcttcaaggcatcttcagattgctagaaacctatcctggatccaggtttagaacccctgtcattatgcggcccttcctcccaggaagtgtcttgggctggcttttgtctggggctgctggccctgtgcctccctctcccttccccacagccctgtccccactgcttccacatctcccatgtgtctcccttcaccactgcacacaggactgtgtgttccagaggaacatgtggtccgctcccttattaatcttgctgtatcttattaaaatggcctcatgcctgcctggtattaatctgcacagagcagcggggttcgtgcagcaagctgcagctaggcaagctgtatttcatttcttttgtgttgaaggaatgacctagatgctgctctgtacaacagactcatacttgcaggctttaactcgttctttcccatccggcctggtgctcagatggaagcagaggtttggactcctaccatggtggtgtcagttgagctgacaagtaggctgagttggacccatgtgggaaagaacagcttgagacccttcagagctgctcctgatgacaaaggcaatgctccttgatgggtgggtgggtgtctggacagcagaggaaacttctctgggaatccttatttatgcaaattcatacacaagacatgagtgaaaggagaagttgagtgacttgtggcttcctccatctatctacctctttccttggttggtttccatcccgggctgtcatattcattcattcactgtgctgttatctattcaatgtctactctacacatggctttgcaagggacccaaaaataatgacagggctgtaagagatcctcctgaggagaacatatataagcaaaaccccaacaggcaatatccacacaggggtcgagaagtgccagggagacaagctgttatccccagattgacctgggtgtgccacttactaactgggagcttatataagcttcccaaagttgtgaactagaactaggaccactgtcttagctcgggtttccgtaacaaaatacattagagtgagtggcctaaacaacaggaatttacttctcacagttctagaggctgcaagtctaagatcaaggtgctggccaattcagttccgtggtgaaggccctcttcctggcttgcagatggctgcctcctggctgtaccctcatatggccgagagagagaggaagcaaggtctctgatgtctctgcttataaggacactaatcccatcatgaagtctacacccccatgacctaatcaaaacctaatcacctcccaaaggccccatctccaaataccatcacactgggggtcagagcttcaacaaaggaacttcggaggaacacaattctatccatagcaaccaccaaccccacaggatgagtgccgtgatttactgggatcccacaggtacacctccttataagaataagcctagctggcccgcttattctggtagcgagtgatgcaaggatggtgcctagggtgaatgtaggtagaattcgtctcctaggacctaggctgcctctcagcacactcaggaccaaccgattctgcacccttctcacccgctgcctacctctgccgagccagagcatgactcggaattgaactttttccctccaggggtatgaaaggaaactgaaaacacaagagatgtgattacatgctgagctggtcatcatgccacgatcagacagtcacacgccgaccgagtccggtgattttccacctcttaatcacgtccctgccagatttaaaatgcaatgaacatcaatgagaataaatgctaataaggctctaacaggcattggatgtcaagaggtgaggaataaaccttgcatattttgactgaaagggggtcaaagaggaaataactggatactaaatagaattcttctattcaagagaaaggctccttgaaaggcagctgctccaatgagtgacactcgctcattaaagaatgcatcattcaatgtcctgcggcaacagaaacacccaacccagtgacacatatctttcctggaatttagctaatgtggtaaagtcaccagcaaatttatatcaggcctaaatgaaaaagaagatccttttctgacacatgcaatcattagagttttagctgtactgagatttctctaagaaaacactgtggctttggaaatgttatatcacatgcctcctttaagcagcgttggcaaagttaatgcatttgtcaagcatctctgcctctccagggtcttgggaaagcctctggggtgaatgggcctcaggtccatgaatgcatcgtataaaatctgcctgtctgacacaaagggacagcctgagaccagggctgtgctgctctcacagctggtcacagtagctggccatgcctgtcaatggccaccatgtactgcactctggttccagaacccagttcagccctggcctgaggactcagccattttctgggcttatgccttcaggcttacaccctctccagtgtctcagacattctgaaatacccagtgtgctgcataaggtttcctgattaaaagagactcactttttgagttctaaggaggcagaatgaatagtgccacaacttgagaatcagactgacctagattcaaggctcagctccctcacgtcctggctgcaagatgttacttatgctaagttctgcttccctccacttaaactggtggggccagcacttgccttggagggctactgtgagcattaaataaagaaatacatgagaagcacttagcatagtgctaggcatatggtaagcacttcccaaaggttagctatttataactggcttcatgaaaacctgatttttcactccattgcaagagtcaaagtagcttggtaaataaataagcctctggggattctacaaagcagtttgcagtgagcagccatccctttaggtaacaggatttaccatgaactgcatacacagccttccattaccaatacaaatgaggagccaaggggatgaggattacttataacaccagagagccccaaatcataaacaacctcctaagaagttgataagtttacctcaaaccacaatccagatgtctccacccccaactttctcctcttagcttaggtttccaccctggatgataagatgatgatgacgataatgtcaatgatgatcatctgaggctttgtaaatacttactatatgccgagtaccaaactaaacaccattcatctattcacccatttaaccctcacagcaacccatgaagaaggaaggggctgttactatcctcaggtgagatcagcactatccaatagaaatataacgtcaaccacaaatgtgaaccacatatataatttgaatttctggcggtcacactaaaaagcaaaaacagggaacattcattctaatattttatttaacccaacatatccaaactatcatttcaacatgccatcaatattttaaaatattaatgatctttcatcctaaggcattgaaatcttggtgttttatactcccagcacgtcccactgtgagctagcctagtttcagctgctgagtagccacatgagcctggtggttactgtactggactgtgtaggtctaaagaatgataaaacaggaagaaacttcatcagttcctcatgtggacccaaacagtctgtgtccacagccaagctcctaactactgtgctcttcagtgtctcatttgctgaatccactgaaccccacattctgccaaccaataccctccctgagcaatagaagcttgatctttccttataaggattggatgcaaaccccttcctgcatgctgagggaaagtgtaaggagacacctgcactgtaacttttaaagaaaatatcttgacaaggcaccatcactaaaacttgctaaaaacgaccccagggtaagaaacagctaagaggagacaagcactttttcaacagcacccaactgatgtcagagggtaattccaaaactgtcacacacaaaaaatggtctagcactgtgtcagaaattccaagaaagggtaaagagagtgttaaagagattagatacaattaggtaaggattccagtgtaaaataccagaagatgacaatgctaagcacagaaaaatatggaatagaagaggagctaatacatacttaagtgggaatgggtacacacacttaatggagataaagaaaggacaagcaccaggcaaaaaaagcctggaggtgagcggccactctccgcctgcatctcatctcataaatcttcagttcttcctccaaggatgtagaaatgatagcagagaggaactctttgcagctacagtttgtggtatgatgacattgctatggtttgaatgtgtccaccctcatgaatggattaatgccaattctaaaaaggcttgaggctgtgagttccctctcttgttctctctgtgtatgctctcttgcccttccaccttccaccatgtgatgatgcagcaggaagtccctcaccacatttaggcccctggatcttggacttcccaaccttcagaactttgagccatatgagtttctattcattgtaaattacccagtctcaagtattctgttatagcagcacaaaacatactaagacaggcctaatgctaattacctgctaccaactgtactgtgagtaaaagtgcatttaaaaatcaaaatggcttgaaaagcctccataagattaacatgatcaacagggagtttcctactgagaatacctagagtttaaaaagaagatgaaaatccccaagcatgaaccatcattgccctaagcacaggactgattcaagacctctgtcagacaagggtgggtttcacctcctgccccaccaattcccctgcagcatccctgtagaaggatccaggacaggaatatctgcccaatgcctgcagaatcctggtgaagggccaagatggaagtccatcgccaagtcctctgccctgccagactgggggcagccaagacctggacctatgcaggtgagggtcctgaatgaccccacctggacggcaggtggcacatcccatgtgtactcggcagcatgctgggctcattatcacaggtacatataaacactgagctcaaggtaaaatccctctctctcatcccatcctttcaggaagggtctcccctccaactcttgtacaggaggacagttaccagcaggagctcagaatcaaacagacctggctcagcgtcttactagcagtgtgatgttgggtgggtcatttaactggtctgagccccaaattcttcttctttaatagaaagaatcattcattcattttacacatttatggagcccacactgttttagcttctggggatacaacagttaagaaaagaaaagaaaatctctgcctcatggaatttaattctagttaaaatggggagatgcccagtgggcagatcaacacatgtaactgtacctatctcataggactgtcgggaagattaaataacacatctaatggagattgcatgcactaaataattgtcacctattgttattacaaacagttataatagtaataactaatccttccagcaacacatgggcctgggtctgggcctggctccaaaagaccaatttggctggaagccagggtagaataaaagcctgaaagtagctccattcttcacatcataacctctttctggattcacgccacaaggacatcctgtcacaaagatgaagccccaggcagtctttatttagcagactcaataatcccaacaagcccaggtacatagtgaaaaatgggtatgagaactagagctctaggaggtccagttccactcgtcaagagagtgtcagccttctgccattcccatgatgagcgatgcacctgctgaccacaggttcctgcactagcagggaggagggcctcagaggcactccaacacgctgtggcatgtcacatcttcacggactggagggacagtgagggctgtgattctgctactgccatgaatccatggctttctgatggtgccccagggagtgctagggctctgcagaaaatgacactgactacagtgatgacagcggcgctcaccacaccatttatgacacccttgctgaggggaacacagcatgcagtgctttccttgcactgcatttcttaatgctttctagaaccctgcaatgtaaggatttttttttctttttttaaaatctccatctcacagataaggaaagtgaggttaagtaatttttccaagaatgtacagcaaggagaaattaggcaggcaggcaatccaactccagaagccaggtctgaaccaacaagctaaactgcttcacctaatggccatcctatagggataagagaaagcaaagaggctgggggctccaagccactctcccccatctcagttgcagccgttcacattttatctgtttcctatgaatggactctatatgaaatttcctttggaaaaaaagaaagatccactgctaatttttaaaaaaatcattggaataaacgatggccaacatcaaaagatggtttttgataagccaagctttaaaaaaaagtcaagaagtaacaagaagtaaaatatccaatcaacagaacagataaactgtagtaataaactcacaaaaaggaataaaacacagcaatgacaaacaacgacttctagacacaacaccatggtaatcccatagacataatgagtgaaagaaggcagatacagaagaatatatactggatgaattcactttatatcaaattcaaaaacaggcaaaatgaacagttggtgataagttagaactgtcattacccttgggaagggagcactgtctgggaagggcactagagggcctttggaagtgctggaagtgctttatatcttcatctggataaggtgataaggttacaaatgagtatttagaggtaaacatttactgagatgtaaaattaagatctgtgcactttttctgtacgtgtattatacctcaatagaaatgtaaaataaaaactcaaaaatatctcagtaaattatttaatccaggattctactgttaggtaagaataaggccagactcatttaagaaagagcaattgtgtctcctccttgtaaaaaactaaaaataagaatttttttaactccaaaacagaaattcagcatcaacaataaaacacttgagcaacagaaccggctaatgggagctttgtgctccaagtctgcacaggctatgcgtgacctccagctaccccagtccaccctgctggggagatccacagcttgattctcagaagatgtgtctgcagagaacaaagtccacgcctgccacttcaaaggggcttagaagaatgctcccttcctctgcgcctaggagcatcaggccttttaagaaggcaccatgagaaactcaaaagcactgaatgcaataaaactgttgctggctatctcaacaaccaagtacatgaagtaaaatgggcatacatgacaaaaggaagccaacagcccaccaggctttcaccacacagtagacaaccgcaggcatgcttgcctctaattatttccaggtctggggacaggtagggcctagaataaaagccccgggatccgcccagttacactcccagaaagcaacccagagccctgggtctttctagttccaagaagagagcagcacaagcacctcttgccacctaccaccctcctcctgcagacagcaccggctgccccgccctcttgtgctaccctgcctattaaaagggaagccggcctgccaagaatcacaggctaagtgtgctgggctttgctcagtgtcaatgtgagtggttttgatgcaagaggcaaaggagtaatgagagtcacttggtttgatcacaattgcactctgatttgaaatgcagttcagcaattacaaggtcctcagccgtagagctccccagggatgggggcagaggggggccttttaaaagggaaattatatccaccatacaaaggtttcactttttagctccttgtagaagattctttttcatgaaaaaccccttctggagctgagggaaaagaataagccttatgggaaaagtaactcctggacttatcttattttcaggctcttgttttttttctcttcatgccagtttcttctttaaatactgctgtatactgactctctgcaagctgtctccaacctttgtctatatagatgcatagaaaaaaagattagaaggtcaacaacaaaatattaacagctgttaagtatgagtggaaggaccatgggtgacttgtgccttctttttgtgtaccaatatgttaaaatagtacattaagaattttactggtatcttctgttcgtctgtttttgctgcaatatggcacttcgcttcctaactcatgaaggaaagaccagctttgaacttcctaaggtctgggctctcattgctccacaaaagagtaaacattattatttgtgggtttccaaatgtgagggaggaaccgacgggcagtggataagccctcctccaattttttgtcttcagtttgttggcccaatgaggcaaattaattgtaccagcacttccaaataggagagatgaaggtatgcgcttcaagcactgtatcaggaaatggccccacacaggttactgggcaaggcagtgatgactgagcttatggggcctcccctgggagaatctgatgcctctgcaacacaggactctgacagggtagaaatttgtgtggggaaagacagggaggtaccactgagacaggagcactcagtgctggaagctgcagagccttctggccatctcctcttcctcctgagtcttataaattcctcctctcaagggaagaagccttgaggaacacctgatactgggcttcttgtctatctcagcaaattatgcttaaagttgatttaactttagaaaaatattttaatgtgtgatgtcttactccccaagtatcaaggaacaatttgttcctgttattttttttaatctacaaggaacatgtactacttgtggaataataaattaagtttttggaagaatgcaagacataagcaattcaataagctgacagataaatcgtgggagggggccacttcttatgctcctgcatgaccatcagctgtagaaggattccggattctcttaccaggtgttcagaagaaaccccttgacattctctacaatggacaggttccaagatcaacaaatgaatcaaatcagtcctgaatggaatttcttgtcctaaagagaaatcagacaaggtctaaaagaaatcaggcaagcctaaatgcaaagcaggagacagagctggcagaaatgcaatacaatcacttcttccttttttttttttttttttttttgagacagtttgctcttgtagcccaggctggagtgtaatggtgcaatgttggctcaccgcaacctccgcctactgggttcaagtgattctcctgcctcagtctcctgagtagctgggattacaggcatgcaccaccacatccggctacttttgtatttttagtagaaatggggtttctccatgttggtcaggctggtctcgaactcccaacctcaggtgatccgcctgccttggcctcccaaagtgctgggattacaggcatgagccaccgcacctggccttcccttccatttcttagctttgttctgcatgagaattgctatgtgagggagactcagatgcttgagttctcacagctttacagctagaagaagaatgaagagaacaggtctagtaggaggtaagaaagaagtggcattggggatacaggtaggacaggcataacaactccagctccatacactgtggacatgccagttgatattgaaaaaccaccttgaaggttgagctaaatggcggtaacttgtctcacacatggatggctgcagtctctgagctagatacgctaatgaacccaaagacccttcatgggaatgaggttggaaaccccacctgagccagagaggagcctaagatgatgcaaagagctacacactgacagttttctttttgagcaaatcagctggacagagttccatggccataggtcagcatgcttggtaccaggcaaacatgcctggcctaaactagccagaccagggcttggcgcctgaggcaaaggctgttttatatagactagctagcaacaggatcacttacagcaactcagtttccttgtggggagtttgaagtggggcttgaagaaatgtgtcagtagctagagagagagaagaaagcagcatcagaggggtaaaaaggcaccagaaaggcaaactgctaggcttggagatagccatggagccagacgtaggaaatcactgctgtaccctgagccacttcccagggctccacggggttggctgtttgaaaggcttgcctttcatacaactaagactatatcttgagcctcttcatctcccctgggagccctgcagtgcaacccaagccacactcttctccaagagcctaaacactctcccatcaccagctaacctccaaggcatgtctacagggatggggggatgctgtaaactactgtgggccaaggagcacttgccaccctgcccccaccccacaatcccccaagcaaccccctccttggccctgcatggaactaataatgtcaggatcatgttttgaagccaccagaatgaaaacttattctagctttccatcacagaaaagacagaataaccatttgaaaagagtttcatcataatgattctattttaatctccttcaaacacgagagatcaaacatatacagatttatttttaccgaaaagaaaaaaaagtcctgggtaatatgcgaatgcatttctgagacatcctgtggctttaacaaaaaaggaaggtttaatgttcaaaaagatactgctcaagtaacaagatctcttaatacccacccccccaccccaccaccaccactcctaaacaccctgcaaatgctcctgagcaacatccattgctgaccagagggatttgggagctacttaaaaatcacacaagacaagtcaatgatttcaaactttactattgtctttgacttaacagccataaatcacacatgaaatcagcatctgacttgaatgtgagattttgctctgatgagccaagacatgcttggcagtgccaccacaccagtcaccagccagggcttgatgtgacaatagaagctgtaaggtgagtggggcttaaaactatcttctctttccaaagtccaaataaactcatctctcaagtcattcagaccttaggggtgcattaattcatgagcccccgtggtgatagcactaaaaccaattcccctgcacagactgaatcatcaaactaaatattgccactttaacacttagtgagtaagaattagaatgtcagggaagagctttccaagcattcatcattctccttttttccctctaagatattcatacagcaactccctaagacccacacctaataaactccagaccgacagcttggtggagcaaatgctgtgtgtgtgaatcacgctccatctatggcataatatatctgcctgccaccaaaaggactcactaagggcacaggcaggagtagagatggtggcggccgggggaaaggtgatgtgacaggttagacaacatccaaagctaaaaatgaatgcaatgcaacagaaaactcattaatgcaattgctttattggtgtagtcaccacaatagcttctgggtacattttcctatgcaatataaaggagacagaaggtaataaaatgatctgtgtgtatctaatgtatgagtgtgagcttctgaaaaagtctcttgcttaggaagaggaatgctgtatcagtccattttcacactgctatgaagaattacctgagattgggtgatttatgaagacaagaggtttaattgactgacaattccatgggcttaacaggaaacatgactaggaagcatcaggaaacttaacaatcatggcagaagatgaagggaaaccatcttcacatggtggcagaggagagagcaaggggggaagtgccaaacacttttaaaccatcagatctcatgagaatttactcactaattcgagaatggcaggaaggaaacccgcccctacaatctgatcacctcccacctggcccctcctgcaattcaacatgagatttgggcagagacaaaaatccaaaccatattattccatccctggccccttccaaatctcatgtcctttcttgagcctcttcagctcccctgggagccctgcaatacaacccaagctacattgcaaaatacaattatcccttctaaacagtcccccagtcttaactcatttcagcattaactaaaaagtccaaaggatcatctcccactaagagcctgtaaaatcacacacaagttatgtacttccaagatataatgggagtacaggcattgggtaaatgctcccattccaaatgggagaaattggccaaaaaaaaaagtggttacaggcctcacgcaagtccaaaactgagcagggcagtaattacatcttaaagctccaaaataatctccttttgactccatgtctcacatccaggccacactgattcaaagggtgggttcccagggccttgggcagctctgcagggtacagtccccatggctgtttcatgggctggcattgagtgcctgtgacttttccaggagcaaagtgcaagctgttcatgaatctaccattctggggtctggtagacggtagccctcttttcatagctccactaggcagcgccccagtggggattctgtgtgggggcttcaactctatgtttcccctctgtactcccctagtagaggttctccatgagggctccacccctgcagcacacttctgcctaaacatccaggcaagtccatacatcctctgaaatctagacagagtttctcaaacctcaactcttgtcttctgcacacccacaagcccaacaccacatggaagccaccagtgcttagggattgcaccctctggagcaatggtctgagctgtaccttggtcccttttagccatggccagagctggagtggctgggatgtagggcgccatgtcccaaggctgcacagaacagctgggccctgggcctggcccacaaaatcattttttcctccttggcctctgggcctgtaatgggagaggctgccacaaaggtatctgaaatgcctttgaggcattttctgcattgtcttggctattaacatttagctcctctttacttatgcaaatttctgcagcagacttgaatttctccaccaaaaatgggttttttgtttctaccacatgactgggttgcaaattttccaaacttttatgttctgcttcccttttaaatattagttccagtttcagataatctctttcttcacacatacgagcatatacatttagaaacaaccaggtcacatcttgaatgctttgctgcttagaaatttcctcttccagatactctaaatcatctctcttgagttccacagatctctagggtaggggcaaaatgccaccagtctctttgctaaagcatagcaagaatgacctttgctccagttcccagtaggttcctcatctccatctgagaccatctcagcctggacatcactgtccatatcactatttgcattttgggcaaagccattcaacaagtctctaggaagttccaaactttcccacatctttctgtcttcttctgagctctccaaactcttccaacctctgcctgttacccagttacaaagatgcttccacattttcaggtatctttatagcagtgccccactctcctggtaccaattttatgtattagtccattttcacactgatataaagaactacctgagactaggtaattaatgaagaaaagaggtctaattgactcacagttctataggcttaacaggaagcatgactgggaggcctcaggaaacttacaatcatggcagaaggtgaaggggaagcaaggaccttcttcacatggtagcaggagagacagagtaaggggggaagtgccacacacttttaaactatcagatcttatgagaactcattcactatcatgagaacagcatgggggaaatccacccccataagccaatcacctctgaccaggctcctcttccaatttgacatgagatttcggaggggacacaaatccaaaacatatcacatgcccaggaggacagagcatacaacattacccagcttaaacatattcaccttaaaaagaaagcctgtgatgtgacaagttctcagaaatttgattagttgctgggccaggactggttaaaatgatgaaataagtaaaaaatggcctttttgtttttccagtccctttccacaatctccacgtagaagagccagcaccaagcagccccctgagggccctgcctggtctgtacctcgtgcctcagaagtagtaggtaagggcgtggcctttggagtcagaaagactccaggttcaaatcccatcactgtcatttactgtgagtccttagattagtcacttaagagttaagccctcaaaccctttttcctacctataaaatggagacaggaaaatttatctcaaagagctgctgtgatacttaagtttaagaaaatcagggaaaaaaaaatcttaaagtcttagcatactgcctggtacttggcagggctcaacaaatggcagctccatttgcccttcccctccccacatcctgacctacccagcccttagtatctactgctggcctgaagagttggtctttccaaccacactagcagctaactggctagctgagtttcaactatgtctgttccccatgaagacgggatggaaacagatttgtggggaaactttagaagctaataatgatccttacccccaagaatgcagccagcctgtgtgaaaggctgaccttgcaaggtgacctagtcagggtaacttcctccttccctctagctagttaagatggagctgcagtgagataaaccaaggcagtctaagaatgaagagggcagtggcacaggctttggccaaatagatgcagccactgattgagatggaaatgattgatgggggaagtccaagaaacagttaactgcgaggtccctgtaggcccagaccatccttgcattgacagtctttccacagctgcagctctcaggacacactttcactctttcaggcattggagtctattccacctctttttcccccttggggagtcctgaatcatttgcaatttaaaatgaagctcccggtaaaactcagcactggctcccacctcatcagcccaaccaaggtcactgttctttcaaggaccacaaaaggcacacactgttttccctaccccctagaccaagcatggaggcctctgcttcctgctatgtccacagcctgtgcctcaaatgcccagtccagctccaagccacattttccaaggctgccctctgagtccccagctggcataaaccacatgggctctgttccaggcacaaggactgtcagcacagcatggacatatgacccagcaagctccctatggggattccacctgggcctctgtatacaggaggcagatgggtgcttgccctttgtggcgggaacaaggcctctgaggaataagcacaaatgctcacttagaattgacaagcagagctgcccagtgggactctgcccaaaacattttgttaatcaggttccaccatatctggaacccaaaccctgctctaccagtctaaagtagactaccctatcaaagctctagcttcaattcaaagctctagcactcaccaggtatgccaccatggacaactaatgaaacttccctgggtaaggtaataattgttttctgcagctgccatcacaaattcacacagacttggtggcatatacatacatacatgcatgcatgcatatgtatatatacacacatatacatacatacatatatatatatatatgtatgtatttttttttccccctggaggccagaagctcacaattaatgtgcccagcagagtccctctgaagtttctagggaattctttcttacctcttccagtttctagtggcacctgacattccttggttgcggcagtaaaactccaatctctccctccaactgcacatggccttcccctctttgtctctgtgtgtcaaataaccctttcctttctcttttaaggacaactaatcattggatttagtgtccaccctaaacctaggatgaaatcatctcaaaatttccaacttaattacatctgcgaagaccctctttctaaataaagtcacattcacaggtactggggattatgacttgaccataactactgtaggatggggggggcggtgcataattcagtcctgcagtgtctatcacataatcacatggagttatttagattaaaagagataatgtctgcagcatgctttgcacagtatcaggcacattgtaaataataaacattacatgttgcttttatcacagtcataatcttcacctccctctccaggaagccttcctaatacctcattccaaaaagaatttgaggcaattcagactgccactctagatcacaatcaccttaagagcaggaaccatgcttgttgatatccacttcctctgtattactaagagtgtgtggtacatataaaggtccgtggtctcagtgtcaagatcatgggctcctgtatcagatagacccatgcttggaaactggctcttctgcattgtaatgatgtgatgtcagatgtgtgaatcaatgtctaagcctcaccattaccatctgtaaaacaggaatatgaccagctttgtaggaatgttaaacacacttcagactttgcatacatagcaccaaagagtaaccagcaaatagtacatggtccaaaactagaataatgattcattattgtgcttgggaattgttttgttaaataaatgtctaataactaaataaatgaacaccaacagccactcctcctcacagtccaacagaggtgtcagatcaccatccacactcctgcacagacttctggtcctcagaggtagtgctgagattgagcccacaactttacctcctccacatctcctaggagtgaacaccccacctgcagattaataaaccaacccattcatccattctacggcattcactgaacacatactctgccaggttcctaccatctgctaaatgccttctgaatgttcttgagcagggatcagaaaactttttctgtcaagggccagatagtaaatattttaggctttctgggccatatggtctctgttgcaactactcaactcttctgcatgaaaactgccacagacgacatgtaaacaaatgagaatggccatactccagtgcaattttatttacaaaagcaggtggtggctaataagcaattacagcaaggtggcaggatacaaggttaatatacaaaagtcaattgctttcctatttgccaacagtgaacaagtggaatttgaaattaaaagcacaatatcatttatattagcacccaaataaatgaaatactcaagtataaatcttaaaaaagtacaagatctatatgaggaaaactacaaaactctgatgaaagaaatcaaagaattaaattgagagatattccatgttcatggataggaagactcaatattatcaagatgtcagtatttcccaacttgatctggagatttaatgcaatcctaatcaaactcccacaggttattttgtggatattgacacactgattctaaagtttacatgaagaggccaaagactgaatagataatgcaatattgaagaacacagtcagaggactgacattactcaactttgagacttattataaagtttccataatcaagacagcacataatagagaactagaaatagacccacatagatgtagtcaactgatctttgacagggaagcaaatgggtaaaaggtagtcttttcaacaaatagtgctagaaaaattggacatctacaagcaaagaaaaaatcacagactttacaccctttaaaaaaattaactcaaaatggatcacagacctatgtgtaaaatacaaaactataaaacccctagaagataacacaggagaaaatctagatggccttgggtttgatggtgactttttagatatggcaccaaagacagaatccatgaaagaaagaatcgataagctggacctcattaaacttaaaaatttctgctgtacaaaagacaatgtcaagaaaattaaaagacaagccacagactgggggaaaaatatgtgcaagacatatctgacaaagcactgtaattcaaaatatataaagaactcttaaaactcaacaataagaaaatagacaacttgatttaaaaaaataagtcaaagaccttaacagacagtttacagaagacatacaggtggcaaataagcctatgaaaagatgcttcacatcatgtcattaaatttgttttaatacaaataaaacaacaatgagatcccatacacacctattagaatggccaaaatccagaacactgacaccaccaaatgctgataggaactctcatgcattgctggtggaactgcaaaatggtgcagccactttggaagacaatttggtggtttcttatataagtaaacacactctcaccacacaatctagcacaagtgctttctccttggtatctttccaaaggaattgaaaatgtatatctacacaaaaaccagcacatggatgtttacagcagctttattcataattgccaaaacttggaagcaaccaagatatctttcagtaggtgataaactgtgatatatccagacaatgggatatttttcaacactaaaaagaaatgagctgtcaagccatgaaaagacatggaggaacttcaaatgcatatttctaaatgaaagaagccagtgtgcaaaggcttacaatactgtatgagcacaggggatttttagggcagtgaaactagtctgtaggacactattaatataatgatgtatacatgtcagtatgcacatgtccaaacccataaaatgcacaacaccaagagtgactgtagtaatgtaaactatagtctttggatgataatgatgtgtcagtgtaggttcatcaactgtaacgaatgtgtgacttgcagggatgttgataatagctcaggctgtgtaggtgttacagcacgggctatatgggaaatctctgtactttcctctcatttttgctgtaaatttaaaactgctaaaaaaaaaaataaagtatatttaacaaataaaaggcagtgagctatatacagtttgtaacccctgcttttgaggatacacaaatgagtaagatgcagtctccatacagtgataagaaaaagtcacagagagaagggacagtgctgagaatagaatccaggtttcccattcccataaaagctattgaactaagtcctaccttgtccacctagggtcaattaaaagtgcatttaaagggaaaaataggaacagttataccaaaacaatttgtcagatggcacagaggaaatatttataatacaaaatccaatcaacagatatgaagagtctgttcacacacacatttaactagtatttactgagtggatgagagtttcatctcctgggtaacagcattgtgctagatgctaactgaaagcacgcaaactatataagcacatggcagaccaagaaaccccactgaaaacagatactctttcaaaaattgtgccaagttcttgtgttctctgatggcatctccagggtaaggggtatgtggcgggagggagggggggaaatgatgttgaatttacaagacattgtataacaaaagcaaggtcacaaaactatgctctatttttcctgatatgcagccagatgtctagagtgtacaggtctatgatgacccgtaccatctcctgcccttgaaggacttcaacctctcattgaagtccacatggtatgatggcatgtagggccccaaccccagaggcacccctccagttcagctcaacagcatggatggacactctcaccttccagctctccacagatgtggacccagtttctggatgtggcattcacacatcacaccgaactagaagcttttagcgcctctgccagggctccagattctgttctgcaaaacaccgcaactgctcagcaacctcttcaaaacagtcaaaattaattttagacaaacatttaagaggaaaagaaaatctatctgagggatcttgccaacactcacagctgtgacactgacaagaaaagggctgcagaagagagaatttgccacagaccattcacttgtcatcatatacagcattttgcacaaactggcataatttaggtaggcaagaaaataggccaactacagcaaaacacctaaggctcattccaaagaccaatcaagacaggatgagagaggtacaaataaagcacactgccacacacttcctgggagatggtttttatcacaggcttacaaatgataatccaaataagacacataagttccaagtataacaaccctctttaaaatagcacagaagcatctccaattcctcacaagctctggtgttgcacaagactaccagaagggccaagagctttctaggcttccaagaacaccttgtcctggtcctgtctgtcccctcaggagctgatatgccctgtcctctgttgaggactgcctgcctttgtggatcccaaatgtttgaatccccactgtctaatactactcggatttgtattaagtttttgacaatacagtgcatcactgcacaaaacatccttcatcagggttcaagatgtcattgctgaagtgaaccagaagcaggagggacccctgactttgtggatttgacacatggtcccaacacttgatgaagtgatgagcaatccaaagctggtagtgatggcaagagccactgttcctgactaccatcatgtgctgagcttccacagagcacttgcaggtctgtcctcagcacagtgacatcctcatctcacagactaagagccacaaagctgcaagaggcagagctggtgttcacaaccaggtctccaagatgctgaggaacagatctgaatcaagtccctcatggttggagtgtggaagaaaaaccagttggccacaacatctcgagttccatgcagcttagctgtgttgtctctttaaggttctgatgggtacatacaggtttcagacatgcttgatggcattttatggggaaaatcctaggctactaacaatattaaccaattctgtgatgtgagtctgtcaagggcatattcagcatgcagggataccacccccgccccatcctactccacccacagtgtcctgtccactctggtccatgtatgtgggtgagggaggatctctacctccacccaggttcaagcagaacttcacattctttcttgctctgacataaaaattcccatgtctttgtcctatgttccctactaaaggaaatcctgtctcctcttctctctaaaagggactctgcaacctgggggtacttggggattttctatttaataaaaagggcaaaatacaagacaacttggcagtcaaaaatcccctatggtctgaaacaaggtcatggagaagtcaatctggggaaatcatgcttgcctggaagccgtatgtatctataagcaaataaaggacatttgttccgtggctgctaatgcaatgacccctgggacctgaacagcctcccagcctaactcatatatatttttaatgaaaaattgcaaattagattagcttaatttgaccacatctgcctttttaaataaaggaaattaccattttaataggaacaccatctatttgtcttgaggaagaaggtccttgtgaggtctgctttgcccgttctatttccgtttttaatatgagaaaaggggactgaggacagctgctcaggcttgaaaaacacacagtggttctcctggtgagcatacaaagagattgagagaaacaccagagaaatctccaccttcatagatgttctcaactaccagaggcaaaaagggtttccctctgcacattaacatggcctgtctcaattgccttcagaaaatctgttctgagcccctactgccagcaaggcatggtgtcagggccagcacttccagaggagttcaggaaagaagccagaggtcaactgtctgaaccaaggcctgcagttagggagtagctggtgggggggtgtggcaaatggaacagagctggcgggagtgtgtataaatatatgtatacacacacatacatactttaagttctgggatacatgtgcagaacgtgcaggtttgttacataggtatacatgtgccaaggtggtttgctgcacccatcaacccgtcatgtaggttttaagccctgcatgcattaggtatttgtcctaatgccctccctccccttgcccccaaccccccaagagaactgggtgtgtgatgtcgccctccctgacgtttctcattgttctattcccacttatgagcgagaacacgcagtgtctggtgttttgttcctgtgttagtttgctgagaatgatggtttccagctttatacatgtccctgcaaaagacgtgaactcatcctttttatggctgcatagtattccattatgcatatgtgccacattttctttatccagtctatcactgatggacatttgggttggttccaagttttgctattgtgaatagtgctgcaataagtatacgtgtgctggtgaatattgagggagggagtggctggatgaggctaaggaaacgccaggaaccccaacatgaagggcacccagcaatacaggctaccttaaggagaacagacttcaatcctgagggcaagggagatcaagaatcgttttattttcagaataccctctggctcctgtgtaagaagctgtaactgcaaatacagcaatggtgactaccccatgacagaatggggcttatccttttctcccagccccaccaaacccccgattcactcggtgcctccccaggtccttccacacgtctctccccgctcccctccatggtcaattcctcctcctcagctggttcctggtctgcatttttcacatgtcccctgggatctgctcctgcaattaggcctctctctcaagcatcctaaatcatctccaactgcttcctcttgagctcccagtctctacagcacagccttctcccctagccctgctgcccaaaacaaaggtcctgggcttggctgccaatctccctgagtgcaggctctaaatctgacactcacatactgccctccaggtagctatgcaacctgccttctattgccacagctccctgaaactgccctctccaacaccttcacactgacctccacactgccaaatcctagaactcttctcagttttcttccttgtggcttttcccacacttgaccataccctattcctccaacttgaaactcttctcctttagtctaaattaattctatccacaatatccacctacctttcaggtcactccttcactggctcaactctctgtttctaagtgtacactggcctcaaagctccattaccagccctccctgctgtttatatttcccagatcccccaagtccacggctttaccactgcttgcacccacagtccatagacatccaaccgcccaatgcatatccaacctcagcaactttacaatccccaacgccagcccacaacttgacttttatctacctttcctaattctgtccaaagtatgactcctatgactggaatgttcagttatttctataacttatctctgtccctcttttcttccatcgacaattaccaagtcttagcaaatctcactcaatggtatgtgctgctcccaggggtgatctctggagttacagtgaagggttcaggctctggagactgactgcatgggttcacacccagcatagacatgaggtgtctgtgtgaccttagacaagctgtttaattgctatgcctctgttttcttatctgtaaaaggggataatacgagtactgttctgaggattacaggtaaacacaatgagtttggcatagtgcccagcatacagtaagaactccattaatgaaagctgcaattattaatctgattgcttttgtccatcccttcctttccatttccttctaccccaggcctatacttgaattattccaatacatagtgacttggttccctttctccagcctctattcacccaaatgtgtgccaaatatcatttttacatttactttttgaggccctacccttattgtatcatccagcattactgacaagataaagtccagcctctttctcctaacacatgatgccctgtgactctcctctgctcatagaaaatgggcagacccagccccaacatccagtgctttctccacatcttttccaatacataccctttgtcttaaaattcctctgcccaccccctgcatctatagacacatgatagaattttgtgcagcaagcaagaagggcaatgaggatgtatattacagtagatcaattgcattaggggtcccaattcttcaccccttcctgtatgtacactcttggccatgtcaccttgcagagggcttacactctgccattgagcccatccatgtgacttgtcaacagataggacacaagcagaagcttgaaaaaacactagagtgtttcagctactgctcctttgcctcagccatcaccatgagaacatgcctgagctagcttctaggagatgagacacatggagttgacccagccaaggccatcctgcatcagctgacagccagtggatgcacaggcatgccaggagaccagccaaggtgagtcaaccctagctaactacagacataaatgcttattgttgtgtgtttcagtggctggtcgatttgcaacagatagctggtatatacatcaaatgacatcaagaaaagttcacagcacattagaaagggaagatcacagacagcagagcaataacatggtcccaactgtgtatgtgtgcttatgttcataggaggtgacacagctgcaattacatatttctaataattgttcaactaatgctaggctgtttcccagcctagctgacaatgttcttaagaaacagtatctgctttgtttaccataataaacttaagtgcctaactcaaggccaggaacattgtatacacataataaacactattaagtgaatgaatgtccatgaaagtgcatgcatccacagatctagagggttcacaccaaatggtaaaaagtggttatctccagatgttcaaatgatgagttatgttttagggtttttttttcaataagtattttctatttttctacagttaacatggatgacttatataataaagtaataagagtaaagtaataaatccttcaaaatgaaggttcctggattccaggcagaggctttctcagtcagccaaaccccaggcaatgcttccttctctgaatccttggtgtgcattgtcattcattcttgcatttttatttacttttttagtgtcattcattcttacattcttatttacttttttagataaaaactcctgatattaagagttgtacagtttactggtggatctttatctccaccggtagactgtaaaactctttattaagacttttacacactacacactacacagtcccgtagtacttaatgtcaacttttaaaaattaattcactagcatctctgaattttatgacaattctgaaacagagaaagtcctaaaattgttgtacatttgaagaaactgaggcacagtgagttgcttagtatcacaaaggacagcattataattcatcacaaggctggaatcaggtctcaaaccttgaccttttctccaatgttgctgccaccacgccttatagccttcatcagcattagtgctggtgaccacatgtgaagcctcccacaggctataccctttaaaggctgggtatgaatctcattcatctttgcaactctcccatctgaaccagagccttacatgcaataagtgctcaataaatattccctgagctgaaccaggaggcagagaccacaagaatgagaaagccagctccaagagccagctcttgtttcttccatgggagaagtgttataaagtgtaatagggttttaagatagtctccagagcagagtgagtctgtaaggctcattaaatctgggggtccttaacccaagacccatggatggacttcacagggtccatcaagtcctggaactgtgtgaaaaatactttttggatatgtacaatgttactcagggaaagggtaaagctttgatcagaattggagtccataactcagcaaagctgaggtccagcaagaccaagttacttctgcccattggtgcatggtggccaatgggcagacctggggccaaacccagacctcctcatttctaccctggggtcttctcttccttgtaggctgcccagcatgtggcatgtgtacaccaatgacatggtcccagaacactgcatttctgcagcttggaaggatggtcagctttgtagctttactggattttgttgcccgcagaccacaatgttttgtaagggtaaaaaatttctgacgtgatctggatacattcctctaattcatcaggaattcatacaaatgtcaggtgtgccaaagtaattttctttaaaatgatttatcagccatacgaacacaagccatcccacctgatctttggaattaaaaccacatttctcttcagaagggaataaaagtgcagtcttgacaaacaggacacattttcactggtctgggatgagctggtctccatcagggagcaaagtggtaaacaggaggacattttatcaggcctgtgaatcttccccacatctcatccacaccagatctggcacttgatacctggtgactcattcccaactgactgtgtttaataactaacataatcacccagctaccagccaaactgcaggcagctgctacattatgtgtgccctggaataaaggagaaggcagggctatggtgaggtgaggtggttgatggagcagaaataatgttcctgcaatgcagcttggaagagatacaagtcagttcctgcaaggcgtggagctgtattcttgagaggtgaggaggtaagctcagcgggccaatccaaagcatgctgtttatcctgggtgggattctatcctgcatgtgcacttaccctctgagaaaagcctagatgggaatagctaaccaaggtcattcacttagtttcctcccagaaagatcccaatcccccccaatacaaatagaaaggctacaactgcctactaatggcacccattcgtaactctgaatctctctccaacataagttacgtttccttgcagccaataacattactcaatattttgcagctttttgaaggactgcctcagttgaggctcttgggttccactatctagagacagatggagattttaagcctcagaacccagacaccaaactggatttggggttcctcactgaaattcagccagttctgttcctcaaatttcctgggataaaaaattccctccactaacctatctccaaaattccttgagtatttcttaacgagaagtaacatagaaaacaccaccagcaagcatgacaagtagctcaaaggcatttgactagcacagtgtttttcaaagtatgatacaactaaggattttggaaaatatacatatatttttatttaagtaatttacatgaaggtgtattaaacctgtggcttcaaatggattatcctttaaaactaagttaggggtaaagaggaattgattttttaaatatttctacattaattccggtgtctgataatgtggcaggaatcaggactgtggtacccacaaatctaggaagcactggattaggtatgagactggagacgcctgcctagtgcacctgctgcacctgcagctacctatgagcacacatctaggttgtgattaggggaaggcaatgaacattctctggttatctactctgtttcagaagccatttatgcactgtctcacttaattttcctaataaccctatgaggtaaaactcagcctcctcattttatagccaggagaaaaaacccagatacattaagtagttgtccaaagtagtatacttattaatctcatgtgcattgagtgacttatctggccttgacatgtggctgaaccaattcactgccacccaagagagggtgtctcaggggccatctatcccccttaaaaaatataacactaagaactcgctctccaaagagccttacgcgtttatactttgaatgcttaaaaaaacttttgcaaccatcaacacctgtgtaccttgtggtattacttgaaacagggcccagagatgttgagcaagttgcccaaggtcactcagtaagtgagcaattgaggcaggatcagaactgagacttccagattcttggtccaaaagctcaacaccctgctccatgatcccaccatgatgtcaggccaaagagtcagagccttaccaaagaactcatccagaagtgggatgcagggagctccatggatgaccctctagaacagcaatggcatcccacctagcaagggctggtccaagaagtgagtggagccacgcacactcctcctcgatgtttgaggactgggtatgtgtggatgccagtggtgatggaccgcttgctgtcatctcctagagatcaacatctgggctgtacatgtgatcgtagtttttatttctatcaaacagagctttccagctttaccttcctaactggatcataaactccttaaaaatcttaaggacagagatcaagtctgtccttctcttcaccataagctcctctcctctcatagaggcagccctggatgtcaggtttattcattgtcctctcgctcctcacaactgtctccttttccttgccaacactgggtcaaattgtggactttacctgtctgtcctctgctaaagaacagtggttgagcatgggagctctgaagagaaacttcctaagttcacttactagctcttgaccttgagcaagtcacttaccctctctgagattcatgtccttctccatcaagtgagaataacactaatacagactactcagggctgcaaggggcttaagtcatttcagctggctctcacatattcaagattcagctcaaacatcgctcccccaggaagccttcttggacacacccaccctcctgtccacagaggccagcactacactcagcatatacttgatgcttagtaaatatttatcaagtgaatgtttgaagaaaatttcccaaagaaaagagaatcatcagaacctaaaagaaggaagatgaactactaggatggcgatggtagggtcaatcctcggtagcctggagagactacccaggacaccgtctgggccataccagccagccacaccatacaggaggctgccaacaccaccgacacctgagcccattccactggcccacaacacttccatgaggcctgccagccagcctgcctgccatttctgagcatctgcaaaccttagtgaggaagcctcattagctgatgggttgcaatgaggtggcaccatgacaataatttgtgactttgaaataattggtgcctagagactaagtgttcagtccaagataaagcggcatgaggcagaggcagatccccatcaccctgggagatgggccagagaaacctgaactgcaatccatcctcagcttccccaggaaaagcagaatgtaatgtgattgtatctggcattaagcaatgtatctggccttggatcattaacttatatggttcacgaaaatatagtaacaagtttgaaatatttgcttaatttatctctgactcaatcccttcaagcagcttctgataggatatgcagaacacattcttctctcaggaagagagaaacaaatctttgggggaattatgagagtaaataaagcaggagacacccagagaccacagctaaacaaatactcaacaaatctaattgattctctaatttgaaaatttggcagattaacagggttttatggtgattttatggataatatttccataatttcttcctagttaagtgatcgataaaatctaatactataacacttgtttattcctgcaaatgaacaagctgcatgaaaaatactttatggaagatgccaaatgcaccagcctaccataatctgcagcccacaaaacagggcagagagactaacccaataggtatacagcatgcaccacgccaattggattttccaaaaacctgacactgcaagcaactagggagaactgaagagggccaaatgaattggagtgaggaggaccatctgtatacaaatgacaccatcctaaagcttatgcaatgaaaggcaaggagatagtgcatgccacccaaaagataggcacttcacatttatattataataagccttttatttttcctgaaagttctacttttcgagtcacagtagcctatgtagcgtgccaaaagtaatgccagaaaagttttgaaatatgtcagcagtggggacattaaggaaacctagtaaccttaataactaatactgaggactaggcattgcacgtggcaagtttttgcaggcatgagctcatttaattctaataaacctactaggggatatccagggcacagcttcttcactactgggctatattgcctctttattgtttgttgttgttgttgttgttgttgttgttgttgtaattgctttattgaggtatgactgacatacaaaaatctgtcagcgtttaatctatatgacttggtgagtttgcagataagtatatactcatgaaactatcaccacattgcctctttaagtattaaaaaaaaaaacaacctgtgactttgtctccatcatcgaaaacatttattccatgcagagattgaccaccaccaccacagctcccagccaagagatatgggtgaaccccaaagaccagtgtagaccagacgtttgcacgtaaagagagacctcaccaacacagaagaaagctttgtgcagtgattaaaagttgaccttttcaaactatatattttttaaattgattgcttttaattgtaaaaattattttttaaaaaaaaactagtaagtaaacttaggaagtctctcttcagagccctcctgttcaaccactataccttaacagaagacagacaggcagactccactatttgacagcgttggcagggaaaagtgggagacatttgtgggaataaagaaaccactaggcttgttaactctgggagagttaaacttcttttctggacttgctatctctgaggtcaacatttcctgaaaataaacagaattgctatttaatctcaaagttttctaccctaaagcaggtctcatccaccaaactgcagagaagctgattcatctgcaaaagcctggcttgcacacatgggcgttaagttaactgggatattcttgcccctctgcagtcagtgtgtgcatcataaggttgcgatcactgtagcttctggccagctcgagtgatcaccagaccatagtgtggaagaggacagtattccaagtacagcctcatacaggctgattcttgtagcctgtcaccacaaacagagactgtaccaagccagcctatgcagactctgcagctccccaggacaaatgcaaatgacttaaagaaagactataggagtcttcgcagagaaggggctcaagccatctctgtatgggaacatccacaggtagataggagaccactgaagtcttccaggagactacgtagagtctctacccacatgtacacctgagagaggtctcatctctccctgttcaccccacccagtcagcacagcaaatctgcaagctatgctgtatttcctagaaaaaaagtgccttggatcataatatattactcctgctttgaggaaccaagtggaagaactctccgcctaactagtcttcagggttttatggagtactgtggcagtgtggtcagcacagttgccatcaaatggtccttgcagggccctcagcacacacagcactcagaactttagcgggcccttgagaagacttaagtgcttctcccagccaaggagctcaatgctgcatgggcaaacacccaaacacagatggtccaaagaacagctggcaaggagggaggaaaagtgcggatcagagaaaagaaaaggccaagctacagacaaatcaggggtggttcccactacccagagggcagctcttccacagccactttcagttttacccagcagagcacccgctggaaacccctctcccgcccaccccttcatgtgctgcctttgccagagccagagtcagtggacaagcatggggccagtgcacagagagggcctgtctctcaacaggggctatcaagcatccttgtaccaaatccaacatacaaccagaggcgagaaaccaggggtcatccctgatggttccagcaggtcgagtaataatggactaagtcatcaagagaggtgtacaccaggtcccactcatggaaacacttcaactggaggaaaagtaatagtgcttaaggagtttatctttccatcattccaacagggacaagaaagagtcttgtggggggcagggggaaacttagcaaaatgatagctaataaaagctaaaatttactaagtgcttatcatgtgctagttttatatgcatcatcttatttagtcctcaggttgaccctatgcagcaggcactattaacattctcatcttaaagctgggtatggtgtatggtgggtgtggtgtctcatgcctgtaaccccagcactttgggaggttgaagcaggaggatcagttgaggccaggagtttgagaccagcctgggcaatatagcaagacctcatctctacaaaaaaaaaaaaaaaaaaaaatgtaagtttaaaaaaattcactgggcacggtggcacacatctctagtctcaactacttggaaggatgaagcaagaggatcacttgagtccaggagtttgaggttacagtgagcatgatctcaccactgcattccaccctgggtgacacagtgagaccctgactcaaaaagaaaggttgggaaatggagggtcaaagaggttatataattttctcaaggtcacacagcttgcaccaaggaaaatctgctcatgatacacatatgcgtgatgtgcacaaactccccacaccttctctctcacccacctctccttgggtccctgcatctctttcttttaggggaaagctaaaggtgtttttactcaagaaagccttctattttgtctaagatatcaggattttagtctcatgtttctctgtaaggaaaggggcactttgaaatgatgcatttattagtgttatctcagaggcattctatctccctctcaaggagcaacaaggagccccatctgttcatgcagatttcaccttcaggccagcaccaaaaagccagggaagacaggttacaagtgcaaacctgtcgtgtcttgaagaaaataggcccatttatttcagttcccctgagtcagaggagttttcatttgcttcagtagaagctgttaggtttctcttggaaaagctttcaggaaaagatacaaccattgtagatactctagttcatcggaggttaatatgcttatggcattataacaaaatagacttgcacatcttcccaaaaatgaatttaaattatggaagaaagcatttcacagactttaatttagtcagcatttttaaatgtcatttcttattgacaaccatttggagtgggaatgagatgtgttttgtgtcacttggctgaggcaatagttggcctatatcatttcatctttgactgaaattaattccttttagtaagaatggcagtgaaaatctcaacaactccattaattacacatgacggtgtgaatgctggggttgcaaaagcagcccccgggggttagacctcaacctgctccccgccttcccagaagggatatgaaaaccacagcccagtaaaacagctctttgaaatcacgtcatatttcactgagtgaggggaaaatatctgaacccaaaatggagtttctaatgaaatctgaaaataagaaaaaatatgtttttaatagcattgatttagatttaggaaataattatggatcctacacagtgcagatgagaggcacaaataattttacttaaagtttctcctgctaaatgtgaaatacagtcagtgtgggtcaggaccttcttagaactattgatggcttacagagttgtgagaaacctcagagaattctccaaaacaacaggctcatctcatagatggtaaaactgatgctcagaaatgtgccaaaggtcacacagctgatgacttcagaactggaaccatctaaacttgtcccttcaccttccttccttccttctccatttactccttgctttatttgacagatacactggcaccttaattcccatttacagagaaagagataaaagagctaggagaccactacggaagatgatcaaggaaaactgctaggattccggccctcacacctccagttgagagcagtcacgctgcactgcctctgctgagcttccctgctgggcagtatgcacccagatagaaagacaacctccaattcccatcattttaagggttaagcacctggaaacactcagaaaacgggaacatccaacaacacatatttattaatagccactctgtgccaggcatgtctcaagatgcttaggataaaatggtaaacaaacaaacaaaaaaatccttgccatcatcaaattcacattctagcagacagaagtggaaaataagagacatgataaagaaagcatctaatgtgttattagggaataaatgctatgggaaaatgaaactgtacagcaggctgaagggctgaaaaatgcaggcggtagggtgtggccaggttgtagtaataaatgggatggtgagggaggcctccttggtgaggaagtgagagaattggccaagcagatatctagagggcatccaggcagcacgggcacaggaactaaggtctggcttgttcaaaaaacagcaagggggacggtatggctggaacagagcgagtgaggcagagaggaggaggaggagatcagcttggaggggtaacaggaggcctgtcatgacagcctgcgagacggggtgggtactttggcttttcctctgagggaaatgggggcccatagcaaggtttggagcagaggagtgatacgctctgacttaaattttcaaaggcgcagtctgacttctgtgctgagcattgactcaggctgggaggaacagggaagatgcaaaggtgagacagacaggcctgctggtagatgtttgtgtcaatcccgaccagagatgttagctcaggccaggatggtgcagcagagttgacaggcaataactcactgagcgtatccacactcactgctctgatcctggagtcaccaactcaaatgcgcatatgtggccaaactgataaattaaataaacaaagaagatcaggtagaaacagaaaaaagctgcacggcaagtgcacaccagccccgtcagaaggggcagctgctacgacagccaactgtctccaaaagggatcatgggctggtgtgctcaagtctgaggattttcccaaagaatcaggcaatccagatgtatggatttttagatgtttttagatgtcatcttctattttttaaatgttaacaactaattcaaaatgactttttttttttttttttgagacagagtcttgcactgtcgcccaggctggagtgcaatggcgcgatcttggctcactgcaaactctgtctcctgggttcaagctattctcctgcctcagcctccccagtagctcggattacaggccctgccaccacacccagctaattttttttttttttttgtatttttagtagagatggggtttcactatgctggctaggctggtctcgaactcctgaccttgtgatacacctgcttcagcctcccaaagtgctgaaattacagggggagccaccgcacctggcctaaaataacattttaaatatcgttggtacaggccaaacaaaccacatcaagccagagttaacccatgggtttgtcacctctggtgctcccatgctaattagtttgatgaatcactgaaaaactagcctactgatatataaagaaatacactgcatcagcaccacccacaaagttacgtttccaggtgcttattagtttttatgtttaaaaatactccatccttccattcaaatctggctgccaatgcagcaaacattcataccaggagccagcaggctgaagtcctcccaggtgatgctcttaataaatatttaacaattaggaaaataaagacaacacaaccgtatcaaagatgcacgaagtctttggtcacctatagcgccagaaaatttcctgagaaaccccacctaagacaagcttgttacaaagcaataggtgcagagatcagaagttattctgaactaaaagaagctaatgtctaaattcatcactgtttaggtcaagaaagtgaaatcaacctgaaatgattttgcaagcatcaaagggaaggaacagggaatcccctcatcaattcatataattactgacagctcacataatgagcttatcttagtcccataaatcggctgaactgcaagttattaagtctctgaagggagagagcttggggtgcacttcctgggagaagggccagaggcaggaggtaaagctggctgcccgtttctcctgtgtcctattttccagtcagaaacgagggtcctcctgcgggtagcccagggctgaatgccaggcaccaacttcaccgtcccacctctgtcaccgtgaataagccaagaacgggcagacagatccctactgggccatagagggctcttcctgtttctccttcccgagtccatctgagctccagatcgcccccagctacacaagtgagaggtaccaagaagaacaaacccaccgacaacatcgaaattgcagagggcaagggaaagagaaaaggttggctaattcctttcccagtctagccaaatatttccattcctaatttaagaggatattccttgtggttagaaaagtaagcaagggacctcagagctgtgctgtggatcaacagtacatcttcgccacaccatccgggaactcagaccaggcaaacagaaccatcccacaggcttcctgcaatggccgagtctccacctctcctctgttcacccatttggcccacgaactgaggggaaagagaaaacagaagactgtggctggaaggcagcctggctctgtcacaccttgattcagagtccccaggcaagctgtggctctccaggttgctgtgacagtccagctgagaggacatcccaatttctagggagtcaaaacaagaagctgtaggctccctgctagagaagcccagcctcctacagaggctcaccactaacagatacttatagcccaggagccaggcatccagacaggggcagcctctcaccaggacagtcatacctagggacacataaaagtggtgtcagcccctagtgcttgacgccagtgccaaatgctgtaggtgccaaagtcatcggaaggaagagattaattctaggactgaggtgtgtatcaatgagcaaggactcccacaggagcagtaaggccaggcaggagtagatgcatgcccacgacattgaaggcaaccaatgggcctgggggtctgggcagaacaccaattttcagacagccttaccttgtcaacatctaatggcttgacatgcagtctatcccgagcactggatgccaaagaactgtcaccatcagcagaaagcccatttggattcaaagcttctgcccttctacttagaagtctttcaagagggcaacccttcagaactagagaagaatactgactacatgccaggcactgtaataagtgcaatgcacacatttttccatttaagtctcacagcggccctcagagggaggttctatggatagctctagttaggggccaagaacacacactctggctttaaatcccagctcctctactttctaggtaagtggcattgggctagtaaatgaacctcaccccagtgttcacacctgtaaaatggaaataataatagcatttgccatgtaggactgttaagaggactcaatgaattattcaagcaagtgcttcaatagactaatatgaatgttcacttccattagcttctaccattataattttatattgaggacactgatgctcgcaggagaaagaaatctgcctaaggccaaaaagtaagtgagtggccaagctgggtcttgaactaaggtcttgcccttaaccactgtgaggcattaacagcatcctggaatgctgctaaaacatggctgaaataaactcagaaagaattaagagcttaattatatcagtgaaatatgtactgcagcaggacataatttcatggtctggaaaaaatagatataagatttttacttcaactccatagctgtcactttaaaccactgctgtccgaggagaatgggcaattttagagcaattgatcttttttctctagggaaatgtgacaacgctgtgctctttaagctgcacttcacagctggggagaaacttgggaagagacaagaggcagagaaagagcagcactaacaggcttaacccagagggcaggatgttatgataaaaatcaaaccttcctgagacacaggaacccagggttcttgcagtcactcaccagcttggtgtacctgagaggggggagtggtgatcagattaggaaactattccatggtagcattcggtagtgacccaggaatgcttaaatcctgcctgagcccatattcccttcctcaaggtccctgtaaaaaatatatataagacaaaagcagcacaaaacaccacattcttgagtccaaaccccaacataaaatgccagtgattcaggctagaccatagagagaactccgatcacccaggctcacataaagaatctcattctccccccaacacaaaacagaacctcaagtctttctgctctgtaagaaaacacaagccactgcgcacctatcagcagagccatagagacagagaacatctgaaacctatgtcaggtcacatcatttcctagattaaaacccattggtgctttcccctatgcctagattgacatcccagtcctgcttccaagccacagggccctgcagggtctatgcttgctggctgcctctcccgcccccacccccactgctcacttggctccaggcacaagggcctccttgcagcccctgcaacagaccaagctctgcactacctgggactctttgtagatgatatttcatctccctggaagatttttttcactgcatcttgacttatttccttcacaacacttatcattaactgaaaatagatgatttatttgttttctggcttaatgtctgtctgttagttctactagcccacaaggcccatgagaacaaagaccttggctgtggtattcagtgctgtgttcctgacactccccatatattatagaagacagaagaggctaggtgtccctcaaccccaccatggatggtgagtggtatggtcttaccatcagatagtcaggagtggggatgtggaggggagagagacagacagggacatgtttcctctcatataggcccaaccatgatgcccagcagactgaggctgaagaagaaacaccacagccctttgctgtgatcattcctgccttgccagtgccacctctagcatgcaatacctcctaagtgcccttgaaacacatcagttcttgccctccttctcagggataaaaagcttatctttgtctctaatccaaacccattcttgagaaaaagtaaggggaaaggggaacagcttaagctcctagctgtggccaacgtgaaaggaacatgtttaccctctctggaccccatttactttattttttttaactgcataactcttaaggctacctgcagctcattttctaatgttatgtcatggtaaaggacaccagcctccaccaacagccaattccccctggaaatcagaataagatgtcaaggaaagaacatgagacagaccaggagcagcccagctccaccacttactagctgcatggccttgcccatgcttcttagcctctgggagcctcaatttcctcaaccaaaaaaatgggaggataactccactttcctcactgggtgagtgggaagacagccctcagcactgtgcctagtgctcaatttatgtttcacgaaggtcagtcccatctccctcccaaaccccttccccaaacacacattttagagcacagcctatcagactcctgggaaagaaatccaagtctgaaggaatccaggccacctccagtcccccatacaatctccaaagtgtcatgaccacccacccctgactccatccaggaagcacaagatatggtccccacctccccatcctcaaagggggttttccctttctttatgaaaagcctggaaggaggcaatactgttagaggcattgaaagtgtctgtaccaatcctatttgttatacccttcataggagacataagcttcataaccctaggcaggcaggctgaaccaaagccatgggtttggggaatcgcagatccataggcagcatgcaggtggagagggaggctgccatgggataaggctgaagagtgctgggctaaaggaaatctggaggaggaagtctggcctagcatctcagagcacaggatctagagtcagacagcctgggctcatatctcaaatctgccatgtgctagctgtgtgtcactttctgtaaaatggcataatgatagtacccatctcctagggttgcccataaggattaaataaaattagccttagcagcattttaacacatgataaattagcaatacttggcacatgatgaatattacatgggtaagaggcacatggcagctgccatgggagactagctattgtgcccacaatgattgggttgagaaagttaattttgttttttggttttgactttcctatgtttctgttaggttagaaggatatacataccagaactccattccttccatcatttgacagctattatatgctaggctcactaataagtgctgagcaaaatagacatctagcccttagggaacctatggttgaatggaaattcagtttagcttggtttagcatttaccagctacctcctatgcttcaggccagggctgagtactgtggtggtgggaaggaatgcccaggcacatcagatatggtctagcaatggccaccatgagccacctcccactgccaccacatagctggcctgggtcccagctgtctcctcaagctgtgaaaacttcacattctcccttagcttcaccacttcccaaatcatcacaccacagaccttattatctttgcaagccttcccattttatgcctttattatcatgctcctgatattcggcattcacaggcacttaatcaaggtgctctgctggtttattacaacatctttcagctgatctattttcccttatctagacactccaccactgcctgttagtgtttaaaaggatcttcctgaggtatcatttgacttgttcctgatgataattaattttaagaactgatcaagatgttaaggggaaccagcccttggaaactgatgaccatgtaggtttatcatgacaacagagcctttttaagatgttatgagcaggctggctgcaggaagccagggaaaggctgtttgttgataatcatctcattggctgcatggatcacggctgtcaggttctgttattggtttcattattccaaacaagttccgttctgtgccctttggataattggcccagaagatatccctgcattttaataaagtcaacaagtattaaatagggactgcaccccacgccactggacagctctctttgcctatggcatatcacaaagattaggcaagcaagattcacacctgtgagcatgagctcgagttcagaagggagtgtgccacaccagctctccaatggacaccacccaatgcacagtcagagacatcccatgcacaaaggagacctgctttccctccaaggaggcccagatggagagacaggcagcaatgcactgggagggaggaggggatgcaagccacagaaaaggcagaaataccaccttgagaagagcaccaagccttgcagatgagcacatcaagtttggggacctcaggaaagtttgtttcctagtgtcctgctttagataaactccagaagcaagtgacaaatgcccatgcttctcaggaccagtggcatcatgggttccagccagaaggtctttacttggcaccctcttacggaccgggcactgtactgggccccaatgaaaatacagtggggaaaaggacaggtgcagtccctgccctcacaatcctatcacaatacaatggagtagggtgcagtgtgagcagctggaacagacaactatttaacccagtctgagatctagccaagacttcccagataaagggagctctgagctaaggcctataggatgggacctaattatccacagaatgaggacgggtagagagatgagcagttacaagcaggaggcaagatggagggtgttctataggatcacagcaaacacctgaagaaggggagagcaccagtgatgaggatggagggagaggcagggccaaatcaccaaggaccttgttgggcatgttgagtttgggcatcactctgaagttaacaaggagccccaaaagatttcaagaacagtaaagacataatactattggcatttgaagacaatccctctgagtaaccaatgtgatgttctggaatgcaccttggactggaagcaaagagaccccaggcttctttccactctgccacttcccagctgtgtgtttttggatgtgccacctcccctcatgggcctcactttatcttctgtaaaatggggttaacaacttctgggtctgtttatctcaccagggccttgtgaggctcccatcctgcaaatgagagcatggcaaagtgcaggaagttaaataaatgcaatggataatgacagctctcccaaataccaaactttcacttcatcccatagcttcaaccttctccaaaaaatttaaaaatctatttagaccttgaaaaggaaaatgttgactgtttttccactgcatttcctagccctcacctacgcagtaaagaaaaggtccgcgtggctatcacagcagccaaggcgaaagaagaatgaggggagagagacactctaggactctgatgcagagccctcggactccagataaacaatccacccacaatgtgaagagttgaggggaagagccacctgtcatggagatggactgcacgagcccaatgcaacagtgtcctcatgtattacttctctcaccagacaatcattttccaggcccacaagccccactccactcagacaaaatctctaatttgtcagagcacaggtttgcactctgcaggcccattctacctcactgacaaggggcaggtatagagctcctgttggcacccaatttctgccagctggagtgccttatgccaaaatgaacatctggcaagcctatggaagttgagccacagtgaaacattagctgaacttcccttctacagctgacaggcctgaaaaaggcaattcatgggagatggctaagtatgggtagatgttttccaagtaaaatgtgtcaccttgaaatgtcagtgaatgagaaaacaactgcatagctgtccactttggtttagggagggacacaatggaagcgcagggtcactgtctgggaaacatcattcctaggccaaatgaaaggaaccaggttgacccactcagagctcctgaagctcagaaagagaagcagtccctcagacagaaagagaacagtattgactccaattcccacctcagaagaagccttggaacttcagtggagtcttcacctgggcctgtgatccaaggcagggactgtgttgcccttcacaggcctcaagaacaagtgacagagatgttattcttcaaagctaataaataaataaagcaaaataaatgtgcaggaatgttctctactgcactgtgagagaagacaagtgcagaggacctaaatttccttcaacagaagacttggaagataaatgagagtccaagtgtactctgattatctgactagatcactatgttctaacagagaaagctgtcccaaatctagtgttaagtggaaaaaaaaaaaggtacctttaaaaacaacatgtagcatctaatgctatttttataaaatcttaaaagtaatttttggaggtgctgtatcaaaaacttacagtcataaccttatttagttctctatgaggtaaaggccactattacctcattttagaaatgaggacagtagctcaaaattcttttcttctcagtcaactctgctgaatgaagagctatactttgcttctcattgactcttcgtctattttgggttttttttccccagaattatactgcatttaaatataaactcatggaataaaatatagaaatacacaaacactaattctctttcactgatgacaagcaaaatttttaaaatcatgagcaaaaacaaaaaaccacacatgcaccataatctgtgattttaccaacttctcttatttcaaaattggctttggtattaaactgttttaataataataataagcagataattaacagctgagtggatagatgaatgggatttctattcacttactagggtagtttccccctgatcttgtcctgccttcctggaagatctcagccacatctattccttcacagctcctggcatgaactccatcccacctgagcataaatcacagccctcaaaccaagacctgagctacactcctggcttctctgaaggcacgacctttggagggagcagtaccatgccctatgtcacatcagggtataatgtgatgtcacaactctatttggaaggcttctgcctctatacaaacttcagtcccaaatacctgattaaacatttatctcacataatcaagaagtaccaaactgttcataatgagcccctacctgttcccatcaacaactagtttgtctatcacaagggttctaccaggtatattcatgacaagaatctgaatttcctcagccccacacgcacttttttaaaacagaaattaccctccctccacccacctgttctcctgaaacaaatatatgtgcacttacaggtcaaataacctgtctcccaactattggttcaagaaaatatcatctatagacaaaccgtgattggtaaatgattccaaatggaaacaaaacacacacaagaaaatgttttgtcctgcttataaccatatgaacaactttaatacagaagagcaaaaatataattcttagggatcagacagattctgcttacttcctattcctcctctatccttcactacagtgtctgcaatcacaaagcttcccctccaagcaagtacactggctgggtgagaggggtgagcaggccagtatttctgagtggcaaaagagagtgaccagacatgcctgtcctttgtcactaaccacctttcaagcttccccttctgctgagccatctgcaggaaaatgtcaacatgtgctgcagggaaaaaatgtatttgttaatttatgtgctgggtaaattcacttattcagtagaataataaaaatgtgactgcttaccacctttcccttctagagtaaagacatctttattaatgattttaaagcctgaagaaacaggaatgcttgctctgtttacatttccccatattaaatggaagacattcacttgctgggggcgaaacattgaaaatacccttctggtcatgatttattgctggagaaattttactaaattgggatgtgaccatgtatccacctattaataacattgctgggaaaataaaataacagagatttacattttcagtaattcctgaaataagcactctgtgtttctggaaggtattaaaaaatattttccaagactttatattttagcacctaagatctggagtttcaaaagctgcatactctgaagccaaaaaagtcatagataatcccaagtatgtccccgcccaccccccttactaactggaggatattacatcttgtcccttaggtgctatatctttgctgatcaaagctttttccatcaaagacctccctgaatctgaatttggcctgaatccacaaatgaacattcaattaggactagggaagcattccaatttaggaactagcacagttacaagtaagccagaagaggagatacaagatagtatttctaagtcctacttaaaggatacaagccatttgggggattaaatttaaaattgatgagaaaaatgtatttcagaataaatgtgtaaatagagatttatgaatagttcctcaattagggaggaaggtgagataaatagagaagaacccatatagtttgagattccgatcacaaaaggcaatccctttctattacaagcacacaaatatttgtgagctaaatcagtgctactggtaattctctgggctgactgtttaaataggatttgtgagggaggaggagaaacacaagccatatgtttgtgtgactaatgaaggccagtggttaagaagcatactgtgagctacagaggcccaaggttgagggacatgcacccaaaggtggtaggaagggtcctctaggatgaggtcaagatgacagccaggtccttccctctccctccattgtgaagaagaatgaaaactgcttggatccccattatggggtaaacaggcagttccctggttcagaggaattcttcagcacattccagaagcgtgattccaataagcactgagccaaaaagccacaaatgggaaatctctacctggtcaactgcccagatgaataaaaatttaaatgaaggtccttattttcttaaccaagagtctggtggcaagctcacttaaggtttctgggaaaaaaagagaaacttttgctgatctatatccacttacttacctgctaacttaattgaatgaaaatacattagctgtcactgttatcttggcaaccctgagaaatcatatcttcctaaatatcccaaaagctcaagtcaccttgttagttcttagaaacctaagtagataaaaactgtaaacccacagatccaataatctcaatgaacctcagtcacaggaaacaggaagaaaaggatacaaaggctcatatcaaattgctccaaaccagtcataaagagaagaagtcataaaaccttaaaatcagccagaggaaaaatagacatgttacatacagaggacaatagaaaaggaaaagaacacatttcttgctgaaaacaacgcaagcaagacagaagagcaacatctttaaagtactggaaaaaaaaaactgtcaacataaaattctataccaagcaaaaatgtctttcaaaagttgcaataaagactttttcagacatacaaaaccttacagaattcatcaccagcagatcctcccctctgaaaaaaaaaaattaaatgcttcaagcagaataaatattataccagatggaaacctggatctacacaaagatataaagaactctggaaatggtaactacatgggttctcagaatcaacattagttatatatattagctgcttttcctacagtaattgtctttttaaatatacctatcgcattctttgatattacttttagttaagcagaggagcaaaagtgatagccttatataatcctcctcaaaaataataacggaacttgagaaaacctattgctctccccaaagagccataaaactgggggaaataaaagatacagtggaggatgtaactgtaactgtaactaagaaagaatcagaaggctatcaaaaataatattaataagaaactgccaaacacttttccaaagcaagtgtagcattttacactctcagcaacaatcagtgagagttccacatccccaccagcaccaagcattgccagacttttaaatgttagccactatcatgaaggtgaaatagtatcttcttgtgattttaatttgcatttccataagtactaattttgaacatttttatgtgcccactggccacttatagatgtctttttgtgaagtttttgttcaaatattttgaatatttgattattttgaatattttgtgaagtttttgttcaaatattttgtcctctcattgtgaagttgtaatatttctttatgtattttgggtataagtcctttgtcatacatatacatatccacatatatagatatatgtgtacatgaatgtttatatgcacatgtgtgtatataaaatattttctcccagcaggtgtctcatcttttcattttcttaatggggactttctaagagcccaagttcttaacgttaatgaagttcagttttttttctcatatgagaatgctttttgagtcctatctaaaaaatctttgcctactccaaggtaatgaagattttcttttagaagttttatagttttacattttactctgacgttcaggtgtgtataacccatttctttttttttttttttttcatttttttaaaaaaatcaattttactgaggaaaaattactgtcaaatgcacacattttaagttacagaagatgacttttgacattcacatacactgtgtaaccaccacaccaatcagtcaagatattataggacatttccattaccccaaacagtcccatcatgctcctttgagtcagcctttctctcagcttccactccaggcactcactgatctcatttctgtcacaattgataaatgttacctgctctagaactttacattaagaaaacattaaagtctgtactttttgtatctggctattttaattcaacatattttagatacatctattaccaatagtttgttcttatgcatatctcaaaaatttattcctttctaattgctggctagtatttcagtttttttggaaagtttttctatttttttatctttattagtcagtttttatgttttattttcttttattatactttaaggtttagggtacatgtgcacaacgtgcaggtttgttacatatgtatacatgtgccatattggtgtgctgcacccattaacttgtcatttaacattaggtatatctcctaatgctattcctcccccctcccgctaccctacaacaggccctggtgtgtgatgttccccttcctgtgtccatgtgttctcattgttcaattcccacctatgagtgagaacatgtggtgtttgatttgttgtccttgtgatagttagctgagaatgacggcttccagcttcatccatgtccctacaaaggacatgaactcatcattttttatggctgcatagtattccatggtgtatatgtgccacattttcttaatccagtctatcattgatggacatttgggttggttccaagtctttgctattgtgaatagtgccgcaataaacacacgtgtacatgtgtctttatagcagcatgatttataatcctttgggtatatactcagtaatgggatggctgggtcaaatggtatttctagttctagatccctgaggaatcgccacactgacttccataatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccactgatgatgagcattttttcatgtgtcttttggctgcatgaatgtctttttttgagaagtgtctgttcatatccttcacccactttttgatggggttgtttttttcttataaatttgtttgagttctttgtagattctggatattagccctttgtcagatgagcagattgcaaaaattttctcccattctgtaggttgcctgttcactctgatggtagttaattttgctgtgcagaagctctccagtttaattagatcccatttgtcaattttggcttttgttgacattgcttttggtgttttagacatgaagtcctgcccatgcctatgtcctgaatggtattgccaaggttttcttctagggtttttatggttttaggtctgacatttaagtctttaatccatcttgaattaatttttgtataaggtgtaaggaagggatccagtttcagctttctacatatggctagccagttttcccagcaccatttattaaatagggaatcctttccccattgcttgtttttgtcaagtttgtcaaagatcagatggttgtagatatgcagcattatttctgacggctctgttctgttccattggtctatatctctgttttggtactagtaccatgctgttttggttactgtagccttgtagtatagtttgaagtcaggtagggtaatgcctccagctttgttcttttggcttaggattgacttggaaatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgcttgtatcctcttttatttcaatgagcagtggtttgtagttctccttgaagaggtccttcacatcctttgtaagttggattcctagatattttattctctttgaagccattgtgaatgggagttcactcatgatttggctctctgtttgtctgttattggtgtataagaatgcttgtgatttttgcagactgattttgtatcctgagactttgctgaagttgcctatcagcttaaggagattttgggctgagacgatggggttttctagatatacaatcatgtcatctgcaaacagggacaatttgacttcctcttttcctaattgattaccctttatttccttctcctgccagttttccctggccagaacttccaacactatgttgaataggagtggtgagagagggcatccctgtcttgtgccagttttcaaagggaatgtttccagtttttgcccattcagtatgatattggctgtgggtttgtcatagatagctcttactgagatacgtcccatcaataccaaatttattaagagtttttagcatgaagtgtgttgaattttgtcaaaggccttttctgcatctattgagataatcatatggtttttgttgttggttctgtttatatgctggattacatttatcgatttgcatatgttgaaccagccttgcatcccagggatgaagcccacttgatcatggtggataagctttttgatgtgctgctgcattcggtttgccagtattttattgagaatttttgcatcaatgttcatcagggatattggtctaaaattctctttttttgttgtgtctctgccaggctttggtatcaggatgatgctggcctcataaaatgagttagggaggatttcctctttttctattgattggaatagtttcagaaggaatggtaccagctcctccttgtacctctggtagaattcagctgtgaatccatctggtcctggacttttttttggttggtaagctattaattattgcctcaatttcagagcctgttattggtctattcagagattcaacttcttcctggtttaggcttgggagtttgtatgtgtctaggaatttatccatttcttctaaattttctagtttatttgcgtagaggtgttatagtattctctgatggtagtttgtatttctgtgggatcagtcgtgatatcccctttatcattttgtattgtgtctatttgattcttctctcttttcttctttatgagtcttgctagtggtctatcaatttcgttgatcttttcaaaaaaccagctcctgggttcattgattttttgaagggttttttgtgtctctatctccttcagttctgctctgatcttagttatttcttgccttctgctagcttttgaatgtgtttgttcttgcttctctagttcttttaattgtgatgtcaggttgtcaattttagatctttcctgctttctcttgtgggcatttagtgctataaatttccctctacatactgctttgaatgtgtcccagagattctggtatgttgtgtctttgttctcattggtttcaaagaacctctttatttctgccttcatttcgttatgtacccagtagtcattcaggagcaggttgttcagtttccatgtagttgagcggttttgagtgagtttcctaatcctgagttctagtttgattgcactgtggtctgagagacagtttgttataatttctgttcttttacatttgctgaggagtgttttacttccaactatgtggtcaattttgaagtaagtgtggtatggtgctgagaagaatgtatattctgttgatttagggtggagtgttctgtagatgtctattaggtccacttggtgcagagctgaattcaattcctggatatccttgttaactttctgtctcgttgatctgtctaatgttgacagtggggtgttaaagtctcccattattattgtgcgggagactaagtctctttctaggtctctaaggacttgctttatgaatctgggtgctcctgtattgggtgcatatatatttatggtagttagctcttcttgttgaattgatccctttatgattatgtaatggccttctttgtctcttttgatctttgttggtttgaagtctgttttatcagagactaggattgcaacccctgcctttttatgttttccattggcttggtagatcttcctccatccctttattttgagcctatgtgtgtctctgcatatgacatgagtttcctgaatatagcacactgatgggtcttgactctttattcaatttgccagtctgtgtcttttcattggagcatttagcccatttacatttaaggttaatattgttatgtgtgaatttgatcctgtcgttatgatgttagctggttattttgctcgttagttgatgcagtttcttcccagcctcaatggtctttacaatttggcatgtttttgcagtggctggtaccagttgttcctttccatgtttagtgcttccttcaggagctcttgtagggcaggcctggtagtgacaaaatctctcagcatttgcttgtctgtaaaggattttatttctccttcacttatgaagctcagtttggctggatgtgaaattctgagttgaaaattcttttctctaaggacgttgaatattgtcccccactctcttctggcttatagagtttctgccgagagatacgctgttagtctgatggggtaacccaacctttgtctctggctgcccttaacattttttccttcatttcaactttggtgaatctgacaattatgtgtcttggagttgctcttctagaggagtatctttgtggcattctctgtacttcctgtatttgaatgttggcctgccttgctagattggggaagttctcctggataataccctgcagagtgttttccaacttggttccattctccccatcactttcaggtacaccaatcagacgtagatttgatcttttcacatagccccatatttcttggaggctttgttcatttctttttattcttttttctctaaacttctcttatcgcatcatttcattcatttgatcttccatcactgataccctttcttccagttgatcgaatcagctactgaggcttgtgcattcgtcacgtagttcccatgccttggttttcagctccatcaggtcctttaaggacttctctgcattggttattctagttagccattcgactaatttttttccaaggtttttaacttctttgccatggctttgaacttcctcctttagcttggagtagtttgatcgtctgaagccttcttctctcaacttgtcaaagtcattctctgtccagctttgttctgttgctggtgaggagctgcattcctttggaggaggagaggcactctgattttcagagtttccagtttttctgctctgttttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagcagaggctgcagaacagcaaatattgatgaacagcaaatgttgctgcatgattgttcctctggaagttttgtctcagaggagtacccagctgtgtgaggtgtcagtctgcccctactggggggtgcctcccagttaggctacttaggggtcagggacccacttgaggaggcagtctgtctgttctcagatctccagctgcattctgggagaaccactactctcttcaaagctgtcagacagggacatttaagtatgcagaggattctgctgccttttgttttccatgccctgcccccagaggtggagtctacagaggcaggcaggcctccttgagctgcggtgggctccacccagttcgagcttcctggccactttgtttacctactcaagcctcggcaatggcgggtgcttctcccccagcctcgctgctgccttgcagtttgatctcagactgctgtgctagcaatgagcgaggctccatggcaatggaccctctgagccaggcgcgggatataatctcctggggtgccgtttgctaagactgttggaaaagtgcagtattagagtgggagtgacccgattttccaggtgccatctgtcacccctttctttgactaggaaagggaattccctgactccttgtacttcccgggtaaggcgatgcctcgccctgcttcagctcatgctcggtgtgctgcacccactgtcctgcacccactttccaacactccccagtgagatgaacccagtacctcagttgtaaatgcagaaatcacctgtcttctgcgtcgctcacactgggagctgtagactggagctgttcctattcagccatcttcatgtttttttccatataacccatttcaagtttatttttgtatatgttgtgaggtatgagtgaagattcattttttttttccatacagatacctggttgttccagcaatatttgttgaaagtctatccttttctccagtgatttacaccttgatatctttgtaaaaacaaacaaaataagccaggcatggtggcgcacacctgtaatctcagtcttttgggaggccaaggcaggaggattgctttaagtgaaggagcttcagaacagcctgggcaacacagcaaaggcctatctctaaaaaaaacttttaaattagccaggcacggtggcatgcacctgtggtcctagctactcaggaggctgaggtgggacgatcacttgatcccaggagtttgaggctgcagcaagttatgatcatgccactgcactccagcctgggtgacagagcaggaccttatttctaaaaacaaacaaaaattcaactgaccatatatgtgtgggtctatttctgaacactctattttgttccattgatctataaatatgacccagcaattccactcctagttacttacccaacagaagttaaaagcattcattgccatgaatgctcacggcaaacaaaagctctgtacatgaatgctcatgacaaccctactcataatagtctcaagctggaaacaatccagatggccatcaacaggtgaatggataagcaagctatacaatggaaagtagtcagcaataacaaagaattactgatatacacaagaacatggacaaatctaaaaaagattgtgctaagggaaagaagccagacactaaagattaaatactgtatgattccacttatacataaaatttatctacggtgacagaaagtagatgagaggtctcctgggactgagggactgagtataaaggggcatgaggaaagtttgggtaataaaaatgttctaaatcttgatggtggtggtatttacatgcgtgaatacatttgttaaatctcaaactgtatactttaaatggatgcattttattgcatataagttattcctcattaaaattgatcttttaaaaagcagtcttccctgttatcaatacaagcttcccattctagaactttaccaaagggtttgtctacattcataaatatgaacaacacagttataaatataaatatttcaggctgtcccttgtttctattgactacttctaaagtgctttcacaaggctaatattttaaaccaacacttaagattgggcttagtacaatggccttacctagtggagatacacttattactaatgtacttattgatctgctctggttgtttattttctggattcccataaagcattggtatggcaaaagactatgatcctggagacatgagagaatattcaacaaagatatatcctactgcacattatctcctgctcccatgtgtggcttttcatctgtgtcacgtcaaacatcctccacaacctgccctccaaaaaagaatgacctgaaatcctgctgacaaattcatctccaaaaaaaaaaagagaataccacatgcattttctgaagcaaatgacaactctaataatgttgctgaatcacaatataacacagcactacaaagaactgaagcttgcccagatatctgtgtttgcacgccagtgtctggatgctgatcacacatctacaacctctggtttagcaaactatatatcaaagcttctcaagctgggacctgcttacctctatcagtgccctgcattttaccagagagtacagcaagccactaaatagcatggtgcatattttcttgagtgtcaattttacatggaaatttagaaaggataaaatgaaaatgttttcatggtaaaagagtcacactatattatagaatagaaagccatattcacaaaatttattaagatgtttaaaaagacatttcctactgcagtacatgcttctagttaaactccccaaaccctcaaaccccctttggggtatgcattcatcttctatattgttaagggtacattacagaaaaaaaaaaaaaaaaaaaaggttgccagaagtacaccaactcattctagcttagcgtctatccagaaattaggtactacacccaacagctgggctccaaccctggcttggccacatctctacaatatgacctttgaaggattgctatagtttttgcatccataaaatagacatgacaagagtacctggcttataaagtactgcacagttcatatgcctggccaacagtaaatgatcaattagtgttagctgcctatcatcattgctgttatttgactgttgcttttaatctatatataccatggcataacttttttacatatcaactgcagtccatttggtgataagattatcaactgcttactccccaatgcagagggaggcaatgagaattctggacacccaatgtgaacgcacaccttttcaggaactcttactcaggtacggtatactctttggataccaactgacatcaacaaaagaaatgagggcttttcagggctgagctttgacaaattacctgaagcaatcttgatgttcgacatatttctaacaagggcagcctggtgagttattctcctacatttgtaggatatttctatggaacgaatgtggatcatctcccctagaaaaactctggaaaattcttattacatgtgacctgagtttcctcaaacatcatatacctataggccttgctctaacctatgggtgactgcctaaacatgatgtaagaactcctgctaccagaagtgccacccagttatttctgggagtccccagaagcaaaaacaagagttcacaaggaatccttcccagtctggcacccccattgctcagtcctacccgcacaacaccctgagagtgctgacatctctgccaggggtcacagatgccaacggacttccataaggtgcaccacaatattgctgtatgtggcacagagtgagtggtccaccaaccattcacattctccttccagagtagatgcactgctgggaagcagcttccaagccaaggacttcatttcccagacccctctgcatgtaggtgggaccatgtgactaattcttcctaatgaagtgactagaaataatgtgtgtcacttccaggtcgaacggttaagagagtgggtatgccttctcatattctttccccatttgccagtggattcagagagagcagctgcccccagtagcctaggtccctgaatgatgccaagaagcagaaccctcccccaacccactgaggtgctgggatttctctcctatagcagctagtattatctttactaaaagcactgtgttcactgctgaagtggagagaagcctttctccacaacactggttgatacttttatgcttgggcccaaaagcagtgtgggctgtgctcatgtatctcaccaatgtccccataaaaacacagtttttttcatttactctggaagaagcagctaagcagggccagggttaggaagaagccaagggcatgggcaagggctgagctctatgtggtctcccttgttttctcacaaaggtgcatccagaatcccccatggagtaagatgcctaccaggccaaagatctcagaactatgatctccctactactccactctgggttggaacccagaaacaacttgtcttaccgtaaaaggcagtaactggctgggcacgatggctcacacctgtaatcccagcactttgggaggctgaggcgggtggatcacaaggtcaggagatcgagaacatcctggctaacgtggtgaaaccccacctctaccaaaaatacaaaaaattagccgggtgctgtggtgggtggctgtagtcccagctactcggtaggctgaggcaggagaatggtgtgaacccaggaggcggagcttgcagtgagccgagatcgcgccactgcactccagcctgggtgacagagcaagactccgtctaaaaaaaaaaaaaaaaaaaaggcagaaactttggctactcagcaagtcattgttaccctggccaagtcctgtttccatgctcaaaggtactgctgtgccaggagtaagctccctttacttgtacctgcactgtagaacccagaagttttccatttctgtccacttcaggactttctatggataagccaagccatgacccagcacaagtcactccctggggccactgtagacataccaatctctttgtaacctggctggactcaggttaaaaacaagttagaatgtgtgaaggaaggagaaagtggagaggacagtagtaggagagagactgagagggtagactgtatcctttatacaacaaagaaccttcattcagccttttaacctcttaagcaagaggtttctgagacacagtcacatcactaggagagtcatgtagggaaaatggaaaggcagggaagcccagttcagaggcaatcacagccaaccaaccaggcgagatggccatgggagagccagtccccaacctgtccttcaaggcaactccaccgactcttcctggagttactcatggtttgctggacctcatggaatctaacttcctttcactgtttgtgtcaaccattttcattctgcatctttccctggaaaatttgtagactctgtctactcactgaatggaaatgttgcgttctccctcagataagctttccagaagcactagttcatccctgttaggcattaagttctccctcaatgtcctgctgccaaactgtgggtcccctctggctctcctcactggcctctagcccacccacccgcaaagacagacaaccagaattatgggagttgtcctaacacctccctcttcctaattcctccaccttaaagtaaaacactaaatcctatccattctgcctcctgagtttctctcaagcccttcagcttctctccatctccactgctgccatcatccaagccaataacagctctctcgcatggactgatggaactccctccaacctgagtgcccttgttcttccccaacctgttttcatcctgcaagaagaatgatcttttacagacttacatctgatgatggtactctcgccctaccttgagtggtttccctttattctttggataaataccaaaatttccacatggttttcatgatgctgtgaggatctgggccctgcctacttttccagcagtctttgcttttctcctattcactcattgttttcccacagattggtctcctttcagttcctgaaatgcagcaggattctgctttctcaggctgctgtgtctctggaaatagacgtgactctgccccttgggatcacatatcccgcaaaacataatcccacagaaaacttacatgtacccttcatctctgtttaaggcagaactttctctgtgaaatgtttccagctcacccccacccccattatatcaggtctctcattacataatacattatattatactttcctttacagcacttaccaccactgtaattactacttacttggataagtatttgtttaatggctgtcacatttgctgaatgtaagctccatgaaggcagaaacaagttcaacatgctcagtacaacggcctcagagccagtgcattccctagctcatagtaggcaatcagtaagtatgatttggcttagcacattcagcatgcccacatgaactgagaagaataaactgaggcctagaaaaggaaaggggatttcccaaagccttgtcttctttggcagagctgtggtttattaaaccctggactcttaatccacagttcaatccttagcccatactgatactgaagtcactgtagacccaagagatcaatccatctataacccaaaagagaggagaaaaactaaactgtggagaccagagatctctattcaaatcctggatggactgaccacttaaatcttacaacactatggcagaaattaagcaagctgatgtgtacactatgattggtgtagaatctggcctgagtggtctctccagagacgtggctgttctaggacaccttgtgaagtgtgtcttcaattcctgtgtgtccacctcaatccaggccagaatagcaagtacttgggaaggcaggagagcatttcatattgagcagttgctgctcccccaggcagctggtaaacagcgtttgatgaggatgataaacacatgatactaatcttactacacagaggtgtgttcaacattctagcacacagagccacatggcaggtgatccatcttaaaaagatgacattgctggctgatttctgccacagtgtatttacttggaatttaaatttagatttaaacctacctatagcattattatagaatataccaaaggctctattcacaggtgggcaaaaagactatccatcaccccagctcatactccgcaattcacagacagcttcttccttcatccaggacagctgggtgtcctggaagcttttctaccactggcatattaaaatgatgcttcagccaattctgtaatcacctatttattttgcccatgatgtttcaggccctgtgctagaccctggggattcagcaatgatgagacacagcctctgccccaggaagctcccagcctagcaaaactacatttgcatagtcctttacaatctactaagtgattggacttaaaccttttatccacctctcctggtattttcattatctttgtatatgtcttccttggttggagaagattttgacataaaatttgtttccagttaaaatgcggcagaggaacttaatcactctcattttggctttagaattctaattaaggaaaaataaaccctggattcctccagaaatgtataccgtaactgactgttgagtggctgcccaaaagccacggcaaacaccttttcccttgctgcctttcactgcagagatggcagagtcacccatccacttgccttctttacactgaggggtcatcacatgatctagttctggccacagcgatgtctgtagaaatctgttcagaggcttctatgaaagcttttgctttaattttttataaagacagtccaagctagtttggcccttatttcttctccccatcttcatcctaggtgtaatgtttggggctgtaacagccaccccacaaacaggaagcaatgagggagccatacgggaaagacccagagaatcagatgttagctctgatgttgttgagctaatgaggcaaggacagcagctatagcccttcagactagttattaagtaagaaaaacaaactcctcattctttaaatcagtgtaggagaggttttctgttacctacagccaaacagtcttggaatgcatggttcaggagatgattaagcacacagcctttgaactagacacacttgggtttgtgtaccagctcagtcacccactggctgcgtggggctggacaagttatttaactgctcagagttctgtttccatcttccatgaaatgaacatactataactgcctttttcacaggcttgctgttaggaataagtgagatggtatatgccatgatttggatatggtttgtttgtccccaccaaaactcatgtctaaatttgatccccggtgtggtggtgttgggaggtgggacccagtggggagtgtttgggtcatgagggtctcaccctggtgggtggcttggtgccattctggaggtagtgagtgagttcttcctctggcaagactggattatttctcaaggaaaatgtactagttcctgcaagagtggatagttacaaagccaggatgtcccttgtgttttgtctctttgcatgtgtccacttcccctttgaccttctcactatgttatgatgcaacttaaaagctctcaccagaaaccaaggccatgccattgaacttcccagcctgaagaactatgagctaaataagcctcttttctttataaattgccccgtctttggtattctatcacagcaacacaaaatggactaagacagtgcatgtaaagagtttttgtgcaatgtctagataaataactactcaaatgataaactgcagccaataagcacatgaaaagataataaccataatcattaagtaaatgcaaatcaaaaccacaatgagataccacttcacaccccttaggatggttattacataaaacaaaaacgaacccagaaaataacaagtgttggtatgaggatatggaaaaattgtgcaccactgatgggagagtaaaatgatgcagctgctatggaaaaacagcactgaggttcctcaaaaagataaacatagaattaccatataactcagcaattccacttctggatatacacccaaaagaactgaaagcagggactggagaagatatctgtatacccatgctcatggcaggattattcacaataaccaaaaggtagaaacaacccaagtgtccactgaccagtgaaaagattttttaaatgtagtatataatacaacgaaatattattcagccataaaaaaaggaaattctgacatatgacacaccatgaatgaatcctaaagacattatgctaagtgaaataagccagacacacaaagacagatgctgttaggattcctgcctgacttatgtgaggcacctagagtagtcaaactattcacagagacagcaagtagaatggtggttgcctggggctgggagaaaaggagaacagtgcttccattatgcaagacgaaaaaaattctggagctagacagtggtgatggttgcactacaatgtgaatatacttaatgccacagaagttcacagattaaaatagtgaattttatgttatattttattgcatttttaaataaatttttaaaataaaaatgaaataaaatgatgacctgcattactgatcctaatactgatattatcatcttactgagttttcagtaactcggtaagttgtcagacaataccactggctgggtacaaccctgggtcaaatgctgaaatgcttgcccccattgcatatttgtcctagatgaacatatctaaaaggcatttcatccatgcagcaaacaagcatatttacttctttctctaggaaaccaaaggtaagtcaaatggtttcctgccctgtggaaggcaaaaagatgttcacaaatagccacactacaaggtaagatgtagcacctgccttgaagacaaatgcagaatcttcagagagcaaagccactgcttctggctttggggtttgaggaaagttccaaagaagagacggaaatggagctggacttgaaaaaccagaacctttattgctgaaacagaaggagtgttacagatgattccaggtagaaatagcagcaatgtgagcagagacagcagagcatcttgtttggttagagggaactgtacattagggtgaacagaaaagacaatagccagttcactaggcagagaagccatgtctttatttcatggaggagggcaggagataaagatgtgtttgcatccacagcacctaggactctcttagcacacatcaagttgtcaaaattgtcaattcaatcattgaccagcagataggaagatctgtagaatcctccagatgtctagcattgatgctcaggagaggcaggccccatttggctgccaaaaccacctctttcatgtcactattgtctaggctacttcccaagagatggagaagcatagcaaacgggcgaacatctcagaaggcctttggttattgatggacaccacaggccagtcctaacctcccaaaaacctttatcatgcatgctcccagatggaatccaaccaactagaacaaagcttcccttccaaaggaacactgagactaccctcccaggacaacttgaactctgggcattgtgccctttgaaagcattttccatgtccttatctaaatggaaggcaagtacactagcacaaataattgaggggaaaaaaatggacaaggagacccaatcaaaaaaaagtattcaattgagtaccattttaaggaattatttcaaagttctaatcactataagtgatgaaacaattcatgacaaaaattgcaattaccaaagaaataatctgttctgcaacagcaattttagtgacatttataacacacaagaaatcatgaagcttaattatttgaatttattgaggctacagatgccatgtttaaatctaattaaacagatccaccaaaactgaccatctgaagaaatggcaaagttgctgaaccgaacactggtttttaaaagcagttcgtgaacagcctccaaataggcagtgagtaatgatctatctttcttcctcagctgtcatttggggaaaaaagagacatttctttattgatcttcagtccttcacaatagaatttacctcaactcctaaaaaacatcccccattccaatgatctttgatagatctgcaggataaatggggactctcctactattacctttcaggtctcacactcaaactatattagatctcaaggaagtaggtacaaatccttaaaagtgattgagaaaaagatttcccttctccatttcttttttttcttttttttttttttttttttttttttttttgagatggagtctcgctctgtcacacaggctgcagtgcatggtgcgatggtgcgatctcggctcactgcaagctccgcctcctgggttcacgtcattctcctgcctcagcctccctagtagctgagattacaggcgcccgccaccacgcccagctaattttttttttatttttagtagagactgggtttcaccgtgttacccaggatggtctcaatctcctgacctcgtgatctgcccgcctcggcctcccaaagtgctgggattacaggcgtgagccaccacgcccggcctccatttcttaagaatgttaactggtaaatatcagtagcctacagaatttgtataattcctgaaatatcaatgaattgtttgcttaaataataagtattctatgaagcaagattctgattataaaagtaataaatgttcaaagaagaaaatatggaaaacatgaagaaacaaaaagaattaaaatttccaacaatcccactaaccacatatgatcacaattaacattttgcacttacttccaatgtcatttctaagcttacatacttttatcacaatgcgaacatgttatatttataatcttacatcttgttctaccattaaacatgatatcaagtacatttaatttctttaagtaacctctcattgctggatttatagcttgttcccaatttttaaactttcatcaataaactgacttacattcacatagataaacctatggttgcatctctaattaattccttaagagaattctcaaaaataaactcttgggatggcattcattgactcgttaaagttctaataagacctgccaaattgatttatctaaaagttataccaatctacatttctaccaatggtataataaatagctcaaatttaaaactcttttctttcctttccaacagcattacttaactttcagtgaatttcttaccaatttttttgtatgtttctctgttttacagatttttgatacactattttgtctcctgttgtttccacttcatattaaactcatttccttaggatattaagagttctttgaaaacatgattttcttaaggggcacatataagccatcctataaaatgtatttctttaagtaaagtgggaggcattgaaaggcttaagatttttttcgtgtttattagctatttgtatttattctgttaattgccatcttactgccttcaccaattttcccactaaggttttagtgttgttcttatttctatattaacaaaattaatgctttgttgcatgtgtttttcttagatttttttttttaccagcatcttaattttaatttcttgggggagtttttttacttattaaaacactaattttagctgggcgcggtggctcacacctgtaatcccagcacttgggatgctgaggcaggcagaccacctgaggtcaggagttcaagaccagcctgggcaacgtggcaaaacccagtctctactaaaacatgtaaaaattagccgagtgttggtggcacatgcctgtaaatcccagctactcaggaggctgaggcagggaaaattgcttgaacccaggaggtggaggttgcggtgagccagaattacaccactgcactccatcctgggtgacagagtgagattctgtctcaaaaaactatatatatattaattctgtatggagaaatgagtcattttcctccagtgatattttgtttctgttgacttccctaatgtcagagttaaccacaatttttcctacttttcattttttattattaaaatttttgcatcaaatcaaaatttattttggtatatagggtgaggaaaggctctaatcccattttttccaaatagttaacttagaatatattaaataattcatcctttccctccatcatgtactaaaccctctttcacattaggctctgtttctagactattctgttccacttactggcatgttcctgcaataataaccacgtggtcttaattagcatcatttgagtacattttatatctggaaatgtaaatctcctctattatgcatcatttccaaaaattttttggcaattccagctagcatattcatatttgagaataatttgacacaatccaaaaaaagaaagaaagaaagaaaaccccagctgagatgctgattggaatggggtgaaatgatacattactttggaaagaactgacatctttatcacacagagagaaactggcagcacatatctccctttattgaagtctccttttatgtcattcagtaaatttttgtgattttcctcataaggattctgtaacatttcctgttatgctattcctgtgtgttttatacatttttactcctaagtaaactacaccaagcaaagaaagtctgagattgtatgcctgaatttcaacatcacatcatgaaatatgtgcctgtctctctttagggtctgacagagagggcccaacatttccggaatgaatgagtgacgaatgggtccgaaagccctagtatcaggacagaactgggtgggctacactgtgtagcagactcacaattgttctttcatgctcagtgccaattttatattttcaaagaataaaaaatcatcttaaaataatcacacaactacctctgatagttctgccatcatggtacactttcccgccactcctcatcctccatctcatcccaagaggtgggtacaaccaaaccaaagtccttctagggaacttcagtttgggacagaaatgactagcctttggagctgagccaagacagagatatctcttcatgaaaaccatctctgaatccctgtagaggagcacagaggaaacagaggtcagccctgatggatattataaagcaggtttgcaataaaagagattaagttttttaacaattttattgagatcatcatccgtataccatacaattcacccaattaaagtgcacaatgggttttagtagagttgtgcaactatcaccacaatggattttagaacatttttatcacctctaaaagaaatcctgtagtttttttaaattgtggtaaaatatacattaactttcccatcttaacctttttaaaacaatttttaattgatgtataataaatgtacaaagctatggaatacatgtgataatttaacacattcatataatttgtaaagatcaaatcagtgtacttgggatatctagtaccttatatacttgtcatttacatatgctagaaacattcaaattattctcttctagctcttttgaaatgtacagattattgtaaactatagtaaccacttctaagtctacagtttggtagtgttaagtcgattccctgaagccaatctccagaactttttcatcttgagaaactgaaatttatacccatcaaacagtaactccccattccctctccccacccagttcctggcaactgccaccttaatttctgtttctgtgattctgactactctaagtatctcatataagtagaatcataacagtatttgtctgtttgtgactggctcatttcacttagcataatggccccaaggtttatccatgttttagcatatgtcagaatttctttccttttttaggctgaatacattatgagcttttttaaagagaagagaagggagggagaggtaagggggcagtgagggaagaagtagggagcagggagggagaccagaaactgggggctcctgcacaggtccaggcaggagatgatggcggtctgccctcaaggagagatgggaaactggatgggagtagatgagttcaagatatatttggattaatataatgaaagataaaatgagaggacttgcagatgaatgggatatgggaaagggagaggaatgcccaagggtgacaccttgcctaatagaaggaagactacagggagcagagaaaacccaaaccaggcagctcctgggtacacctcctaaataacccaaaggagaaatgcaagtcctcaaagtagtgaatgcagttctgccctggaagggaatatctacagccaattcccctcttagaatctgccctggaagggaatatctacagcccaatctatcaccactgtgtgcctttgtaagaaaacttcatttctaaaatttcatttggagatatttgcatatgcacacacacacacacacacagaagccaccaagctgaacctgatgacctgtttgtctgaattcccacccataggttccaaaaggaaggtagcatctcttctcagccaaaatgaactggcaggcaggctgctgaattgcagagagagcagtaggaggtagactagacagactccccaatcacaaggaaaataaccattacttaagttttccaagtcaagtcagctgtaaaagtccatgataaaagtaagtaaagttttcagatcatttgggttcgttaggcagggctcaacaactcaacacgtgacttaagagggtgcaatgcatcagtaaagcacacactttggagtcagatgctggttctaccaccaaatagctctgtggccacaagcaaattataccatctgagtttcagtttccttatttgtaaaatcaagataatcaagcctaattcataggattagtgtagcagtcacacgaaacagacaaggggaggacaggagatgaagagacagaggatggggatgttgcatgtgggtgtggctgtgacacagtgctgaagtacacaggatagtttcaatgctggatgaagagtcaaaagacccagtttctatgccagcttctgccctaactagttctataaggacagacaagccacttcccttctcttgccctaggcttcctcactcattaaagtctcagctgacctgaggacaccaaagtgtaaactagcacagggagagctaaggaccaatccatttaacactataagtcccaaaaggctgaaaagctcatgctattattaatagattcctccagaggtagggggtgagggggctaaagtaaaaagaattgattgcaattgtgatcaacaagcagtcaggcccctagacttcctctgccactctgcacaacagagctgcctgctccttctctaccatggcaaaatacaggaggtttaataactggtacctcacagggtctgttaattgagggcataggtttaaggctggggtacctcatttaaagtaggagtattaaacaaagggagatgccaagacacacaccccaccacacacaaacacaaccctctcatcttcgctggctcccagtaaaaatggcagctggccattcactctacaggtggcagatgataagcatcttctctgaagtctgagaagcctaagaggaaagacctgaagataccaacactgattcttaatcaaacagcccagccagatcaccctacagtgaagctcagtgtcaactagccccacccacacatcaaagcgtccaaacagctttgtagtccctcttacagatgaacaacaactgaatattatcagagattggaggaaagcctttcacgggaaaatggagatcaaaacagaggggaaaagaaagtaaaaagcctggagaaaaaaagactctgcagggagggggaaaaatctttaaaatgattaccatgaatatctttagagagataagaaatgatagtaaccatgaaatagtaattatagacaaaataaaagaacatctggaaagaaaagaaaaaaggcctggaaagttacatttatgtatttgtgtatattcacagacatggaaaagttaatagagagttgaaagataaacttgagaaaagctcctagaaaatagagaagaaaggaaggaaagagaaaagacaaagacaaaggaagaagacagaaagggaaggaagaaataagtttgcatggcccaagaatgtaatggtagggaagagtatgtacagttagctttggagggatgttcattaaagagcaaagccaagagctacaggaatgattacacaacaaactctcataagtgaaatctgattatgtcaagggttaacccctgccacttgctgttcacgatctttttaaaatgatctctccaacttaagcaccatccagtgggtataactgtacctttgctacgagcaatcatcttacagaactcagaatcaaattttgagtctaaaccacattatggtgaagtgttgatataaatggaaattgtgtcgtgatttggttccctggaagttatattttattttttatatctaaatttgatttaagcttttattcttataatctgccagttttattttttccccaaagcctactgcttcaaaagcaagttccagaaaaaataagcctgtctaatatgagtaaagaaagatgaatgtcttatgaaaataatgtctattgacccagatcctgctgagagagcaagcaaatccttaggtgcaaatgaggcacttattgctgccattcagcttcaggaggcttcacttattacatgactgttggagggcagtaatagttctttaataacctgaagagtaaaggagttttctcataatgacaactaatgctcgttcacttgtctgcaggtgattgaacatccgtcacaactcttcctgtgattctggatagaaataggtgagtcacaatcagacgttcaacatcagagtggctgagaagaaactcaccaacagccactggaaaactgatgaggtttctccaatctctttataaacttcttttccaattttctcaggcaataggaccagccttggaagcatttgccatggagacatctgaagtggtagcagagaaaaatcaccagggtatgaggcagagggccactgcctcagctgtcacctcagagtctcctcaagacctagccaaggaaatcaccacctttctccagccttggtgttctcctttgggactggaccaaggttcctttcagctttaagtctatgattccaacttttatcaaatcatactatttagtaagataaatcaaatcagccatcttagccacccgccaggctgaaaccactgctcaccacaggcaaatgagcaaatgtgtatttgcagggctccctggcatgtaggaagggaatggaaaagtggctgatggcagagctttgtaatcactttggaggctctgacccttgggtcccagtcacacaaggctggcagctgtgtcttatgctgcacggatggcaacaccaatccattgagcatgggccattgactcctgggtaattcattagcaaaagagcacagacccactctggtaacaaaagaaaatccataagcaagagatctcaaacaaagggaatgtttctgtctatgtagtaagacattggcttttaaaaggacactcactccagctctctgaggatgagcagttacctactcacaactaggcaggtgcagaacccccaacagagccagaaagcatgtcccctgcaagaataaatggtcccagagccacccctaaaggccacagggtgtttgatagcatcacaatttcttgagtctcagaaacaacctccttccacttctaaagaggcaaaaagaacaaagtctgtcagtgacaggcctggagtgttcacttactgatgacattctggcagatcttgatccattcctcctgggacttcagctaacgctaatcccaagacctcagctagtccagctgcagactaaggcctctatatgggttgtttgaaatgttttgggtcattcaaccagttactttttaaacagtcatgctagcccttacgagtcttcaagaacaatcatagttcggggacgggggagcggggggaagatgcaggcaaggaggctctgacttggataaaacaccagcccagagaagatgtagagagtaactgggaaggccagggagaattgggttcaaatctccaatttgccatttatcagccatgggatcttgtacaaattgctaacttcctttagtattgtttctgcactggtgaaatgacaatgatattacctaactcacatggttgtgccaagaattaaataagatagtgcgtgtacaacactgaagcccactaccttgcacacagagtaggtgctccataaatgtcagattcaggtgtgtgcccacactcacactaaccgaggatcccacaaactctttacaatgtagctaaacaattctaacaccactaccttagataaaaactgatccaccatgtgcactcaaggaaggaaatattaaacagggaggcatgtgccaacaaggaaaacaacagaaataattatagtagatcctctgtgccttgtgcccaacagaaaatgagtttgttgctaggttccttttctggccacaattcacggtgcaattaaattcctggcattgtttttcatgttccattttaaacagccttcttgtccaggtccctgtcatgtgacctgctcagtggggccaacagagaaatgagcccagtgggcctccctctcattggcacctgtaatgctcaagttcctccaatttgacatctgcccaagttactgaggtcccctaaaggaggaggttttctggactctggagcctccatctctgctaccaccaccattcccatggggtggaaaagaacatgggctttggggaaaaagaaaacacagatctgccactttggctggacagctaaacttggacatgttatttaaactcggagcccctaagtcatggctaattccacccacctgcaagactgttgcagatttacaaagtgagggacctggagttctcagcatagtatgtgaatcatagcagacctccaattcatggtaacagctattcctgccatgcccttaggtctcctcctccctctttctttggtccttctcagtgtcctttgtgtgcactcatttctccttgccttttccttaaacacttgtatccctaaacaaaggcttagtctttcattttctcttcttctgtgacaccactccccctgaacagtagcatccacactgatggatccagttctcacccacaaccgaatgacttgcagatggctgtcccaggccagtcttctctcctgggccccagaccactactttcaggtccacacttgactccttgtccggcttccccatgaccccaaaccatagacctaaaacaaacttcaactgcacccctgccaaagcctgcccttattcagctatcctcactagcccctctccagacagccatgggttcaccaacggctgtggtctgtacctccttgctagctttcacatgagcactatcttaccccgttgtattaccactgctttgctcaggcctttctctctaagctggcctccaggcatgctcctgtccctctatcctctcccctgcctcctgaatcatctccctaacttgaaatctcaccctgtcccttcgttgtttaaaatccttcagtaggtcccatcatctaaaagtaggacaaagatatttcttattaaacctgggcacttttgagagtgaaagagggacaccgttcatcattgtaccaggataacaggcataaacaggcataaagcgtgacacagtgagatgtacagtcatcctacccatgaagagcgagcctcagccaggctcccaaggcactttgtgacctagcttccacctgtgagggcaaccacacctccctttctctctcaaatgcaatctgctctggacttctccctgcatcccctgtgtcatgctcttccccacctgacacatccttctacctctgcctagatgctccccctgtccaccaggcagttgcctacatccaaccctacatcaccttccctgtgatgtctttctgctccctggagcaccctggctcctccactcccaccctctcaagtgcctgagcatgcatcatataggctctgcctggtgtcacaatagggttgggtgcagaatgcagtgtaggtgtccaaggtttaccagataaatacataagcttccaaccaatgatcccctctctcaggtgctgaactcagaatggccagatgtgctaagtcacagcagagacaacatactgacccaggcacactaggaccaagcaagccactagacctggcctccaaggagatcaaaaccaaacctcagcaacaagctcctgagatacagccggactcactctgcttcctgagactccctttattcttaacactcttagaagcaagtaatagagccatcttcacttctccccagaggagattggggacctgcggagaatctatgctgcagccacaagaatattgacatgagtgtgcacgcagggctatagccaggccctacaaccaggcaaggccctaaggactggaaaatcaccctctgctgaccattctcttccccttgttcagcctcctggcagataccaggttgtccacctcccagctcccaagctcacatgacacaaacccagctacctaagttcctctcccagctcctagtccaaatacccaggaaagaggctctgatcttgggttaggggcttgtccctagctcaatcaactgtaggtatctggcaggatgcttccagacagaatggccatggaggagcccactactacaaatggtggagaacgaggcagagcatcagggctcacatgagccaggtaaacactccaaaaggaaagtccactgcccacctccaccctagacattgcgttttctcctcccctcccccttctctatatttccttcttcctgggtatgctatttttcctctactataattatcttcacaaattctctgcccattcttcagaactgagaccaaatttcacctccccatgaaactgggtgtggctaattctaactggttacaaaatgctattcacattgcattaggaagctgcattttatttgtgatcatacttttccttcaaccctatgaatggtctacttaaattcagtacagccagattgagaagagaaaaaaaattttaaaactcccttccatgtgctgggcactcagaggcaacagggaggcttgggaagcttacaatctcacaagaagtaatgtacaaggtccctgaagagtatcatacaagtgtaaatgaggaaagggaagagggagtcaaagttgaatgcaaacattatttcccaagaaaggttaattcaaggatgatttttgtcatgttatagaagaactcttccattttcaaaatgatttaatccagcaatcctctaatagccagctccttggaagcattaagttcagaagttgactttggcacagaagcacttatctggggtaaagagaaggcaactgacataggacttcagacatggtctgaagaatttataaacggtatagccacttctcactgctagcagactggacatacaatcacttcaagctaatagatatattatgctctaaaatgaatggtattcagatccctggaactagatatagttttctaaattccaagggggtgcatcaagaaatagagcacaaaatacaaactgtgacctaagactgattccagctttgccattaaacactttcctaatcagggccccaaattcctcccctataaaaaaaggaagttgaaattaaagctctcagaaatcccttccagcactaaaattctatgctctacattaaattatatatatgcaggctccacaatatccctttggacttaaatgtcacaccaaaaaacagtgccaggcatttattaacaataaaaattcaaatgatatggaaaaataattacattttatcttttggggagacagaagcacccaaagacttttttcctgctgtaccttgtaaaaatcgttaacagcagagtcactgcaattaaaccaaacctaatgatgcaactaatcaatgcagctgcagaaaatgacagagtttggatctccagagagctgttgggccaggaagaaacagattatagatgctaagagacaggaagagtagacacccaccacagcagtggcccagaggcaaaggcagtcttccctttggtctcagcaggatcccacaggtgagagatcccagaacaagtctaacctggattctgaggaattcccataggaggaaggtatgtgagatgcacagtatgagaaaattgggaaggtgcccgcaccatggaaaagacaagacgggcacaagtcaacatggcttagaaactagaaacgcgatgattctttttattgtgatttttaaaacagaacaaaaaatttaccattgtaaatttttaagtttacagttcactactgttaagtatattcacattgttgtgcaaccaatcaccagaaatttttcatcttgcaaaactgaaaccctatactcattaaactataccccatttcccttccctgcagctcttggcaacgaccatcctactttctgtttctatgcgtttgactactttagatactgcataaagtggaattatactgtagttgtctttttgtgactggattatttcatttagctttatgtcttcaacttccatccatgttgtaacatgtgatagaatgtccttgcctttaaagctgaaaaggattccacttgtatgtatacaccacattttctttacccattaatccatcagtgcactcttggattgtttccacttcttggctgttgttgttaatgctgctatgaatatgggtgtacagatatggagataattcttataagtagattctcataagcagaaatgtctgttttgaacaacaggtcagcctaatgtttttcattgtttcctaatataaattattgctccttcttgcctaacgtggagaaaaggagggcaacagctgacaaagcccttcaccagcagaggagaagagtgtccacactaaaggactgtcgtgtgtgctacataacgaatgcccctgaatacacagaggagaccatgacctagtcacagggatgtagctgttccccaaaccagtggtcctctactagttctgtttctgtctgaggagactttctcaaatatctagaaaaatcttaattaaaataggtacactgtgacaaaaagctactggcaaatcagaagtgttttgaaataaatcggtattatattacactcaatcacacacaagtaaaaagcaaagcttggcaaacacatggatttaccaacttgaaatcattcccccccccaatatatgacccacaccaccaccatacctaccacctctcccaggggtctgagagccagaagtggggaacgcctccctaaaccatccctactcacctgttcaggcatctgtaaacctatcaccatacctataagagaaatgactaggattcaatctatgcctgcaagaaaatccctaaataaatttaatccacctctataaagccagccaaaaacatcagcaacctcgaggtaggtgatataatccggctatattcaaaagcccaggggcttgatgcctggctttccataatattaccattcagtctctaacatcaaataggcattaagcattggtattaaaaaataaatacagccaggcacagtggttcatgcctgtaatcccagcactttgggaggccaaggtggacagattgcctgaggtcagcagttcgagaccagactggccaccatggtgaaaccccatctctactaaaaatacaaaaattagccgggcttggtggcaggcacctgtaatcccagctactcaggaggctaaagcaggagaatcgcttgaaccctagaggcagaggttgcagtgagccaagatcgtgccattgcactccagcctgggtgacaagaacaagacttcatctcaaaaaaaatttttttaattaaaattaaatacatacccactcgctgttatctcagtaagaaccacacctcacctcatgtttgtactagagagggcacacaatctgagagcaagttagggtccatcctccttctaccaaacatcatctgattagaaacctggtggtttctttggggctcttagactagggaggactggacagaattctactgtgaagtgcaaccccagagatccccaaacacctacagatgccacctgactccctgtgtgcctgggctacagcggccaggactcaatgatttcttttcattaggtatagccactaaatggaattcaaatacaggtaagaatgtatgagtgacaaataatcagatttttttaactttacagtaaaatttccttgaacttgcatttgcaaacagcagcatatcaaagacatttttccccatcaatcaatttgaatcattcattcagaattaattcaatgatgatttcaaactccaaacatcaggttctccgttgtttcatctttctcagagttagcagacactttgtacagagacatcctgcacttggcacctgctccactttctgtgccctcccaactttcctcctcccgtggggcagggccctatcagaaaagccctgcctgagagaagaaggtctgcccttcagtaggaatctggcctgacacctgatttccacggagttgtcagtggggtgccagggaagtgagacagcactcttcgttcaggtgtcacttctcttccacaatcttccagtgatctccctaccctcaggccctgcttcaaggcatcagaactgctaagaagccaggaaggagatgcttggcttcagcccccaggacagttgcaggaccaggtgccctggcactctttccagcctgctggctggtcacaatcgcaaagtagaaaatgatttcttctcaactgacccaagggcccaataccttctgcccagtgcaacaaaaagagagatagtctccttgaccagacacaggcaatcctggaccatgtgtcaggaacatgtaccacctacacaataactttgactcaaaaacatcctctgctctaccccacctctctcctctcagcctaaataaaataaccagttagtttcctcagaaagtagttttaacattagctctgctacaactgtgttttttcagtcttaagcagttctgattgtctgtgtttccatggccagcaaagagaggcagcatcacagagatgggctctgccaagtagatactgtcaaattttagagcctcttgcctctctaagtcccagtttccttatctgtaaaatgaggcaaaacccatgtctaagattaaacaaggagcctggcacagtggctcatacctgtaatccctgtacttacggaggccgaagtaggaggatggcttgagcccaggagttccagatcagtctaggtatcacagtggaaccccatctctatgaaaaataaaataaaataaaatagccaggtgtagtggcagatgcctgtagtcccagctactaaggaggctgaggtaggaggatcacttgagcccaggctgtagtgagctatgatcatagccactgcactctggcctgggcaacaaagtgagatgctgtctcaaaaaaaaaaaaaaaaaaaaaaaaaaaaaaagaaagaaagaaaaagaaagaaaggaaacaaaataaaaggtaaataagaaacaaatgaaataattttttaaaattaaacaaggtggcattcataaaaaaaaactctatagaagagtgtgtccaaacacacatggtagatacctcccaaaaagggcaggatcttctttcctcaatgcaaaaaagcccagggaatcttcaagctatagccttgggggagtgagatgttgaggtggggaagggcaagaagattgaggacctttcttctcaactttaatagttttcactcaaattgcaattgatgacaaccatcagaggacttgtgtctccacacctgttctagggaatttatcacctttggtaatgataggtgttaacccactgggatagagtgggttcagttccactcaaagactgctgtgattcttgtccttttcagccctggtcaccactctgtggcatcctgcaccagtgcatgcaaatctgctctgagttttcacttgagcattccaaaaatgggggcaggtgcatctccccaggaaaggtgtggggtgtacatgcatctcagcacctccagctcaatcagggctgacttcatgggtgtgtgacctgcgcattcacatagggcccatgcttagaagggccatgctctgctattgccatcttgaaattcttagtaattttttaacaagaggcctcatattttacttttctccaggccctgaaaattatgtagacagtccttagctccgaacttcacaacaatattcagcttctttcaaaactgttctccctcttttttcctgataatggcaccattatctctcctattacctgggcttgaagtcataggctctctcccctcactagccctctgcatctgaaagctgctagatgctgccaattctatctccatgctgcatccgtgtcatcccatccattctcactgtggctgctccacctctctcacccaaactattaaaataccctcccgaccagtgttccctcttccaaactcctccacagctcatcttccctgcccacccatgccaggcaaatttcaccaaggcaagagcaatcatggcattctcctgctcaaagctcctcagtctctctcagtgtagcagttcagttgctctgaagccactgataatccccgcacctggcccagtctaggaacagacccaccctacccaggactcaaacttttcaggtaagccacaggccacagggtagatcacctctccctccttgatccttagtctaaaacagaacagttttccccttcttaggtaatgccattcttattatactccatgctcccggcagccaggagccatgcttgatcattccatctctgcttacccccaaacactcctgcacaacgcagaatgtttttcaaagtgactgtcacaatacacagtttctcccaatgttgccccaagctcacgtttcagccttagcagggatgaactcaatgcaatcacagtgctatttacaatgtattcaattttgcaggacacctgtcacttccttttcttctttttttagtgacaataaacaccaacagaagaattacattaagcataaacagactcttgaaatctacctcaaagtaatatgaaagatctgcactaatccagctaatgtgctttccctgcaacaccacgtaaacccagctctcatttgaatatttaacaagcaacatcttggtaaatctcattcccttgatctatgtagaaataaaaaatggatttagcccattcagattgtgtttggtcctgcacatacattttatgcctccacttgaaatcttaatcctattgcagcacactaattctggcttgtataagatgctgccagcagaatccattgatttgcttcacccatttacatttgtatccttcagccagtcctgtaacgttttagctcagtaagtaagcatgtatatttttgagttctacaaattagggtaattttagaccctaaaggttgagtttcccttatctaaaatgcttgggaccagtagtgttttagattttggattttttccatattttgcaatacatgcattatatactgaccttggttaaacatctcaaatttgaaaatccaaaatgccccaatgagcatttcctttgagcatcaggttgatggccaaaaagttttggattttccagtgtttcagattttggatttgggatgttcaatctgtataacaactacatactttagaccactaaccatgtagaaaaccttgaaagtatgttttgtaaaacaagccaaaatttaactatttacattcgtggtatataacttcaccatcacatgccgtgtgttttgtatcaaaatgatatgattagatgagcttttttgccaatgaaatgtatttttataccaattctgctggcttgttgctgtacatactaagaaaatatgaaaatggagtgttttgccaagtcattatgaagccgtcattttgaaagggcggggcttactgaatcccaaattatttagttatctttttccccatttgcattgactattacctactgccacctggtaaaagaaaaaaagtgaatctgattcaaggtttataacatagtagttttgaaagaactcatctttttaatttgaatgtgtctaacagacatcctaaaaattgagattgtaatgtgcataggtgacatgtctcatctaatacctcatgtaataattcttgtgagaaaataaacaacaaaaacaaatcccaaagcatagttatgactacaatggtacttgtatttttattacttgcatttcaaatgcaaaagctatagtttcccttttgcttatgtggcatccttggcacatgggcagttatctatcctatgtctgtttcctccactgctctatcagctctatgagggcccagatgtaaattctcaagaaatatacattaaatccaatatcgcttttggtcctggtgctagtatcaaagcggcagagctacctgggtggagaaaaaagcactctcttgtttcctaagaattttctagggcactagcaccctaagaatccaggacaccttcaagtccatgaatctgagttttagaaaaagagaagatgaatgttacttgacttttaagtctttttccactttatcatgttcttcacctcattcaaaccaaaggcaaatattagagagctgtgttttctccaaatgtcacaactagtaggtttgcttagaaaaaataaggcacgcttctgaaataaaactaaaaaccagagcccacttggtccttccagaaagtgattatgaaattcgctgtcaatgctaatggtaccagaagtacatctcaaactccctgattccactaaaaagcagtgcaggaaattcagagtaagaagctgcttcatatacacctctcattaaaaataattgtcaattccctgtgtgctctctgtgatactcttgggtagctacaggaaagaaaaaatgaaaacacgagctttatctaccaaaaacagcccagtagtaagaaattcttccaatgtctaagaccaagaaaacttgggcccaaaatatcaaggcactgaaagctaaaaccattattttggctcaatctagtgaaacaattgtccgcaattttctatttcattcagtatggcaaagcccagccacgggaatctagagcgctaatttcagggagcaaaaggtttcattccatccaaggctgcactcttgttcaagaatagttttcttaataagcctatcagcaccacggacagttccaattagcattgctgagatacatattaccactgccccataggtatctatgccacaatagtgatgcaatttaaggggtagagcgagacatgatcaaggtgtccttgtgtgtttcttattgccctgttctgtgggggtacagggggtgcagaaaattaaaagtaaatgaaaaatcaaggtcttagaggtctaatgtgattgtagtggagtccccttattccctgggtttcacttctccaaactaaatttagctgtttgtgcatggataaatgcaaatgcatgccatgctccctaaggacaaacattatgatgtacaaggatgtcactatcaagaataaaagacggatactacttgggatcaggaaaaaaaaaagaaaagtaagatttcagagtccatatattgtattcaagaatagcattggtgagaatagtgaagataaatctctacaggataaaatagaattgttgtctctgttagtgtagcccagctcatataacttaaggtggctcatctaactagcaaaacctgggcctagatgggtattaatgagctcaacaacagacagaaagccagacttaagaggacagccacccctacaccaactctggcaaccacagggtgggttataagtcaactgcaaggatctcccccaaaatacctagaagaatgggaaacacattcggaggatcactgagctcctgcttaaggtggctcaataacattcacatgaaagagcatttaaaatctcttttacataaccaaaagaccctaaaggaaaggccatattcctataaatccatacaagtccctcaaaatctgctgaggctggaggggaggggggaacaatgagatataacttgctaaggtaatgaagtgagtcccctagaagaattcaaaattatttattccagcaatgtttgagagaggctcacagtgatttgtattctcattcaaaaatagatattgattcctctatggaaggataaataaacattaaagttacatgattggcatgatgagaatgttttcccttaattttgttttggcaaaggacaatgaaaccccttgaacaattaatcacaattgttgaatcacagcaataaatgacagctcttatacaatccaagaccaagaatgctgtcaaatcatatatatgcaaaaggggagttgcttttagatgccagctttttggaaagctgtcatgcataatttggaacatttgaatatgaagcatatatctatctatctgttccattgttttttaccaagaaaaaataatacatgagaaaatggtctctcttttccaaagtaaatgtatcaccaaataagacctccattgtcttaatgggtaagtttctccagatacatgttcaattctcaaacctttgggttatcagttcacttagctaggaactgtggagaaatggtgccacattttgaggctgtaacaagactttgtaccttacacaagagaatgcacccatttatcattgggataatattacttcactttcatcttcatgagcatgtttccttgatggatctgggtctattcacaaataccaccttatcttaaggacaataaagttatctgaggccagaaaaggtggagggacttgcccggagtcccacagtaactcatcaagaaggaaagatccttctttacagacggttttgtttccagggcacactgtaggcaccaggctgcctgaatcaaactaagatagtttctctcagaatatcgagcatgtctcctaggagacagggcccaggctggcctaacagggtatatgagaagaatagctgcttcttggagcctaaataaagacaattctaaagagacagcagccagtcaaagtcatagccctgagatggcctggaataatagcaaccatttaccatgggaatctgtgctgatgtggtctatagtaacaggttgcttcttgtctctaatacctgcagcactggggatctgacacacttagaggatcttctcttaaaatggaatcattccttcctgtcagccaccagctttcttcatggcttaagattcagagacttcctgggcacagtggctcacacctgtaatcccagcactttgagaggtcgaggtgggaggatcgcttgagcccaaaagttctagaccagcctaggcaacataacaaaactccacctctgcaaaaagtagaaataaaaaaaaattagctgggtgtagtggtgcacacctagctacacgggaggtgaagcagaaggatcacttgagcccaaggatccaagggtacagtgagctatgatcacaccactgcactccagcttgggcaacagagtaagaccctatctctaaaatggaggaggaagaagaaaaaaggaggagaaggaagaaagaagaaaaagcaggaggaggaggaaaagaattcagagactaatttcttttcccagtccaatttaataagtgagactgctcatatgagggtccacagcctgaatctgagaaacttctgtagctgtccacagtgtttaattatcaccgcccctcagttgcttctcctatttctcaggagattcctgctcgatccagtgctcacagctttcctttggacaggaggagaaacaggattctgtattattacaaaactaacataaccaataactcatgtgtcataattcatggagctgtttgtacatacttttaatacttataaatacaatgatttcttctctcctcttggcaaactgagaagaaatgtgccctttataacttctaattctctaactatattaaatgctaaagaatcttggtaattcctgatcccagattgtatatttatatccaacgacccaagggtgtttttgacccatcagcttaattagaatttttgatgtatttattcagtcaatgaacacttactaaacgatattatgttctgtcacaattatcaccactgggaatgtatatgaaaggagaaagtctttgtcctcaaggaggtaataatgaatgatgaaggaaagaacccataaccagtaaaatgattgtctatagggactatgacagaagtctgtaatggataccgtggtagactgaaacaataactagtcacctagaaccaatgggaaatttatataaattttatctatgaaactataatcatgataccaaacagactacttcaatacaagatagcttgacacctacagaagaaattcattgttaatacacactaccaactactatacctctgctagtgggtatattaacctttgtttcaagaaactattcagtaaatctgaagtaagtctgcaagttgtttggccaactcatgttttccaatagttatcctacttaatggtctggggctctcagtttagcttgatattcagtagagaataaattgaaatttgaaagcaactcatcagatagataaatcactagctaagatgaggcttcactatcaagaagaaggagtttcacatatggctggttttgagcagaaacccacacatacacagatacctgcagaggtccttataaatttttcagaggaagatcaaagagaaaatagacacgaatgggttggatcagaatgatataaagtggaagcagtgccagtatggattagaatttagataaagtctatccatgcaggatgagtctgagcagaatacaatattcctaggcttgaggagactgatgaataatatcagtgtggggcagtgggagagcatgagcagctttcagactcaacgtcacttttcgagatttttgttttcaccacgccaagaatcatggagcctttcaaatctcatactctggattgactattccttctagacaaggctgctacattaggctgcacaagcaggacagtacttgtgcaaagatgcccctggaggtatgcagtgtggcagtcctctttcaatgagataagctaataaggatgtgttggggttttaaatcagtaattcaactagccttgtttgagtaccaactatgtgccaaatagcgtgaaagacattggagatgcaaagattaaaaagcactgagcctaccttcacagaattactacattccttttatttcaacaagaacatattggcttgtctaatcatcccagaggggaaaaaaggggaatttgttcctcgaacaaggtaactctccttcagttttaaacaaagtgggagctgcatatgggggataaaccaaaggatacaaaatgagaaaacccacagaaatgactcaattctgttttgtggttattaaaaataaagaaaacagtggcagccagtgcactgctaggaaatacaagcagggacttaaaggaatgttgaggtgtcttttaaagagaggtggtttctttatggacgacaacatcatcattccagtaagctctcgttctaggttaggctggactcttcttggtaagtcagaaaagcacatttcagaaggaacaggctatgggagagacgacctggtgaagaacccacataaatagacaccagtgtcactttcttgtgacatatgtttaagacataggactggccagcaaatgctcctgaagacatcacaagctttgctcatcatttccaaacctgggtccataatcaggttctcttgaccagctaggaagggtcttagaaacaaaacaaaacaaaagaaaaagccaagagttgacactattttctaaattttctacaataaacatatgttactattgtttttgtaataagagaaacaaatttttaaaatacagaaagtattaaatactgcctggggcaacatctttagcccctagatgccttaactttgcaaaataattcactcttcctgagaaagtcagtgaatcttgaccttcactcaagcttttatggtaagatatggtaaaaactcatgtgctactaaatttaagaaacattactgttcaattatcccattttgctccaacgaaatttctcctagagtaagggttccatttcttgtttgttcgttttttttagcttttaccaataaaggcaagaaaacatctaacattcttgggtgtatcacattgtccctttgagaaaacacatgtgctctgtgggcaaaagggaagcacttgagcatcaaatgacaatacacagattagaccctcagctaaaataaaatactatagaaatactcatgtcaaaataaatactagaagcaactgttctggggtggttttatcatcttctaagcccataaagatgggccaccaatttggatgtgctaagttggaatgattttaccaacagggaaacagagaatatacacaagaaggaaagtctgtctgtatcttaccatttcccagtgaaggtgcacacacaattccatgtggtcaggtggtccagtgagtgaggctggcagcccaagtccaatgccctatatcgagtgagtgtgttggtgactacatgttgaaccagacagggcctgctcttgctcaaactgagtgggtgaggatgtacgtgtcgtgtagtcttctgcgagctaaaaacaagacctattattgaattcaagagcaggggaagcatcctcaagtctgagacaaagaacatttatcaaatcaatgccagaagcaacaaagcagtccctgtgaccaggtccacctatctccagagctgaccttccccctcaaacaaaaataggcaactcccaactccaagccttaggggaactttcccatcaatgaagaggtggttccaagagcagaatgtccttgccttctacaaacagagagaggctaatgaaaggcttttttttttttttaattcattgctcacagctggagttgcggggaattatttcagccagggacttcttttggaaactatctgaagagctgaccggaacaccaagaaatttaagcaatgctactccatctttccggactatttcatggggaatatactcccaccctgacctgaaggaggtgcatgtggtttccagcttgttcacagattctcaccatctctgaggcttttctcgacaccatcaataaaccaagtgccctgcgctccaggagctgacggtacactggaggagataaaaaggtaaaataactacatggtgaggccattacagacaaagactgtaagcactagagccattcagaggtatatgaaagatactcatgaattaaagcaactggggaaggctgcccagaggggcaggtttggaactggaaattgaaggtgttcctggagtgctaggataatggaaaaggtatgctaggagaaggggcttggcatgtacagatgcagacaggatagtggcatttacacattgtgggtaaacatgtacagtatgggaaagaatctgtgtaggagaagtatgagcgagaaggatggggcagtaagtaggactaaatggtaaagggccttgaaatccaagctaagaggtgtggattcaattcactgaattgaattagtttttaaagcatctgagcaggtacatttaaggaaaatatgacaaatatgaatcaggcagtgggatggtcagagtggtgtaggcctgtgctggagaatgagcaatggctcaagaagtctgggagatctggcttctacatctgcaaggtgaggagtctactgaccaggactcctctgaaaatctccgcccctgtatgcttaacaatcttcactgcaggggagtaagcccttaggatatgacgcctccagggagactcttccaggtcaaggtacgggataaggaccagcctgtttaatgcacttagggaacacagaagagccaaggagtaaagctcagcagccgctccctgccctcctcctctgccccaaccctacaggagacattgaagtaagctggtccagcagccagcagatgcaggccaggctccaggatgaatattggacagacagagaggacaatggtgactgtctctagcagagaggcaagtaacatgaagttgcaaagactctccaagcaaattcactctgagtttctacttgttaaacttgatgagtagagaaggtgatctctaacatcaaatagaatccaattccttacactgatctacatggccctgtatgatctacaaagctctacatatcaattctaccacactgctgcccattgaatgtactccacacatccttcttttattcctcaaacacaccatattcattcccacctctgggcctctgcgttgctgctccctcaaccagaatgcctcttcccagatcttaaaccagctgcctccactcaactttctacaaggccttcctggctgctcttatttaacttttgtgcccccaaggaggcatatcacatgtatcacatctccctgtcaggtcttcctctctggacgtagctctatcagaaattctaatatatgtacgtggttggtttgttgtctgtggccctattagaatataaaacccaggagagcggggacctcttccgtcttgctcaagtctgtctctccaggatctataaatgtgcctggcacatattagtgctcaatacatttttgttaaataaatggaataattaatcagtccgtgtcttgggagatccacgaaactttacctccctgggtagaaaatctgtttaagggtatgtgatgctcaagcagatcttaaagagactgcagctacagagtttctagtttcttttaaaccatctgcatccaagacactggcagctgggtattgtgtatgctcacatcaaatggaggaaaaaccatggggaaccagctgaacacacagtcagtgagaaaggatacttccagaaatgtcttcattaatgaagcagcttttgggggcagccccttgaaatgctgtcagtgttgctaataaaactcccataaccacggacttaagggcgggagagacaagggtaagatcactggcattccactgtgattgaaataagagtctcctggaaagcttaggctgcaagtcacagtgtgctccagggcctgcatttttgttctgcccgtctctgggctctaatgaggctttatgaaaagcagagctgccttttaagaaaatttcatcctaacctagaaacagcaaaatgcagccaagtctcacttactggtactaacgagatagagagacaataactgaaactcagataaatcagaagtatcttccagcaaccctctctatgatctaataataaaaactacccccatttctgtagcatttgattactcacaaagcactttcacatcccattatctcttgtgatcctcaaactccccatgaagccagtgttaacatcaccagatgaagaaactgaagctcaggaaaacaaggagactcatccagagccccagataaaaggccaaatgaggactcaagccatgaccctctgactatgctgaaggggttaacgcccaacctgtgcctgcacctgctggcagttaaagccttaagcgagaggaagtgggaaggtcctgatggccccctgtgcttagcctctggaggccaccaggaggccacatctgggcaaaccccacacccttacagccactttattttcttttatttttcactgatagaatttcccattgtttctagcatgcacatttctccttgacagccaggatccagaaagaccccaaaggcaggaaccacatctgcttttcctctggcagcagccagagcctggagcttccatccattcaggcattcagcccaaagtttcactgcagctggatacagacaaggccatggctcacactccgaggtgagaaaggtttccaaggtcagactaattcctgcaagccacagacactgggcagctggatcgtgcactggctaaggggcaggttcgtggtcagactgccaggcttggaaccccagctccgccacttctcatctgtatgacccagggcaagttatcttgcctgtgcgttgttttccttatctgaaaaaaatgaggattatagtggtattgatgacatggagctactgtgagtattaaatgcaaagcacttagaatggtgtctagcatattaagcaggggcttaataaatgtaagctattgtcactaattgctcttatttcagatataatgcccttaaaaggttaagagagtctgcaaagaaagggatggggagaaacatgtccatgtgtcagaatgtagcatgctgaatagtatctcagagagatgaacaaagagccaaatacaaaaccaaaaattcactagaaggaacagggagggcttcactgagaacagcaagttcattctagcttcaacaagtgctgatagtttcggtaccattcagggagtggaaaaggatgaggctgaagagatgagcaggagccaaatcattcaggggcttcatgggccacagtaaaaatttggaattagtcctgaggacaacgaggagtcatcactgaagcatgttaagcaggaatgtaataagatcagatttaggtttcagaaatatggagctcaaagccaggtccatatggaaggtggcttaaagatgatgtgctccactactgggtatatacccaaaagaaaggaaatcagcattttaaagagattctacactcccatgtttgttgcagcactgttcacaatagcctagatttggaagcaaactaagtgtccatcaacatgtggtacatatacacaatggagtcctattcagccatacaaaagaatgagattctgtcatttgcaacaacatggatggaactggagatcgttatgttaagtgaaataagccaggcacagaaaacaaagacaaacatcacatgttctcacttatttgtgggatctaaaaatcaaaaccattgaactaatggagatagagagtcgaaagatagttgccagaggctggcaagggtagtgggggggtgttgggaggagggaggtggggtggttactgggtgcaaaaaaaaatagaataaataagacctagtatttgatagtatagcagggggactatagccaataataagttaattgtacatttaaaaataactaaaagaggccgggcgtggttgctcatgcctgtaatcccagcactttgagaggccaaggtgggtggatcacaaggtcaggagtttaagaccagcttggccaacatggcaaaaccccatctctactaaaaatagaaaaattagctggacacagtggcgtgcacctgtagtcccagctactccggagactgaggcaagagaatcacttgaactcgggatgcagaggttggagcaagccaagattacaccgctgcactccagcctgggcaacagagcaagattccatctcaaaaaataaaaaaataactaaaagaatgtaactggattgtttgtaacacaaaggataaatgcttgagagggccaggcatggcggctcatgcctgtaatcccagcactttgggaggccaaggagggcagatcacttgatcccaggagtttaagactagcctgggaaacatggcaaaattccatctcttaaataaaaatacaaaaattacccaagtatgatggtgcaggcccgtagtcccagctacttgtgggggctgaggcaagagaatcacttgagcccaggaggttgaggctgcagtgagccatgatcatgccactgtactccagccttagtgacagagcaagatcttgtctcaaataaataaataaacaaacaaacaaaggcttgaagggatggatactcaattttttgtgatgtgatgattaaacattgcattcctgtattaacatatttcatgtaccccacaaacatatacacctactatatacccaaaaaattaaaaattataatttaaaaaaaattaagaatatggaaaagatagtgtggcaagaaatggtatgggcctaaattaagagactgacaagaagccagtgaagatgggttgagagcaactgaggaggtcaaatggacaggcctgggtggggtggggtggggtggtagatagcaacagcctgccagtctaggtgacaggatgaatggcaatgccactcaccacaatgagaagcaagaggaaaaggagcaggtctaggacaaagaggaactcaggtctgcacatgctgactgtggggtgacaaggtggaggggccatccaagtggagaggtcgctgggcaaaggaacgagtgtgtcttgaacctaggagaataacctggactggagacacgtattggagtgtgagcatatatgtggtagcagaaacattcctagtgaattaaattatccaggagagattagtaaggtgaaaagaggtctgaggacagaaccctagagaatcaccaatatttaaaggttgagagaaagaatatgactcagacaaaaagacaaagccagagatatcagagagaacgtgcagaaaaccttgagagaacaacgctatagaagccactggagaggaagggagtgccagataacaccagagtccaggattcacgactgaatgagaagtaatcaacaagcacccacggccatcaattttggttatattcataaaatacctccacaaggaagatataagatcgccaaataagtgaacacatttctccaaatttaggttgttgaagagactaccaaatcaaacacacttaccaaatcaaacacacttgtgatctcactgaggttagaaaacaactctaacatcagaaagctgccaaaatcatgacagctttaaaaaaattaaaatcatgacagctgaacaccatgggcaaagcaaagccttggaatataaaatccaagttccattcaaattccttctcataacaacattaagactaatatataagcttataatttctaaaaattgtaaactcgtcttttactgagagcctcaacttgattcttgtttagctggaaaagttctattgaactgtcagggatttttgctactagatacacaggcacatctctgcaatacaaagtctgatctgaagcaacatttcaaatagtcacacactcaagacacatttcatatccaacacttatttgcaatctgtgtctgtatatgccaggttatttggcaatcactcaaaattaatctatttaggtaagcaattatcatgcaaccctacagtacttaagaagttgccaaaaatcaattctgaggcaagagatatagaatcacaccaaagaatagaaaaacagacaacaagagtcttggtcttccaagatttctaacaaagaacatatattccagaatccagggctcagaatcacaatgcatacaaaattacagcacaaggtcttagaacctcataacctaaaaccatagtgatcatacacaacatttatctcttcccccaaacatcttacattcttctgttcattacattttaagatctacaaataaatgagataaaatggaacataagcttaaagactttattactggtttaaatattcacaatgccacaatctgcctcagacaaatcagagtcatgtggttaaatgtgcaaacaattactcgatttaatttcatcttgcagaagttgaaaacaagctgtaatcacagtggatgctgctcattttattccaaaagccaccatcttttgtgttcctgattggattttattcttggacacaagtggagtgactgaccagaatttcttcctgggtttccacactaagcatgctaattcatagggtattaagagggtcatgcctaaataaaacaacagctggatctctcctaaaggggcttatttcagctccttaaagagacagggtccaagctgaggcactgcccaaatcttcatactgaacagttggacaacttacttgcattgagtcctggaagctcataaagtcaggagccctggtctttaggtgaggacagagcccaaagcaattccaactcatagtctaccttcagattgatgggtaaaagcagactccaggatcacactcccagtgctctgccaaggccttagacaagttattcaatctctctttgcctcatttttctcatctgtaaaattgacataatggaacttacatggagttaatgtgaggaatacataagagtgtgcatcttaagtgtttagcacaagaccttgcctgtattaagttcccatgagcatcatttgtagctaaaaacctaacagggaaaaatctgtgtatgagttatctatggctttataacaaattacccccaaaattagtagcttaaaatagtgagcattaatgatctcagattctctgggtcgggaatatgagcacagttttgctcagtgcctctgcctcaaggtttctcacaggctgcaatcaagggatctgccaaggtttcacgggaagcttggatggagggaggagccacttcacagtccactcacatggttgttggcaggattcagatcctcaggaactactgggctgagagcctcagctcctcgctggctggcaactagaagtttcctttggttccttgccacatggcctaggcctctggtagggtaacttacagcatggccactggcctccatcagggcaggcaaagaagggagtgagagagggcacacaagctggaagtcacgttctctgtaacctaatttcagaagtgacatcctataattttgcaatattctactggctagagatgagtcactaggtccagcccatactcaaggagaggggactacacaagggcatgaatgtcaggtgagaatatttggggatgttcttaaaggtgtacctattgcaatctgaaaagccaaagtcttcacgatgagcttccaactcttcctttccttctttcaacaactatttgagtacctacttggtgccaagctatgtgcaagagcttgaaaacatattaaagaaaatagacatacctctgctctcatgaagcatataacatagaagaggaaacagatattaaagaaataaaacaaatcatcattgacttaaaggtgtgacaagggcaatgaagaaaaagtacatctgataacaccacaggaagaatgtgatctgcttgggattcaagtaaggcttccctaaagaagagagccaggctgagaccaaaaggatgagaaatagttaaccaggtaaagggcagggccggtaaagagacagcatttcagacacaaagggaatagagtttatgaagactgtgaggttgaaggtatcttgcacatggcaggggctcagcaaatggaagggtggaggcagatatgtgcccaagcaacaccaaatagaaacgtttctaattggcccttgttctcaactaaattaaattcaacaatgtacttcaggcaaattgaccctccatggtttaggttggatctacaaacaatccagataaacagagttaataaaatccactttggtttcaaccctccacactttcagaacctccagtgccttcagggcttagaattattttaataatttttccattaaaacagctttatacaataggacacactgtccctaatcaaaatgagatctcactccaatggattgctgctaaccaaaagacactcacttagaacaatgaagactccttctcattccatttctttaaactcaatcaatttttacatgagtaatgctacttagtgactcctgcagttaaagagaacagagggctgccaatacatggcagagatagactgaaacactcaaaataaagatgcttttcttttgattcccgtgcttaaaggataaacacagaaacagacacagaccagtgggtgtttaaagaactttcctgcaaggcatttgaattctgcccagcgctttctcctgcttaccagcaagctgcaggttcaagtaccagccatagaatgacacatttcaatacatctgaaatctgatgtatttgtacaggaaaagaaattaacagttgctcattatagccacattaacctgggctaatatacttatgacaaatggccaacattgtaatcctattgacgaaggaccatcttttctattgatgctgtgaaacccccaagtacactgtcagtagccaatacatacataataataatgcagtggaagtttggggggccggtaacacgtttttattatgctcaaaaattgagtgtcagctgaaagtcagctttgggaaaagcccgccttcagccccacttccaggatggaattcccaaagtaaaagccacagggagaacgaagcaggcatgatcacagttacatgctttcctgggtcaagaagctgtagtgagataaaactgagaaagaagggccgttccccccaactcacacacacatgccgacaactgtcccctcacccacctcatcacaattaaggcccatgataatgggtgaaggggagtcaggaatgatgggcctacggaaaactacttaataaaagagttaaccttttaaaatagttttgataaactgtaggaagctggagggccctaaatttagagtttgtgggctgacaaaacaagcttctggctggaagttgaaagaactggattccagcatcaactaattaactctttggcctttaacaaacatcttcaatcagtcaattaacaagtcattattgaatagctattacatagtcagtgctgagaaagctgtgggcttgatacaaaggatgttaggatttcattgcttgccctcaaggaacttaacattttaactcaggaaggaaacacgaatatgtagtcagctttccagaacccgccaggaacaactctgttattcagtcctccaagagttggaacctttaaattcaacagctttttagcagttaagtgcttttaccatagaaatctttcagaaatatactatctcaccattcccaaagttgttttttttttaaggcacagaccatggttcttatgaatattaataagagttatgcaaaaaagtagggagatcccatggtaagtttgggaaacaatgagttgaaaagttaaataggtttctttaactatagaacaccttggagccctttaaaaactaatgtgtactgcacatatctaaagggagtatattatgtacttctccagagaatcatttattctcattggattaaagttcagtgcaacgtactttggaaacactgtgatatacacaccccgttctccttgagtaaatgctcctgatggctcagaactgtcttgtcatggacctccatcatggggatggactggtgatatggatgagctactgcatggaaatgccttcattggccacccccacccaagaggctatttcatgggtggaagctgtggacactactcagtcatgctccactattgactatgctgctatgaggtgggctttgagagcagcccaaatttgacattcccatctgggacccagaggctggctgtgaaaagctttcaggacctagaacactcttcactccatgatgctgctactataagttatctcctacccttgaagctccacctcccttagaaagactctaggccacactgatctcctgctccactgagaccacagatggcctgcatgatgtttgtggcactcacctgggctctgccttatggatttccatccacaatgaaatgtatttggccatttattgtggacggatttgtgagtgcatcctcagctaaacaatatgttccacaagagcagtgtctgtgtctccctgtggcactgagaacatacttttaaatttttgctgattgatcaagaaaaatttaaagagaaatgcaaggtatttttacgaaaagaggtcagtcaagctcagtcagccatcctggcattggccttctgagataagagttatgctgtttgtcttatccacaggcacagtgtgggaggtgaggctgtccccacactgtggtgatagtattaataagaagtccaaacccagacagaggtagaggaggctacagggacatctggaaaggcttctgaaggtgtggctgctgagcatggtgccctcgagaccccaccatgccctgaagtggtcaaccatctccaagtgtagtctggtggctcatgcaagagccatgcactctgcggcccatggagactgcctttgtaccaagcccaccaaagccagaaaggaaatctgctttcttaaaatcactggtcaccagtgaatcactgttttgattttggtgaatcactgttcaccaaacagtaaacagcaaaaaattctggctgccctctctccagtactaaaagggagaatctgtctggaggatgctgcccagtgtctggcagaatttccccagcctcacgggaagcagatcagccaggtctgaatcatggctctctagtgggttagtcatccaaccttgggcaacatggttagtgtccagggcctcagtcttctcatgtgtaaatgtaaactgggggaaaacagttctttttcatagggttgttgtgagagtaatacgagttaattgtaatatgagttaacggtgcaaagtgctcagcccagcacgtggcatgcagtaaatgctcactaaacgttggcattattgatcaacagctccacctgctctgtgcaggacttagctctgtccaactctccaatccaagctgaggtccccagagccacatagggtgatcctgggctgatctattcagatgacataggctcaataagtgaaatttattttttacataattagattggcagattttgctgccctccccaccaaatcataatactcctcaaagttaaattagttgtgtatttttatctttttttgtttgtttgtttgtttttgttttgctttgacacccaatagctgtgaggatttgggcagcttccttatctgtaaaaatggagatgatgatggcacctacttcattcagttgctgcaaaggttaaatggaatacaagtaacatgctcagcccatagtaaattctcagtcagtagtcaccgctattcctatctgtgcatctacatttgccagaatcaagagaaagatccaccaccactgctttttctgccatagtgtggctaacaaacattgctggagacttcaggaccctggtgactattctaaagtaatgtgaaaacccagaagcagtcctttcctacccagcatagataatgatggttcctggaggccagcagtcagcagatcagacccacggcaaagtgcaccatgcctaggagggcaaggtctcagcagccagaaaaggagcatctcccaagagcaggaggaaccccatcactccctccacttctcagcagggaaataagaggctgagaacaaggtgattagggaactccacagccttgcaatcagcaaagaggtaatcacatgcccatgggacctgagggcatgggaaataatagggcagagtgacttcactcaggtagactgcgcaggagaggagaacagagcaactgacaagggtgagcagaaataaaagggatgaaaacatccctcaagtcacaaactgttcttccagagtcagactctccctccactaagaaattcatctggagggtggctcgccaaagactcactgccacgaattcttgggaggacatgcccggggccctggcccagtgctgccagcagaccctgtacacacttggagtggaccttaggaacagggacacttgatgagggctttagtctgcggctgcaattctccagagacagagtttctggtcagacaggagcaatccccatcacactatcttctcttcaactcccccatcaccaccttatccaggaagaagtgattctgccaggaaaaagggggctcaaaccttaaaagaatgtattaggtgtacaaaaaaaaaaaagctcagtgcaaactaacatttcactgagatcacatgtttttcctatcaggacaaaaatccaaaaggcaatcactcagtcagtcgggagaaaataggcactcacgtgtgctgctggtgggggctttaactggggcaacccatggaaggggagtgtaatttggcaacattcattaacataactaatgtatatgcccttggaccaaacaaattcgtttctgaaatttaacctacaaatacagctgcacacgagtgaaatgaggcttccctaagattattcattacagcattgtttttaacagcgtaacacagggaacaaccccagtttccaccaataggagacaaggcaaataaatcaaagtacattcagacaatggaatatacgcaactttcaaaaagaaaaagaattagaacccaatagaaaaatgggcaaaattcataaaatgtccacacagaatatttgaaaagatgctccacttcactcataatgaaagaaatgccaattaaaactacactgtgataccattcctcacctatcctgcttgcaaaagcccaaatgcttcatcacatattctgttggcaaggctgtagggagccaagcactgttctatgttgccggttaaagggcaaaatggttcagccccatggagagggatttggcaattgctgacaaacctgcatatgcttctgctgtgacccagcaattccccttctaggaatttacccccaaagatatacgtctctgcaaacatgaaacaataaatgcacaagattattcactcaccctcatgaatatgccggaaaatgttcaaacaacctaaatgcccatacataggagactggctgaataaactactataaatccacacaatggaaaaaattctgcagccctatgaaagagtgcgaaagatcttgataaattgctataagctgtttccatgtattgttaagtggaaaacagcaaggtacgcaagtaaacatgtatacatgtatacacatgagagagtaggaaacaaaaacatacgaatatacatccttgtttttgtagaaagaaacacagaaataataaactagcagctactagaaatggttcccacagtgggcaggataaacagggtgggaaggacagtagcagggagtaaaatttctattcctctctatatagttttgattttgaacataaatgttttatattttcaagaaattttaaagtgatgaacaaagcataccctaaagttgaatacaaacagcaataagaaaacctaatcgtatattaacatggaaacaaaatcactttaaaaataagaatttgtccaagtaattttcaaaacactactcctttaaacctttactgggatatagtgtaggaacaaaaagagctagctgtctacagcacccgaattattttcttcgcactgttaggataacctcacttcaacaattttaataaagccaaatgcccatcaatcaattagtggataaagaaactgtggtgtatatatacgatggaatactatgcagccataaaaaggaatgaattaacagcacttgcagtgacccgtatgagattggagactattattctaagtgaagtggctcaggaatggaaaatcaaatatcacatgttctcactgatatgtgggagctaagctgtgaggacacaaaggcataagaatgatacaatgtgactttggagacttgggtggaagagtgggaggggagcgagggataaaagactatgtatacggtgcagcgtatggtgcaccaggatctcacaaaccaccactaaagaagttacataaccaaataccacctataccccatataacttatggaaaaataaaagaaaaaagaaaaaaaaagaaaatttgaactttggtaggtttgttgtattatcagtacggtaattcctagactcttgtatacaccgtagaatacaataaataagtaaatgtattgatattatttggaattaggtttctcactgtgcgaaaaataaagagcctattttatggagtctaatggtatggtgtttgatttacactgaaagtatcgataagagctcataatttatagcattcctgcctctgtgcatttaaagtggctcaaagtaatgacaagtgctgatagcgacctgcacacccagcccccagatcttggtttataaataccagtcctcattagaaggaaccaggattctttggatctgattccaggactggggaaatgcaagataagcctagaatatcttattatgccagaaagtgagtgagtgctcaaaagaacagaaaagcaagcttgaaagggctcccatcgtcagatttgggacaattagtgcatcaataggcacagtgatgtccatgacaacacactgaatggtaatcactgaactgaaagaaaatccaggagtccacagtgttactaacaaggtgggagagagatgaagctcttctttactaaaaaatactagcaaaaaaatatgggtaatattggaaaatcatcactttgcaatgtaatactataggaaaggaccattaatgcatgctaaagtatttgggtaaaaggtcttttgaggaacaggatattcacatggtctcaaacttccatctcactgattatttattggatacaaaggaaacagggtgcctttacactgagctagccggcagacacccccttaaccaagtgatcaaactaaggatcccaaacagtgagacaaggcggcatggcatcttatgtgatacagtgggaagtataatacagaccatcactgctgtgatcttcctggcaaagtgtctgatcagagtccaatcgtgaagaagcaaccagacaagtacagatggggtgacattcaacaggacaacctgcctgaacccttgaaaaataacaatatccagaaggacccccctcgcccccaaatggtagcagtactcttctcttttctagaccaaatgtgacataacaaccaaattcaatatctcacagatcctggaatggaagaaaaaaacagttacatacaatgtttttggaaagtaagaggaaatgtttttcaacaaggttctagctaaagtaagaaattttaatgcaaacttgatatcattattatattaatgttaaatttcttaggtctgatcattttgttactgaaaacatgagataattaatgtatcacctaaagtatctttatttatttatttatttatttatttattttgagacaaggtttcactctgttgcccaggctggagggctgtggcacaaccatggctcactgcagccttgaactcctgggctcaagccattctcctgcctcaacctcatgagtagctgggactacaagcacaccatgctggctaattttgttttttgtaaagatgggggtctcattatgtggcccaggctggtcttgaactcctggcctcaaacaatcttcctgccttaacatcccaaagtgctgggattatagtatgagccaccaaactcggcctaaagggtatttgaacataaaaaaagatgaagatgttgtctctgttctgattatttttaaagtttcttcattatattttatgtttaaaaaggcaagctagagaacactgtgtatagacttctaccttggggtaaaatgttggggagggggcaaattataggtttttttttttttaacttttaagttcaagggtacatgtacaggtttgtcatataggtaaactcatgtcatgggggttttttgtacacattatttcatcatccaggtattaagcctagtatccaacagttatttttcctgattctctccttcctcccaccctccactctctggtagggcccaaattatacagttgcttatatgcacatacacaatttctggaagaatatgtaagaaattaaaaaagatggtgacctgtggcaggtagaaaagagaagcagagaacaaaacagagcagataagaaacacaggtgggagcaagcacatcagctgtacccttttcgaaatattttgaaccatgcataggtactatgtactaaaaaaagaaaaagtcagcattgtgttttagaagagaaaagtgaatatctagaaggtggaaggaataggtcagtgaaagaactaagaactttgagaccttaagggaggggaccttaacattttctaggggtgtcagtgatgtccttggtatcatgaaacatgaccttctcaggctgagtggggcagggcaggtgtgcagctcagcaaaacacatcagaagtcttacatttttggctggacacggtggctcacgcctgtaatgccagcgctttggcaggccgaggcaagtggatcacttgaggtcagaagttcaacaccagcctggccaatatggtgaaacaccatctctactaaaaatacaaaaatcagccaggcatggaggcaggtgtctgtaatcccagctacttggaaggctgaggtggaaggatcgcttgaacctgggaggtggaggttgctgtgagctgggattgtggcactgcactccagcctggacaacagaatgagactctgtctcaaaaaaaaaagtcttatgtattcttattttgcagcaattcagcaattcttttactaaaaatatatgccaaggaaataataaagatgaacaaagatttaatcaccgaaaatgttcatcacaacattgttataatagggaaaaactaaaaacagtccaaatgtttttaaaagccttatttaaataaattattggactatccacccaaagaaatactaggcagtcatgctcaaagtatatgccatgacccagaaagatgtttatgtagcattttaaaacgaagggggcatatacagctcatgatttcatttaaaattgtgtatgtgtggatatataaatgtataaagcaatatggctatcttggggtgacaggattacaggttttttttcttctgattaattttctcaaaaagtgaggctttattttatgttttgttttttgtttgtgttttttttaagtagtgaatttattgttgtaagtgggactgggaaggcggttgcagagaattctggagaggcacaatccagatgcccttctcatcagcttcaaggttgggaagacacttgcagaccactcagtttgggtatagccaacttgcacctctagcttctgaagcatttctcagtataacttgcagggaagcagagggggccagccttctggctaagatatcaaagcaaacctgtcaacctactgacaacccctaagagcagctagagtaggtcaatgtccactggactgtgacgcttccccacttactctccagggaatgatcacatttgagggggaaaacagagctgcattttaacagagcaccccttgctaagctccacatgtcagctcagacagcacctgaagctaaggaccactgtaaaaagctgacaaaagcagctcccacacatcagcataccctgctgactctggaaagagggacgcttggcttcatgtaaggaagctgaaaaagtcctggtttctgtcaacttgctggctgctgagccagtgaacagaatgaagtggacttcattcagcaacacagcatgctggagaatgcaggtttggggtcaaacccagatttgaagttccccttcttttccttagctcctctacttgggcaagtcacctcctcaccctatgtttcaggttcctcaggtatataacggaggtaatgggattttctagcagaaccaggaagattaaacgggctatgtgtaaggcttggatagaagtccagtacatgtgtaggtgtacacatgcatgggaggatggataaacacgaggaaaatggtgacaaggccatcttagaatagcacctggcacagactaagtcataataaatgccagctgttattattgctagagcaaagattagtgagctggagtcacccaccaacagatcagataaccaagcatgagggcctgagacacaatctcttgtagcaagattcaaagtctccaggagacaagcctggcattggtatcccaaaaaggtgagaaattactggatttaaagtaaaaatcacatctgagtcccacatgtcagagacattcagatttgaaataatcactggttttactttaaatgcaacataaactaaatgacccaataaaatgtttgtttttagaaattaaacaagctttccccccagcccctagtacatttgaacagaaaaagaaatttgtgttcagtaaaagttccaccaaaataagctaggccacaaatctaaaggattttaaaattggtatatattagtaagatttcctatttatcaataaactactacgtttccaagcagagagttaggtctcttataccagactctattgtttaaatgggactttgtattcaccaccacccccaacccaaatttgactaagaccaaagttcaacaccaaattcctgactattctaaaaataataataataaggaagataggggtaggggggcaggcaacaagctttcagatgtgaaacaataattcttacccagagagcttcataaaaggggtagaaagaactaatctctaccattactccacaccaggcctccctgctcccccagtctgtataagaagaaaaccaaagggagaaggcggtggtcaccagcctttggggtcatgcaaggttcaccaggttttcccaccgaggtgtgttcccattcaagtgccgtgtaagggtatactagataggagaactgctcaaaaactggagcacctgcaagaagagaagatttgtttctccacttgggccttttctcaggcagcgagcttgtttatctgtcccgtgactaacggaacagagaaaaggaaattcaagaagtctagccaaattgagagaagatgcagcattagggaagtctctgtccccatgggttagtagagcaaggaatgagagtttagggagcatcataaacagtagctcagctggaaccactgcatgcatatccatccgtccatgaggaccacctataggtgagaggactttagcagcataactctgcaggatagatccccagaaggggatgcccttgggacagtattaataccactggccaagcatgtgacttctccacctcctaggcacatgatagcatcacctttaactggcccattgatggggtgtctggccatgtgacctacctggctctcaaaaatggcatctcctctaagaagatgcactgaattgctaatgcaaggccccacagcacactcttcctcctgcacagtgattgtgaatgcacggagatggagccttcatcagcctggtgtcctgggacaacgcagatcagagcccctaccaataatccatgagagatgtgtggcatgagaagaaacaaacctttgttgttttaagcaaaagtgtgattaacatggagttattggttaccacagcataatttaacccgtcctaactgataaaagcgggataggaaggaagaggttgacctggattcaaaccactgcatcaagaaattatatagtaggcaagtcccctgcctggccctctagagggcataccttgatggtaagcctgggaggaagagggttaaataatcaatcagacattcatccccactcagactcctcaagccacaagtcaagactgtgcaggggaacaggaagagaaaaccccaaatctgatgtaagatggaagttgtaaactcaactggacttacttttaaggctaaaaatgatagaaaattatgcaatctgccaagatgttattaagggaaagcagcaattaaaaataaacaaaactgcctcatgtttatttcccgaactgaaattccttcaatacgctggctgcccatacatgtttggtaaacaaggacatgtgtttatgactggtcttagaaagctgcagctgttcacgttgctctccttcacacacacacacacacacacacacacacacacacacacactcattcacttgtattactgaaataatttccaaaagacaatcaatattgccccaagacaatcagttctaatcggctctaccaactgtgatatactaatcctattatgtggccttcctgcttctcttggacatagagttgttttgctttgcacagagaaggtacacccactgggaaagagagattaggatgtctgaaaataatgtgtccaagagaagtaagtggattagagcccaactatcattactgagaggatgggcactgaatggccaaatggcccatgagtgtgacagggaggagatttattaagatgtcaagcttccccaacttctccccactccacgtcacccaccccatgccctctaaagaaccattgtatctatttctagcctggaagtcaggagggtagaagagcacctaagaagccaggggaaagtgggaagtatttaaccaggagaggcaaatacctcctggctaaggagaagagttttatgctgctgtcataagagagactcctgagcatacaaagggaccaaaagaatgaggagagggaagaggaagaggagaaggaagaggaggaaaacagagcttttgagaaccttcattgtgggttatgattttgagtattctttaatattttttacttgaagtaaaaactgaaacttctcacgaattcctttggctggtggatgtgcacctgtgaatggaactttaagcaaagccctggctgtgtgaggctctgaggtttatttgggtgacagattcttctgcatcattctccccctcgccctcttcctctgatacttctccaaaaggcatttcacaattcagagcagatgccttctctctctctgcaagcctctctgacctctccactgggattgtatgaccctccctgaggctcccctggtgtcctatgcttcccctcacatcaacttgtattacagctatttacctgtttatccaagtatagccttagctccttacagccaagatttagtcttgaatttcacacccctgagcctggtaccatgcctagcacacaagtattcagcaattaagacagtctagcatctctcaaactcaaaattttactaggtcaaaaatatgggaagaaaatgattatctgcttcccttgtcccataaaacataaaccacatttcttgcctgtgcatcaacatctgtgttatttctgcagaagctcaaccattctgctggtcagtcttacatgcatttcacataaacactaactctgtagtggggaagggaatggaggagaaagattttaaaaactataacaagtatcttaaaaggttactccagaagattccctggagtgtcaaggtctcttgttggatgatgggtcacggagtagcaacgtcagctgcaggtctgtgtgagcacctcaaaggatggcgtcctgccaagctgcggtaagtgagcaggctaaggctatgacattacaggttttcttccctgtcttccattccccctaaagtatgccaaagagctcagtaggcctttaaactttaactcaagactggaaaggagaaagatacactttagcttagaattgctcaggagttacattggcaggaagttaatatttaaagggaaaggggcctttcagactggacccaaaagacttttctcccatactcctacccatgcctaagacatctgacctttacctggcaagtgactggccagggcagagatagcaacccatgctggatgtcggggatagaaattgggaggatttgaggagggatacagaataaaaagtaggggagggaaggggaaactgcagaaaatgcccaaaggaactctctctgccagccatggcatgggccacatggtacaccacataatgctggactaagacttcacatccatgagcagcagctgtagaaacatccaaatagagcagaggcatttgttccccatctccactatcctatggacttgatgtagactcacagatgacttgaaccagaagtaaagacgtgatcagacatcctctgagaggctggtgggcttgatcactttgttatggaccatgtcccctttcccaccccaaggcagagatattagaattatacagggaaagagaagatgctcccccagcacagcctcaaatgtatattgaccatctagagaggcttctagatgccacaatacaggagccaaggcctggaacacaggagttcacaatccaagtgtgcctcaaaccgaccaaacgggaaccagggtgaggaacatgctccccaatacccagccatgtggtactggctgtcactgctacagaattcaggggaccgggtcattaaaatttgccatgcagcagatgaaaaagaagcaagctgtgaacaaggatcatcgcgttggaaataacagatactacccaagatgtgcagagaaacaagaatcaagggagaatacccagcccatccatctggagactgtcagttctcttggggaaaagcaatatttttatgctgcattttcctactcctcagggtaacaaaatcaaacaggctctctgattcacagtgcagccaatttactgtaactcataggtaaataaacaacatctcccagtggccatttatcttggcaaaaataataaaaatcatacagtctttattatacctgattggatgtaataatctgtcaaacttccttgagatataaaaagtaatgtatttaggctgggcatggtggctcacgcctgtaatcccagcactttggaaggccgaggcgggtggatcacctgaggtcaggagtttgacaccagcctggctaacatggtgaaactctgtctccactacaaatacaaaaattagtcaggcgtagtggtaggcacctgtaatcccagctactcaggaggctgggatagaagaatcacttgaacctggaaggcggaggttgcagtgagccaagatcacgccattgcactccaggctggacaagagtgagactccatcccagaaataaaaataaaaaataaaaagtaatgtatttgttcagttagccctcccttctcttggctctggaaaagtcaaacgtcacaaacaagaggagccatatgccctagaatgtaagctccataagggcagggaatgttgtctgttttgttcagagctgtgtcccagagcctaggagagtacctggcacatgtatttctcaaatgaacaacactcttaccttcatccagctggactatatcttacattaaaaaataattataaaaggagcaactgtatctctaggccagcatttctcaaccttgaccctagtgacaatttattttggggttggagggaggctgccctgttcattgtaggctgtttagcagcacccatggcttctactcactagatgccagtagcacactctccaaccagtatggcaccaaaaatgtctccagacagggccaaaagtcttctggggcaaaatctcctggctgggaatcactgctctaggcctgcagagaactcccaaagagctgacacagaccaagagaactgttgtgttttctgtctcgttcatgatgctgagacagcacccggggaagcccttctgcctgcctgctctctgaggtgagtgcaccagacaagcctgcggtgggaggaaacattgggtaatgaaaatcaagtagatgtcttgaacacaaatgaagactgagatgcgggcccaagccttgtctgtattcgacaggaaaaaccactttaccgctgtggtgggaatggacttggttttcaatgatcccctctcaacctcctccaccacaagggcattaaaacatctatacattgcaccaggagcagggcatccatcagcagcaatttcacttaaaatccagcttggagcatctgctcctgctcctaattaggaacaaggctgagattcattaatatccccacaaccagttcaaagggctcttcagagaacaggccctgcaaagcattcccaaggccaggcactagcatgaggaagggcagcagcttctgctccccagctctgggtgagctgtgggctctcacacctgtttccctgacaaaactcaagtgggatcaggaaaacattcctcccaatcgggactctgatgatcatgcatcaccttacctgtgctggtgctgatttagtacttgcacataacctggcatgccatgtttccctcaaattcttcttctttaccaaaattcactgatacccgtggctggaaaagttgcagtaaaacacatattctacagttccaagggtagaatcagtaccacgtgacaacaaacatcaatgccctttaaaatacatgtgctggcacaccaagcattgctacttctggaaatatatcaaaaggaaatcattgtaaatgtagaaagactcatataaccaaaaatattcgtcacacaattatttagaatagggaaaaaatagaaacaaccaattgcctaccatcagataccttagtttggtatactgtagcatatacactcactggattcaaaaacaccattaaaatgtcatttacaaagaatagcaccttactaaaatgtttatgttgtgttgttacatgaaaaaagacgcgccaaatcatataaacagcatgataatatgctgtttataatgataaacagcaatgataataaaaccacgaaaataaaaattttagtattcaaaagtctactggaggcaaatagatccttcccaaaaagtgttcaaggtgagtgcattttggagggaataatttatttcactcttctgtatcttctaacttcttttttaaaaattatctatttcttcaaattcggaaaagaacaatgtaaagtcaaaagaatagtggaagacccaccattacagcataaatatatcccctctatattccctctatactagggtatctttgtccctagcacttaaaaccaaccattgtatctttaaccgtgttgcttttctccttcaactggaacataattttcataagggtaggcaaatgtctgacacgtaattgatacacttttgttgaattggatgtatgagctagattataggatttctctttttaatttctcaatcagtgaatcaaaaaacattgctcccagtgaaccttcatatatgaatgaaagagtaattggcacaaccactttggaaaactagttaactgcatctctttaagttaaacactcacctgtcttacagtgaccagtggattgccacacctaggtgtgtacctgagaaaaatgtgtacatgggtttaccaaaagacatgcctcagagagtgctattatgtaataaacaaaaactggaaactaactgcccttcaacaatataacaggtaaataaattgtggaatatttatactgcaatgaaaattttaaaaacacacacacaaaaaaaagtacaacaaatttaatgttgaaaaaaaaagaagccagacatttaaaagtacatacttattccatttatacaagtaagaaaatgggcaaaacacacctatggtgttagaagtcagtgactgccaggggcatgagatggtcttcaaagatgctggtaatattctatctcctgatctggctgtttgggtgtgttcactttgagaaactgcatcaagtgggacatttataatgtgcaccttcgatctctgtatgctatgctccaatgaaacacactccctaccaatccagggctgctaagggcagggtatgttttccataattattcctccatttactacagccctcgaccaacagccctgacaaggctaaactcaccatacttcagcatttatgcacacacaagttctgtcttgtctgaactctccaccttgattgtacaggccagcaccttcctgttggcctgttggcagtgtctgtacccataaaattgggtaaaacgacagaagttgcccatgtatgccaggaagagttgaggcaaactgaagtgacctgaccaccagaaagattcagagacatggccctggatcacaagaaggacaatgcctctggaagcccagctcgccagaactgctctgggccatttgcagagtaggcccttttctttgcagaaaaatccccaacaggtttccctgacctccaagcacctctttctcttcactttgtcgcaaatagaaagcctgcagcctgaccaggggacaggaatcatgtttgtttcccctctgctacatcctaagtgcatagcacggtgcctggtacatggtagcctggtcagtaagtatctttggtatgaacacacgaataaacaaaacctactgaatcagtgcaccaggatctggtttctaaaaaggcaaagatctaggacctggatggccatgcaaagaaacaaaatattccaaaaaacacatgaaaaggtctttctggcataggaatttttaaaccaacaattctggcatgtaaaaatctcacaatttctctaacaacagtaaacacagtattattttatctttactgtggatagaatttgaccgtcttagtcattggaagtgatgcaggcctcattccaggtggctggacaaaggctccagaccaggtccagagtcatgacaaggctggctgactcagatgggaagtgaggccttggccagatgaaagtactgacacaagccaaccacgtccacagaagtcacagggaatcatcatgtccaataagcatggaaagatccagaaattccccatattcccctaacagtggaacaatggaaagacctccaaatagccacaacagtctgtccaacagacttaactattttcttcctcttggcaattttttttaatcaattttaggtgccatgaatttaccattaattaaaggaaattcaagcagctggggaaaagaacatttgagagtttgttcagtgggaatagaatgacttcagaatgaggaatactgccaagtctggttgatgctcataaattttctaaactttgatgagtccttttttagggggcaggggagtggatgccttctgatctttcaaaaaaaaaaaaaaaaaaaaacctctggccaaccaagaaaagaactgactacaccaaaaagagagtatcaggtaatgtcaccatctagcccctgtgtctcagactccctctgtggttccgactatcagtatctgcatctcagtgcccaagagtaaacattctttattacatccaccattccttgtttgttccatacccttaacaccacttcagtttcaatattcttttcactataaactaaagccaacgtcagagtcaatttccttcatttcgtctgtgcagaaaacatatcagttgggttagatacaaagtcaggccagagttagctagaatcaagccttttggagacaaatatgctgagatgatcccctggaatttcatcatgtagaaggtcccacatcaattccactgtgctcatgtgtgcaagcatccctgggccctggcagccaatcaagacccaaatgttattccattccaggaaaacctcatgacaatagctgttgctgaggcctatgttgagtcacacattggaaaacaagaccattttttctgatgtgaatggtagccctgttggcataaggggaaaatactgcactcatattaatttattgcaagtcttcaaaataaaatgctcattttgtctaaaatgttattattcattgcagctaaatggtgttggctatttgggatggataacaattctctaggattttcctaaaaatacagtctgagaactacctacatcagaatcacctggattgggctgagcacagtggctcacacctgtaaccccagcactttaagaggccaaggtgggcggatcacttgaggtcaggagtttgagaccagcctggccaatgcggcgaaaccccatctctactaaaaatacaaaaattagctgggcgtggtggcgcatgactgtagtcccagctactcgggaggctgaggcaggagaatcacttgaacccaagcggcagaggttgcagtgagctgagatcgcgccactgcactccagcctgggcgacagagcaagactctgtcttcaaaaaaaaaagaatcacctggactgctcatttaaaatgcaggttcctgggtgccacctttgacctgctaaagcctatgctctggactagcaggatgaaatctgcattttaaataaaccctgacagtgatttctcaagactgtaaagatattagtctgagaatgccactctaacagaccgctctgggcatcttttctctttgtcttggccaggcctctcagaattgagttagagcgtgactccatttgcacggcgggacagacgagtacagctgaaataaaaagtagaggcctctgctctctgcatgtttgttttctccatgttttatttgggcaaagattgcctggaacacctgcagtaagttccacttccctgctccaatcacaggcgccgacggactttgcataaatgcctgctcacctaccacataattctgctggggaatgttgacggtgccctctggagtgtgatgtgtcccagatcacacaggaagggtttcagaagcattacaaatccttgtataatatgtccgcccttcctccctttccccaaagaaaagtttgtttttgagaatgaagtgagagggtctctggggggtatattttcataaaaccatgagaaaagctaccaaatcaaattaacttggatcttagcattatccttctaaagggatccccaataattcacatcaccagtctgtgaatgcatctttcatcttccccaaaaagaaaccattatccccatgtctgtcataggaacaatgggcagactcagacccaagggcaagaaggtgcacatgctatccacacactccccatgtggtgctgaagtaagtgcatgcgtgtctatctctgccgctaagctgatcccttagatgaatgtcttgcttttcatctttagcctcaaagtgacagtggaaggggaaaaggtaaggggaggagctgaaggagcaaccccatgtatactagtctcatttttaaaatataaactccacagatcaccactctgaccaagaaacactatgatcctcttatttctaaacagcagtaggaactgtaggagctctaaagcccaggacatttgaccacagagggaaggagaaacttccagaccatggacaccagaggagtaggaaggattaagtgggggaccagagtgagggatgtttatacaatagagatggctgcagaagatggcacagagaggcacaaagaggagaggaaaagaacaggccatccttccaagtacttgggccatctgtgtgcctcactttttgcagttgactcattcccctgcccccaaatgtgtgttaagttgaaaatgtgtgaagtgtgctttaaaatacactaggagagagcttgctacttaagggaacactagggcaaacacatctgatggaaacacatcaaggtctttcccacttcaagacctttggacccactcttcccatggcctctcctcacctggttcactgcagtcctcctgcagggctcagcttcaatgcccttcccagggaagcagtccccagccaaaaaggttaatgggttcctcctccctcttcccatgacatattctgagagcatcggtgcctctgccttgtagtacttttctcaaaggaacataaatgattattccgtgattgtttgtctaccatactagaccataaatgccaggaaggtacaaatgtgtctatcttcttcacccgacacctagcagaggcctggcacatagctggcatttgaagaacatttgtgtgacaacacattaccctacctgcattaactatttgttattgctgggtttctcctaagccacaaccaacctgcttgggctgtagtgaatgacaggccctctgacgacccataatgatctggaactgaagaactgggtctttggagagaaggatcaaaggtctggctaatccctactagtattctcctttggttctaaagccaaatctggagcttggggactgcctgagtgccaagaagcaggtgctagcccctgcaagaacttccccaagtatagtgatgccaacatgatgcaaaatcaagaccaaattatgggcaccagacatacagagcgtgctgagaacgccgcagtaatacacaggccggttggatcatttgtctcaaaatggatcccatcccctggtgcccataaagcctgcctgagacctctctggcaggacaagatgaagtttctacctcttgaggtgagctggaggcaactggatcagagcttaacattaaagtgacaccaagtagtgcttagttgcataacggggctcccaagagcaaccttcgcataacttggatttcagacacagttgcatacaaaccccctcccagttacgtcatgatgagagttgccagttttgggggaggaggtccagcaagaatataaaatatgatggcaaggtcttctgtgccaggagctacaactggaaaataacaaagaatgggccatatggaacctcacacagccttccagactggcaagaaatggagtgaagacaggctcatgatcatggaactgactcccccaacatgtttctaagagacagaaagcagcatctatagctgagtgccaacaactcacactcacaagccagacaagaagctcccttaaattaaatgattatagatcattacgaattaaaatagatataccagccactcaaagatcacaagtacctactctgtgccacgtgcttactcagtcctcccccagagccccacaatgcaagtatcaccattccagttttacagaagaaactgatgctctagccaaacacctaagcttagctttggcaagactggaacgtgacctcaggttaatagtgggcacttacaccatgacatgactcagcctcaaagagcttttcacggaatcagagattgtgctggaattgcgaggggggttgcatttccctgctgggttccctctgcctctcaacagcactgcatttgttattatccatcatcattttcaattactaatagagtgagacatacacattcgaagctagtatgactcactctgccatgacagccctctgcagtgaacccctccacttgccacaggtgtggaaagttctggcctgggacagtgcactcagccattcattcattccaacattcaatgagcagctttctgagtggggctctgtggtaaaggtctgaggacaccaagctatatacaatggtgtatcttaaaaggaattacaaaggggtgaggtcctggcttagagataggagttagactaaaaaacagtttttcgatatgtgtgaccctgagaatttccacctctcagagactataaacacatgtgcctagtatgcttctaaaagctttccttcctcagattcatccaagaggtttgctcaggaggcaattcaagtcaacaaaatgcttattggccacctgctgtgtgtgaggcatgacaagacttaggttcttcaggaggcatccaactattaaataagctaaaatgtagatatatacaactataaatcaaggaatactgcataacagtgctataggaattgttgatattaataaaaagaatagcctccacttgctatctatgatgccaggcattgtgctaagagcttcacctgcattaaccaacttactcttcatgctaaacccataagcttggtcaacacagtggacatctgttgacatctgcccatcaggcatccatttccccttgagaaattacccttctaccatccatcaacagtgggatccaatgaaacccctccaccactctagccctaggccccagccctgggcacataacccagacttggacacataacccagacttggacaatcagcacactctaccaacttagccaaagtgattgacggaggaatgggtgcctaacgccgggaaatctgacaagtctcagttctgggacttctgttggcactatcgagaacatgaaaactatgatgatgcagatttgcagttgccatgagccactacatggaaccaaacaacctgagcacaaaaccaacataggagcagggagacagaatgagacacacacaaacccctagtcctatgatgtaacttgacccctggatccagccttacataaaaccacagcttcttagaattttttagttatacaagcgagtatgttttctcttccatttaagccagcttggaccacatttcagtcacttgcaatctaaagtttcaccaaaggaatattattatcatttcttaacaaatgagtcagtggcccagagatgataaataatctgagattgctttaagttaaatgaactgtgtaagttttttatggggggagggcacaatgagagtgtgcatgtagaccagaaacctgcgagagtgccagactgctcagttgcttggaccatgtcttttctctccatccaccaatggaaggtggagacaggcaagtagccttgctgcagccccttcccttcatggtgagttcatttcttgtttacctctacacagtgtagccctttggaattccagctttatccagaggtctattaaactcttcacactgggcactgtcttactccttgacggttcattaaaatggtgcatcttaccattggtggcatctcacaccgaatgaaacatgatggacaaatacttataaccttaagtgaattacataatctcttacaggaaatttattttgtttgtaactatctcacctggagagataagaccaagtataatctgggtcttatgaattttccaaggaccacaggcagtcacctcaccacaggaaaggtaaaatgagtcatcctgaatgtgcttgtgtttagttattgtgtttggtttgaaacacattatattgagtaaatcaataagaaatgatgatacattatttaattactaacattattttgcctcctcaagtaacaaagtgattgagcgaatgatgaggtcccactcctctaggcaagtattacgggtccattatccatttggagccacttcttggttttgaaactggcctcatcagaatataggagagcacttatcctcccagtgatacagttctgctgaagtatcatggagaggcctgggaaggccaactggggcaaggagctctgccatctgagaagacttagcttttctctggcaagggcacattgaaggtaaggacagagaagacaagaaggctcttaggcctatcaacttttaaactgtccctttataatgatccctgtgaaataattatttctatcaatggtcagctagtacaggggatttaagatagtgggttcattaaagagagtcaggatcacaaactcatttaagtctccttgaacctgtttaatcaaaatgattttctgctactctcgattacgggctgagtttccgtgatgacagattaatgactgatccactaagccataccacctcttttgtcaccagccccactgactgggccagccactattttatcaataggctccacttgcccttgaaactcattatagctgatatgttagatcaaatgagcagatcagatgctcgctgccaccccagctctgctacaaagaccaccaaatcccacagagcatgtgccagaaggaaaaagaacagaagttggtccttgtgctcttattagaattacacactcaggtcactccacagtaagataaattccagccaaggcagcacttctgattcttcaggcccgctaaaggtaattatcctaaagttaaatgtcagggtttcatgtgtgcaaaagaaagaaaatgtcatgtttggtgtaagcaacaatattattttaatcaaatcagaagctcattattagaagataagccctgacatgacccccacaatacactgtgtccagctgacttcccatcccactctgtcttaacctaaggctgttcacgggttgccctcattcataaagcaggaaaaacttgcaatgtgctatcagtggaggcttgcaccccaaatccactcagcccctgattggctgtggtacagagggagcctagagtcagatggcatagttccagccccagctcctccacatctcagctctaattttgatcaaaagacttaacctcccagggttaagtacttctctcataggattgttatgaatattaagtgagataatacatggaaagtaccttaaacagtgtctggcacactcgatgctccataaatgttagctattacctatttctgcaatgttttaatcttttagttacaaccagactgtattatgtttctagaaaaaatattttttaaaagaaaacagaataagtagtctatgacagcataagttaaagaatttcctctagcagacaagaggttacatgaaagaagagattacatgtatttatcttgttcactcttataacccaatgcctagtcaatggtagataaatatttgttggaatgaatgaaggtacaaatgaacagaggaaaatttccttatggtaatggttatggaaagccaaagccaaatcagatgcagaaaaattaggagaatggttgtggcatcttgatccctcaacctcaagccatggaggagttaaatgcatgtcagctaaagatggaaaattattgaacaacttaatacaaagatctgcttcttcatcgcctccttaacattgtgtacaaaagtccaggcctccatctggccaaaacttcccaattgctagtgtttataaaagaagaatgacaaaactaacagaccacaaatacatttaggagcaatcatctgagcattgttctatttgtcctggatctgtaactccagggaataagccatggagttgttctaaaggctttacttctaaaaagaaggggataggaagtatttatacatctagagcaataggacacttttcaaaatgataagtagaggttgccaggtcacctctggcaatgtcacagcacacccagtagtcaagggatatggaacacgcaccccactgtcatattcatttcaaagttgaccctgtaacaacacccaagggctacaatcaactctctaagagcagcccttagttttcagtttccaagtttcaaaaatcacatctgaatctctcccccaagtccaacaaagagacaagtcaggaggaaggcaagaagttttctttcacaatgagttccaaaaattgacatgcatcataacaataattgtgggacacagcctttcaaagttatcagtagcttcaacaaaacaaagaaacagcaaagaagctgaggctttgtcaacctcaagcaaggcttggctcaatgaaaatgattaggctggctgagcaactgcaagattagctgaggctttatcgattgtccactgaatagtaggtttctgtagaaagcaaattcttaccctctgttcccaggctcaggctttgtgattattccagggacttgccctaaaagagtgtctggtctgagttccacaacactttaaagaggttaatgacattaaattatgtctgagccactgttagtgtcaggtgactccatacagcacataaaatgggtgatgaatgaagaagtttgggatttttttgaacatttttagatgttttaatggcatgctggattaaattatcattttttaaatatatgctgctaaaaatattagtttaatgtctaaaaccgctccaaaaacaaaaacaaaaaaaaatagtgtattgggacataaaagcttttctttttgttatgtcttggacatttttatactatctaaaggcagtatttcctaaacattagaataacctagtatgtttgcttaaaatatggattccctgcactcaccccagaaatgtaaagtcagattctccagggtaggaccatggatgctataatttaacaagcacttcaggtgagcttcatcctcagtcaggtttggaaacacactgttccaaagatctaaaaatgtcaccaccatccataataaagatgggaaatgaacagaagcccaattttaaaaaatttaaagctaagcaggaattcagaatatcatgcttatgatacactgagactagaaaatcttgaacaggcatgaaagcacagtaaacctttccataacccaaagatccaaaaaagcacaagtgttttcaactcaatccagctgccaggagcaccaaggcatctatctccagaggtggcccttcacttctaatcctggctcaattcttccacctctagcaaagtcaagcaactgccctgctcttcaactctatctaaaagatagccatagaaaagtaaaaacaaaacaaaacaaaaagcaaaattatctctgccccaggtgaatccttcatggtttgggcacatttttcagccatagggaaaggtaatcaatgaaggattctcagatctaagcagttaacagagcaggtcaggaatggggcaatgaatggcaggaatctcactggggtaggggaggaaagtgaggggcatatctactgcaaaagaccctagtagttattatgtatcaattaaaaattttaatgaaattacaatttcgataaaaggccccaaatagctgtggctattcattgaaagtgtttgaaatcccctttccaagagaagcagtccaacatcaactagaaaaaagaagaggaggaacagagaggagagtgataaacccccacacaaagctatgagtgcatctcctctggacagggatctggagagggtgctctttaaaaagtgtatggaaacatctgggattcattcaatgtctcaaattccctctccctgcaaggcctgcagatactgagagcagagcttagaggagtccagtggaggaagctgatccccatacatatcccacctcaaagagtctgtaaaccatgcccggggacattaacaaagggggtctgtggtataggtcaaattatcatatttaaaaaatacatgctgctaaaaatattagtttaacacctaaaactgatcagaaacaaacaaaaagaaacagtgcctttgaacattaaagcttttctcttttttactgttatgccttgggcacttttacaatatttaaggcttctcagaaacaggaattcctaatgttaagtaccataaaacatggtactcccaagtcccctagaagggcatggccctggccagctggggcagtccttgaagaagctggcagacgctcccacagaacagaggagatgccatctgctggaaagactgcaccagatgcctcttgccccacatccctggggcacacctggggagtggcagccagccttgaggcagaaacaggccgcaagtgtgtttctgcgtgtccgggagtaactttctccactcccagggctcccacggaggagcaatgctctgccacccagggtccctttcagggcaggggaccaactgcacgggctagttgttcctgtttcaagattccgagggtcaaaccaccccacctcccctgtattttatcaggcccattgccatgaccgcctccctcaacacacacacacacacacatgcaacacctgactcccataaatagctcccccataaatagcttggaccactcccagacccaacctctccagtagggattctcctgacacaccccagagatggtccacgccaccgctgccccggggaggttttctccggagctagggaaagtctaccatcacggttaggagaagtcggaagctcagagaacctctttctccacagctactggtgatctgtgctgtattttagtgcagtcacctcccgcagccctacgaatacacacacctgggccacaggtaacaggcaagcgcatggagccttcgaagttctctttaaagttcctttcaggcaagaccgcacccaggaagctgggaccgaccagcccccgcgggagatgcccacctgtccccctcccaaccacacacacacacacacacacacacacacacacaccccaaccccgcttcaggggtcccctccgagaggctccgcgccccccagggccgggtggcgccggtactcacgtctcgaaagcggttccagtacttgtcccggtcgtactgggagacggtgctcagccactggtcattgtctaggaaattgccgtggttggggcccgcgcctccggcgagcgcgtccaggtgccggctctcgacttggaggaagcaccacgccgcggcggccgccgccaacaccgcgatcgccggcatctgcggggcagggcgcgcagggcgatgagcgaagagggcgggcggccgcgagccccgggcacccaggcgtcccagcgccccagcccggaggcggggaccccgcggcgggcacgggcagcgctcgcgcacctggggcgcctgtcgcgcctctagacccagggacccctctcacgaatgggggactcatctacgaacgaggaggctgcgtcacgaatccgaggctgccgtccaactacaggggacccgtctcgtctattctccgagtgccccacagatgccgccctcctatcaggggcttggtacccctccccagaagcggggagcccgggtccgcacgccgcactcccacagacggtgcggtgcacacggctttggggcaggagaggggagaacagggctccagcagcacccgagctccggcaagcggggtgggggctgccagcagctgggggtccccggcgacagctaagggaaaggtctcccttgagcgccctgaggtctcgggggtaagaaaggcgcgcggaggtaaccccaggccctgaccctgccagccccctaggcggccgcggggaggtcccaactactccaagttggggcgcggggttcctctgggcacgtaccttgggggccggcccgggtcccctagtccgagttgctcgagctcccgcggcacggtcgccgggaaggctgatcgccggctcgcgcccctgcgctcctgccacacgccgccgccgagcgtctggccgctttgtgagcccgcagcgatgtgct

SEQ ID NO: 663 - DNA, 196677 bp, Homo sapiens
cagtctcctgaatatttacgcgttgctgaatctcctgtggacaaaccaccaataggccaggactgtcctgtggacagacggggtgagcctcttcttgtgtctggagattctgagtgagtagaacccgttatgatccccactgcacttaatgtggcattcatgaatgagtctgggctgatgtgctaattgggggccgtaagaagagttatagccacgatggccctcacctttctctaataaaagcttaaacacagctacggtaaatatttttgctttctgctttcacaaacttcacatacgcttacatttattttgaggcgaaaggggaagaacagacatttacaggggaccagttgctaggagaagactgtgcattccctgtaaccctgtcagtctcacctcggagatcctgtccctggagtgccccaggtcccttttcccagctgcactgagtgcctctgtcctcctggtggagctgtgctgctttcttgggcagcctcccttccccatggggtgcacataggctgggggcatcccggtggtcagttcttcccagggacccaggaggaggggctggcagaaagtgggcaggttctttccgctcgacctggcaataacaattcctaaattgctcagcaccccaggctgcttgccttgacccaggtagccagtcccaggcaccaccagtgtgggcagggccctccccaggggcagcagcagggcagcccaagacactggtggccaccacagttagtccccacaaggcgattgtgcaggacatgttctcgagctgcctgcagggtctggttgtgggagcagctcagcccctcctgcagaggtgggagcatcttctacagccagccattgtcccgcaggagctctgtgcccagtggaatatctcagtgcagtgcacaatggggccacagctgtgtcacagccatgctctgtcctttagtgggccgtctgagccacattccacctgcctgttctgacacactgctctccctcgatgaccctgctcccactggcctccccatggtttcgatctgtaacccagaccctgttcccaggagctggctcagcaccatcctgctccacaccctctctcaggagacatcctaacctgcccagcctgtcctgttcctgcctctcaacccagaacactgcaggtccttcaggtattcggtgagaccttagaagcaggcacagcaggatttatcccacatgcaccatgcaccgtgctgaggaagccacggtcactcccctaatggtcactagaggtgagagaactgaggttgttgcccatgtggtagaactggaattcagggcctcagccacacctcagtcaccacaccacgccctgtgcaggacgctggggaaaccaggcagctaggactggcctgtgccttggaatgcttactcagaccacccatccttgtcccctttgcacctcaaaggcttggtctacttttcagacacagtttttatattgtcagcctgatacatatgcatattttaagatgtcaaagagttttataagttttatgaaaaaaatagcagacccctggcctcccagaccatctccccaccgcccctgccctgcccactccccatagattaccacttccagctcttattgcttcttcctctggatttatctccacatttgtaaagaatatgggcacgctgctatttcttagtcttctgttgtggtcaagatggttgaactcgtagatttccctcctgagagctgctccatctaaccctaaccctaactctgatatatagagttatgtcatcatttaggtgaacccttatgcagtgtgtatcagtcaggataggctgcctcatgatgcaggaacaagcatccccagacctgagagagttccgtttctctagcctcctgccctgggggtgggtgctgagtctgggggaggtgtggggtggggggaggggcctcagcgctcagcagacaggtgctcactggtgtcaccatgttccctgccctcttctcatatggaacacgtggtgcccttttgccagggcatccctgctcaggggtcaggatagtcctcctctgagtggctgggagtctgactgctccctgtttagactattgagtagccccctgctttctgcctcactccctttttgtgctggtgtctcagtgcttgggccttttggggttttagaggtgggccgtgaggctgggcatgaaaaggcttctctgcctccaccgcccccccggggctcctcatccctgtgctgcctcagcacttcgtctggcaagatttgcaggtgcagttttcatttctcattctttgttggttttgagtgatttcaagagaagatgcagaaaggctgtgaccccacctctaaaagccagcggtcaacctggccacccttaagcctgttctagtgggccccctgccccgttgccctgctgtgacagtgtcccacgaggacagactcaacacaggacttcagtccttgccttcccgagtgctggcagccctggtgctgttgctttccctctcccctccttgttctcaacctcaggaggaaaatgcccagtttctcatgatgagatatgatgtcatctgtaggttttttttttaaaaaagtgggtaaaattcatataacattagccattaaccagttgaaagtgtgtaattcagtaacatgtagtgcatttgcagtgttgggcacccactatctgtgtctagttccaacaagttttcttcatcccagagaggaactctccattaagcagtcactccccagcctccctaccccagtctctggcaaccccaatctgctttctgtctccatggacttacatattctgaatgtttcccataaattagacatcatataatttgtgaccttttctttctggcttctttggcttagcatgaagtttatgtggatgacccatgttgcaacatgtgtcagaacttcagtcctttctaaggctgaacaatattgcattctgcagatacaccacatttgtttgtgccttcatttgatgggcgtttgggtagtttccaccttttgactgtcaggaataatgcagctgtgagtgtgtgtggatagtgttagattcggtatctgttttcaactcttttgtgtatgtatttaggagtggaattgttgcgttctgtggtgactctgtttcacttttccaggaactgccaaactgttttccaccacagctgcaccgttttacattcccgccagcactgaatgaggattctcattttcccccatcctagccaacacttgttagtttctgttttttgtttctttgtttcatgatggccagtctatgggtgggaagtggggtctgactgtttattggcatttcctgaataggttttttggtagatgttctttatcaagctgaagatggtctctgcctcatttagtgagtggtttttaatcagaaatggttgttggatttttgtcagatgctttttctgcatcaattgatctgatcatatgattttgtctctttagtctgttgatgtggtagattatatccattgatttttctaatgttgaaccaacattgcagccttggaaaaaataccacttggttgtagtgtataattctttttaaacgttgttagatttgatttgctaataatttgttgtggatttttaagttgtttgctcctgagaggcagtggtatgtcattttcttataatttctttggttttgatgttaggataattccagcttcataaagtgaggaagtgtttcttcttttccaatttctggaataggttgtaaagaattggtgtaatttctcccttaaatgtttggtagaattcaccagtgaaatctatcttccttttactgatttttagtttaattctattgtagtctgagaacatatttttatgatttctatttttaaaatacttgttaaggtgtacttcatagctcagaatgtggtctatctttgtgaatgttctgtgcaagcttgagaagaatgtgtattttgctgtagttggatggaatattctataaatgtcaattctgttgagttgatttatgatgctattcaagtgaactgtccttgttgattttctgtctgcttgttctatcaattactgacaggtcttgaagtctccacttataatagtggatttaccaatttctcatttagaattaaaattctctcagattttgccccatatatttcaattatctgttgttaggtgcatagcctttaaggattgtaacatcctcttaaaaattgatttttctctcattatgtaatgtcgcctctttatccctgataattttccttggttggtagtctgctttgtctgaaattaataatggtactccaacttactttgattagagttagcatggtatacctttctctatccctttacttttaacctaccagtgtctctgcatttaaagtagatatcttgtagatagcatagagttgagacttgtgttttttatccactctgaaaatctctgtttcaatgggtgtgttttgatcattcacatttaaatgattattgaggtacttagattaatatcaaactttttagtaactgtcttctgtacttgccagagacttctttttctctctcctctggtttcaatggaccattttatgtgatgccattttatctcctttcatagtgtatcactcatacttctttttaaaagttttacaatatatgtttacaatatgtatttcaaaataatctaagcccaccttcaaataacactatacctcctcccatttagtacaactaccttataacagaatactcccaaatcctccttcctgtcccttgtgacattgctgttaattatttcaattatccatatgtcataatcatacagtatatcgttaccattattgcagtaaataaatttatttttatatcaaataagagtaaggaaaatagaaaattttatttcactgtcatttattcctttttgaatacctcttttttatgtagatccaagttttcaacctatataatttttcttctgtatgaagaaaaatcttttaacgtttatttcagggtatatattgccagtaatgaattcccttggttttgtttgcctgataaactatttctccttcatttttgaaggatactttttctgaacatagaatgctaggttggtggtttcttctttcaaaattttaaggatttcactccactctctctctctctctttttttttttttttttgagacagagtctcgctctgttgcccaggctggagtgcagtggtgctatctcggctcactgcaagctctgcctcccgggttcatgccattctcctgcctcagcctcctgagtagctgagattacaggcgccagccaccatgcctggctaatttttgtatttttagcagagatggggttttaccatgttgtccgtggctggtctcgaactcctgacctcaaatcatctgcctgcctcagcctccccaagtgctgggattacagacgtgagccaccgcacctggcctatccaccctcttcttcctttactggtttctgatgagaagtgggctgtaattcttatctttacccctctatagataaggtgtttccctaccccgctggtcatttgccttagtcattttctctgtctttggttttctgtagttcaaatatggtgtgcctaggtgtagggtattttgctttttgttttttttttgttttgttttgttcttagtatttactctatttggtgttctttgagcctccatggtctgtggcttggatctgtcattaattttgaaaatattttggccatcattacctcaaatgattttcttctccattgtctcttttgttcccttttggtattccagttacacgtgtaacatctttgatgttgttccacagttcttggatactttgttctgttcccctccccaacccattattattatttttttatttttatttttttgtagaggtgggactttgccatgttgcccaggctgatcttcaacttgtgagctcaggtgatccccccgcctcagcctcccaaagtgctgggattacaggcatgagccgctgtgcccggtcttcccaccattctttgtgtgcatgtgtgtttcattttgagaagttcttgttgacctgtcttcaggctgattattttcagccatgttgatgagcccgtcaaaggcattcttcatttctgttaataggttccttttgggctgggcgcggtggctcacacctgtaatcccagcactttgggaggccgaggcgggcggatcacctgaggtcgggtgtttgagaccaatctgaccaacatggagaaacccctgtctctattaaaaatacaaaattagccaggcgtgatggcgggcacctgtagtcccagctactcgagaggctggggcaggagaatgacgtgaacctgggaggcggaacttgcagtgagccgagatcactccactgtactccagcctgggcaacagagcgagactccatctaaaaaaaaaaaaaaaaagaaacatgttgtcctttttgtcttctagcatgccttgtaagttatttgaagctagatatgatgtatagggtgatgggaactgaggtaaacaggcctttaacgtgaggttttctgttaatctggctatgggctacgtgtaatgtttgttgtagctgtgagtgccggcgtattccgatccttgcagtgcccttgtttttgtcctctggctctgggcttccctaaattcccttcctcagacagagtgagtgtcgtgcagctctcccagctttcacctgctgttgtacactggagtcctgttggtgtagttgtagggtgtggggagggccagcggtctatagtcttctgattacatctcagtctttctgtggtcccatttccctgggctgtgactgtcacagatgtttcttcttatatagcttttccagaccccaaacaggaggccagagggggctggactcaggaatgcccttcctccgtggctttgcaacaaggttctggtaaagtctttccctgcggggagcaggcctttgtcctagagaaggctctggatgcatttcaccaggatgacgtttgtcctccctctgccagagtcaccaggagatgtctcttgggttttcatggtgagaacctagtagggatcctggaggaaaagcccatgaaagttttgggcccccctaagactgtggcttctaggagtttctcagtcatgggagtccacccttggcctgcagcaatttgtcagaattacccaaactactgtggtatggccctggaggctctgttccaggtcagtggatctttggatttggctgtgtctctagatttcaggggggcgggttgcaaactcaattcactgatgagtccaaagaaggtcattgattttcagtttgtgcaccattttctagtcatgaggatgggagtgatgacttccaagttctttacgtgttggagcggaaactccaatccttcccctgctttgattttcctgttaccctaaccgggaatcatgtttgttatttgatggtttactcagttgtcatctgtcttcctaattaggacataagctccagggaactggagtgtcagtgttcccttgcgtccttgcacccacaagacagcctggcacattctgaatgaatacaccgaaagggataaataacgaggccaagccacctggctatgggtggctgctaatccgtaggatttctcgtgccttgtggtttcagtgaatttgcgacacacatgagtgatgctgccaatgggaggctcccagatgtcctcaacaaatagaggagtgaccactcagatccaagggtgtagcacttcccgcctatcactgggagctgatgggctgtctttagcatggcactttgtatggtgctggcgcccaggcttccctggggcaacagcgttggcccaggcgacacacaagaagaagggggtttttctgtggtcacttccgcgttgctagttgttttgccctcttactgtggctaaaccttctgtccatacctgtcccccattctcagtatttggcttttcggattgcagtagtgggacttgggtgcacattgcaataaaccaatttgcccccattatccatgtcttgttgatggtcccactgccagcatcagttcttatgaacagatttctaaaccatcaccatctgttctgctcttaatttcaagtgtaaaaagtattactttcctaattccgtcaaggggagggagaatatgtattcctaaagaccacagttcttgtatgaggaagtgtagatctgccacccacctactaaaggaaaggttgcttctgcccatcctcaaagctgttgagcagttatttacctagagggtaaaactggcccattcgcatctctataaaaacaggtaggaaaaggtggaaggagctgagttggggaggtggaaggggggcaaaagctatgtctcccgtccctccctgacagtgcagccccccaaccctccagcccccgccagtataggtgggaatgggctggcagggctgcattgtggtggtccctgctgctgctagggctgtttccagaagaaggcccagtttcaggcttgacttcccctcagaagtcataaggaccataaggtccatctgggtgggcgctgagctctccacgatgggagcaggatagacatgagcatcttcaccctcgtggtccctctgagcctgccctgggggtgagctctttttctgctcaaatgaacattccaggcaggccctggagctttctgtcgttctaaggcaatagaaggttctttggttactttcagtcccaggaacattgttggtcagtcatgaaaaggagtaattatagactctttggagcttctcccacccggctggagcctgacctgtcttggagccggctggggagggagggctgtgtgtctccttctttctttctttgcctctgtttttgctggccagggagtgttccgagggatggagtgtctggggagagggcattctctccacaagtgggctgggtggcacttctggggtccagcagatgtttcacttggacttcctgtctccagtgaccctcgggtaggtttcttagagatgaccctgctgggaacttgcagctcttccctgcgacctgtgggaggccttgctgggctgatgcccttgactgctctccctatcctccaccatgcccctcgggagtgctcctgggctgttccttcaaggcggccccaggctggccccacactggtgggagcagcaggcagctcctccttgggcagctcctcctcttcccctgtgaggcagctctggtcatggcctcctgcctctggattctcaggaaactcgggtgccgcgtccgcagacattggggactcggtacagctatcctaggggtctgctagaagccctgtttgggaatcatggtgaagccacctccccagccccctccatgaggcacagcccttcacggaaagtccctgctcctcttctggtaccccgtaggccagaaaccatgctggggtggggagctgggagcatctgttgatgtgggatgcaggcgtgcttgtcacctctcctggccctcagggcagcaggacagcttacatgaacatctcatcccgctgctggtggcctctggtgagagactactccagtcggtccccctgtagctcctggatcttagcgggggcctgggaatgggaggccacaaggaggttccagagctaactaaagccgctgagactcagagggagtctcacgccactgcctcctgtgcccccatcccctagcaaagtgggactgatgagggatgaccttgcgtccttctcccctgttcactgggacctggtgctgttgccaccgtgggcccaaacatccactgcccttttagcaaggcagcgctgctccatagggtccagccggggaagcatctggctttgcacaggtggaagatcatgactatttccagagtctgttgccaggctccatgtagttcaggagttgtttctccctctgagagtccaaagtggttgttttccggagtttggcagtacctaagggttaattgggatgttattgtctgcatttggcttagagataggaaagttttatgtttattcaaattatcagtaatttaaaattacaattttagtcttaattgtacgtatttggagatcccatttaagtctttggaaataattgcagagtaatattttgggaagttatattacaatgcacagacgttcaagtggagaaaggtccctgcgtgtgagccttggcctggcagaggggcatccaggacaggatctacagcacacagccctcccaactgggtctgggcatggctgcagctgagtctagccctcctttctgtgctgctgcatcccaggggatacggccacacaggccacagttgcctagaccgacctggtgtcaggatcactgtctctgctttggtaagatgtccttgggaggggaagggagccagccaatgagatgaggggtaggagggtgacagggtggagcagaccctcatgctggcagaagagaggttcacattcaccagggagcaggtttttctgaaccctggagagctgaggggggcacctggagcacccctgcagtccacagcatggggtgctggcttctgtactgtagtgcagtgccatgaggtacccatcccttgcagtggggtagggtttaaaacccagaaggcagccctccctggagcacagccccatggtgtttagagaccctctcctctgagcacatgcaggatgtgacaatgcaggtgggcctagtgctgcagtctcagagacacccatgggcttctgccatgctttttatccaccagggcagtaaaagcaacgtccacagtggcttagcctcctgcaaagcctgtggcaggacagccagggttccctgacagtggagatggtggacggccccatagggggttggtcccatctcgccagcagaagtgacctgtgtggccttagtggtcagtgctgcctattgtgatagtggattgtttaaagccaggtcccatcgtggctcctgagggaatgaaaatgaggggttctttgctgtgatctgatgcttgtgttccaccaaatccatattttggaattcttatccccaaagtgatgggacctttgggagggagacattggaattcacattcccaaggagatggggccttatggaggtgtcttaatctgtattctgctgctgaaacagaataccacagattgggtaatttataatgaacagaacattatttggctcagagttctaggggctgggaagtccaaggttgagggttgcatctgctgagggccttcttgctgcgtcctaacatggtggaaggcatcatatagtgagcgagagagggaagggggccaaactcattgttttattaggaacctgctcctcagtcactaacccactctcgcgataatggcattaatacattcatgagggtagagctttcaggacctaatcacctcttaaaggtctcacttctcaacattgttgcatcggggattaggtttccaacacatgaactttgggggggcacattccaactatagcagtgggtgatcaggtcctgatggtgaagccctcataatgggatcaatgccgttttaaaagaggctgcagagagagcctcccgccctccaccatgtgaggacagagtgagaagctgccgtctctgagccatcacgcaggtactcaccaggcacggaatctgctggctctctggtcttggacttcccagcctcctgaactgagacaagccactttctgtcatgtataatctacccagtttatggtattttgtgagagtaccctgaatggaataagactcccttcaaacaaatgtcctgctctttgaaagagagtgtggggctcacagtctgctagtaaagacagttgtaggagcaatggcaagcccacactggctcggattttcagaccttatcattgagttaggagcgaagtcctcgacctgaggttttattggtccaaagtcagggcctgctggagcccgacaggttgcgtgcttggcctgtggagcagttttctccagagcacctctatcccctctgccttgtgccaggcccagcagggactgagggtagaataatgacaggcacagctcctcccctcaaagagtccactatctggggtttgatgctggagcgcaaggaggggctgcccacatgggcggagcagagggcctggggaagttccaggaagaagtgactgtgtgccgaggctgcaggagtagaggcagcccaggagaaaggggggcatgggctggaggtgggggtggttccaggcagagagagcagcttgcacacgggaaaacaaggcatggagtgggcagctccttccgcctggtctctaaacctgtgaagagggggctggggagaagagacgggggtggaggagagcaggactcacaggccagccagccctccacagccttgggaacagagtgaagagcttggactgtgtcctatgtcctggggccggtgccactgcaggctttggagccaggagggactcagtggagcttgctgtgtatgattgtgagtgtggggaatggtttggggtgggaggcaggacaagcagctgtggactcctgtctgcaggtgagtgccagggctcagtgtgggttctgattgggctaagtaggtgcccatctgcctggagtccagctgtccttgtgtggtctgtagaccttgttgtcaaggtctggcagctcaacgctggtctttctgagataatgaaaagggaaaactttagaggcaggacgaagaccttgtagtgaccagtgacatccccacagggtctaggtgtgcgaggtctattggcgcctgtgtgggaaggcgggaaaccaggggcttggggccagctacaaatgccacactgggctctgccttggctctaggtgctttggttgctggatttggtggtggctcagggcagtcacttgtcattctcagtattttatcccctggggcctcctcagagccataggagatggttcacctctgaaggactgccccatgctgtgcttggtaagctcggtcacccagggctgtcacagagatgggctatggcccacatgggctgagcggatttctgccctgccacctacaccttgctgtgattactttggcagtgtttccccgtcaggagagcaggtgggaagggaggcaggtccctgaactgggatagagcccggagacctgggtgtcctctgctctgttgtactgacacgctgcgtgcttatgaaatgagggcaggggttctcagtgctcccatggcatggtgactataatccatgaatgatgcccacacagttcctggcatgctcagtgtagccttgttgttgtaagagaaaaaagcagggattctccacttccccacagagtgaactggaacgaggagagactggtatttctccaacactaggtttctttggatttttatgctggttgatactccctaaatcacaggtcgccttaaagagagcaagagccctgcacggtggcccggacccttggggccccttccatccgatgcacctcgtggcccagtctttacctgctcaccatgcacagcacttcgcatgggtttggaaacgtgtcatctgcatggcaaggatgggaatggggagtgggaacctgcagtttagggtccaggcgggtggattttaatttgcccctgggggattctagggccagcagagctcactgccgctgctgtctgggcctccaggcagtgagctgctgggggagcccctctggaaatggacagtggctgtcagggcgtaggacgctagggggcgaacagaggaagtagaggtatctggggctgaagttcaaggttgcagcatgaagttcagggttgcagcgcccagcctagcagggcagggttcaatctgcaggactggcatgaggaggcagaggagtcagccaagccctcccctcagcctctctccagacactacagatccaaggccaggtctgcatgaggacagccacctggtctcggctgaggttacaggaagggagtcggggcaagggccagtgagtttgttcctaatttgggtcccctaattgtccaagagaagaagaaaaggcctaatttctgtttcgctaagttttagactactttagttcatgttctttaacaataggttattcatgcagagctcatctctattaatcaaaatgtatgattaggcagaaagccctattcccacaccagagtggtgaaatgcagtgcatgtgtgttcagatcaatttttgaagtcttgattttgttttgttacatgtttatttgattgcttgcagaagaatgaagttttttggccctctggaaaatttttctttctcctgagaggttttccaatctagtagaaaatagacgcagagtttggcttgcactgattgcggcattagaagcggccctgtacattttaatgtggaagacgtgatggttttgcgtttgctcctccagttgtgccccatagctgtctttctgccagctctcttgcacatttagttcttgagtgagatgttctaaatagaagccatggtccattcagtccccagcctgctgtccttctgtgacccgccagccagctttgcttagggagctatgagcccctcctactaggctacaaagtcatgggcaggaaaagcatttgtgcacagccaggagcagagcacccaggcccaggtctgtcccggagccatgtggacctggcgaatggctgttcaggtcagaagggggtttggatacaccggttctgtgtttcggaggccagcgtagtccccagtgtatttcgcagaagtgatagcagctttattcccaaggcactagtgcctgcgcgttaggcacgtgctgggtgcctgcttgagtgtctcctttgttcctctctatcactggctgtcccctgcagaggcaagcgaggcagagagttggctggtaacagccagtgtccgcagagccccagggctccctgactgggctgtgccacctggggacaggcagatagaccccaagtaaagttaaagggaagcacagtggggcctgcacaggatgtgagttggaggctctggtgaaactgagacttggtgggggatgggaggcaggggccctgctgggacagacaggagaccaggggccagtggcagaaatggtcctcgatctaccctcatgcagatggtggcctctaccgggagccctgtgtgtctctgagccttagtctccctccctccagtctgcgaaatgggcataatagaaatgatgcctctcactaataaatctgtgcagaaagagaaagcagtttgcaactgcaaagcattattcaggtcttcctggctctacctccaggatcgtatgcctccgctctctcacgagacacaggcctcccatgtgcccggtggtggtctcgaggtcatctgagccatcatccacccctctataccggggacagtgtgctgccaggaggggcaccagaagaggtgtcatacagtggcatgctgagctaggatttgaggcacttcctgcctcttctagttccttgtgggccgggggtgctttgctcagatggtgctggggaggaagggcaatatctaaggatgtattgagagggtcacattcaggtgtgccatcttctgagggacagaaccctgtcacgacagttttgccgtgactgaattcccacattgcagagtgcgcttggggtgtggctctgaacatcgctggcaggtcaggtggagcctcgctgctctggggagctgtgcccaggttccctcggttcctgaagctcagaggttgcaggagaaagggcctcctggtggctgcttactctgccccactgtgaagtgcctggtcactagagttaggcctctctcccactccgggcttcagggattccactgaggatggagggtgttggatttagtttcttttttttttcttttttttcttttgagatggagtctcactctgtcgcccaggctggagtgcagtggcaccatctctgcttactgcaagctccgcctcctgggttcacgccattctcctgcctcagcctcccgagtagctgggactacaggcgcccgccaccacgcccggctaattgttttgtatttttggtagagacggggtttgaccgtgttagccaggatggtctcgatctcctgacctcgtgatccgcccacctcggcctcccaaagtgctgggattacaggcatgagccaccgcgcctggcccccttctggagtatttcgttcattagaagtaagtcagggacttagtgtctttagctccagccagtcctgtggcctctctgccactgtgtgaatgtccccaaccccccacctgataagcaggtgtcctgaggtcatcagggatttggacttagttattaaaaagcaaccagcacccttaggagcctccagagcagagattgccaaactttctcagaccacggtgccctggatctcagcaatttcatggtgtttctagaccaaaacacatagctaacaactctactctttaagtagctaggtccaaaccacatggtatttatgtcccaacaacttggaagccacatgagaaataatactcataaattgaaacaaatgtatttcatcctaaaccacaattacaaacggaagtgtgtctgctgaatgagattggcaccattctcatttcctgtttgatgctgacttttgtgtgggacttgctgtttaaaagtttatttttatttttaatttttatacacatatcatagttatacatattatgggggtacgtgtgatattttttcttgagacagcgtgacagagttttgctctgtagcccaggctggagtgcaggggtgcaatcttggctcactgcaccctccacctccctgttcaagcgattttcatgtctctgcctcttaagtagctgggactacaagaggtacgccacctcgcctggctaatttttgtatttttagtagagatggggtttcaccacattgtccaggctggtctcaaactcctggcctcaagtgatctgcctgcctaggcctcccaaagtgctggaatcacaggcatgagccaccgcacctggcctacatgtggtattttaatataagcatatacattattaattgtggcaaagtacacataacataaaataccatcttaatcattttaagtgtatagttcggtggaattaagtacatcaacattgttttgcagtcatcaccatcagctatctccaaaacgttttcatcttcccaaaacttaaattgtgcgcatgaaacagtacctctcctttcccccttcctccagcccctcccagccaccactctactttccctctgtctgaattcacctctctaggtacctcatgtaagtggaatcgtgcagtatttgttcttttgtgactgtcttatttcacttcgcatggtgtccgtaggggtcctgcacgttgtggcatgcgtcagaattgcttccttttttagtgctgaataacactccattgcgggaatatgccacattttgttgatctgttcttctgctgctggacacgtgggttggttccgccatttggattgtggataatgctgctgtgaacaggggtgtacagatgtctccctgagtcccttctttcagttcttttgggatatacccagaagtggaattactggaccatatggtagctctttttaaaattttttgaagtgccatactattttccacagcagctgcacccatttacatttctattatgccaacagtgtacaagggctccaatttctccacatcctcaccagcacttgtgttttcattttttttgtttttcttttctttcttcttccttttttaaatggtactatcccaacaagcgtgatagcaggaatttgcttttaattacagctacttctggcctcacgagacgtctttcagaggaatgtagtgtgatctcaccttggaaacgagagctgcctcaaggcagtggtgcatgcggtgctgacaggtgccaagggtcactgccttccccatggacatctgggctgtgctgcagtgcccctgtgggtgcagcagggcccctagggtgcctccgtgcagcttgggagccatggaactagacagtgtgcttcagacgagtagataagcacagaaacagagccgtaaggactggggggaacgtccagtccatagttctgtgtggaaccacgatccacggaggcagctgaggggcaagtgtagtgtacgtggctgtgcgctccatctccgtgcttacagccctacaaagtgggaagagaatggaagaaacaggagagaaaaagtcccgtgtggtttcccggaatcctgtgggtagtgagagtctcagcattgttattcctagcatgttttgtgtgtaacgtgagatgaagcaaatgattactgatgtgatcttttaactctgaggaccttgaccaggattttcagtggcgaggagaaaggagatacggaggaaaggtgctgcgggttaagaaagcctcgggaggctgggcgtggtggctcacgcctgtaatcccagcactttgggaggccgaggcaggtggatcatgaggtcaggagatcgagaccatcctggctaacacagtgaaaccccgtctctactaaaaatacaaaaaaaaaaaaaaaaaaaaaaaaaaaaaaatagcggggcgtggtggcaggcacctgtagtcccagctactccgaaggctgagacaggagaatggagaatggcgtgaacccgggtgaacccgggaggtggagcttgcagtgagccgagatcacgccactgcactccagcctgggtgacagagcgagactctgtatcaaaaaaaaagaaaaaaaaaaaagaaaagaaaaagaaaaacaaagcctctggaatccggaactacaaatccataagtagccctagagcgttccctggagaggcctggaatcagtggccaaaccaatcacacggagcacccccagtcccgggtcatgtcttgaaattcagttttctgctgaaagaagctgagactacttggacaaatggttgataccgggttgggggcgggaaatgtacaagttgaacctaaatgctttgtcatagcagataataaaggagccaccctggactgtgaggatgtgattctgctgagagagagcattaaaagaggaaaaaaactattaaagtcaaagtccacgaggatagtgttaaaaggactcgtgagctcacctgatgaggccagagatggacaatttgaacatcagtaagagtaaaaatcacagtaggttgaaatgtatgcagtatgtttaagtccatgagtttttttaacaatactcaggaaataaacctaatccgtcacctttggagaatgctagggaaccaattatatatttttggtaaataagggaaagctctgaaatatatatcctgcttttcttatgcaggccgcactactgggtgagcaggtggcaggttgggaggttccatgtatagaggatggaacctctgtgtctgaagcgtctcagcacatctgaattcacaagctgggcgctggtggccctggggcctgctgacatctcaggaagggaggaagagccacactgcccgggagctggtctgcccctattctaacagggatctcattcgacttccagatccaaccactgatttgcaggaacggaaaggacagaggacgatgtttggctgtgcttcaggcacctggccatcaaaagccaaaccatgggaaatgctgtgtgaccaacgactcttcagttaataacttgggaggcaaaaaaaaaaaaaaaaaaaaaaagaggtggaagcacaaccaacggttaaaggggacataaaaggcacacatagtgtgtgtgtagggacatgtgctacatggagcagggtggggctatgattaccctacaaccaggatgtggtcaggggcacacagggaggctgggtcccgagggctggagtggccggtagggcccctcttcttccctgcctgaggattgtaaaggttgtttcatagccgttttgtttgtttatttatttatttatttatttagagatggagtctcgctctttcgcccaggctggagcgcagtggcgcgatctcagctcaccgcaagctccgcctcccgggttcacaccattctcctgcctcagcctcccgagtagctgggactacaggtgcccgccaccacgcctggctaattttgttttgtatttttagtagagacacggtttgaccgtgttagccaggatggtctcgatctcctgatctcgtgatccgcccgcctcagcctcctaaagtgctgggattacaggcgtgagccactgcgcctggcctcatagccatttattaagctaaatatttacactatgttttctaaaaaagtaaaattattttaacaacataaaagtcaaaggaagaagttcctggaagtggtcttgaaggtgcaagtgggcaattgtgaacagtctgctggtgcaggatgtggcgcttcgtcgtgggagtgctgtctccctccactgtgggccgcgctccttcctgcagcactcgcagctcactgctgccatttcccgtgtaatcctgtcttctgtcttgactcagacccactcgtatctttgttgtctggggtctgcgctttactaggggaccttggagttctgttgttggctgtgacttcattccatgttctttcccataaggaactgtgttgggaatagtttgatgattccatggtcatgccttttggccttttctgtgaggggcgaatggggagcacatggaacttattgctgctgtcttcagtatttcttgggggaggaactcggtgtggttttttccagcctgagcccaccctgaggtcggttgttggacccacctgcctgatgcagactgccagggtcttcctgccagcgcgggatcccccactttccatttcctcttgcaaccatcagacccagggacacatgtgtggctccttctccagtaagcgacctgggaggtatccttaccccaggacccgagtgagcgtctgttggagactcccaggtgtgcaggccagaaggacatgcccagttgtgtggctgcctcttccctgcagggagagagagaaggctggcgtggggcttctccccgggctgggcctgcgttgtccccgaggcccgtggccgctggagcagcccctgagcgactctgctccttcctgggcctcggtttcctcgttctcagggggggcttctgccagactgtctgggagatgttttcagccctctaatttgtgcatgctgtgactcacccaaaattacagagcaaagctaatggaatcaggaatttataaatcccccttccttcctcacgcggttccttgagtttttgaaaactaccattcagaatgagacagtggccttctacctgaggccacagggttgtctgtggcctaactgatttctggccagtcaggctgggtgagcctcaacagcgtgaacatactaaaggcttcttccttgccctgggacaccggttctggccaggctacagggctcacagctcagacctgcctctgcctgggagtgacacggtcccctctgctcacgtgccatggatcagagctgccatgtggcccagcttagggagaccaagaagcatgggagactccccggctatttgacgagcaggacctgtccatgccatctcccatctgtgccctgcatctgcgacttccaaagagcattggcctgcactgtcctatgaaatgctaccacaagccctttctggcaagtgcagttaatcctgttcggtgggttaggaaaccaaggctctgagggaggctttcagtgccacagctgggaggtgagagttgtgagttgcagatgtctcagccatcccgagcgtgaccattctgagtggcgggaagcttttcactcagcactgagtacatgatgcctacagtgttctgggcctcctccatcaggaatcatgggcccttctccccaggacgctcatcgatggccccggctcctccagccctggctcctccagccctggctcctccagccctggcccctccttgggctgtggctgcaccctgggctccacccattccagacccaaaggcccatgggccaaccagacaccgcccctacatggtgtgcccacaggctcttatggatcccagagggccccctttgtcctgcttggggaggctggggtggccgctacacagtgccctgccgtggcccccatgctccccaactccctactgtgtctgctggacgtttgaacagcctcctgccctaaaccttgcatcctgccacctctggcccactctccaccctggcctactcttcaccctggcccactctccactctgcagccaagtgatcttttccagcagcacatgtgactgagtattgctgatggctgcgactgctttcaggatcaaattgtgtctcttccgaaagagacatcagataagagacattggaaaagaacatgaattgcggtcacccagagctctttcgcggtttgggattaagccatgcagaaaggtgtgcaggagcctagatcacctgccaacctgcctcttgccatcctctattttgtacgctcagtcaccccagaaaattgctccggcccttggatttacctccgtgtcactgtccatccggtaccctctgcctgggatgcctcctgggtctccatcacccgcctcactcgtttttcctctgcacatggcatctacttccgcccttccgcaggacaccttcccaggctgggtctggaccaccctgcggactcgctcctcgcaatactggccacatgccctcaagcccatctgtttcttagagtcgatgtcccctaaggtgtgagttcctggtgagcaggagaacctgtgccttttataacctggtgtgctgctcggcgtgccgaaggaaccaaggcgatgttgagaaatgaatggaacagctgtactgtgcagagatacgtgcagagaggggcaggaggaagcctccacttcagacttcagtgtgaaaaagagacactggaaaagaacatgaaatgtggttgcccgatgctcctttgtggtttgggatgaagccctgcagaaaggtccgggcagcactgcagccccgccatgctgcttgccccacgtgggttctggagtctggtggcacctggaagagcaggtggagtggaagctgctagaaggtgggaacctgagggtcctgggctggcagaggccttgcccccgctttgcctagggaggcagtgagcttcctccttcatttgaactttgccctgaagagctgggccttccttgttcatggggagcctgatgcttcttcccagcacaccacagccacacaggaggtgcagcagagcatgcggagatccacctggcaactcacagccagccgcggcgtcactgtcaggactctgtgaaaaacaaggtttctgtttggcgcggggacgaccagagggaaggagactggtagagcctaagtattcagccgaccattaaaaagtgaaagtcagaagcaatgtaagtcaaaactcaggacatctcagggtgaccttggccactcacagttgttcgtgtttgaaatcacattgattctcgcagctgtccaaggcgcaggaaataaccactctgggtgatgtcgttgggatggttttgtcagcactcaggatttgggggtttgttatgaaaatttcacgttacaaaaaagggagaagtgcagttttgtgtgtttagggttattggtggctagacatctgaaaatcaggatccccgctcattgattttttttttttttttgagatggagtcttgctctgttgcccaggctagagtgcagtggccaatcttggttcactgcaacctcggcctcccaagttcaagcgattctcctgcctcagcctcctgagtaactgggattacaggcgcctgccccccgcctggctaatttttgtatttttagtagagacagggttttaacatgttagccaggctggtaactcctgacctcaggtgatcagcctacctcggcctcccaaagtgctgggattacaggcggtgccgctccttacattttgttgctgttcccaggaagattgatggagggaaaacacactctccacagaggagatcctgtgtttacagccgtcttagatagagtcgtgatgaggaggaggactctgggccgacagtgtatgagggttccgcctcataaggctgtttggtgtttgtgcccacactgggtgtgacgggttgaagcagtggataacaagcctattactgttatgcaaatgtgggcggcccagttgcattcttcatgcatgtgtctctccctaatgagtttcaaaatcttaatttagatcttgattttgttgcagataggattccaatttaaagagcgtttgtcattcagagactgtggtagacaggaaaatggtcttcagagatatccacaccctagctgtggcgcctgtaaatctgttactttatgtgacagaaaggactttgcagatctgattaagttatggatcttgagatggagagattattctggattattcaggtgggcccttataatcatggtgacccttataagaaggaagctggaggagttaattgtcagaggagaaggtgctgtgacgatggaagtggagattgaagtgatgcactttgaagatggaggaagcggctgcaagccaaggaatgcaggtggcttctagaagccagaaaaggcaaggaaacagattcttgcctagagcctccgtaaagaaccaggccagtcgacaccatgaccttagcccaaggagacctgcgtgggattcctttctttttattttctttcttttcttttcttttttttgagacaggatcttgctctgtcatccaggctggagtgcagtggcgccatctcagctcactgcaacctccacctcttaggttcaagccattttcgtgcctcaaccacccatgtagctgggatacaggcacatgccaccatgtctggctaatttttgcatttttttgtaaagataaggtcttgctatattgcctaggctgttcttgaactcctgggctcaagggatccacctgcctcagcctcgccaagtgctgggattataggcgtgagccactgcactcagccctctgtgggatttctgaactatagaactgtaagagagcaagttggtgttgtctgaagtcactagatttatggtgacttgtcacagcagccataggaagctaacacagagactcagggaccaagcctttccattgcagcaagattgatcagttgttctctcccatcacggggctctcattttgctcaagtcctatgtcatcgtccctcttttcctggagagcaggagctgacttcagacgccagatcttcttttcctgccacagcgcacttgcagctcttgggaggtgaaggttctgcctgctgctcttctggaatgataaacgctgggcccttagtggaaatgtcaggtgaaatggaaggcagctccttgggtgcagtgacaggacctgcagtgggcctgttggagctggcactgagggctgctccccatccctctgtgggtgtattggctgcatgctgactggccgtcctcgtgggcgtggcctggtgtgtgtgcaggtggacagaggctggagtatccttgagaggctgtgcgttctctcggcttcttttggagccagagccatcagggagccatcacctgtcctggcctgacctgtcctgtcatgagtgctgtgttccttgagctgcctctcaggctaggggatgaggtggctgtgctcaggcctggcttctgcaggcttcttcctatctttggagcggctccaccactggaatctgtgacatgagaggcccgtagcccaggcccatcatctagaatggagaggcagccccacagcctcctgggaaccagagctccttgcctgggtcatcacagaactaagccttaaaatcaggaggcctcagcaaagcgcctctagagactcaaaccaccttgtaaatctcactgggagtgaacgattgactttttactcagtaccaggactacatactacctcatttatgggtttttcctctaaattgctaatgtttgaagtggaaattttcaaaactgactaatgtctctgcttcaagatttgctgtcaggcaacttatttataaataaagcagcttttcaaggagcactaacaaacaatccctcgtgttaggagactcagagccaagtcgtggctctaggttggccttgcagggtgttagggagccagttctccaccccagggccatggacttctgggtccttgcaccatccagagaggtgatgatgtggttattcccatgtatagagtctactgttttcagggggcatttgcatctgtggtttcattagatgttcagagcatccccacaggggttagttcatgtagagaaggaatcagaggctcacagaggttcagggtttgctgggtcaccagctcctaagaggggccctttgggctgaggccacggcgctttctttcttgcaagacagaaattttccttttcctttctttgccataatggccacctccttccaccccatatccttcttccctttggccactggtgagttctgattatttttggaaaaaaaaaaaaattaaaactctgggagcttgagactgaggtaaagtcccctttcgtagagatttttggactgacatgttagctctctgccctgtgtaacttcagagtttggtaggtgatggggacacgcctgttggagagtcctggtgtgtccagttttgtccccgcagcttcactggctgtcagagccacagcctttgcttacggctacgccctggaatatttaacagcaatttcttttcgctttcttctgtcgtgttctgtctgtgtcagtgttttgtggtcttactgtacctgttgttttattataggcagatactgtaaacgctgatacagtctgtgccctgcggttgtggtttttagggccttgcggcggcatctttgctagtgctcactgcaaataggggcaggaagcagttgtttgggaatgagccacatggtggaatatcttgaatgtcccaggccaggcacagagcagctgctcagtaaatgttgctgagtgagaggctggggggttggtgaggataggcaggggtgggcgtccaaggctgcagagttgtaaagcggggggtggggcagccagcaagtccagctcgaggaaacaccacggggttcaggggctctgtgtaagaaatggcagaggtttggcttcgcttttagttgttttgtttcttgttcaagtgaggagaacacaccgagaagggaggagagcaaggctggctgagcgtcatggcagggtggtaaaggaatcaatcacccggacaggttgtccgttcatgtgccgttgtttgcattgctgtgatacagactgctgtgccactgaaaccttccgaaaagcaagccacccagagagtgacttgggcaggtgtgtattcatgtgtgcatcagggagaggaatacttgcaaggagcagagcttccagaagaccaagattcagtggaggcagcaagtcagggccgggcagaagcccctggggtatctgcggaagagcactttccagggtgcatggatggatgcgttaaccagccagttcctacgcatcacggaggagaggtgcctgccctcctgggagccgtgcctattccattgcttctgttgtttttttgagacagggtctcactctgtcacccaggctggagtgcagtggcacgatttcagctcactgcagcctctgcctcccaggctcaagcgatcctcccacctcagcctcccaattagatgggacttcaggtgagcaccaccatgcctggctaatttttaaatgttttgtagaaacggggtctcactgtattgcccagactgttctcgaactcctgggctcaagtgatcctcatgcctccacctcccaaagtgctgggatttcaggcgtgagttaccacacccggcctcttgttgttgttagtaaacttttaattctagaacagctttaaagttataaaaaagttgcaaagactgcagagaattcccatgcttgcttcctccagtcttctctctcgttaacatcttacatcacacggtgcatttggcataactgaggaaccaacgtgggtccattgctatgaactaaactctgcagtttattccaatttccttagtttttgcttaatgttttttttctgtcccaggagcctgtccaggccactacgttacctatagtccttgcgtctccttagcctcctctggtctgtgacagtttttcagctttccttgtttttaatgaccttgatagttttcaagagtacaggtctttgtgaatatccttcgatttgggtttatctgctgttcttctcatggttagactggagttatgggtttgggggaggaaaaccacagaagcgaagcaccattttcaacatacatcaatgttgcatgatatcaatatgactcataactatcgatgttgaccccgatcagctggctgaggtagcatgtgccagttgctcactgtaagattaccccaccttcagcggggtgcggtggctcatgcctgtaatcccagcactttgggaggccgagtgggtggatcatgaggtcaggagatcgagaccatcttggctaacatggtgaaaccccgtctctattaaaaatacaaaaaattagccaggcgtggtggtgggcacctgtagtcccagctacttgggagactgaggcaggagaatggcgtgaacccaggaggcagagcttgcagtgagctgagatcacgccactgcactccaccctaggcgacagagtgagattctgtctcaaaaaaaaaaaaagaaagcaaaaaaagattaccccaccttctttccatagtcctccctggaaggaggtcgatgtgcagagcccatgcttaaggaatgtggagttacactccactccttcatggggggtggggatatctgtataaattatttggaatatttctgtatgggggacttatctattctcccccatttatttattcaaacatttacatcaatatggatttgtggatatataatttataccttgctttataatccagtgctgtgttatttattttattgctcaaactgtcccagctttgactatatgaagctctttcaggtggcatcccatgtcccttagagagatccctacctttttgtttttttgagtacagtcagttggccatatccgtgagttctgcatctgtggattcaaccaaccttagatgggaaatatctgggagaaaaatagatggttgcatctctactgaacagactttttgtcttgtcatcattccttaaacaatacagtataacaacgatttatatagcatttacattgtactaggtattataaataatctagaaaggatttaaaatatattgaagaatgtgcataggttatatgcagattctacaccattttatagaagggacttgagcattgaggattatggtatctacaggggggcctagataaccaatcccttacagatacccaaagaaaactgtacctctttctggcacaagatactcaggctcatcttgaatttttcctacccagtcctggactcagctatttctgcaaggatccctgccttattttattgaagaatggtatctagaaaccaaggtctggagacagggttcttcttgtcaccgaggtacattgcttccaggccctctcagcagacagagctaggaaatatgcatgtatgctaatctgtgtatacatatgtatctcccatagtttttttttatttttttattttttgagacaaagccttgctctgttgccaggctggagtgcagtggcacgatctccactcactgcaacctccgcctcccaaattcaagcaactttcccgcctcagcctccctagtagctgggactacaggcgtgtgccaccacacccagctaatttttgtacttttagtagacagagtttcaccatgttggccaggatggtcttgatctcttgacctcatgatccatccgccttggcctcccaaagtgctgggattacaggcgtgagcccactgcactcagccttttttttttttttttttttttttttaagacagagtctccctctgttgctcaagctggagtgaatggcacaatcttgtctcactgtaatctccacctcatgggttcaagggattctcttgcctcagcctcctgagtagctgggattataggcatgcaccaccacgcctggctaatttttgtgtcccatagcttttttttgaatgcacgaccccatctggcggcgaagccctggacctagccttctgatcactcatgggaaccatgaccacgtgtcacatagtagaaaggaaaacttggacaacttactgtgtagacaggagcagcaacaacaaaaaagacttggaaggcttaaagaatattttccaagtatacacaaatacagagaataataagaggaatgactttgagagcctgaggcaggaggattgcttgagcccaggagttcaagaacagtctgggtagcatagagtgaccttgtctctacaaaaaaattaaaaaaaaaagccaggtgtggtgacgcgcaccagtggtcccacctccgtgggaggcagaggcaagaggatcacttgagcctgggaagttgaggctgcagtgagccatgattataccactgcattccatcctggctaacagaccaagactctgtttaagaaaaaaggagtatctggggtacctgctatccagtttaagacatgtacaaatatgattcagccttccatgagcatgcctccccagccacccctgtgaaacccagtaaattgaatttactgtttgttttttggaggcatgttttatttttacactgcatgtatgcctaaatgatatatcccattgttatgatattttcaaactttgtagaaatgataccttactgtgttcctacaacttgaattttcattaactgagacattttacatgtatttatcttcttagcaatcctgagaaaagcaagagtcactatctccattgtatagatagagaaactgataatgtagagcaatgatgtgatttttgctaatttcaagcagctaatggagatcgactcacatttgtaccttcagagccctagtccatgctctttgtatgacataaatgtcaagattcatcaggaaaaggaagaacaggcgggtcttgttggttactctgtgaccctgttgcttccctgggacctggaagtcctggtgtctcccttagcctggaatcccagtctccatctgggttttgcaggctccaggagttttgatgaaatgaggacccatatggctggttgagactcccaccccctcatcactccctaccagcgtttgtgcagaatcctcctctcctcccgagttggaaataatgtatagttggctcaaaagtcagcccctccttattttagcaccagatgctgcctctcagcttcacgctgccctccagcagcattgcctgtggtccatgggatcttggccttcacactcagcattgaaacagctgccttccgctcccatcataggaaagagaacagaagtctcttgctcccactccccccgccccaccccctgctgctggcctatttctgtgctttgttttgctgtagaacttctggaaagagttgtctgcagtggctttctccatttcctcccttcccgttctctcttatacccgctccagtcggacttttgccccttccacagacacctctcctgacacttttgaccccatcacttagagatcaagatctgtaagactccaagtctccagatccagtggtcagctctcggtcccttcccatgtgactgaccagcagtgtttgccacagtcgtcccctctaggaaacaccttcttcccttggcttgtggggcactctgtgcttgggattttcttcctgcttcactggactttgctcagtccccttactgacccgtgagtgtcagagtgtccctgcggtcagtccatgcccctcttctccgctcggtccacactcccaccatggttgacctcattccgacttgtggcacaaggagctcacatttatcttttagctctgatttctcttctgacctccagactgtacaccctgttgctcacccagcgctttcccttagagttctaattgacgtccccacacaacaggcaccaagctgtccctggccatctcaaccccaatctccacatctcagtaaatggcagctccatgcttccggacacctagaccatagacttggagccaaccttgactcctgtctctcttaaaccccacatggaatctgttccgtaagctgcccatggtcacaccggcaccgctgccgtgcgatgagagcctgtcatctccttgctagattgctgtgccagtttcctgatggttcctgtttccacactgactgcataccttcccacccaagtctgtgtctgctcagcagctggtttattgcatacaaacttaaatgagaatgctcctccgaccagagctctccgttccctggccatcccattaagagtaaatgctggaagcccctcctcaactgactttatttcttaaaactctatcctgcaaaatcctgcctggctaataactttatcaccttcttcgtgttggttccaacgttcccttctgcaggtggcttctgcggactttggtactggcccacatccctgagctggtaaccccccaccatgcacaggcacccccacattaattctgtagcttatttgtttattgttgtctgtgccactccagacaggaagcctgtgggggttgggggcttggtctgccttcttcagccctgggctcacagtcctgacatcttcttgaagacggcgctcacggtcaggctgcagcaaattcacagttgacatctaggagtgagggcctcctgccatgctgcactctggcctctcacctgcctcctgctagtcctgggcacacctggaggacaatcagggaatttctttccccatctgctttggcatcctccaaacctgggaacctttctaacacctgactgcttggtgaccatgtgtgtgctctgtggatttctgtccaggagggtccctcactctggccctcagggccatgtgcatgtggacaccgactggtagggttggtttcctatgcagagagcagggccagaggcatagccggcccacccccagccccattgctcacggttcacccagtcccctggcctttccgacgctgtgcgcatctgtatttgttgcagtgaacagagcctagaattataggactttgtcagacagtttgattttcaaccccgtaaaaaatacattttacttaaccacctaggatacctctacattatagacctcaagcagaagtttcaggagacagtttcttactctcattagaggtgatgcgttttgtgtggtcttcggtttcattgccccataaactcacttggcgatctgcctgtgggtccccagcagtctgtaagccacagctttctcaaccgtacttcctgttctggaggagaaacctgagctgcaaagagctaagggtcttgctaaggtcataccagtgaattcaccaaacagccagtactggaaccctgtcctctgattcccatcctgtggcttttttaggcttgtgtaatcaattttaatgattgtaccattgtagcttatttaaattaccccaggaggaacatcagctctgttcaagaaatgttattgtagttgctcacctgctttgttcagggaaatgcatcttttgtgggatttcttctgagtaattaagagggtctaagaagccagttttatagtcatttatttaactgtagagaacaatgaagttaaacacaaaagctggttccatctgcaggaacatatgagtgatttgcattagaaagggtgttcatcaaagctcctcccaggtgcctagggaggcatggggggccttggtgggttccctgagggtcgggccaaggccttgggccagggagcacagttccattgcactgggtgtgttggggcagaaccttgtgcttggaggtaggtgttgcttctggccctcggttgcttgctcctgcaggcagggccgtggacccgtagctcagcaaccatggaggagctgtgagaaatgcacagtctcaggccccaccctggctctgctgacttggaacctgcatgttaacgagactgggggtttgtatgcacatcacatccggtccagctctggcctgaggactccggtctgtggtttctagtttttatcatccagctggtcatcctcagcagtagagaatgtggttggttaccatgtgcagggcagcctgctatgtgctgtggtaacagaagggtggggcagagccctcctagccctcccagccctctggggcttgctgtctctagggcaggcaggggctggcatatgcagttgtacaccatggtgttttacaaagcacgagtgccatggaccccatgggtgggctggattgagatgcaaggagggaaaacagatggggtggggtcccaagcaggaggaactgcatgaggaaaggcgtggaggctggacagatgcagaggcagtcagggaatagccagtgtcagaatggagcaggcgacagccgggttttggaggctttcagtcccacgtttagatatttggactttatccagtgggtcatggaagctactataaactttttaaaattaaatactattttatttaaaaaattgtgtaaaatacacataacataggattcaccttctggaaccatgtttaagtgtagagctcagtcgcattaagtacatttacacggttgtgcaaccatcaccccatccacctccagagctctcctcaccctgcaaaactgaaactctgtccccattaaacacttaactcccattcctcctcccctcaccccctggcacccaccattgtactttctgtctatgattttgacgacttcaggtgcctcgtatgagagcaattgtataggatttatattttgtgactggcatatttcactctcaacgtcctcacggtgcacacacgtcgtagtgtagcacgtgtcacagtctccttgtctgttaaggtcgaggaatacttccttgtatgaatagaccacattttgttgatcgttcatctggtgaaggatgcttgggttgcttttacctcttggctgttgtgaatcatgctgctgtgaacatgggggtacaatctctttgagctcttgttttctttttctttttttttctttttcttttgagatggagtctcgttctgtcacccaggctggagtgcagtggtgcaatctcagctcactgcaagctccgcctcccgggttcacgccattctcctgcctcagcctcccgagtagctgggactacaggcgcccgccaccgtgcctggctaatttttttaagtatttttagtagagacggggtttcactgtgttagccacgatggtctcaatctcctgacctcgtgatccgcccgcctcggcctcccaaagtgctgggattgattacaggcgtgagctactgcgcccggcctgagctcttgttttcacttccttcgggcatacccccagaagtggagtcattcctagatcatatggtgattctatttttaatgttttaaggatagcattttccaaaggggctgcacaccattttacattcctacccaccgtgtacaagggttccagttttctccacatcctcaccaacacttgttattttctggtttttcaatcgtggccaccctgatgggagtggggtagcagctctctgtggtttggatggcgttttcctgatgcacgatggtgtggagcacctctcctgtgtgggagcactgtggcctggtgagcaggggctctgtggtggggaggcgcgtgccgagggctgtaggagagggcgacgggtggtgctgtgcatcaggttcggggtgatgggaacgctgtctcttgcacctgcacatcaggcctcccccatgctactttggtggcttctgtgggagcacaatatgtccagggtgccatccccaaggcagaagggagcaccatctggtttgatgtgtggcctgtacttcaccaagcccaccacatttggcctatgactgtgtcctgctgcgactgggttgaagtcagaggagccgagacaggcgggggagcatttggaggacgtgtcccttgctgtggtgtctttgcagaagtggccagcacttgcactgcccagtagtattttcgatgctcctgggaacatgagaggattgcactctctgctttctcaaagttagataagaccatgtgccttgcttcagccaatgacatgtaagcagaagtgacttgtgggtagaagctggaagggactttctatgctgtcctttctccagtcacatcggtcctagaagcacatgcctaggaggaggggccataatagcaacgtggctgttatttgctttggactcacagtggactttgagtgagcaagacagaaaccattactgggcccaggccctgtggcgtgggagctgtttgttgtcacagcacagcctagcctgtcctcactgatccaggaggaacctgaaaagtattttaagtgcacagataggtgaagatgaaagtgtagcgttttgggataattctgcatgcttcttagtatctccagcagtttcgagatttggcgaaggggctgaacttttctgtaggtaaatctcttgctgaagagttcattatcagctggtaatggcttcattttgtcagcggcacagagctctggcttgtgcgtgtctgaggcctgtccccactggggcagggaggtaatgagaactcatgaaccctgcatctctgcctggctttaacagcctctgtgttttccagtgcttatcaaatccagagctgtttacatttcaggagacaacttcagactctgtggacctcattatacttccaaagcaggagggtcgttgtttttaagcattattcccaacttttttttttttgactgcagaaatgcctttttaatatcagaaaatttccaagttttccttacttggctatagtcttgtttttagtactgctttggtggttcagtaactattcattaaacaaatctcttcattttaagtttatttcttctatagggctcttctcttctcttctgttctcttctcttctttttgatacagaatctccctctgtcgccaggctggagtgcagtggtgcgaccttggttcactgcaacctccacctcctgggttaaagctattctcctgcctcagtctcccgagtagctgggactgcaggtgcatgccgccatgcccagctaatttttgtatttttagtggagacggggtttcaccatgttggccaggacggtcttgatctcttgacctcatgatccacctgcctcggcctcccaaagtgctgggattacaggcatgagcctccgcattcaaatatatgtaaaaacggagagaattgtgatccctgaaaattcatgtgttgaaatcttcacccccaggacctcagaatgtgactgtatttggagagagggtctttgaagaggtaactgagttaaaatgatatcatcaaggtagcttaatccaatctgactgatgttcttgtaagaagagattcagacacagacaggcacagacggatggccgtgtacatacatggcggaagacagccgtatgtgagccaaggagcgaggcctcctgagaaaccagccctgctgacaccataatctcgacttccagtcgccagaactggaagaaaatacatttctgttggttaagtcccctagcctgtggtactttgtgatagcattcctagaaaactaatacagtgcctgtgtgctattgttcagtgtcagcagttccagtttttaagcaatcttcatggactgctcccgaagttcagggagcatggggcctatagcagagaactaggcagcacctgcccttgtgaaactgacactctacggaaactggaaaaattcatgaggacaagcttcagttaacaacactttgaggctgggtgtgggagcttgagcctgtaatcccagcacttcgggaggccgaggcaggtggatcacttgaacccaggaatttgagagcagcctgggcaacatggtgaaacgccatctctactaaaaatacaaacaattagctgggcctggtggcagttgcctgtggtcccagctacttgggaggctgaggtgggaggattgcttgagcccaggaggcggaggttacagtgagctgagattgcaccactgcacttcagtcagcccaggtgacagagtgagaccttgtttcaaaaaaaaaaaaaaaaaaaagacactttgagactgggcgaagtggctcgtgcctgtaatcccagcagttcaggaagcagaggcaggagtactgcttgaggccaggagttcaaaaccagcctgagcaacacagcaagacccctgtctccacaaaaaatatattaaaattagctgggtgtggtggtggatgcctgtagtcccagctacttagaggctgaggcaggaggattgcctgagcctgagaggttgaggctgcagtaagctatgatcatgccactgtattccagtctgggtgataaagcaagaccttgtctcaaaaaaaaaaaaaagagcactttgaattctcataatcataatcatatgacatctgtctaccttagaaaccctcgctggtgggtggtcacacataatgctggtggtctgcggggggcagatggactctcacaccctcctaggttcccctttaggaactgaggcttcaggtatgggaagggtttgtggaataaatggatgaaaatggaatgagaagctttgcccacgtcagagccaacctatcatgtggaccaggattcagaccacccctgggagaggaaccaggatgcacccatcattctttttttttttttttttgagacggagtgtcacactgtcacccaggctggagtgcagtggtgtgatctcggctcgccgcaacctccgcctcccaggttcaaatgattctcctgcctcagcctcccgagtagctgggattacaggcgtgcaccaccatgcctggctaattttgtatttttagtagagacagggtttctccatgttggtcaggctggtctcgaactcccgacctcaggtgattcacctgcctcagcctcccagagtgctgggattacaggcgtgagccaccgcacctagccgacacccatcattcttacacagtgaagacccagggagatgatgagtcacaccgggaagtgattcatttgcttactgttaagttcatccaggattcctttaaataccaaatccccatatacgcttaaaaatacctagttcactcagaaacagtgtgctgactgacggaagccagacatgaaagactatgtggtgcaattccatgtataggacgtttctagaaagggcctaatgacagagatggaaagcagatgagggcctgcttgggtctggggcgtcagtggggattggctgcaggcagccatgaggagccttcagggtgatgagggttctaaaagtgcgtcgtgtgcctgagccactgcgacattcactagaagtcctccgtgctgacggagggtgaactgtgtggggcccaagttctatctcaggaaagccagggaagccactcagttcagctttgtgaaaatcaagggagtcttcttggaggaagtggactctgagctggatgtgaatgacggagtgtctttggtaaggagagacagctgcaggggactcctggtggaggaacaggatcccgggggagcggccgggcgggtgactgaggcgccaatggaaggagaagcctgtcacaggtgagggcattgaagggaactgcagggacacccagcgcttctcaactctgactgcagatttccagctgccatttctaaaggacaggtgcctgggctccactcctggaggtttggatttaatcagtctcgggtatagatcccggacgttagtatttttaagcatatttttaaatgaagtgatactctaattctatcattttctttttacttctcagcttgttgcttctctaaagagatacctccctttatccattttgtggtcacccagtgggacagttgagagagaaaaggccgggtggcatgtgattcttctacttcatttaccagttttgaagatgatgaatttgtttcccatgaccttccaaaggtggttttttaaaatttattttaatctatcgtcgtgaactcctggggcgtgaacgtgtgtcataggtttcaaaccactgcaatcattatcctcattgaggttcattgtggctggtggtagtgtcttcatattggcctctgagaccttctgacctgattctagttatctttgataatttccttgtctttaaaaaattataattgtatatattttttaataataaagatgggtttcggctgggcgcggtggctcacgcctgtaatcccagcactttgggatgcagaggtgggcagttcacgaggtcaggagattgagaccatcctggccaacatggtgaaaccccatctctactaaaaatacaaaattaactgggcatggtggcgggcgcctgtagtcccagctactcaggaggctgaggcaggggaatcgcttgaacccaggaggcggaggttacagtgagcagagatcgcgccactgcactccagcctggcgacagtgagactccgtctcaaaaaataataataatagtaataataataataaagacagattttgccatgttgcccaggcttgtctcgaactcctgggctcaagccatctgcccacctctgcctcccaaaatgctgggattacagtgtgagccaccatggcccagcctaacttccttgccttttaagagtaaagcagttttatttcccattgctcttccactagctttaagtatgtgttaatttattattttaggttgtcctagaggttatgatctgcagactcattagatgctagtgatgctggtcttctttaaattggtactttaaccgcttcctggacaaggcagggactttgcatacagatatatcagtatggtgtggaagacagctacactcaccattataccacctgcacagatatcagtatgttttgaaagttgcctggagaccttggtggcaatccagggctgaaaactctgggtggggcactaggtgggtggcaggtgcactggggactgaatgggatgctgtggcagagaggaccagacctaaagcctttagtgaagaaggcctggtgtgaattttttagctggttatcaggttcatattttaaagaatatttttctaattacgtttgtttgtttggtctggcctgatgtgggacgtggtattttcagtgtataggtcttcctagagttgggaaggagggatgcccttctgttggagatgtttctgttaactcaggtgctttaggaatggaaaggaaagtcatgcagctcaggcccggcaggggcattgttgaagatcctcagccagtgaggcgccttccctgtgcccagcacattgctgaggaccttgcctgaaagatgtcctttcatcctccccacccacctgaaagatgagaagtggaggactgatgagaaccttccagatgggttctccaagccacacagctaacaggtgccagagtcggaatttgaactcagctgtgacttacttctgttaccagcagaagtgggtgagaaagccggccacagtccactaaacacgggctatgaccaaggtctctttgacaacataatccaacaaataggcttgttttagaatataaatctcaaggaatttggggggagttgatatactcttgttttttactttttattttgaaatatttttagattcacaggaggttgcaaagaaatattcaagaagatcctgaacactcttcacttagccccgcttcaatgttaacattatgcataacgatagtacaatagtcaaaccaggaaactgacagtgatgtagtcaacagaaactagtcagactccagtagttataatgtatgtatgtgtgtgtgtatgtgtgtgattctgtccaattgcatgtgcaacttcatgtaaccaccaccacaatcaagatatttaattgtatcatcagcaaaggactgcctcatgctaccccattgtagccacatgcacagtccctcttccatcattcctaacctatggcaaccactggaggacatttggagtttccagtttggggctgttatgaacccagatctgctatatgaacattcacttacaagtttctatgtgaaaacaagtttttattcctctatgatcaattatctacaattgctggattgcatggtaaattcatttttacttttaaaggagttgccaaactattttccagagtggctgtaccattttatattcccattagcaatgtatggatgattcagtttctccacatccttgccagcatttggtgttatcactgttttttattttagctattctcataggtgtgtagtgatatctagttgtggtttagattgcatttttctgatgcctaataatgttggggatcttttcatatgattatttgccatctgtgtatcttcacgggtgaaatatctgttcatcacttttgctcattttttttttttttttgagacgaagtcttgctcttgtcttccaggctgtagtgcagtggcacgaacttggctcactgcaacctccgcctcctagattcaagtgattctcctgcctcagcctcccgagtagctgggattacaggcgcctgccaccacgcctggctaatttttgtatttttagtagagatggggtttcaccatgttggccaggctggtcttgaactcctgacctcaggtgatcagcccacctcggcctccgaaagtgctgggattacaggcatgagccaccgcacctggcccacttttgctcattttctaattagattttttttttaattgttgagttttaagggctgtttatatattctagatacaagtcctttgttaggtacgtgatttgcaaataatttctcccagagtataatttttttttctgttatcttaacttgacccttgacagaatgaaagtttttaattttgaggaggtcaaagttttatcaaattttttccttttatggatattgtgtttggtgtatgtctaggaactctttgcctaatcattaaggtcccaaagctctttcctttgattttttttttctacatgtcttatagttttatatttaagtccttgattcattttgcgttagtttttgtataaggtatgaaatttatgtcaaatttcttttttctttttttgcctatagatgtgcaaatactccagcgccattaattgaaaaggctgtccctccttcatggaattacttttgctccttgtgacaaatcagttgggcatatttgtagggatcatttttcctgggctctctactccattccatttgatctctgtgtctctccctttgcctatatcacactgtcttgattactatatctctgtaggaagccttaatatcaggcagggtgatttccccaattttattctcctttttcaaagttatttggctattctcaggcttttctctttctaataaattttagaataagtttgtttgcatctacaaaataccttacaaagtttgacaggacttttgttaagcctgtcagtcaatttaggcagaatcgaccttttaactatgttgagcgttccagtccatgagtatgtctcttcagtatttaggtctttgatttccttccttgtcattttgtaatttttattttatatagatcctgtacatattttgttagatatattcataagtatcttcttgttatctttagagcaactttaaatggtgttgcatttaacagtcttgatttccacttctttgttattagtgtatagacatgcaatcagtttttgaatgttgatcttgtaccctgaaaccttactgaactatatgttttcctctcagcactgtctgagctgcatcctaccaacttggtatgtcgtgttgtcattttagtgcagttctatatagtttaaaatttcccttgagatttcccctttgacctatggattagttagaagtgtgttggttaatttccaagtatttggagattttcctgtagtttttttgtcattgatttctagttggagtccattttggtcaacatattctgcatgattttaatttttttgaatttattaaggcttttttttgtgacccaggatatggtctatctgagtgtatgttccatggacaattgaaaagaatgtgtattctgcagtttttgggttgaattttctataaatgtcaatttgatctttttgttggatggtgttgcacacttctgtatctttgctgatcttctgtccagtagttgtgtcagttgctcagagtgggtactgacatccccaaatattattgtgaatttgtcgatttttctcttggcaagatttgtttttgctgtatgtgttttgtggtctggggggtacgcatttagaatttctgtatgttcttggtaggctgggcattttattattatgtaatattattccttgtctttatttagtttctttactctgaagtctgcctggatattaatatagccacttttgctttctcatgattagtgttggcatgacatgtcttttcccatcctttactttcagtctacccatgttgttatgtttgaaatgagtttcttgtaggtagcttgtaggttattttttaaatccattctgccaatgtctgttatttgatgtagttagaccatttatatttaaaatgattattgacttgctagggtttaagtctgcattttatgatttttttccttctctttctcattcctctgtttctttttccttgccttcctatggtgacaaacattttttagagtcccacatttccttatttatactgtgtttgaatgtacggctttggatagtgttctttatgattgctgtaaatattatgtcagcctactggtgtcagagttttaccactttggaccctttaccctcactactttttaaatataattgtcttaagtatttcctccgtatccactgagtaccttatcgtatgacataataacttttgcttcaacttaaagtatgattaaagaacctcatgaggtgaaggacagtctagtcttcttctgttagtctctttttctgtttgaagacatttctttagcccttctttaaaggttggtctgctagtaataaattctttagcttctcttctcctgagaatatcttaatttctccttcatttcttttttttgatagcaaatttattgagtcataattcacataccatgtaactcatacctttaaactgtacaattcagtggtttttagtgtattcacagagttttgaatcataaccacaatctaatgtaataaaattgtaagtctggctttttgcatgtgatagaggggagaaggaaaagcagtctatatcatcttgctctggaactagaagttgatagtcttttcaagtgttttataaatttcaggttcctctctccatccctttatttttatttatttatttattttgagatggagtctcgctctgtcacctaggctggagtgcagtggcacgatcttggcccactgcaagctccgcctcccgggttcacaccattctcctgcctcagcctcccaagtagctgggactacagacacctgccaccacgcccggctaattttttgtatttttagtagagatggggtttcaccgtgttagccaggatggtctcgatctcctaacctcatgatccacccgcctcggcctcccaaagtgctaggattataggtgtgagcctccgcgcccggcccctttctttatttttaaaatgtattttaatttttagttcttaattgtggcaagagatacatacaaatgtatcatcttaagcattgtttaggtgtacaggtcagtgacgttaaggacattgacattgttgtccagctatcaccaccactcatctccagaatgatttcatcttcccaaaatttaacctctgcactcattaagcagtaattgtccattcccctcttttcacaccccctggcaaccaccattctactttctggctgtgaatttgactcttccaggtacctcacgtaagtggaatcctacaatatttttgtgcgtgactgacttctttcccttagcatagtgttctcgcaacgttgtagtaagtgtcagaattcccttgcctgtgaaggctgaataatactccaccgtatgtgtagaccacattttgtttatccattcatccatgatggacacttgggttgtttccacgttttggggactgtgaataatgttgctatgagcatgagtgtgcaaataatctcttggagatagaccctgcttttcattcttttgggtgtatactcagaagtgggattgctgaatgatgtggtaatttatgtttttaattttggggggaactgctatactatctgtccctgtcttttccttacaaacacgtgtggaagactttgaggcatttgacctgtggaacatctcccttcttattttggatgggtgcactcctggtgaagttcagcgtgtccctttgtcctctctctcctgcacattggcagctggatccagtacctttgctggacttggttccgtctctttcgcaggattagaggaagtgctctatgtctgttcacccatctttttgtgagcaggcagctgttgatgctcaatgcccctgttttgggtaaaattgtgtctccccaaaattcatttgttgaagtcttaagctccagcatctcagaacctgcccttatttggagaaatggtctttacagagcttatcaaagcaaaatgaggtcattagggcaggccctaatccagcatgcccagcgtacttccaagaagaggaaatgcggaagcagacacgtgcagagggaggatgggaagatgtggtgactccatataaacataaacacggctgtctcttgcccttcattcttgaacgctttgctggacaggaaatccttgagtgtcttaaataggctactctttttttttctggaggtaatcatggttgtcaaaaagtcttaagggtcagccacagtggctcacccctgtaatgccagcactctcggaagtcaaggcaggaggatcatcggagctcaggagttagagatcagtctgcgcaacatagggagaccctgtctacaaaaaccttacctttcatttctttttctttctttctttctttctttctttctttctttctttctttctttctttcttttttttattttttatttttgagacagtctctctctgccggccaggctggatccagtggcacaatctcggctcactgcaacctccgtctcgcgggctcaagcgattctcctgcctcagcctcacaagtagctgggattacatgcatgcaccaccaagcctggctaatttttgtgtttttagtagagatggggtttcacctataggccaggctggtctcgaactcctgacctcaggtaatctgcccaccttggcctcccaaagtgctgggattacaggtgtgagccactgcaccgggccttaacctttcatttcaaataaaaaggagataacctggaattctgtgtgggctctcagtgtaaagatagaaggacacacagagtgttttgaaacatgcccctccctgatcagcaggtgtcctgctgtgtcacatgtgactgtcagttcccgacccctcggccgagcagaaagggctttggcaaggtgtccggagttggaggtggcctctgggaggtttgctgcccgagggtcctgttgccgccaggactggtgaggagactgaggattgaaggggccaaaagctgacaaaattctgtgcgggggctgagtggcagattcgggtctgaatcatttcctggttcctggaatattcccacttaggtgccgaagccagaattggagggagcgtggcgcctactcatggagcctgccaaggcactgccagctgctcacaggccaggccgggcgggcagagcctcctcgctgcctgctggctttgaaattcatgtttgagacacacattccagccttcactgcttgttcaaggtgatacatgattttcagactggacagcttggcctcttgtctgttcttgtgttttcctttatgtaccaggataatgttaaacccttcccatgatgctgcaaaaaccaaatagtgcagcacacaccccacagcccgaaacaactgcaggtgcgtgtgccagtggttctgaaaggaatacagagacgtgtggtttccgaatccgctgattgttttattatatactgttacagatcatgttattctaaattacaaaataaaacttatgttaatatacatttatacaacgtatatattatacattatatagcatgtagtgatgtatgatgtaatgtatgatatgtactatataataatttataatatattataattattataataaaaatgactggccaggcaccgtggttcatgcttgtcatctcagccctttgggaggccgaggcaggagggttgcttgaggtcaggagtctgagaccagcctggggccacatagtgagaccctgtctttctaaaaaaaaaaaaaaaaatagtaatttgttattattcttcctattactatttttaagggacaattttggaaacatactttactttttctagtgtagcaaagaatttacattttgtcacctgaaagcgtcctggaaaatccatcctagtgtcttgtaattctaacagtcaccaggaaggctactttgagaaaatttcatatggtatgagggaaaacaagaacattctcatttttttttgtcttgctgaattaaaaaaaaaaaataaaagcaacaacaagaaaaaacaaagcccagggctggggttaagtaggtgaaggaggaaagggagtccccacctgccagtctcagtgccgctctttgccatgcacacacccgtatgtgtgcccatgtgtgtgcacacagacaccaccgggtccccttggagttaccaggcaaatgcatgtcatcagctgttgtgccttgatgtctcctaagctacatagaatcccctcagaccacgcctgacacccaggacaccagggcagtaatccgcacgcccatttcactctcaccatgtaaattgcgttttctattttcatttcattttatgtcacttttcttcaacaagtaattattctagggctttataagaacgctgtgctttcttagtctatttataatgagtaagaagttgtttttattctatttcttttctgtctgtgcttgccattttttttaatcacgattggataaggggggatccctgcaagataacagcgcccaccaaattagaatctccctgaaaaacatacagttaatcaggaggaaaatatagttgcccatagtccatgattatagcacaactaggggacaattaatgtagcaaacctctgtttccacccaagaccaggatacagggtttcagggccaggccagagccccgagccatcaggaccgggcacaggagagtgcagcagcggcctggtcccaccctcactcgggagataataagagacatctgaaatgtcactcaggaataaaagagagggtcttggaaagtgcatgggatgggagagtctgctcctgggagatgtttcctggaggtttggtgtgaaagggaagagaagaattagctgaaaataaggaacttagtaaaacaacaaatcatccacaaagaagagctcctctcaggggaggaggaggtggaagaagaggaaaatctctctccttaattaaaaaaactgtactttagagaagtaagagaagagtgcatggctgaaccatgttcctgagcaagccacacagacctctccctccctactgactctactcatcagcttttggggagtctaagtaaattaatataaacccaagcacacctagcgtccatacaatattactgtaagaaaaagaaatagaaaatgtgtagcaaaatgctggacatgaaaacagccaagaagcacaaatgaaatgtaagtaataggcaattgcaaatgtgaaaaaacaccatgagccagctcttcataaaataagactggaaatggataaacaacgggagatatgaaatgagagctaattaaggaaagcaaatgaagaaaagtctaagataatctctgaaattaatagtaaatgataaggttccccaaagggatagtagttacagctgaaagcacagtagggatagaaatgaaagaaatagaaaagatcaaaaccaaagtgtctgttggaaagacatccaatttacctgtaattggtgaccctgaagaactaaaacaaggcaatggaacagaactaaaaatttaaaactgcaagtcaagaaaactttcctaaaataaaattaagacccaaatctacatggaaatatagtccactgccattccgggaatggttgactcaagatttatgctctaggaagactaaattctaaagataaagagaatatcagcagggcctccaggcaaaaggaccaagttatttacaaaggaaatttacagagttgtttacaaagttacaagttatatgcaaagtctggtgtcagacttataacaacaacaaagaaagcaagacagcaatgcacaatacttttaagaaactcaaggaaagaaaacgtgagtgaaggattttatgcccagccaatggttctttaagtgattcagaaacaaaaatattgtgcccaccaggcacacttaaagaatcagctggcattagtgatatgtcagaggctggacggcagaaatggtctgccctggttgcaggcaatgaggagtttcatcatctgtcgataatttaaaaacaataataaaactgactgaaagtccgtctgctttttatgtcactgtgatccaacacttttaaacaatgtcagccaaaaaatactcctcctgaaaaaacctattgttggtctaatttctaagcaatttttcctattacaattgcattttaatgctatgtgtaaacctcaaattagcatatttgcattacttatgctttaataaacattatattctacatggcatttaatttggagaactcccaagtatacgatcagcccctgacatctgcagactgaggcacatgtgtttattttgagaggaagtttgtagcaatccagaatcatgcaaactccattgaggtccggactcctgtgaccctgtgtattcctctgtttggatagcagattaggaataaccagtgatatcacaataggtaaagacaaagaaacagaacttggatttcttcaattctgtcattctatgtgaacactagaggtttttattggtgtgtaaaatttgaagagtaagagcacagatgatgagattggatatttttgtttgattggtgcaacttgtagttgacacatgaaatattttactgaatatgagctgtaccattaggactgaaattcatcttttaaaattgtccatggtttttaaaattacagatccagttaaggaaatagtgattattactggttattatgtgataattactgaaaacactgttgtcacatagaggatgaaggtgttaaaaattagccacattatgtatgccacatagcaggggacaggcttcatccaatgaaaagatgatgtgggaaactttggcgaaggcactgatagtatttttacacttaaacaagtattttaaaatgtttaaaaaaaattgtatatgtatgaccgaaagaaaggtagggataagtatggaggaatggctataaatgttatatattctgacaaaatagaaataatgaataaaaataatagttggagtaggaagagcaaaagaggaacagagaatcagctcattgattgccctgcaggtaggaaagtggtaacattgtttggtatacaagaatgaccactgaaacaaaaatatagaccttaaatacccaaagaaatgcaaaaacaaaacaaaacaacttttaaagaagcaaacaaaccatatagtgaaatacacacggtcaatataacactaaagaatagaactgagaccaaacctagcagccgcatcagtaaattagagtggatttaacccatttattaaaaggcaagactgattttcagattggttcacatagtggcacccaactctatgctgtataaagaagtcatatccaaaacacagtgatccaggaaggctgaaaatgacaggagggtgtatagcaatgaagagagaaaaagagcttgggagttttaatcctgactgcagccaagctagtatcaggccaaaagcattaatggaaacaaagagggccgctgtcaatgctaaaggctgcaatttgcagagaagatacactaggtgtggttatgtctgcttcacataacatcaccagaacctctacgatgcggaaaccacaggggcggtggggagacatgagggacacgcagttccaggacattgtgactgccttgctcagcctgagacatgtgaaggggaccaaaacatacgcctccaaatgtaccagactttgtgctgtgataatagggaatacaactttgtttcgagactacttggaacacttaggaaagttgacatatattagcttacaaagacaacctcaatgagttccgtaacagaaataatacaaacaacattctgtgctcacaatgcaataaaactaaaaattaatcataagattaaaaaccaaaaaggcccttcaatttgaagagttacaagattaaactctattaaataagtttttaggtgaaaggaaatacacaaaccaagtgcataatttttgaatttgacgataattaaaatatatcactctgtggaatacacataaagctgtggttataacctcagaaatgaaaccaaacgaattaatggatttatcatctaactaaaaatgatagataaaaatagccaaataaacttagagtagaatgacaaaaaataagagtaagattggaaattcatgagttttaggaatgagaaaaaaatgaaactgataaatacacaaaatactacatcctagaaaaagaatcaagtggacaaacctctgtctaagctaatcatgaaggggagagagagagaccccaaacaacacagaataagaaatgacattaacagaacagagcatatttaaaaaaatcattaaaagcttactttgtatagtgctttgcaagtaagtgtgaagacctggatagaaagggaacttctttaggaaaatataatttattcagattgaccccagtagacacagaaagttttaaaaaaaaattcctactggaaaaaaattcaaatctatattttcacaggagaattctatcaaatcttcaaagaacagatatctcaatgctacttaaattattctagaacatagaaaaagaaaccttaagattattcaatgagaaaaccacacaccaatctcacttaggaatattgatgtaaaatgcctaagtaaaacagtattagagagaaccctttaaaaatggttttgagacaactggatagccatttggaaaaagataaaattttgtcgatatctttcatcatctacaagcatacatttcaaatgtctctaaataggtagttaccagaaaaactaccacaagaaaacatgggtaaattttaaaataacctgtgggtagggaaaattatgattcaaaatccaaaagcaatgtaaaaaagattgagaaatttggttgcattaggaaaaaaacaaaacaaaactgctttcgcatgatgggggagggacaccataagcaaagtgaaaaagccaggtaataaaccagtagaaaatatttgcatcttatatcacaaagctaattccttcaaaatatagattataacaagataccatttctcatgggccatattggcagagaggaaaaaactcaaaacaaaacaatacaagtttgatggcgccctctattggcgaggctgtggagcagccattcagattgctccacccctggaggaaacaggatgccttgggacttggtgcacctgcatagaccctgactcagccatgcctccttcctgaatttacctggaagacaatactccaaatccaaacatgctcatggcatatggagatcttaaattaataggtcctcttttatgtctttcaataaagtaacagatatgtttctatagaggtcttccatttttacattaaattgattcccaggtatgaaattttggctactgtcccagtggcagccctctggaaatgacctttgttgagtttgtgttttgacctggtatccagcaaccttgcttaacagtctgaagagcagcttggggcttttctctatggacagtatgtctcctgcatgtaatgacagttggctttcattcatccattgcaatcttcatcctttaatttctttttgttttcttacttctgtggttgggagtgacagaacagtgttaagcagaagcagttatactgcaaattcttgtcttattccttcttgtagggccatctctaatggtccaccatgaggtgtggagtttgctgtggacttgtggtagatcctcactttgttaaggaagtctccttctggtcctaatttgctaggagttttttctccctttaattgtgaatgcatgttgaactttatgaaatggtttttgggcatcaattgagatgatctgttaatgtgatgaattatgtgattgcgacaatagcttttctaatattacaccaagttgacatgcctgggataaacctgtatttcatcatgatatgtctcttaaaaattgctgggttcacttggctaatactttatttaggatgttttttcacctgtttataaatgagtttggcctataatttacctttcttattctgcctttcattggttttagtgtggagattatattagacccataacattcagcatctcatccttttctcttttggagagcaattaatataagactgaggtgatatgttcctcaatggtattgttaaaacttacctgtgacaccttctggttccagtgcattactagtggccagatttcaagtgactaattaaatttccttaacatttaaagtctattcacaatgaggaaataaaccttacctcatcagttggcttccttcaacactaccatttttcttctttcttgtgagtatgtgagccttagttcaggctgctataacaaaaatatcatagattagtttagagaacacacattcattcctcacagttctgaaggctgggaagtctaacgtcaaggggctggtgattcctggtgagggccctctgcttggtttgcagatggctgccttcttcctgtgctctcacatcggggagagagagagcatctctctcgtgacttttcttctcattcccattcatgagggcctaatttcttcccaaaggccccacattataatagcatcacattaaggattaggcttcaacctctgaatttgggaggagcacattcagcccttagcagaaccccacccccaagattttcctaagtgaatgaatagtcatcccccagccttgttcctggcctctaacagcattttagaaggaggtttctcatgactggggttggctgagatgggaatttcctgattccattggctgtgattcagccccatgccatcctgccagtaagatgaacacatgagtcatgctcagctgctagggtgcctggtgctgcttccagttcctctgggtgacctctgtccagcacataaacctcctgaagcattccgaatttgcggaaagtgagccaccctcccaatgtgtacatgtctgggcctaccttcctgctctcgtatgtgacaggcacacagcctttccagaaggtacctcattgcctagtacagaaatgctgaggttctcacaggagtgagaaccctactgactggctgttgtgtctctcccatacagtcgggtgtggagcagttggacccacatacctatctgcgcccatcctcagttgaaaggtagtgaacagcttgggctgtggactcaggcaggcctcggttcaaatcccagctctgccactcaggggctgtgtgtgcagataggctgcatctattgtccaaagccaaacatggggaaaaccaaacaatctctcaaaggggtgtggtgagggcttaggcaaaagactggtgtaccgtggctcggatggattagtttccattctccctctctctgtttccagctttcctctcactacaagatgagggccctgtccctcttgggcgtttgccaaaggaaggtctggacacccagcagctcattcatgtcgcttcccagtttgctgttaccatgttgcagtgcagaagccataagccgcatgatccgtgagcctggccctgcaacttggctcctccacacagcagcgtttgccttcattgtcacagatgactatgagaagatgcccttggtcatctttggtctgggctctggagttctgtagagctttgagccgccagagctaagggggtgaggcttgccccaggccggtggcacacccaggactgggcctggatgactttaatggtaggacagaaggaagagaaaggagctccccagagtccagctgctgggctgtgcagcccatttgcagtgtacttccaggagccttgatggtgaatgctgtaaaagggggaatctttcttccccacctttctttaaatcatagagctattgtgatggcttctgagctgcaatagaatcacccatgaggatttttgtttgttgtcttggcatgaagttcctgtcccttcacagtaatccggcaggtgcctcccagggcatggagtcattgtgtcacattcttctccaggactgcaggagggtgggcacagagttccacaacttgaaatgcagcagacagttgaaaggattctgctcacaccaggagttggattgtatttttccaaatgcattaagtattttaagcagcttgagctgcttaatgggcctgaaagcatttgattagtccaaagggctctatgcccggcaggtcaggggacaagaagttcttaaaatcctatgggtctgaccccttctgctctctctggctatctggctacaacgggtccccagggttgcagcaatagctgtgacctgcttatcttcccagaagtgctggaggcaagctgatccctgagcactgtgcctggagcactgcaggtgccctgcagccatctccatccacaccccctgcctggcctgccccgattccaggctgggcctcgggctcccctcccttcttcgtccccctcctcatctatctgtggctctttctctcgggccctaccaccaagccctctccttgccattctcttctgtccctcaagccgtattcctcagcatcacatggtcctcccgggtcccggtccactcctgtcatgtgagaacaaatggtgtctgctggaatttgcttcgggcctctgttgtgttttgagccaatgtgtgtggtcctcctaacgtcatttgattcatccggcaaaaggctctgctgcctgcctgtctggggcagagcttctaagaccctgtcagttttggacaatgaggcttccctgggggtgcagagtggtgaagctgtttggaatccttctcttgaggtggagtccagagtttcttcctgtcagttcctccccatttgtgtcagcagggtgctatgtccagcgcaggtcctcccctggcccctttctggccttgcagagtgcccccggccccgtgtgagcagatggccttctgggcggagcgtgcagtctcttggcagggcagccaagttgggggtgagatggacctagggctctctgaccccgtaggtttggcctaggctgagactctgagcaggtcacttacctctgggtcctcatgctcaggttcaaaatgagacagacagtggagttaagagatgatttttctgatccttctttgggtctttgcatcagttattttaaaaaaagagaaaagcaagccaacacaaccatcctcggctgattggtggagcagggcttacttatgtggctagttaaaagaaaatttatttttgaaagctgcatggagattttccgtaagcacagtaatgtgagccggggtcaaagctgtctttcagagacagggaagtgcagagatgttcaatgtaaattgtgccttttagctaaacacttggtagattcagcactggccgtgtaggtttgtcctgcttgttttgggggaaccagaaaagatctgattgaatttaatctgatttctgctagagtttggtcatgtaagatttgaaaaagtgaaccttcctgagccagagcaatcaggcaacaaagaaataaaaggcatccaaataagaaaagaagccaaactgtctgtcttcactgatgttatgattctatacatagaaaaccctaaagactttgccaaaaggctcctgtaactgataaacaacttcaataaagtttcaagatacaacatcaatgtagaaaagtcagtagcatttctctacaccaataatgttcaagctgagagccaaatcaggaacacaatcccatttacaatcgccacacacaaaaatacttaggactacagcgaaccaaggaggtgaaagaaatcagagatgacacaaacaaatggaaaaacattctatcctcatggattgaaagaatcaatattgttaaaatgaccatactgcccaaagcaattgacagattcagtgctcttcctatcaaactgccaaggccatttttcacagagctagaaaaaactattccaaaattaatatggaaccaaaacagagccagatagccaaagcaatctgagcaaaaagaaaagccagaggcaccaattaccaaacttcaaactatactacgaggctgcagtaaccaaaacagcatgggactgatacagaagcagacacacagagcagtggaaccgagtagagaacccagaaataaagccacacacctacaaccatctgccctttgacaaagctgccaaaaataagccatggggagaggactccctattcagtaaatggtgctgggatagctggctagccttatgcagaagaatgaaactggatccctaccttttaccatgtaaaaaatcaactcagttggattaaagattcaacctatgagaatcctagaagaaaacctagagaaacatcattctggatattggccttgggaaagaatttatgactaagtcctcaaaagcaattgcaacaaaaacaaaaatcaacaagtggaacctaattaactaaagagcttctgcacagcaaaagagtaaacagacaacctacagaatgggagaaaatacaaactatgcatccaacaaaagtctaatatcacaactctacaaggagcttaaacaattgaacaagcaagaaccaaataacctcgttaaaaattgggcaaaggacatgaacagacacttctcaaaagaaaacaggtaagaagccaacaagcatatgaaaaaatgctcaacatcactaatcatcagaagaatgcaaatcagtaccacagtgagataccatctcacatcagtcagaatggctatttttcaaaagcaaaaaaaataacagttgctggcaaggctctgaggaaaagggaactcttacacactattggtaggaatgtaaattattcagccaccttggaaagcagtttggagatttctcaaaggacttaaaacagaactacatttgacccagcaatcccattcctcagtatatttccaaaagaaaataaatcactctaccaaaaagacacatgcacttgtatgttcatcactgtggtattcacaagggcaaagacacataatcagtctaggtgcccatcagcagtggactagataaagaaattatggtacatatacaccatggaatactatggagccataaaaaagaacaaagtcatgtcctttacagcaacatagatgcagctggaggccattatcctaagcaaattaacacagaaacagaaaaccgaataccacatgttctcacttataagtgggagtcaaacattaggtactcataaagatggcaacagtagacaccaaggactactagagggcagagggtgacagcggggcaagggttgaaaactaactgttgggtactgtgcttgttacctggatgacgggattaatcataccccaaagcttagcatcacacaatatacccaggtaacaaacctgcacgtggactccctgaatgtaaaataaaggttgaaattagtcaaaaaataaggaaaagtgggccttccccgccccccacacttataaagagttaaggattttgtgtttattttaagccatgttgaactcagcccaacatattgacacaaggcaggacttagtgcagtgtcactaggctttaattttgttgccctttgggctaataaagtcaggttatctcactgggctgtttccttatccattaagacatttgatgtaactaagtacccatcctatggtgacataaactttttcttatgtcattggaaagtccagaatacctggttgcaggcaaggtttgatctagcagcttgaccttgttagcacaggtccagtttctttccctcagtcctccctggtattttatcagcttcatcctaaggctggttcagggaagatattctgatgatatatatttctgctttggcaatggaggatttatattcgattgtcagaagtcctcatgtcctatttaaagtctagtcattggaaaataggttgataaggatggacctgaagaaaataaagcagcaatttgtcatgacaaagcaagactaggaagaggcattggaccagcatgaccaattcaaggacacgttgatgatgtcttcagcgcaagtgttcttcccaagcttgggggacctggcagggctgcctacagggctggtgtccagcctgctctatagaaggcgaattagagatcgcaataacgggccagcttccatgatgaccccaggttgtagtgatgtctatgtagaaatgaaataaatgcataattaaaaccaaaggtaggcttgcatttgggttgaggtcctggcacctacggaggccacaagtgtgtcagggtggaaggtaacttggtgaaataggaagtcactgcctattgcccactcatgtccccactgatggagttagctgggggatcccctggtgcagaccctggagaggcatcactgtcttccttgttcagtgggcttgggtcacctgcatgaattctgaggttgggaaggtgtaaacatttccctcaacacctgcagcccagccgccgtctccctgggtgcttcagtcagccgtcacgttggggaggcgtcatgtaaggtggtccttgtctgagtagaacctgattttgaaaatgaaattcatttccttgccttcattttccagacgaaaagatatgtatttgtggtgtgtgtgtggcgggagagtaattggctttggttttgacaaggaggacaccagagtcctgttctgatactcagttttgggcccatgcgtgacaattctgtgtttcttttcagcatttgccaatacattattttctagagtctctcccagcatacggaaaaaccccaaattcaaatttgacttttctcttcgaggctggttgtggcatgctgaagctcccaaggcatgtaatgtagtgaacaaggtggcctccaggagcgctgtcggctcatgggccccacccacccacctcgcggtgtaggaggatccaccaagtcactgtcagagtgggttggagagacctggcctggggtcagctctgtgggcagatgggccctttcccccactgggtggagtacgctccttagtagcccaagacagaacattgccttctcccgagaaacccacctctggggaaggttaggccatgggatctgcgggaagggttttaggagtagattaatgggatttgtgatcccaagcacccaggccactctgtggtccccacccctgggcttgagtcctgctgaggtataagtggtgctagaagacctctgccctgccctgccctgccctgccccaggaacctggctttctctgggctaatgagtgtcctctctgaaggtatccagaggccgtgcagacactcacactttggtgtgaggcgtgccctcggttgatcagttacactgctgtggggtgcacaggtggcaaggtgggggattctgggatcggggaggctagtctgggtgtagggtcctgccctggaggggctcacagtggggttgaaagcaagctctcgaggcgttattattcgggactctgagtgccgggccatgctgggggagtgagggcagggggagctgcggaggcagggctctgagggctttagaacaagagccggtgtgtgtttcccactgagtacctgccggcacctcatttatgccacgtagcaaccccatgacataggcttataggggactataattatccccatttcacagctgggagaacctaggcttagtgtcacagaacctaggcttagccactgggtggctgatactgccacccagttctgagccagtatcagcttccagccccctgactcagtctctctgctgtggtttcctctcaagtgccaggatccttcctggtcccgtttccaactcagaccagtggaggggcgcgctgtggttaccactcattagaagagaggcagggtctctctgtctctctctgggtgtcccccactgccatctctgggtgctgggggagctgctgtatatctctctctgtctatccctatctctccctccactgccatctctgggggttgggagagctgctctgtctctctatctctctccccccccaccccactgccatctctggagtttgggggagctgctcgctctctctcccccctcccactgccatctctggaggttgggggagctgctctatctctctctctctctctctctctccccccactgccatctctgggggttggggggagctgctctctctctctctctctctctctccctctctccccctccgccaaccactgccgtctctggaggttgggggagctgcctgggatgcagagcggcttggattggtgctccctctgcctcagtggttgagctgacctctgtccagtctgtacacattggatcctgaggctgagcttgggtggctgtggcaggaaggtttggtgacatcacacccttcaggcttgtgtctgtctgagccaggctctgactggctgggagaagaggaggaggtggggttctgggaggccctgaggctgagcacggctgctgtgctctgtggctgcactgcaggggcacgggctcagcatgttctgggccagggcacacaatgctttcagatcaggctccagcaccccacacgccccttcatgctttgcactttttgtctaccagccagagggcagtgaataatgagaacaaacaacatcgggtccagattttcgtggtcattttcctaacaagccgaggtcagagagcactgaaaggaggcctaagtgcttctgccacctcagctgactgtttttcaaaaaggaaagcatgcgtgggatgtgtgtattaggtgttacggtgatgtctgttgtcagatcatggccagaaaaggggttgtttcaattaaaatggattttggacttcgtttttcttggaatgagtaaattgagggaaatagcacatgttgagattttggatttctgctcttagaaaggatttaaaataagtggtcttcagtagttccacagcggatcttcgagactggtacagatggggtctcctggatgtaacgagttcttgctgctttaactggatccggttgactctgtctgaccagctcagctggttcgttctatgaaacgcacttctgctttctggaatctgaaggaaggagagagatagaagacaaagaaggacagatgtgttggtggccagaccctggcttctgaacagtccttcctgatggcttcaggacctgggaggagcggcggagcaggtggctgccctgggcttgccagacacctccattccagcaagatcctcctgggggatgtggtgccctccctgcctctcaggcacaagcatatgcttgtttggcctaaaaaagtctccttaattaaaattaatatcgtaatgcagtaaatccttctgcctcctcttcccctgcccagttacaattcccggcggctctccagcccatagaggaggcttctcaaagtttcctgcctcctggaggagagaagccattccccgatcacccaaaaggacaaagtatgtgcccactctgcgtccttgcttgtcactgcccaacatctgcaaacattaactaaagtgctgagcccattcaggtgtaggactcactagttggttaatgtgacagacagcgtttcctgtgccagcgctggctggtcacttcctgtcatccagcactcttgagtgttgcagtggatgcctgtttcgtaggaacactcagcctgttccgtaagaaggagcgccacttctcagcctgtacttagcaggtcactactgttggccactctgcttttctttttaaaattttaattattaaaaaaattttttttgagagtttccctctgttgtccaagctgaagtgcagtggtatgatcttggctcactgtcacctctgcctccctagtagctgggattacaggtgtgtgccaccacgcctggctaatttttgtatttttagtagagacggggtttcaccatgttggccaggctggtcttgaactcctgacctcaggtgatctgcctgccttggcctcccagagtgttcggattacaggcatgagctactgctcctggtccccttcttatttttatgttagtctttggaaacaattggcatatattttagtctgtttaggttactgtaacaaaataccataaactaggtggtttacaaacaacagacatttatttctcacagttctggatgtgggaagtctaagatcaaggcgccaacagatttgctgtctggtgagggcttcctggttcatagaaggccatcttctcactacatcctcacttggtggaaggctcaggagagttctctggagtctcttttacaaaggcacaaatcccattaatcacctcccaaaggcccactgtctaatagcatcactttgggcattaggttttaacatgtgaatttggagaagggcaggcacaaacattcagtctgtagcagcatacaaaaatgtaacaagaataatgtgatgaacagctaggtatccacaagctgctaaaggtagagaatactaccatattggttacctatttctgtgtaacatattatgccaacacttagtggtataaaacagtaaacatttattatctcacacatagtctgtgggccaggaatatggaagcagctgagctgggtggttctagtggaggggaaagatgtgagctggggcacctgaaggcttgactggggcaggaggatccacgtccaagatcgacttcacctggctgttggctggcaagagggctcagttctttgccatatagacctttccacagagctgcttgagtgtcctcacaacatggcaggcggattcccccagcctcagtgattcaagagagagtatagagagagtagagaggaagccgctgtgccttttatgacctggtctcattagtcatacactgtcatttctgcttatgtctgttcactagaagcaagtcactaaattcaggccacactcaaagagaaaggaattaggttccactctttgaagggagtgtcaaagaatatgtggagagagatatatatatatatatatatatattcttttttttttttttttgagatggagtctcaccactctgtcacccaggctggagtgcagtgatgtgatctcagctcaccgcaacctccgcctgccaggttcaagtgattcttctgcctcagcctcccaagtagctggaatttacaggcacacaccaccacacctggctaatttgggtatttttaataaggcagggtttcactatgttggccaggctggtctcgaattcctgacctcaagtggtctgcccgcctcagcctcccaaagtgctgggattacaggcatgagccaccatgcccagcctgtggatgtattttaaagcatcataacaccattgcagctagagcccctccccagttgcatcttgtctttcacacagaggtaactactgttgaagtttgatccttgtttatggcctagtacatgtataagtatttctatccctgttagttctgcattttgtctgtaagcgttatgtaaatgatatcaccttgtatttttttctgtagtgtgcctttttttttttttgagatggagtcttgctctgttgcccaggctggagtgcagtggcgtgatctcggctcacggcaagctccacctcctgggttcaagcgattctcctacctcagcttcccgagtagctgggattacaggcgcccgccactgcacacagctaatttttgtatttttggtagagacgaggtttcgccatgttggccaggctggtctcgaactcctggcctcaagtgatccgcctaccttggcctcccaaaatgctaggattgcaggcctgagccaccgcgcccatccagtgtgccttttttgcttaacattatgtttgtgagattcatccatgtgaaaacaggtggctgtatttcatgcattttcactgctgtgtggtattgcattgtacaaacataagactatttgtcgttctccattgatggatgcttagttgggttcctgtgacttgctgctacaaacaaggttgtcttgagtactcaggtatgtgtctctctgtgaacgtgagctggatttgtcagtatatttagcaaggattggaattgctatgggagagagtacagtaatcttcaaacgtactagaaacagctaaattttattccaaagtgtgtgggtgtcctcatgagtggtcccactgacagcgtatgagtttcctcttctcctttttcttgacagcacttggtgttgtcagacattttacatttttgtctaatgcgtgaaagtgctgtctacatgaggtattaatttgcatttccctgcgtgccagtgaggctaacatctttccatgtatctattttcacatatatattttttcatatatttggtattctgtgaatgactggccatatcttttgcacctttttttctgttttcttattgatcaatctgatccgttgttgagtttatgtaccataaatatcttttttcttttcttccttctaacataatgtagaagctaagagtgtggattctggggccacattgccagggttaaatcccagcttcaacacttcctgtgtggccttaggcttagtctgtgtatgcctcagtgtcctcatctgcaaaatgggatgatggctccccacggtgggcctgggaggatgcgcaggttcgtatctgtgaatcagttagtgcctgtcatagtaagcacaagatagactaatgcaacctagtgtgctgggccctgtgtggccacacggggctgtatgcacaggcgtcaccatggccagagctggagctcagatgtgtctgagaagattggcagatgctgcttcactctggctcccggtctcctgggtggccctgcttccatccctgagctgcctgaacggaaaacgaaatcccatccccgctccagggggtgcctgggaattggaaggcatcaggctcctcacagcaaaaatagaagcctcatttgcttaggagagaacaatgacgaggaggcaagccagcagaggcggccttggcgggctgtgtacaccctctgcttgtctccgcactccctggggtcagacgtagacgtggctaagctgcctgcagaccttctcttccccttcatcctggcctgcagtgggcatcagggtccatcctgggacgtgggctgtcttggcaccaagttccagttcttaatacctcagtgtcacactgttccctgatttctcaaagccaggaaggaattgcagaaaacaaggtcagtttagtatcgagaatcactggagagccgtgtcagagccctgctgagaagggcgcggggaactgtgttcctgtctacctgatgctgtgggctgcacaaggacggacttactgaagattacaggccagggggaagagggcacgtttagtgtcaaccctacacagaagaagttagctccgctgggcgcggtgggcactttgggaggctgaggcgggtggatcacctgaggtcaggagttcaagaccagcctggccaacgtggcgaaactgcgtctttactaaaaatacaaaaattaacctgttgtggtggcatatgcctgtaatcccagctactcgggaggctgaggcgggagaattgcttgaacccggggtgggagaggttgcagtgagctgcactccagcctgggcaacggaaactccgtcttaaaaaaaaaaaaaaaaaagaacaagtcagctcagccccactgcaaggagctcctgggtttatttaagtgagcctcagataactttacataaaagcaaatgtgtaaaaagcgataaagtcagatatattgaacatttgtcctgagggcaaatttctgagctctaaaagccagtttggttttagataacatctgtgagtctggaaacaggctgagatactctatatctgcactcccaactctgcctttggctttgtgagccctgtggtctccttgaaagaattggtccccagtgggtgaactaatcacccatgaagagtctcccaattcaaatctggaataaaaagtgaggacatgggggcagaatgttactcatcacatgtggcccgtcagtactagacttcaaggtaagtttccaagaacagagctctgtgaccattttcatgatagcaatttgtacattattactaagtaattttaatgccgtgtttacaggccaccttcccaaacaaaacaattgtttctggaagttagactcttgaagacttaacttttaatccagtttgttctcaaaacatttgcacaaatgagagtcttgaggtttgagctttctattctaaaggctcagcttcttgcccaggagaaaaataatacatgctcgtgtttataaataagagttatggcattggagtcctttacattgcagccagcctagggactcagttattcagaatttaaacattttacttgtaaagagcactttggtatccaccccaagggccctcctctgcctgtctcagcaccatctctgtgtgtcccatcaggaagcaacagacaactccctaagccccacagtaaaaacgtctctcctggtctgggggcgcatccatcccccatgtccccagtcccatcctgggtgttctgggattccagccacagctgtggggacaccgccatctcactgcatccctcttgctcttgcggcagcttggctgagctacagggccgggccgcaggaggcgtccttgtgccggagctcaccttgtgccggagctcaccttgtgccaggtgttgagctctgccagctgcccggccccactgtgaggccgccccttgcaggtgagttcactggcagcccagccagcccacgaaggccatgtgagtgtgaacccccattacaagctttccctcatgagatggcgctgatcagtctgggggatacctgcctttcagtatgggctgcagccattaggctggtaccaggaggagccaggtcgagctggcactggggcgacgctctgtctttgatgcaccctgatgcctcccccatcctgctgaccatggtgctcagcacagaccccttccaacccatcccagggcctctgctcagtgtggccagagcctcctgtcaacaagtatgtcactgccttcgggttattattgttcaccagattccacttgctctacaacccaggcacagtgcaccagagtttcccaaacctgtgtgccgagtgccagccccttagcaagtgcagcgttgcccatttcactctgggaaatgcagccatagctctggggccagctagaggaaggagtgtgattgtgccttcccgggacagcttccaggtctgggagtctgtgatgttgtgagtgttgccttagctttgctaagaaaatgcttagggagatgggttccttcacccattcttccactcatgtgcctttctggctccagggctggtgtcccctgctttggaggggacgctcacatgagctgccctattggggttccgtcaagtttctcttagcctaagcggcttcctgtctcgggctccctccccagccatttgggtcaccttgggtccctgaggatcgcttctggatcttggaccccctcaccaactcctgtgacataataatcaaaggtaatcaggaaatgtatgaatcgtcttctttaaggaatatttagcatttctgctcattccagagtccctggaagcatggcatttcaaaggcttggttagatcacaagtccaatttactgccagaaatttgcacgtagaataatacagagcctatgatggcagttgaagtggtatcctgtgagaaaattaattagtcctgaaactaaatgccgacagcctcagcaaaatattcatgagagaagcaaacctcgtgcgtggtgtttgaagtcaggcagctgaggctgtgtactggacgtgttctctgtggctgagttctgctgtggattctgggctagtctaggcaaggcctgcctctccttctggactggctcccagggctgggggctcaggaaggccctgcaccctggagaagaagggagcccctgagactctttggccttgtatttgtgtgtccctctgggctgcagggctgcagaataaaccagctcccaatcctccaaacaaaaataaagacctgtgaatggctacacttggagagcagagtgttttgatatcatggggagacctgtgtacttaatttacggcctgaagattgagaaggatttaattgttccaaaaatggtgagaaaagagcaggtcccagcctttctgtctgatcacaaacagccgagggggactggggaagtggcctggtcctcactgcccctggaggggcaggaagaggatggagtgatgtgcttggcagatgcaggaatggccaggcagtgggaaaagcctagggtttccaagccatgtctgatcctctgtgttccttctgcctgctgggatggagcccgccccccaaatatgcctggctcacttacgactcagagtcagctgcccccagggacttcccggctctcgtgaccttgctgggcatgactttcaggggagccctctgtccaggagacataggtcactcgaatcacacagccgtgctttagtgaatgctagccaggggccctggagagggcaaggacaggacactcctgcatggaaacgaaaatgaatatttttctctgcagaaaatgaaaagtggtgctgggtccaagtggtaggtgacctggcttttgagcgaaaatgctgctgggaaatgagagaaaagaaacatgaaaagaatgcaaatgagggtggtggacaggggcccagaggcctgattcctccaccctccgcaaaggctgggtgtgtgatgcctataaatagacactcaaaacccgttctaaatggagtgaagacatgggcctgcttcctcttatggaaaggccttacataaggtgcagtgctgctattgctcctgggcggtgtgatgattctgtgcctttgtcggaagtcagtgtgaagcctgtggggcttctgggggatgcacatggatgagctctgggctttctggagactcgcagactctgggaaggaggcggtgggcgatgggcaggtctcctagggctgggaaacagtcctgagacaggctccgggtttcctgaggcgcttctgggccaggagcaagtgggaaaagctggactgcagggcttggtcaagtgacagctgcccagagccggagtttagggtgcctggagaggacaggggctggcaggcctgactttctcactgatccacttggggtcacagagccaacctgtaacagagtgaggaactgaggccgcattgctggactcccagtggaggattcttgctgctggactaacctttagttcatgaactcacccagaaattacttatttttggaggaccgcagatggcgagcttaggagtgaagaagggaatactatttgatgctaatgtgattccaggcaacattctagaggttcccttgcaattcaccttcccagccacctttgaagtagttattggccagttttatacacgatgaaactgacagagatggtgtgaagggattttctgacgttcacacaggaagcaagcagcccatgctgactccactgcggaaagcgtgtgtgtgattgacatgctttttgtgtggtgctcactttgggtgtgataaagaggcctccttgcaaagggccaggatctgtgaagcaccatgttgcttcacagaacaggccgtgaaaagccacagaagcaccatagcctgggaaagaaatggaacaacggtgcaaacagccagtttcccctgagcagaggcaagcaggttacggctctgcagctcccttaacgggtagcttgttcaacatggaaacatctttagcctcctcagagacgttgggtcatctcctttacatggggaccagaagtatcttccctgggccattttgggtggaggaaatttcgtaattataaccctctgctaggggtgtctacctaggaagtgagagcaactggccgctttcttagagaagtgaagacgctgagtagactaaacctttgtgatgaagtcgaagccactgtgttgcctgtgtcctgtttccttccccagtgaatggggctcttccctacgactgcagaccccaggaccagattgcaggtgccctgtccagcagcgcagccattcgtgaagggctcgcagcctggcccggctcaacagctgatgcccccgggaggaggctgtattactatcctttttgaaaggaacacagaaagccctttgtaactttgtctgtagccaacatggagggagaggcagaattcagatgtgatgttgcagacaattgaacacccctcctcctgttccaccccagcttcctgcccgtagccttctaatgcccttgccctgaattcctgatccaacccaagggcctggccttgaaacccccgagcctgctggcagtagcttcctcttcagccttcctgtgcagagcttcctctattcagggaagtctgagacctggtggcctctttctcattcttttcatgaaaccatcttgcccaggagaaggtgggctgagaccctgggcattggaaaggagaggtggtcctccttcctctcttcactttcatcgcagtcctctccccgcccacccccatatgcacaccctccgcagtctgaaagtgtcgtgaagcaccagctctgcaaacccgtggggtcaagctttgttgtgggaaaatacatattcatgagggctttgaggagcctcattaaaatgcagagagtctctcctttcagaatggtacataagccatctctttatttgcccaacacattgttcttaaggcaataattatgcgatgaatggctaaagaaacattttaattatttgtttagggtaatttctgattatctcattagaattataatctgtccacttttacaggtgattcaaagcctcatatttacatttttatacttgaaggagctctatgtgcgcacctgtatcattgctgaagtgaaagtaattttctctgttttcttctgctttattccagaaagatttgatcaccaggagatttttcgggacattaccaaaccactcattttaggtaagaaatacaaggcagcgttgcatggaatgaggttttgcttttgccatgtggggagcggaccgtttcactggagggaaaatgctacattgcaggcagagctggcaactgccgtggctctttgttttctgggatcctgtgtgtgtgagcttggggagtttgaagctggggtttgagtcacagccaaggagtggatggacactggggacgcttctggcacttaccttgcccggaaccgacctgcccaccacccaatgacaacacagcaagacacgcactccccatctgtcctctcctcattatactggtgtttctgtaaaccatggtcctcaccagactcagtcattgatttgtgtaacccctacctaggttcctagttacagcgaaagtagacacatgtatatcggcaataataggtagcactcgaacctttcactctccagtgtgggcagtggctggtctactttgagaagggaccagccattgtgagataccaggaagctgagcagaagaaatctaactttgataaaaagaggcctcctcatcttgccagggatggagcgtggtccatcctccctccctgtgcatggagcagtattgcagccctgaagacactgccccatggtcagcatctggcttgcccttgccctgtaggactggtaggaacagagccctggtgccagccgagtgttccacacaggggagacttgcaagggacaggttctgcactgcagatgaattggctgtcttcttctgtggctggagacacacaaggcagcggctttgtagggaaactggtgtacagggtggggcgtgtttggagaacgaggagcagagggcattgttgctggagttaaagaagcagagccagggatggtcttcatgtcctgatgcccagagcaggcctgagcttctgatggattctgggggttcttatgtattcttgggaaggagcatgtggtaagcttggacagggaggcagttcagagtgttacatgcaaggcagcggtggccttgggaacaccccccctgcctgaccaaggcaaggaacactttgtgtgtcccagtgtggaatctctgtgccagttgtgaggggacggatgaagaccagcaggggtgaggacgggattctggagtgtcaagactcaggttcagaatcacagtttttcttccagggcagcacaaggccacaagtgtggctatttgaagccacccaaaaagccattatttgtaaagcaaggcagctttattgatttcactttctgccctgcatctttcccacattgtggtaaccactcaccatccctgttctgctgatgaggcaggaattcccttgcatccagttggggagcattcttgtcacaaatgtcctggatgaattacacggtggctctccgtggagggagcacattcacaaggcatttaagagatgcaggacaatcagccctcgtccatgaaacagggtgaaacgtagaagagctgcgtgattattaatgggtttggacataagctggagtgtttactgaaatttttctcagttgtcagttttcaaagtttgtgaatgtacttttgtgctctcaacaggccttttctgctctatttaactttctacttagggttgtaaacatacttcagccgtaatgacattagatacatcatccactctcagctctgaaaatgctggagattttgattatcaccagcagtaaggacagcttatgaagggagatgttacttatggagacacagctcatgattccataaaattccagtcttctgggagcccagggttaagcagctgcctcagcccatccaccctctagggactgtccacggtgaaattggcttcttgacgttttccttatggaacctggggtgtcattacattctgttagagtcatagggtggttctatttatgcctgtaaggtataaggtatttttttcttctgagtctagaaaagacctactggaatttttatgtatcctgaaatactattagacgatcaaaatcaattgcaatagagaaggtgctgggctctcttcccaattgctctcacccatctgcagtgtaataggcctatcatgtaagtgaatatactcatcacaattctctgcagcttcccagcagaaaagcatattccttctcagagagaaaggcggcaaggagatggatatttttaaatgccaattatgccagaatgagtctctgtgaggagatctgtaaagagaagaaagggccggggtttatttatttttctgctgcgaatggaatcattctgtagcttcagaatactaatccctgtgatgtgcctgatgtcttttcataggataatttgtgaatgtgcttccacttacaggaaaagtttgaggctcttttcttattcttctttttcttttttttttttttttgagaattaaattctaggcctcactatatcctatgataaccgtcctataggccctcgatctataaaatgtgtgcataatgaaatatataaaatcagcgattatcctgaaggaacacagaaaagattaataagctgtatttaaatcacggcaagtctcagaacatatattaagttagaagacatcacgtcctgaaaatgacgggctgatgtgatactagcatgtacccccgtatggatgcatataaatgctgtgtaaaacctagcccaaagtgttctttaaaacctaagatccaaagaaaggcatggaaattccaagctatgagacatgaagagaaaacacaaagccagagcactaagggaggaggccatgagacccccaagcagtgaggttcctgatggagagccaggatgatgaagactgtgtgacatttgtgcagggagagacacggcaatggctgggacagggtagcaaggctaggagcaagtgctcatatgtataggaagccaggaggtggcagacgtgtgttatggaccaggtgggatgtgatgcaggacagctggttggccacataggaaaagagaaaagataaagtgagatccctacctcacagcacatgtaccagtaaacggccatagaattaaaggcctatgccgggcacggtggttcacacctgtaatcccagcattttgggaggccgaggtgggcagatcacctgaggtcgggagttcgagacgagcctggccaacatggcaaaaccccatctctactaaaaatataaaaaattagctgggtgtggtggcggacatctataatcccagctactcgggaggctgaggcaggagaattgcttgaacctggggggcggaggttgcagtgagcgagatcatgccactgcactccagcctgggtgacagaatgagactccatctcaaaaaaaaagaaaaaaaaaaaggccaaaatgtaaagacaaaaatgttaaaatacatagaagattttttctatctgctcttgaggtgggaaacatacacacatcataaaagaaaagatggattaatcaaacatcagtattagcaacttctttaagagaactacaggctggaataaatattcatgatgaatttactgtgagagatttgtattctgtttgtatcaagaactctttcaaattaattttaaaaagacaatagaattgaaaaatgagcaaatactatgaagaagaaaaaatgaaaatgtcaaatagacaaatgaactctgccttgctcctaatctgggaactgcctgggagaccatgagatgttggcaaattagaaagtctgataatcgaagggttgcccagagtgtgaagcaagggggccttcatgtcctgtttatcaagggcaagttagtaaacccctttagagaacaattaggtgttatctagtaaggttgaaatgtggatcccccatgacccagcaattctgctcatgaaagggattcagtgttgtattagtcagttctctcaaaaacagaaccaataggatcagtttatcttagagtttatgtatcgatcaatcgattgattggtcaattgatataaggtattggcttgcatgatatggcatctgggaagtctcacaatctgccatctgcaagctggagacccagggaagccagtattgtagtgcaaaggcctggaaagcagagaactggtgcagattccagtccaggccgaaaggcctgagaaccagcagcatggagggcagagaagaccaatgtcccagtcaagcagtcaggcagagagtgaattcaaccctcctctgctgttttgttctatgcaggtcctcactggagtggacgatgcccacctacactgaggagggccgtctgctttactcagtctgccaattccaatggtaaccgcttccagaaacacctcacagactatccagaaacagtgtttaaccagacgcatgggcaccttgtggcccagtcaggttgatacataaaattaaccatcacaagtgggtcacaaccagcgttttctaaaaatatgaaccagattagaacagaagatatcagagtttgttctgcatagtgaatgatagtgatcctgagaagggggactttgaggggatgggactgacagcgatggttaagcctgaatggaggtttgctacattgttttctatacttctatgtatttgcaaagttgaggagaaaagaagttgtggtaaacccctggatgtaggcacacggaccccagtgttctgtgctgtgggtccctctgatgcagccgtcttgctcccgtcttgctggttcatcctccaccttggctgactacctggcctcacccttgtacaggtgcttctgtttgtctcttcattgaaatgggtgggatttattgatttatttagagacagggtcttgctctattgcccaggctggagtgcagtggtctgatcatggcgcactgcaaccctgacctccagggctcaatcaaccctccctccttggcctcctgagtagcagggactacaggcatgtgccaccacacccagcttatttttatgtattgtttttatagaggtgggattttgccatgttgaccaggctggtcttgaactccttggcccctagaatgctaggattacaagtgtaagccatcattccctgtgtgaaatgagtaggatttctgaatgagccaggctttgcacattgacctggctctgcctcttgaactgctgccttcacatgggaggctccttctggccctgcctgtgtggctgattcctctctcaggtgcttctctttatcttcacagacgaggctcatgggcttcactttttgggaccttaggtggacatctgagtccacagccctcctgcctggcttctgtctctgtggatttgcaggcctgcttgtcccatatcctccagtgcccagcccagtgcctcatgtacagtggatgctcaagaagtgtgtagtcatcacatagctctagtttcttatttttatttttatttatttattttttttgagacagggtctcactctgtcacccaggctggagtgcagtggcatgatcataactcactgcagccttgaactgggctcaagcaatcttcccacctcagccccctgagtagctaggactacaggtgagtgccaccatgcccagctaattttaaaatcttttgtagagagggcatttcaccatattgttcagactggtctcgaactcctggcctcaagtggtcctcccacgtgggcctcccgcagtgctgggattacaggcatgagccactgcctctagactttagaaatgttcagaagctcaccttcccatctgcaaagtggagactcatgagttgggggcgggtagattgtgagaatgaaccacataatgaagaggggatgtgtagcacatgtgagttttcccatcttgctggtttccttccctggaagaggcaaagagaggacaaggagctggctgttactatttgcttgcagacttggtgtgtgctttcaaattggaagctcctgctctgacacccagttcttttttgttttaagttgtactttagaagagaaaaaaattcatcaacacccttttttttaaaagatggaaaatgggttaagaaagtagcacgaggaactgtgagcccaacataattagtgtgatgaaagagaagttagccatttctgtatgtaacttttgattaatgatattcagctctaattaattatgtccaattctaattaatgacattagtgtgcaagctggcattctcaaactatattctgaggattcccagcggatgttcttgaatataatagtccccggtcacattaggttgggaagtgctgtgtgtactgcccgtcttggacactcccaaagcaccatataaaaggccttcagaagtcctgcaagaaaaggaacaatttaaatttcttttaacctgtcatttcccagacttacttttaccatgtgtgctgctaggcacatacggacatgctaatttaactctcataccacaaggtgtgcttggatgaattgatgagcaatgtacatgtcatggagacgttttctaagtcttccagagtcatagcaggggtctcctgtatcgcagcagagcatactgcaaagaattgcatttccatacagtctagggctgctgtgaactaatctcctttcttgggcaaatcgcttaatctccttcaatcagttcatacatctgcagaggaaagggtgatggcatgccaccctggatggtgggaggactcctagcagtggtggctgttaccatctcataagaaaccctcattacaagaaagtccacgtcatttgccatgtgctggtctcggggggtcagcgagtggggggctgcagggagagaccaccagttacctcctgagcctcacgtgtggggtacactgtgttttgtccgttgttggatttgtattcattgttcatctaaaagtgattatgttgaaaaacagaatggtggcagacaggcatgtttggcatgggttaatgcgaggctggaaagagagcccctgaccttcagttcgagaatcagccactgcaggaaagggtggcgtcttggtggccgcatactgtgaatgtcaagggagacgaagagtgcaccctggggagggcggactcatcagtccagtgggttgtccaggagggagtgagggttgatctttcatctcgaaggatgaatatacatttctgcgagagagggggaagacgggcgttccaggcaaacaagcgtgtatatataactgaagcgtggacagaggaagcagcgtggctggtctgggaatggaattgtttgatctggcttgatggaggagctagggggtgaggtagaagaggtggcagaggccagcttgacctgtgtagatggcttgggagaagccctggcaggtctttgttggagggctgacaggaagggatatgtgctttccatagttgaccttggagggtgcggcatggggtggaggcccgtgcaccagaggctcctcatagagtctctacagagagatgaccaggctagcgttttcatggcatgaaggttgtcttcagaaactcgcttcacaatctacttaagatgagtcaaatctaccctccaaagaacatctgctgctactggagatagcgcttcaaaagctaatgcaggtgctgaatgtttttccaccatgagggttccttctgtgcatcaattagtctagactcttgctgtttgaggaaagaggctcagagtagttaagccactagctccaggtctcatagctggctgataggacatcaacctgcggagtctctatggaggtggaatagtttcagtggtgcactgaaacagtaggggatggataggagaaaggcttggtctattagtcaggttgagccagagaagcagtaagggatggatatgaggagatacattgtgaggaatctgcacacgtggttttgggacctggccaggcaagcctgaagcccgcagggcaggccatggggaagggcaggctggaactcccaggcatggctgcagctgcagtccacaggcagaatttcttcttcctgaaggaagccttggctctacttttaaggtctcctgacaaattgatccagacccagacagattgtctgggatgatctcctttctaaaagtcaactcattatggactttaatgacatggacagaagactttcacagcaacgtctggaagagtggctgattgcctagccaagtcagtacctcaaaaagaccacactcttgataacacgtgggggctccaggaccaaaagctggtgctgcagatgtgtggggtggcagcattgtcacttcctgtctcccactaacctcagggtcacagtgggctggtggctgtagcatgctccacacctgctctcagggatgctggagggagactgaggcccaggcttttgtcttagagacttgggatatgtctaggatcccttctaaaagccaagttctagatagaatctggcctttcagggttggagagaccccatgtggcttctgagcagacttccttcctgatctcagtcttggaagtgaaggtcttacccctggttgcccccttcctgtgacagagggctctttgcctctttgcactccatgccccagagacaatcagtgctggggacaattttgtcagaaatctattcccagccctagcttagcctagtggcactctcagtcctgaaagctagaggccatttccacattggtgtagcaccgtggttctcagactgtgtttgctatcaggatcacctggggaacttggtaaaaatacaaatgcaggtcatattctgcttcctccatcctgggcctctgtgttctttattagccttcttggtggttctgacctacatcaaagttgaggaccactggcataacgcacggctgctcgaactccagtgtgcgccggaatctcctggggatctcatttattttatttttattttttgagacggagaatcactcttgttgcccaggctggagtgcagtggcacgatctctgctcaccgtaccctccgcctcctgggttcaagcaattctcctgcctcagcctcccgagtagctgggattataggcacatgccaccacgcctgactaatttttgtatttttagtagagatggcgtttctccatgttggccaggctggtctcaaactcctgatctcaggtgatccacccgccttgggctctcaaagtgctggggttacaggcgtgagccatcacgcccggccagggaccttgtttaaatgcagattctgattccatggtttttggtggatcctgcgattttgtgtttctaacaaccccccaggtggtgcagttgcttctggtcctcaggccacatcttaaatagcaaaggcgtagataggggccgaaattaagcacttaagaattacccagacttgcatcggaattctgcctctaccacttaactgtctctgtgttaccctgagcagactgcttgatctctctaagccttgatttccttatctggacaatgggaataatgtgcctttttttttgtttttttgaggtagcacctctgtctgttgcctagcgtggagtgcagtgctgcaatctcagctcactgcagcctcaacctcctgggctcaagcggtcctcccaccttggtctcccgagtagctgggacctcaggcacacaccaccacacccagctaatttttaaatttttaattagagacagggtctcattgtgttgcccagactggtcttaaactcctgagctcgggcagtcctccctccttggcctccgaaagtgctgggattacaggcgtgagtcactgctcttgctgctttttaaataaaaactgctggccgggtgcagtggctcacgccagcaaattccagtgctttgggaggccaaggcaggtggatcacttgaggtcaggagttcaagaccatcctggccaacatggtgcaaccccatctctactaaaaatacaaaaattgcctgtcgtggtggcagacccctgtaatcccagctactcaggaggctgaggcaggagaatcacttaaacccaggaggcagaggttgcagtgagccgagatcatgccactgcactccaacctgggcaacagagcgagactctgtctcaaaataaataaataaataaataaataaatattgctttgacagttagaaaagaaagagtttaataccgcaacataataaagaccatacaggcaaagccaccagccaacagcatacccagtggtgaaaaattgcaaaggcttttcctcttaagatcagaaacaagacaaggatgccccctttcaccacttctatttaacatagtactagaaattctagccagaacaatttggcaagaaaaagaaatcagaggcatccaaattggaaaggaagaggtgaaattttctctcttttcacatgtcatggtcttatgcaatatgtagaaggccttaaagacttcacacgaaacacacaaagctgttataactaatacatgaattcagtaaagttgcaggatccaaaatcaacacacaaatatcagttgcatttctatacactaacagtgagcaatctggaaggggagttaagaaaaaaattccattaaccaaggaagcaaaaaaattgtacacagaaaactaccgaacattgctgagagaaattaaagaagacaccagtaaatggaaagacatggaatgtttttagattagaagacaatattgttaagatgtcaatactacctatattagtccattctcatgctgctaatacagacatactcgagactgggtaatttacaaaggaaagaggtttaatggactcacagttccacatggctggggaggcctgacaatcatggttgaagatgaaggaagagcaaagtcatgttttacatggcagcaggcaagagagcttgtgcaggggaactctcatttataaaaccatcagatctcatgagatttattcactaccacaagaacagtgtgggggaaccacccccatgatacagttatcgctacctggccccacccttgacgtgaggattattgcagttgagggcaagatttggcgtgggacatagccaaactatgtcatatccaaagcaatctacagattcattgcaatccctatcaaaatcccaatgatgctttttgtagaaataggaaaattcgtcctaaaattcttgtgcaatctcaagggaccctgaatagtaatagcaatcttaaaaagaaggacaaagttggcgatctcacacttcctaatttcaaaactagctacaaagctgtagtcatcaaaacaatgtagtagttgcataaagacagacatacagacgaaaggaattgagtagacagcccccaagtaaaccctgacatatatgggcaaatgattttttgacaaggatttcaaggtcattcagtggggaaaggatagtttcttcaaatggtgttggaaaaactgaaaacaatataaaaacaacacaagagaatacaaaaatcaactcaaaatagatcaaagacctgaacataagagctgagaccataaaactcagaagaaaacaggtgcacaacttcatgacattggatttggtagtgacttcttggatgtgacaccaaaggcacaggcagcaacaggaaaagataggtaagttggacttcatctaatataaaaacttcctcaaaggacacagtcagcagtgaaaaggcaacccaaggaatggacggaaatctttgtaattcatacatctgataaagggttaatagccagaatgtgtgaagaattcttagaatttaacataaaaagaagccacctgattaacaaacgaacaaagggcttgaataaacatttctccacagaagatagacacatggccagtaaacacagaaaaacatgctcagcatcacaaatcgttagagaattgcaagtcgaaatcacaagataccacctcatatctattaggccggctattacaaaacaaaacaaaacagaaaataagtgtctgtgaggatgtggcagaattggaacccttgtgcactttaggtgggaatgtaaatggtgcagcccgtcggaaaacagtatgacagttcctcaaaaaattgaaaatagaattgccgtggaatctaggcgtggtttcacttctgggcatatgcccaagggaagtaaaagcaggggctcaaggaaatatctgtacattcatgttcatgcagcatgattcacaatagtcaaggggtggaagcaacccaggagtccattggcagatgaatggatcaacaaaatgtggtgtatacatagaatggaatattattttgccttgaaaaggaaggaaattctgacacatgctataacatggatgaaccttgaaccttgaggtcattatgctaaatgaaggaagccagatagaatagcacagatcctgtgtggttccactgacatgaggtactcagaatagtcaaattcatggagacagaaagtagaatggtggttgccaggggctagaaggagagggaagggggttagtgtttaattaggacagaggttcagttttacaaagtgaaaagagttctggagatggatggtcatgatggtagcacagcagtgtgaatgtacttagtgtcactaagctgtattcttaaaaaggcttccaatggtaaatttatgttacgtgtattttaccacaatttttttttcttacaacggaaaggactcaacaccatatctagtaaaacacacactgaatgttgttattgaaagcatagatggcaggatcacttgagtccaggagttcgagaccagcctgggcaacactgggagactcccatctctacatagaattaaaataacagattagctaggtgtcctagctactcaggaggctgaagtgggagggtcctttgagcctggaagttcgaggctgcagtgagctgtgatcatatcactgcattccagcctaggtaacagagcgagatcccatctcagaacaacaacaaaaaacaaataaaaaaataaaagcacagagccagtcacagggacactccatacatatgaattctacccacagtcattcgtgcccctgagtgtctgccttcccaccattctctgggagttggtttccattccctcacctctcctgttctctctgacaaaggtaattgaaactatgtttctgttctttcagtatggccaggtgggaagctgttctctagtgtgagttaaccaggacagagggtgtgtatgtgcaggggagagaagccggcaggctcttcctcccagatgctggactatggaatgtgatactaacatggggatcctccccaagagccttggatcccctagtgcaccaaagtatcctactgagaaggcatcagaaaatctgactcacagaagttagggcagtgtttacagtaccatgacagcaggcagagcttggggttcaaagcagaatctgaggaaagactctaaaaagacgagcccctgcccaagatatggtgccttttctagtctcatagcacattgcaccccctcccctcactgtaacaatccacaccctcagaacgcgcacctggagttgttcatggagactaaagtgggaggaagctttggacagtcacctttttgaagtctgttttgaattgaacagtgtgcaaatgataagccacttattttaaaataagcttcttaattcaagtgtaatataaacagaaaagtacaaaaatcctaagtgtttattaccatgaatattttcaaagtgaacacatccatgaaactaccatccagactaggaaacaaaacatcaccacaacccaagaatctcccctagggtcctctcccagccataacccacccccgaccactaccaccaccacctaaaggtaatcagaatcctagcaccaaatgttatttttgcaaatgtttgaatttttttttaaataaatgaatttctacaatatatactgttttatgtcagcttattttatgcaacattatgtttgtgagagtcactcacaggtggtgtgacagtagttcattgactcactgttacagagcattgtaaaaatacaaataattcatccattctatgtttgatggacatttgcatcttttctagttttgggtcatgattgctgctgggaacactgttacacatttgttgtacacatgattgcatttctattgagggtacatccaggattggaatgggtaggtcacagggtctgggtatgtttctattttagtgaacactgccagtcctttttctgacgtgattgtacccaattacactcccacctgcaaataggagtttcatttgctccacatccttgctcataactggtggtgttagtcattttaatttgatttttagtggatgcatggtgggatcctctggtatgattttcagttcactgaagactgttgaatatctctttcgaatacttgtcttgtgcttttcgaaaccttctcttgaagtttttgtgcaagtttttgctcatttttctgttgcattttctttcttagtgctttgtaggagttctttttttgttttatgagatggagtctcgctctgtcgcccaggcttgagtgcagtggtgcgatctcagctcactgtaagcttcgcctcgtgggttcacgcccttctcctgcctcagcctcccaagtaggtaggactacaggcgcccgccaccagcccggctaattttttgtattttttagtagagacggggtttcaccgtgttagccaggatagtctcgatctcctgacctcgtgatccgcccaactcggcctcccaaagtgctgggattacaggtgcgagccaccacacccggccgggagttctttatatagttagtacctgagacctttgctagatgtacatattacaaatattttctcacactttctcacgttcagtggtatcttttgatgagaaggcccagattatcaatcttttcctttaaggttaatgctttttgtgccctgtttaggaaatctatgcatacctaagaacatgaaaacaacagcatatttattttttccagccattcttgttttctaatatatgattttagggttataaatagcctattaagcctgctttagctgtaatccactatttttaaaaattgtagtaaaaaaacacagcataaaatttaccatcttaaccatttttaagtgtacagttcggtagtgttaagtaaattcataatgttgtgaagcagatctctagaactttttcatcttgcgaatctgaacatctatacccattaaacagcaacttctcattctccttgccccagcctctgggagccaccattctactttccgactactctaggtacctcaagtggaatcctacagtttctgtctttttgtgactggcttattttgcttagtacagtgtcctcaaggttcatctgtgctgggttgtgtgataagattttctccctttttaaggctgaataatattatgtggtatgaatagaccacattttgtttatccatcatccatcgatagacattgggttgcttttattccttggccatgatgaatagtgctgctgtgaacatggctggctgtccagcaccatttttggatacgttgtatttttattattaattagttcaaaatctgttcactttttaaaatttctcctttgaaatgtgggttattttaaagtagttgatttccaaatgcctccatattttctggttatatttttgttatttatttctagcttgcttaccccgtagtcaggaacagattatttacaatgttaacattttgaaatttgtttacactggctttagacttgtccaccatatgattaattttgacagactatcccatgtgcccttgtgtgtagttcctcagttcagtactttcgatatattcatgaggaaaaatgggtaattgtggtgttcaaatcttatatttccattcttatttttacttctttgttatatcatttactgaaagaagtgtgttaaattatccagctgctcataatgtctgtgtctaatagacataaatttcataatgtctaatactttagatttgtcttattatagtcctgtcaattctccctttataaattttgagtgcatttaactagatacatataaatttagaatttattcctagtaggttgccctttttaattatgaattctttcttttccataagaatgctgcttttcgtaaaatctagtttgtctaattaccaatataggtatataaactttcttttttaacttactgctttagaatagttttagattcacagagatgttgcgaagatagtagagagttcccatacatcctgtacctacttttccctgttgttaacatctcacattagtatggtacatttgttacaattaatgaaccagtgccaatgcattattattaactgaagtccatacttcattcacattttcttagtttttatcaaatgtccttttgctgttccaggattctattaggagactgctttgagttcagttattatgtcgctttaggttcttttagactgtgacagttcctctgactttccttgtttctgatgaccttgacaattttgaagagtagtggtcaggtattctatagaatatctttaaatttgagtgtgcttggcatttttctcatggttcaataggggctatgggctttggggcagaagatcccatctgaaaaagtgccattcttatcctatcaaatcagggctacataatttatcactgctgatgttaccctcaatcgtctgagtgttatgcaccatctccatgagggaacagtatctacacaaattatttgcaattctgcacagggagattggtctgttctcactcatttattttctcattcatttatttatatttgtatggactcatggatattcattgtatactttgggctataaaccagtattgcattattaattttgttgttcagatagttccagcttttgccctttcctaagatagtggactcacccctctgtgtttcaactctaccaatttggaccctcaagttcttgttgccttattagccataaattgcaatttcttatttccccagtcctctgagactactgaaagttctgcttaggcctattgcctcttaaccactactttcttcctgtgtgtgtttttaaccttttggcttccatcactcacaaatccccaaatgccttgacgagaaaagcagcacagaatgctgagcttatttctgggtaattatctacttgtcatgatctcagcccctcaagtcctagctgccttggactctctgatgcttccacagagatcatttaaaaaaatttcgtcaagagtttctagttgttcttggtgagaggattagtctgacacaagctagtgcatcatagcaggcggtggaattcttcagacataatatttttttttacttcttctactatgtcatagttgatggtgcctcatggtattttaatatctgatgctttgcacccatacagcaactatcctgagtaacgaagatgttatgtcatataggaaaatgagtcattcttttttttttttttttttttttttgagacagagtcttgctctttcgcccaggccggactgcagtggcatgatctcggcttgctgcgagctccgcctcacgggttcacgccattctcctgcctcagcctcccaagtagctgggactacaggcgcccgccaccgcgcctggccaattttttgtattttttaagtagagacggggtttcaccgtgttagccaagatggtcttgatgtcctgacctcgtgatccacccacctcggcctcccaaagtgctgggattacaggcgtgagccaccgcccccggccgaaaatgagtcattctttgcatttcattcatttatgcccttagtcacaagggctttagcaaagaattggcttccaccctctctttaaggtaaggaaataaataatgaccttggaagacagtattcatcataaaagcgcttgatgaaaggagcaattggagtgaactatgtaaaacaggcttttcagtctaatgggacagtgtaattactggtgcagatttctagttaggccttaaagaaattaagcctccctatatggttaataatggacttgtgtaagaagattgcttcagagatgaagtttgtgattcacattagcatatttggcagtgaaagcgttacctttctcaatcaagcaggatatgtaagatctttgtgtatgcttttgctaaactttactgctgccatccctgaacttgacttgatatttttacatccccttcaagtctgcatcccagttttgtgtcatctacagttctgaagagctgccttgtgctttatcatcatccagggttgaaaagagccagatcattggagaatccccacagactgacagttttccctgaatcgatgcctgcttattgtgctcatgcaggtagctcctattccatctcacttcgctgcatgcagctcacatatttcagatgatccacaagaacattgggaaggacctgccaaaatcctgccttgctaaagtccaggtatactctcttccagatctcccttaactgcctttgcagattctatatcggagaaagaagtgaggctaatttcacaaacttattcttaccgaattcatttatagctctaataattaccacttttcttagatgtgatcccaaaacaatcctttaataaatgcattttagaactgcactgtccatagtggcagctacttgccatttaaatttaatttaaatgaattaaaatgaagcagacaaaaaatgcagtttctctattggactaaccatgtttcaagtgttcaatacctgccatattgggcagtgcagatagaacacttctatcattgcagaaatttctgttgaacagagctgttctaaaaccttgttttagaatcagatctgagctcacccgtctgcagattactcagtcatcatttgactgtttttttttttttttttttaaagagacagggtctcactttgttatccaggctggagtgcagtggtgccatcatagctcactgcagccttggactcctgagctcaagtgatcctcctgcctgtctcctgagtagctgggcctacaggtacatggcaccaggcctggacattatttaagtctttaagaaacatctacatgtgttttttcctgtcacctctctttttctccatttccttcaaaatcaccttgaaggcgactccatttctgtattgcccaaatcagtctacagtgtaggtgttggatgtggactttttttttggtttctaatgaggttgtgttgcagatgagctgaagccacctttgatattctaggatttgtgcctgaagaatagcgctttctgtcttgctgatgtttatatgactgctatgattgtcaagggaaataaggagaaatgaatgggatccacgttgcttggcccagcatacctgtttctgagtgctgttggagctgagaggcatgctcttggagaatcagccatcaagctgtcttttccagagtggatgttgtccagggcagttgcagagtgagcacactgtcaatgagtgcctggggtccttcatttatttctttacagcatctgtagtagaataaaattccagtgttaagagacaaaaaaaatgtgcccagctctcctggggttgacagtctcagttggtaaatcccatcccaagggggcagctcctctcctgtctgtggtttgcctgctgtcccccaggagccacactcaccagtttggtcagctggcagatgataagagggagagaatcttttagaaaacagatcctggagatcattgttagtggagaacttattatcaagtcaggaagaagaaaaatcattgttagttgagtgaatacattttaaaaaatgataaagtgttcgtcaggcacttgggatttcttgctcatatgctaataggatttttgaaaatccactcactgtttggaaacttgcttgctcagtgacaactgcatccaaatagcagatcatgagccaggtttgtggggggacaagagtgaagggagttcggaggaagtcgctctgggccaggaggcagggaccctggccaccagccatgtgacccggggcagatccttgcagtgctgggccttggttttggccactgccccctggccccccacttcccagaattattgtgaggaactgtgcgtgtatgtgcaggaactgggttaacatatctacttatggttggccgggcgcggtggctcacgcttgtaatcccagcactttgggaggccaaggcgggcggatcacaaggtcaagagatcgagaccatcctggccaacatggtgaaaccctgtctctactacaaacacaaaaattagctgggcattgtggcgcatgcctgtgatcccagctacttgggaggctgagacaggagaatcacatgaaccagggagtcgaaggttgcagtgagctgatatggcgccactgcactccagcctggagacagagtgagactcagtctcaaaaaacaaacaaacaagcagacaaacaaacatatctacctctggtcaacacagaaacaaggtaagcttttgttatcccctttgatagacaaagcaacagagcttaatgagcatgcatgtcacaaggaagcacaaattcacgcttattatttttatgggaagacccctcacttcctggtcctgatgttctctgtgggacctttggtgagtcagggaaggcctcacagtatggagacaacagtcccagcctctgacttgcaggagtgtggggactaagtgacactggaagtgtgctgcacacgtgcaggcctggattattaggagggaaggttagaaatcaagagccaggggaaaactgggaatagctggctggcttttcagaagggagtcattattttgtgcaccttgcaactcaggcagtgagcctggcggggaaagagaaatggctgctctttttttctgtccatgtgtcaccccctgtcagtgtgttactgggtgcaggtgtctcctctgatggtgtctgggcttttctttcccctcccttccttctttgcctgcttctcctttgctcctctgtctccgtttctctctccctgcattttgtctctttctattccttctttcttccttttttatcttcagattttaacctgttcctttcatcaaatgatgcttattaaatacatttggtgatttatatttttgtttctaagaaagctgatcaaaataactgtgtaagttcagtccgtgaaaagacaataatgatgacaggcaggcagcgctttggaggaaggagggttgggtcccgggtacccctgattcggtgggtgtttgtgcatagagtggtacctgcctgcttgaggataggaggctttgcagcttgaggtccttgctccctggtgtggggcatctgaagggctgtggtgggaagagggtcagaaccaaggccagatgcacccggagcttgctgcacgcacttctgggaggtttcctcttattttctctattttaatttctccattttctcttttctctctttcctctctttctggaattcccatctatctgatttttgacctattcattctatctttgaagtctctcttttctttcatatttttccatcttcttttctttctttctttttttttttttttttttttgagatggaatctctctctgttgcccactgcaacctccacctcctaggttcaagcaattctcctgcctcagcgtccagagtagctgggattacaggagcccgccactgcgcccggctaatttttgtgtttttagtagagacagcaatttcaccatgttggccaggctggtcttgaactcctgacctcaagtgatccgtccaccctggcctcccaaagtgctgggattacaggcatgcgccaatgtgcccggcaccatcttcttttctttccgttctgttttctgggatagttcaacgactttaaatacccatattgaaatgtttatgcttgctcttactttggctctctgagggctctttctattctttcgtcatttcttattttgtagcactgtatctttgtgtttctgcggcaatatcttcttctatttatttaaaggtattaatttgttattttgtttcttttttgacaattacttctgtttccttcactatcttttttcctttgctgtccttgtacttgcttgcctggattttcttcttcctgtttgagaccttcctcccagatctgtgagccgtggttgttaattcgcattgagaagtgaagcactgaaaattgactggagtgtctgcaacgtggctgcacattagcatcacctggaagcattaaaaactacctctcccgggggacagtctcagggccattggatgaagatctgttagattggggtctgcatattgataggttgataaataaagatattgatagagatcggtaggtagaaatacagattttccctcctcagcaattctaatgtgcaagcagggctgagcgttgtatagtcttgggtgacagtgccgggcctctggagagttggtataattaccgtgcagcgaaaccactctgcgttttactgtgccgggtgcctggaagactttgattgcatccatatgattctttttctgtacctctggcaaattgcagattgggaggaattatatatccctacagagacttcagtgaatgaagtttcagggacctatgagcaagaaggatgaactggcttcccggggaggggccagcagtccttctgccagacaagtcatcagggctgggacaggaagcatgggaagggcagctgtgcagagcaggatccaggaggggccacctggtggcaggtgtggccactgagcagcccctggctagggatggagctggagctgccagggaagctttgaggccaggtaacttggctcttgggctctcatgaagccaactgttcctctcccaagctctgagaaaacagtggagtcctggagtgacaggatatggtagctccataaggaggaggaacctgtagttggaggggcaacaccaggaggccagtgagcgatactctgtacctgagagaggtggccggaacctgggcccccacttgctgccagtgaccttgcacctgccacaccttctcttggagttttggcttctttaactgggacatgaggatcctgaccatctctgccaagcaggagaggaaatgggctgatgtgtgttgtgaggcagtagagactggggcataggaagcaaattgactctcagagtttatggtataaccttctcccacgctgtagggatcaggtttgcccctaaacctgcagactggctaaggccagggctggaaagggaaaaaagtaagcagaggacaggtcatgctgcaggccggcccctcacccctggtgacttgtgctcttggagtgagggcccaggagggggttgcctgcctatgcgtgtctctccctttccccctcctgttctgtggggctgggcctcacacggccattcttcgaaggaggaaggtggccttttgcattccctgttggtgtgttacttattgtcacttatttttgattaaggatattatatttagggagaaattatttgcattttctttgtaaatcatctgaagaattgtgcaacacaggagtgcattcgggaagaaaattcagacatcagagataaagcagagttctcccttggctgcatctacaaccttcctctccctagagaaccactctgtggttagtgtgttttccttcattatcttatataagcatttatgcatgtgtagatgtagatggctgtgttttgtttttatgcacatagaaggtatctgtgcattgttctgctgccggagttgttcagaacatggtattgtggagaaccacatgactgtacacacaggtctatcttagagacctgcctcatttgctttaactgctgcagaggcttccagggaccgtgtgtacagtactagatactgtttaatgaacactttcctactgatgaacatttaggttgtttcctaatgtttgctgtcacaaacagtgatgctggtgggttaatgcttctctaggggagagagcaagaagcagaagtgctggctgtcatctgcattctgcagtttaccagatactgtcaggttcccttcccaaatggctacagagtggtttggtccctgcagtgtcatcagttcccgacattataactttgcagatgtgatagggagaaaatctccattttattttttcatttcctggattatttgtgaagtcaagtatatttgcctgtgtttactggcacatgtattttctctttggtcaatttcccttttgtaatttttgctcagtttcccatggggttattcgtctttttcttattgatatctaggaaggtcacacgttcatgtgagtgtttgggtgtgtgggtatacaagcaaaaaaaggtttaatacatcctggatgctcattctttgatacatttacttcgactattttcttccagtctgttgtcttctgttttaggtgttttttttttttctcatccaggtttaaacattgtttattgttgtagctaaataattcactttatttagggattataagaaaatgtagaaagtaaatttgcattcttttcctttttcttagtattatgaaacttatttcttttttaaaaaaccagtctgttgaggtaagattgccatataaaagctgtacacattttttttttccagtgacttttttaaaaaatatatttaaaaacaaaaccggccgggtgctgtggctcacgcccgtaatcccagcactttgagaggccgagaggggtggatcacctgaggtcaggagtttgagaccagcctgaccaacatggtgaaacccggtctctactaaaaatacaaaaaaaaattagctgggtgtggtggcatgtacctgtaatcccagctactcgggaggctggggcaggagaattgcttgaacccgggaggcagaggttgcaatgagctgagatcatgccattgcactccagcctgggcaacaagagtgagactccatctcaaaaaacaaaagacaaaacgacctcctcccaaataacccccaaacaaacaaaaaaccagattaaataaaatttacagtgaatatacccagcaaacatttgtatgtgcaattcaatactgtgtctgttactgcggcacgaacctcagacaatatataagcgttctggggggtcgggagagtcccaagttttaactctgtggggtctaggaagacaagatggggaagtgagagaatggggaaatccgttttgtttatcttaattctttccatataaatatattcataaagaccaaaaaggaaaggaagcttgggatgttaaggtaataggagaataggagagtgtgggactttcccaattctgactgaccaaaaaatatgaaaggaattaattttatggtgggagaagagatttaaaaaataaaaaaaagaggatgggggccaggcacagtggctcatgcctgtaatcccagcactttgggaagccaaggcgggcggatcacctgaggtcaggagttgagaccagcctggccaacatggtgaaaccccgtctctactaaaaatacaaaaattagctgggcatggtggcgcgcgcctgtagtgccagctactcgggaggctgaggcaggagaatcacttgaacccaggagccacaggttgcagtgagccaagatcatgccactgcactccaaaaagctgtacatatttaatgtacaactttgtgagtttagagcgaagccaacccccatgaaaccattgccacagcgtgtgccgtaaacagatccatcacctgctcacgtttcctcctgcctactttattacgatgatgatgatttgtgatgagaaactcaacagaagatccaccttctcagcagatttttaactgtacaatacagtgttgttagctgtaggcactgtgctttatagtaaatctccagaacttactcagctcggacagctgataccgtgtaccctcggcccagcatctttccacttcccctacccccagctcctggaaacccccattctactctctgcttctatgagttgactttttaagattctgaatataagtgagatcatgcggtatttatctttctgtgcctggcctatttcacttaatgtcctccagtttcatccgtgtggctgtacatggcaggatttccttctttttaaaagccgaataacactccattgtaagtgtataccatgttttctttatctgttcatccctcaaaggacatttagattattcacatatcttgggtattgtgaataatgccgcagtgagcgtgggagtgcagacttctctctgaaataccgatttcagttcctttggatgtatgcccagcagtaggattgctggatcattcggaagttctatttttaattttttgaggaacctccatactattttccataatagtgataccaatttgtattcctatcaacagtgcacaaggattttcttttctgcacattctcaccaacgcttcttatctttcatccttttgatactagccattcttacaggtaatagtgtgttttgcatttccccgattggtcttttccttgatgattttttattgtcttatttaagaagggcttccttatactgagtatctaacattttagagtcacctattttacaataagtctttagtccccttgaaatttatttttgtgaatagcgtaactcagggatatatatatagcttttaaaaaatgagttgcaaagtttataacccattccccccaccagctgatttgacatgttacctttatcatatggtaaatcattatagatgatgagttgttctggactgtcttctgctggtctatttgtatactctcgtggaataaaaaattctatggttttatatccttcattgttcttctagagtgtttctgcaattgtttcctctgccatctgaattttattattctcattggaggttcttttggaattgcactgactttctaagttgatttggaccaaattaaaatacttaaaattgaaatatttactatattaaaatgcagtattatttgtttttatctgggaatgtagtgtatttttttcttgaaagttttgtacacttttgttatgttctttccctatatgctttatagttttgttgctattgtgtatgaaatattttttattattacattttctatttggttgttgctggtgcttaggagagccattgatttatgtgttaaactcatacctggccaccttgctaaacctttttcttagtcctaataattcgtccgttgattctcttggttttctataaagacaggaatattgtctgaaaaaaatgcctccttcttcccctcttccttctcaaactgtacacctcttgagatgtctctttgtgtttgtacttctaggtagggtaaccagccccagactgaaaggtgacagtgatagcagccttcctaatcttgtccctaaatttacaggggatacttttatggcgtcactataaaatgagatgttttgctgcacttggctgataaatatcctttatcaagttaagggagtttgcttcttggtctaccttttaaggtttattttaaatcaggaatgggttgtcgaatttgatggccattatacctttttccttttttttttttttttttttttttttttttttgagacagagtcttgctctgttgcctaggctggagtgtagtggcgcgatcttggctcactgcaacctctgtctccgaggttcaagcgattctcctgcctcagcctcccgagtaactgtgaatacaggcgtccgcccccatgcttgactaatttttgtatttttagtagagatggagttttgccatgttggccaggctggtcttgaactcctgacctcaagtgatccacctgcctcagcctcccaaagtgctgggattataggcatgagccaccacacttggccccattttatacctttttcatggaagtaaacattttctaattcacaataaaagagaaaaaagtataataaacacaacatatccattgccatatttgcttagatttgttgttagcattttattatatttgctacttctttcctttttgtcgattttttttttttttttgagatacagtctcgctctgttgcccaggctggagtacagtggcatgatctcggctcactgcaacctccacctcccaagttcaagcgattcttctgcctcagcctcctgagtagctgggattacaggtgcatgccaccatgcctggctaatttttgtatttttagtagagacggggtttcaccatgttagccaggctggtctcgaactgctgacctcaagtgacccacccacctcagcctcccaaagtgctagaattataggcacaagccactgtgcccggccttttttgctgaagttttaaaagttgtagccatcattatttggccatataagttcagcgtgcactttaaaaataagcacatcttcctacatttccacgagaccattatcatagtaacagcattcacagtaattcattgataacatttaatacccagtctatggtaaacactctccagttgttaccagaatgtcctctacagctggtttctttaccagggcctggtcactgcggagacagcactgtgggccctgatgtctccactccttctctaactggaatgcaccctcttcctttttgttccattacacctctctattgcagagactcacgtggaccagctgtcctgcatcaaatcccatcttcagcgttcgtctgattgctttctgggctagcatttaacttttctctctagctcttgcgcttcttgtaaatgggaatttcagtccaaaggcttgtgtgtttttgctgtgaaacaacagcagaatctcataggacgagaatttttcttcctgtttgtaggcagggtcagcaaaagggcaggtttgttcaggttgcaggtctgctggggtagctctgcctgacatgtttattctgagacccaaactagagggtaggggctgcatggggctcgtgttgcccatggtgagtcagaggaacacaggaggagcggatggaagcaggagatggcctgaggtatagccttggggcttgcaggtggacggttcccattccactgtcgagtatcaatggagtgggcagtgtgcttgtcccatggaggaggaaggggtatttgctgaatgattaaatccaacccaccaaagcatgtttagattcagactaaaagttcttggcaagaatacttcataagcggtggtgtatgcattctattgcagcatgtcacaattcacatgtaatacgtggttgtctcattagcaactgatctgactagttaccatttattaataagatgctgtgctgaacttctgttaacctcaaaaggggaaagcaccaggttcaaggctgaagaagagacccagagccaggaaacaagaattgggattttttttttttttttttttgagatggaatcttgttctgtcgcccaggctggcatgcagtggcgccatcttagctcactgcagtctccgccacctgggttcaagcaattttcctgtctcagcctcctgagcagctgggactacaggcacgtgccaccctgcccagctaatttttttgtaatttttagtagagacaggttttcaccgtgttagccaggatggtctcgattcgatctcttgaccttgtgatccgcctgcctcggcctcccagagtgctgggattacaggcgtgaggcactgcgcctggccaagacttgggattttattaggggcctgcatacaggggagacggatggtggtggattggaccagagaaccgccttatgtacagagatggtccagtgatgggctgggcgtggtggctcacgcctataatcccagcaatttgcgaggccgaggcgggcagatcacctgaggtcaggagttcgaggccaggctggccaccgtggtgaaaccccatctctgcaaaaatacaaaaattagccaggcgtggtggtgggtgcctgtaatcccagctactcgggaggctgaggcaggagaattgcttgaacccgggaggcagaggttgcagtgagccaagatcgtgccactgcactccagcctgggcgacagagcaagactccgactcaaaaaaaaaaaaaaagaaaagaaatggcccagagatggcgggctggataacatatcggccttcctgcagtcttgtggcagtgggctgggcaggaaagctgcaacttcttgccaactttatgcagtttatttagcatttctacttaacaccctcctcttaatgacccctacccagcaaccttcatttaccccaaaactcagggcctcaatgccctgtatggcccgtgttccataggatgttccaggggctcaaatgttcctcatagacaaggaacgaatctctgggttggccacacctgattccccagctcagagcacacactcaggtgcatctgccatacagggtccttctgagggtaggttcaagttatcgctgtcaggtgcatttaccctacagctggtgacagcttgagtcttcttttataaagtttcttatgcttgagactgacaagaaatctgtggctagttctttggcaccatgtatatgaacggccagttaaccctctgttatccattggtgatcctggcctgaatcagttaattcattagttgttgcaaattggtggtttcacaattctctcatactgttttcatttattagctgttattcttctgtaaagaagagattttccttatcacctggagctgttagaccaccctgaaatacagtatcgttagaacaggccgggcatggtggctcacgcctgtaatcccagcactttgggaggctgaggtgagcggatcacgaggtcaggagatcaagaccatcctatctaacaaggtgaaaccccgtctctactgaaaatacagaaaaaaaaaaaattagctgggcatggtgttgggcgcccatactcccagctactcatgaggctgaggcaggagaatggtgtgaagccaggaggcggagcttgcagtgagccgagatcctgccactgcactccagcctgggcgacagagcaagactctgtctcaaaaaaacaagaacaaaaaaaaccaaatccttatttctcttcaattgttaattttcagaataagaagttggcaatagccaattttaatggtatgatacattctcagggtgtgccatcttcccctttatgatataaaccatttttggtcatgacgtgttagtttttaatgctaatagtgaacctatttgttaaagtttgaggtaagatctttgcctctctcatgttggagactagtttgtgcttatcctttcataaaataaattgcttcagctttccatctcttttttgagatgtgacatcatggtaatctattccttgaaaatgtaataaaacgtgtttgtcaattcatctcggtctggcctttattaggttaccttgttattttaaaatatcttctatagctattcagtttttctacttattgagccaattgtggtaatttatattttcttagaaaatcttacatttcattcagttagatttgcaaattcattggcataaagttctgaaaagtattctcataattttataaatttttctgcatctgtaattatgggcttttcagttctaatgtttgtgttttctttctttttcttgatttgtcttatgatatgtattctttttatactgggccaactttcaattaattactgtcttaattttttttagtcttttatcttttttttctttttttttctttttgaggcagtcttgctctgttgcccaggctggagtgcagtggtgtgatctcagctcactgcagcctccgcctcccgggttcccgcattctcctgcctcagcccaccgagtagctgggactacaggcgcctgccaccacgcctggctaattttttgtatttttcgtagagatggggtttcaccgtgttagccaggatggtctcgatctcctgacctcatgatccgcccaccttgaagcctcccaaagtgctgggattacaggcgtgagccaccgtgcccggcctagtcttatatttttctaattccttcattttgattttcacttttatttcttagacttattttatacattaacactcttttcgtttttttttttaatttaatttttaagttttggggtacatgtgcaggatgtgcagcaggtttgttaggccggtaaacgtgtgccatggtggtttgctgcacctatcaacccatcaccgaggtattaagccccacatgcataagctgtttttcctaatgttctccctcccccgatcccacccctgacaggccccagtgtttgttgttcccctccctgtgtccatgttttctcagtgttcagctcccacttataagtgagaacatgtgatgtttggttttctgttcctttgtcagtttgctgaggataatggcttccagttccatccatgtttctgcaaaggatatgatgtcattcctttgtatggctgcatagtattccatggtatgtatatatgtaccacagtttctttatccagtctttcattgatgggcatttgggttgattccatgtctttgctattgtgaatagtgctgcagtgaacataggggtgcatgtatctttgtaacagaatgatttattttcctttgagcctataaaccagtaatgggatcactgggtcaaatggtatttctggttatagatctttgaggagtcaccacactgtcttccacagtggttgaactaacttgcattcccaccaacagtatacaagcattcctatttccccgaaacctcgccagcatttgttgtttcttgactttttaataatcaccatcctgactggcatgaggtggtatctcattgtggttttgatttgcatttctctaatgatcagtgatgttgagctttttttcatatgtttgatggccacataaatctcttcttttgagaagtgtctgttcatgttctttgcctgctttttaatggggttgtttgggttttttttcttgtaaatttaagttccttgtagattcttgatactagacctttgccaggtggctagattgcaaaaattttctcccactctgtgggttgcctgtttgctgtgatgatagtttcttttgctgtgcagaagctctttagtttaattagttcccatttgtcaatttttgcttttgatgcagttgcttttggcgatttcataatgaaatctttgctggtgcctatgtcctgaatggtattgtctagattttcttctagggtttttatagttttgggttttacatttaagtctttaatccatcttgagttaatttttgtatgaggtgtaaggaaggggtccagtttcaattttttgcatatagctagccacttcttccagcaccacttacaaacagggaatcctttccccattgcttgtttttgtcaggtctgttgaagatcagatgacattaacccacttttctaccaaaaaaaaaaaacccctctgtagtaaatgtgtatatttcctaatgagtactaatttggccatatcccctagttgtgatatctaattttttgttcatgtctaaaaatacatcatttacattttgaatgctttctaagcctcagttatttaatgtttaagaatttcccaggcatgtcatattttgttttgtttttgttctttaactatctttgtagcagtctgggtccactcaggagatgggaaccccagggggagcatcatatttaatagaattattaggtatgatgagagagtagctgttaagaggtggaagttctgtgtggtatcgtgggggtggagggagggggacctaagcaggggcagacctgggaaagccccagggaaggaccagcttgttagggaaggtgtggttcagcagtggagagcagggacagccgctggttcaggcagtccagcactggtctagagatgctgttggtcacaataggccaccctctggagtacaggctggggagcagtggcttgaggctgggcctgcggtgtgagttcgggcaccagcacgtccagaggtgccggacatgcagaaggaacgattgctcaacgcaggactctccagaccacgcgggctacatggggtttgtcgagggagtccagaggtggctggccatgtggagctctgggttcgaggcccaacaggtgtggccccaacaaggctgcagggttgcagaagaactaggtgcctctgtggcctgagccgggaactgcgggaaccgttttcctccagcaatgttgctccatcaccctctgcccagaaagcttaatgtgctcactctaaaggagaaacatgaccgggcccggtggctcacgcctgtaatcccagcactttggaaggcagaggcaggcggatcacgaaatcgggggatagagatcatcctggctaacatggtgaaaccccgtctctactaaaaatacttaaaaaaattagccgggcgtgatggcgggtgcctatagtcccagctactcgggaggctgaggcaggagaatggcgtgaacccgggaggcggagcttgcagtgagccgagatggccccactgcactctagcctgggccacagagccagactccgtctcaaaaaaataaaaataaataaataataataataataataaaataaaggagaaacgcttaagggaattctgtttattcagagaacatattgaggggtacattcagaattgggaggcaatgaattgataactgacacaacctttttgtcattcctttctaattgtcccattgtagtcagtgggtgtagccagtacagattctttgtagaatgtcacatttcttttgtggcctaatgctacataggcagttttggttaaacccatgtgagtatgtgtgtgtgtgtgtgtgtgtgtgtgtgtgtgtgtaaaacctccgccttctctatttgttaggtacggggttctaaataaatcttattgttatttaaatttttatatcccatctcatttttgtctggttaatttgattttaatctctcaatatgaatgtggctattaatttcaccttttatcattatttgcttggtttatattttgaagctatgttgtgaagtttataaaggtacatgatgctcttggtggattatttttgttattaatgggaatttttccttttatgcctttgcatactttgttgtttacattcattttgtctgattaatattgccatatgagccttctttttattagcacttgtctggtgtatcttttcctatacttttatttttagcagtcttcgtgccatttttttcaggtgtcatcagaagagactaagcaactcatggcttaattttctaaaataatctgaaaatctatgtttttcaacagatggactaaaagagagtataaagagcactgcattcatttgctcaggctgcggtaacaaaacacagacttggtgtcggaatccatagaaatgtattgcctcacagttctggaggctgggagtccaagatcaaggtgtcagcagggctggcctcctcgggccgtctctccttggccttgatgcccctgcatgtgttcttccttctgtgcctgttgtgtgcccctggggtctctctgtgtaccccaatttatcttttttttttgagatggagttttgctcttgttgcccaggctggagtgcagtggcgcaatcttggcccactgcaacctctgcctccccggttcaagtgattctctgccttagcctctggcaaaatgcccttttcaatcctccctgccattggctacttttaggatcctgctgattggtgcatgttacagattgctgattggtgtgttttacagagtgctgattggtgcattttacaatcctcttgctagctacagagtgctgattggtgcttttttacagagtgctaattggtgcattttacaatccacttgctagctacagagcgctgatgcattttacaatcctcttgtaagacagaaaagttctccaagtccccactcaacccaggaagttcagctggcttcacctctcacaaccaccccaagaaagttgagggtgaagtgcaggccatgcacaggatgctgtcttgatactgagaaaaggaaggtggtgttaaccacagaatttcatggccaggggtgagagttaatgtagcagaggggctctccttggaagggctgtctagaagaagagtgtgtaactctgggcaggataggaagaggtgacacctccatgagaaaagggactttgtcttttttgcccctgtctccccagcctgtggctggtgtgtgtcaaagaggcagagtcattcctgtgtagtcatgatggttagttttgtgtgttaactttgcccagctctggtgcccagttgatttgctcaaacaccagtctggatgttgctgggaaggtaatttttgggtaagatgaacatagtagaccttgagtaaagcagactgtccttcatatttggatgggcctaattcgatcagttgaaggccttaagaccaaaggctgaggttccccgaaggggaaggtcggcccccagacccccttgtgactcaagactggaatgtcaactcctcctggagttcccagcctgccggcctgccctgcagatttcagatttgccagcctctgcagtcatgtgagccaattccttgaaataaatctctttttatatatcctgttggttctctttctctgaaaattcctaatactgtagttttttcatctggtgatctatttggctatctcactaacttctgagttgggacagcctcagagtcagaagtcatgtgtctcctggaccctccatccccaaagcacagccccatgccaaaatatgcctttatgttagtagcactgcccagccctgttcagttttctgagatccagttcctacaagactgtggcactcagtacttttcatctcattgggttctgtgcctctggggctgttgcctctgagaccagatcccggatcctttctttgtgggctgctccacccctgctgtggaaatcacacagaaggcggacagtacatgtggacaggtcagacagacacactgattggccagctgcagcatggggagcatggactctgcccacagctgtggcgagatggctctgtggtgagatctgggctttcttgtgtgctgaggaatgggagcgtttgccatccttatccaagctgcatcactcagggctggcccctctgaggttgcactgtgggccccaccccagcctctgaacgagaattggcataccagccagatgcctaggtgatctgtgcatgtgctgcaggtggagaaggtctgcactagacatctccagaaggacgatctgggatcagggttagacaaggcccacgtctgctgcccagccctctcctctttgatgtcctttctgcacctgacacctcttcttgacattccctttccttggtttatgtggtaagacctctctgtccacaacaggaatggtcttacccatcttcttctcctaccatgtattaatagttccctgtgccttaaacccctgattcaaaacctgcttcctcaactctccaaagtcagccaagcgagaggttatgggcacagtcttccacaagactgccctcacttctgacaccagccccaaattcaggggtcctcaggcccatccttacttcttaccagctggtcaggggttcccatgaccagtcttaaattagataatttgctagaatgactcacagaactcagaacaccattatacttaacaatgacagtttcattatagcaaaaatttacaacccagaaccagacaaaagaaggaacacctggctgggcgcggtggctcacgcctgtaattccagcactttggaaggccgaggcagctggatcacgaggtcaggagatcgagaccatcctggctaataacggtgaaaccccgtctctactaaaaatatttttaaaaaattagccgagcgtggtggcgggcgcctgtagtcccagctactcgggaagctgaggcaggagaatggcgttaacccaggaggtggagcttgcagtgagctgagatggcaccactgcactccagcctgggcgacagagtgagactccatctcaaaaaaaaaaaaaaaaaaaaaaaaagaagaagggacacctagggtgaagtctgggaggcttccagatgcaaagctttggcgtcctcagagatgcattatcctcccagcatccaagtgtgacagtaatcaaagagtattgccaaaaaaggaacctcacctgagcttcaatgtctagagtttttatttgggattctttatgtaggtatgatgcatgatgaattgaatcagtgaattgattaaattgttggccatgtggttgagctcaatatctagccttcccagaagtcaggctggtagcccgtgtctcctgtctcaaagccccaaccctctagtagctagttggcctctctggcatcaccaacctccatcctgagtcatctcttttgcataaactttggaacgcaccacgaataacaaggacactcctatcacttggagattccaaggatgtagaggctccctccaaggtaccagaaggccagccaagttctttattacacaccaactgattgccatgacttagtggttaataaagagtggggcttggggttcctttagatttcaggcctgacacaaccccttggatatagactacatgaaatgaaagtgttaggaagggtgtatgcatgctatttgtttactttgaagagtgacacttggaaccaatgtcagttttacaggctgccctgacttgctggggcacagactgtgaagtgcatattcagaatgaatgaagtgttaccctacagcagtggctctcagacttgcaggcatcagaatcccctggagatcttttaacatgcagacttcagggtcctgcccctgagttttcattggtctgggggagggcccaagagtttctgtgtttgtggagttcccaggtgacactgatgctgctggcccagggaccacacttcaagaagccctggaatagactctgtggtgggtgtttgaactttggattcttggccataggtttttacattacaatgacagaatgggaagtttggcaggaataaagatgacttccacccacaggctcccggggaggtccttcttccctgggccctggcctggtgtctctgtctagcagctagctagcattcaggtcccaggtctcacattttggctggactttaatggcaattgatgggcaagtgcaggctgttcttgcaggggagggagtgctgcctctgcttgggctgctaggcttggggcctggtcacctggggccactgcccttccttcagtcttgccagacaggcagaggagtaagggcttgctaccggggcagagaacatcgaatgattgcaatcgtggggtcattaggattaattagtaaatagccatcagatcttaaaaaatagattcaggaacagcctgggagggcatttgggtgtggtttcccagtttgaggggaaagcatgaatcgactactatctcaggtagggctctggtgctgggaccctgctcaggccagttaagtgacagtggatgtggcctggaaatcctgtttctctcatgttcagtgagggtggaattaggggtgtgtgtggggaccttgggggcgccatgtgatgattaactgtagtctgtctcagttgtggaagctgctaatgtgtttttctgggacatcatcatgggatttttattattgatttcagcagggagactgctggctcattatgtgacaagaaatcgatgtggtgttccacgttcgaagcaggggttctccgtgacgtgcgggccctggaccagcagcctcagcatcccctgggcatgtgtgagcagtgcacactcccagcctccccctgacctgctgagccagaagctctagggctgggagccagaagccccgcaggtggctctgctgcatgggaaggaactgttgggatgcaaagcaggccagagaggacaggagcagacaaagatctgaagctgaatatggacccctcagggtgccagctgtcaccccggagcgcccccctacctggggaagctttggcaaccttcctggttgcaagccaaggcccagggactccaccgctggtgacccccttacctggccctggctgtgccctttggctcagggctgggcccgggaggctggagaggtgccagggttcattgccagaggctgccttgcccctcccttgtgtccttgtaggcagagccctcacccccctatgctttcccgccacccaccagccacacctccttgcccaggcctcagtgcctgacagatggcctgaatacatatatatatattttttgtcttaaaaaactattttttttaacatatctacagactctccccttaccaggtatttcttggggaagaaaatgttgcttagtagacaaatgtccccaggtctccttcagggaggatgagcatcacctgcattgaggaaggggtgcttcagcagagatgctcacttcaaagcgagcctcactagtagccacagggtgcacagctaggatgggaggcagtgctgctgagccaaggggtggtgggagcagctctggagaaacctggtcgggtggtgggtgaagctgcctccaccccagcaagcgatatggggcctccccactggactggggaactgtgtatgagggtttggggtgcagagacctcaggtggccttcaaaggaggggtggccagaggcccagcaggtgactcccacacctcttttacatcatctcctgctgaacaccccagagttccctgcttcttacagtggtaacatttgtttaggagttgtgcagtaagtagaccaggcatggtggttcatgcctgaaatcccaacattttgggaggctgaggcaggcagattgcttgagtccaagactttgagaccagcccgggcaacatggtgagaccctgtttctataaaaaatacaaaaattagccaggcaaggtggtgtgtacctgtcatctcagctattttggaggctaaggtaggaggattgcttgaacctgggaggtggaggttgcagtgagctgagatcacaccagtccactccagcctggataacagagagagaccctgtctccaaaaaaaaaaagagaaagttttgcataaataaagttaaattatttaaaataaaattatttaaaataaaagttaaattgtttaaaataagctaggagaaacttgctacttaaagacatcttttgggagaatttttattcagaagataatcatttatcaaagtgattgagtaacctgtaatttatccagtggagtttaatttaagcatttgaatttcatgtttacccttttagcagctatcattgaacccgtcttggtagctccaaagcacacttaaatatgagatgcagcccctgcctccattggcttatggactgggtgggtgtgtagccaccgtgtacagaaagttaaagatggttctagggaccaggcaaacagcctggggtgagttaccagaaggatgatgtgaatcatcgtgtgagattacaggttgcccatcaccatggccagtgcctctgagggtttgttgggattagaggggcagcttccaggcctttcaggagaggagggtctttacatgtcttttgtgggtgaggacctgaggcaagcagagagagacagccagagttacgtggggctggaagaaatcaggccagagtgactgggacccttgactctccttgttagagggtgtgtttgtccattttgtcctcttataacgtagtaccacagactgggtaatttataaagaaaagaagtttattggctcaaagttctggaggttgggaagtccaagagcatggtgccagcatctggtgagggcctttgtgctgcctcataacatggtggaaggcatcacatggcaaagagacagagagacaagataggggctaaacttaacctcttatgaggagccctctccctgggtaatggcattaatccattcctgacggcagagtcctcatggcctaatcacctcttcagcatactgtctcttaatactgttataatggcaatcaaatttccacatgagtattggcagggacttctgaaccatagcagagggactgccttccccatggatcctggtgtcctgcaccctgggcccagtccactctctggctggcacctctggttttgccccccaggactctgtaagctctagccaaggcagctggtgctgtgcttgccagctctgtgctttgacaacaacttctgccttccccacactgtctgaactccagggtctcctcttcgttttggtgttgggggactctggctcaccacagagctcctctccaggcacgtccctccacagcacctgggaaatccccttttctggctccaagtgacctatcttccgagggctacttgggaattcacagaacctcagctatggagaagctcagaggattgggggattgaaaccgtaggtcatccttgaatggttagcttttgaaaataattgtgcatttttccgtggtatgggttggtttcctgtcctgtctccacagtgctgaaccaaatcagcaacgctgcactttgcaactctgacagttgagcttcctggtcctgcgattagagccctcaagatagtactgaagcattaggtgaacggtggggacagaagcccagactctgtctggagtaggggccctggagggacacacacccacttcctatttggctctgtcctatatgcaggcattttttttttttttttttttttttctgagacgaagtctcactctgttgcccaagctggagtgcagtgaggccatcttggctcgctgcaacctccacctcctgggttcaaatgattctcttgcctcagcctcccgagtagctgggattacaggtgtgcgccaccacacctggctgatttttgtatgtttagtagagacaggatttcactatgttggccaggctggtctcaaactcctgacctcatgatctgcccgccttggcctcccaaagtgctgggattacaggtgtgagccactacgcctggcgcatgcattttttagaaggaccttgagatgatttactattgttgatcaaggaagaagatgaagcggggagatatgctgccttgaaagtgtcctttgagcatgcagccttatttcagctgtatgtcagggtgtgtgtgtgtgtgtgtgtgtgtgtgtgtgtgtgtgtgtgtgtgtgtgtgtgtgtgtatcagggttgctgctgaggagttgcattgcttccctaaggcccaccagggagattcctgtgagggggtcagacagggcctttgaagttttatgtgttattaaagaaggtcgtatcttattaccacaaagacctgggatatctgcagcagggagtggtagaggagaggctgtcaggccagcccttaacagcgtaactctctcattccttcctcagttcctccttatcctcctggcatccagctccccatcagaaactgtgaatcctaagatatgatgggaccatggacccttcacatttttgtcatattcattatagtggttctcagccttggctgcatgtcagccacccagagtgtccaaattctcctcacccagaaattctgacctcatggagctggggcaggatccaggaattgatattttttaaacctcctcaggttgattctagcatccaaccggggtttaggcccgaggaccacagcctgccagttttcgtgtggcgtgacctttcctgccgatgataatgctgatgatgtcaagcctagctgaacgctgatgggcagtgtctgattaatcgaatgaagtaaaaataaacaggttttaacttaatgtacctccccaaatctgtaaagagatccatggatgacatcagtgctgtccaggatggagtaagcccactatcgtccattccactcacggattagaactcaaaactctgaacagaatgaaaagcaaccccatcgggaagggggttggagcttgaatgcgcagcacattagaatagagtttctgtggttgggtttttttccctcctttgatctgagtgctgactgatttgggaaatagcacagtgggcagaggcagcaaaactctgtgagaaacccatctttgtggccagagggttgaaaagaggaacgctgcaagctgaagattaggagggatcactgttttgttttgtcttttcctctctcctggccctgccagacccagagcagtagcacctactaccctgagagaaaatccaactctctggttggaggaaccggttgttgcataaaggtggtgggaagaatccccatttttttctctttctcattctgctttgccctcagcaggggctgcagttgcaagaaactgtgaaagagtgtgatgtgttaggctaaaactctgggagagccccaactttatgggcagaggaaccaggaaaaggtgcatctggtagtagcggaatatggaagaaatcttggagaggggaaatctggaaaagagggtttatttatgtttctgaaccaactccatgtatgggatatacccagagaaccatagcaaaggctttggatttaagctgcaatagaaaccgtggcccgggtcccagacttaatccctgaatagctcgtgcttgaagccaactcacagagcacagcaaagggttttgaaaccgcactgacgttaactccatcccctaacgaaggggaaccagagcttgtgttctcaacctgagtggatttatcgtctgatgaagcagacacatgaaaatcaacattctctacattctcaacattctctctcattcaacatttttaatcagggttaaaatgtacatattaaagcgatctgggatgcaatctacaattatttgggatacaaagaagcaaaaaaatctgactaattcttcagtcaatcaattaaaaatattttttaaatgacccagttctcaagggaaaaggcaattaacaaatgtcaaccctgagatgacatagatgttgaaattatcaaagactttaaagtgactgttataaccatgttccatgaggtaaaagatggacagttctgaaattaacagaaacatagaaattcgcagcagggcaatatgaaaaaaaaaagaaaaaaataggaattttagaatgaagtaaaaatattactggatgagttcaaaagcaaatgtatatgacagaagaaagaatctaagttagctctaagtagatcaatagaaattatcctgaataaaagaaaaatgagtttaagaaatgagtaggccaggtgtgatggctcatgcctgtagtctcagcactttgggaggccaaggtgggaggatcattgagccaggagtttaagatcggcatgggcaatatggtaagacctcttctctactaaataaataagtaaataaataaaattttgctgagcctggtggcacacacctgtagtgccatctactcagaaggctgaggcaggaggatcacttgatccccagaggttgaggctgcagtgagccatatttgtgccactttactccagcctgggtgacagagcaagaccctgtctcagaaaaaaaaaaaaaaaagcaattattaaaaaaaggtatcatttacaatagcatccccccaaaaaagaaagaactacatataaataagaaaatatacaagatccgtatgctggagactaaagaatactgatgagagaaatcaaagacccaactcatggaaagatatatttatattttggaagattcagtatagttgtgaattctccccaaatcgacctatagattcattgcaatcccaatcaaatttccagcaggatttaaaaaactagatattgataatgggattctaaaatttatatagaaaaataagggatcaatagtggaaacaatggttagatccctggtgaaaaaatattcctgattacatgcgggagaatttcccagaagatgaaaaacaagggaactctgaactttgaataaagggcacatgatccttatggactttcttagttctctagggctgctgtaagaagtccacagactgggtggcataaacaacagaagcttactgtctcagttctggaggctggaagtcccagattgaggtgtcctcaggactggtgcctcatgagggctgtgagggaaagtctgtcccatgcgtctccgtttgcttgtggtggtttgctggcgatctttgatgttccctagtttagagccctgccttcatcctgtttgtgtgactgtctccacaattcccctctttagaggacaccagtcctattgggttagggcctacgcaaattactgtatgtcaactaattatatctgcagtaatccccttcctctctctctctcgctgtctcttcttttctttctttcctcactgtgttgccaggctggagtgcagtggcccgatctcagctcactgcaacctctgcctcccgagtttaagagagtctcctgcctcagcctcctgagtagctgggactacaagtgcatgccaccacgtgtatttttagtagagacagggtttcactgtgttagccaggatggtctcagtctcctgaccttgtgatccgcccgcctcggcctcccaaagtgctgggattacaggagtgagccaccacacccagctgcagtgatcctatttctaaacaaagtatattctgaggtacaggggatgagaacttaaacatatgaattttgaggggacataattcagccataacacggatgtggcttattttaaatctacacagtactgtatgcacttggaaatgactagaaaaatgtgaaaatcacagggcaacaagcagaagcagacttttccccctcgagtcttgtggccgcttctctgggggtgacagatttctttgtctctgaggatggatctggtagagggtgtatttagcagtgtacttctttgcacggggtcctggcagctgcagaagctgcgcccctttctccagcatgttaagaaaaaggtcagtgctggtaacgttctgtgttcagttgccctcttatctggaccctcgcttttcccctaaaggcatccaggagcaaacatgacatgcagaggtagactttgccaaggcaccgctatttccagaagttcttgtgggagagagttgacttcttactgttagacgtaacccaggaagaacagcaaataccggccaggccagaagtgcacacagttactctgttcctgttacggcattaatgctgctttcaggcgtggactacattgtgagatattgaaaatgccatttcctggagactagtattgatgatgaaggtctgacagcaattttaatgatgtttaaagggcagatcatcgccctttgcgtatttcgagatgaggatgcagtggggcagatgtctcagcatattgaatgcccagaaggaagaagttaggcccaacattaaccccaagcctcttccaagggctgctgagacttaacacccttcccaccgcagaaatgtcacctgacaggtatggctgcccaaggcttcctgggcttttttatgcttgtcttttttatgttatttgtctgtagaagtactatagccaggaatgactagaggaaggaaataggtaccattgtcccatcactcgaaggcagcccttgctaacgtcttaatgcatttcttcacagttgattctgtgtttatttgttgtgaataaatcataacaatacatattacatgctaagccttttgtaaatatttcagatgccacaaaattgtcttgtggaagtgctaacactgatttatctaggatcctgttattgaaggtttagtgtgtgctcaatatttttgtccatttcactgccgttttccaaagagaacacatccctttgtgaccctaagctaggttagagagccttgcttgacagtgttggatatcagtattgtttttggaagattaatttattagtgtcctttcagagcttgcggttgcctgtgatcttgaagtgaaatacttattcggtgacttttgtctggaatgcttgggctgattatacaagcattctccaggactgttcaaacccacatcatgtatagtgtatagtgaaagcaactaaattatatttgaaaggaacaaaataatattatctttacaacatgtgagaccaaatgggggacaagattggtgtcaggaacaatttggctgagtctgtttctcatttgtatgatacgttttcacccagcctgtattgtggtcactgaatagctatttttcatctggtctgctatattactagctcttctaagcaccagctaatgctattttcccgtgcaaaagaaaaacatggtttagaataaggacactggagctctttattgttgacaatgagcctttatttctcacatctaattagaatgtttcaggaggcgagtggtgagcacggtgtcgggggccgcattagctattgatttatgtgctgttatagaattaattgagtctggacatggagactcattttcttggacatgtagcaggtaatcatgcttctcctgtacatttgaattgctttccagatggtgtgttgtacaggatttatctttaatatgattgactagaagcaaaggacctgagtgtgtttgcatacatgctctgcaatgcaaagcccccagcccccactgtagagatggttaactctctcctggccacaccccccctgggctcatatggggacctgggccttggattgacactgtatgcagcaaagacagcgtcaaagggtcctggataaaggctctgggaggggagaaaaggcctatagtatattctgagggaaacagaataaacagcattacttattatgcaaaaccaggacataatgtgggttcagcaggggaatagttagtgtcttagtcagctcaggctgctatatcaaaaaacaccatagacttggtggctccaacagcagacatttatttctcacagctctggaggctgggaagtctgtgatcaaggtatgggcagattcagtgtctgctgaggtctgtctgctttctggttcataggtggccatcttctttctgtgtccacacatggtgaaaggggcaaggcagctctctggggtctttttcttctttcttttttccttccttccttcctctctccctccctccctccttctctctctctctctctctctctctctctctctcgtctcgcactgtcacctgggctggagtgcaatggcgtgatctcggctcactgcaacctccgcctcccaggttcgagtgattctctttgcctcagcctcccaagtagctgggattacaggtgcacgccaccatgcctggctaattttttttttttttttttgtatttttagtagagatgggatttcacaatgttggccaggctggtctcaaactcaagaccatgtgatctgccagcctcggcctcccaaagtgttgggattacaggcatgagccaccacgcccggcctggggtctctttcataagggcacagtcccactcatgagctccaccctcatgacctcatcactccccaaagaccccacctcctaatgccatcacactgggggtcaggatttctacatgtgaattttgggggcgatgcaaacattcagtctgtagtggtcagatgatatctattcagctgggaaataggatgtagccattaaaatgatacctatggagagcttgtgttgcttaccgcatgttaaaagagaacaacatggatttgtgtttacagtaaggtctcggctatgcaaaagagatgcacagataaaagactggaaagaaagaaaccaccaaacaaacactggctttctatgggtggaacaactgtgagtgggcatccattcctctctatatttcctattaagaacacagagcaaaacagattgtagtccttgttgctgggaagtaatgtgccctcagaaacagtcaccctctgagtacagaagtctgcccacatcagtttcacaaatgatgtgctagatgattagtcatatctccggctctctcctgccctcctacagggcagctgtccccatataacagttgtatccctagaaggagtatgcagttaaagtaattggagattctttgaccagacgttttgagagtctggcagcccggaaaggtgggatttggcagctatgtgggaccttccttcaggcactaaagggcttcctgaaaaagttgcttacacattgaggtgtgttaaatggaattctttatcataaggctgcaaactgcttctgtgcaaaaggcaatgtgttagttccttgcaggaatatgcttttagtgaactcaatgagataccagaaatccagtaggagaacactttctttgaaagaaccacttgtttctacctacgtttttgcccacctttccttctcacctccccttggccacaccccacttttgtgtcttgggaattatctgctgtgctctgaatagccccgtcctgccaggccacccacctttgcccttgtttgaagaagctggggacagttgtccttgctctccaccccctggagtaggggaagaaggcttggaatgtggtgggcctaggcttcttggtgagggccttgtatttgttgacaaggaggtcagatccattccctgggccgtcatcagagacctgcaagcatctacttagggcagagttttcaagtgcagtctttggacctccaacatgagaaccacctgcagctctagacctggcctttggcccacaaccttggaatcttgggccatgaacctgcacactctccaggtgggccttgtgcccaccaaagtgagcgaatcactgcattggaggagtgactcttggcttttcacaaggacctctccctgctttcctcagtccctccaagatgcacccatatcccactgcagggatgcaatttgcatacatagccagggacagtgtcatctggccacagccactcccagccacctgtgtcagcagagttccccgttcccatctaagacattcacctcatcaggcatctctcctggaccatttcattgacattttccttaactccctttatgtagtgtttatggagttcaggcctgcactggttgctctcttctttaactcgcttcaagccctgcaggcacatactgtcattttcagtttcctaaggaggggaaggccatctctccattaaatatcttgccccaggcctcacagtaaacagaggtctgaattgaaacaaggaccttcagtcttcatctttaacaggcgggctctttgtcttataccaaaagtgccccagtaggttccgtgtaattctgtggagtctttgaagacgtggctgccttctgggtagctgctgtgggtcccttaccctttgcactcatgggaaagagagctggatcagaatgtctgtggtgtcaaactcaggaaaagagctgccattagccagcgctagcattgtagtcatggtgaaaaacgggatcattaccagtccacagccaagccatattgcagcctgaggcaacaggaaaaatcaggaataccaatcctatcttcatttacaattttgatattttgttcatcatggatttattttgccttagttttgatttctaaagcattgcattaaaatattatttatttttgattgcttaggtttttggggcctccctgatctccccctggttcagccatcgtaaagtgaaagcattttcattgcaatgaggaataagtcaagggtgcctgttagtgccattgttaactcctcagggaagtgcagggcagggtagttagacaagatgaccacatgccggaaaggggaagcaaaatggtgacttctgaaagtgacatcatttacctagaaaaacattatcaactaaaaactattaggatttaaaaatagcttagtaaaatctatttttacaaaatcaatatcattttttttctgtatgccaacaataaccaggtaaatatataaggaagagatctattcgcaacagccacagaaatattatatttaagaaaaaacttaatatgagatgtctacagctataaagaaaattacaaagccgttgagagacatttaagacttcaataaataggaagatttttttgggtgaaattgggtaaaaagactcagtattgtaagtatgaataatttctgaggccggggcacggtggctcactcttgtaatcccagcactttgggaaaccgaggtggctgatcacttgaggcaggagttggacaccaacccggccaacatggcaaaacttcatctctacaaaaaatacaaaaattagccggagggtgatgacacatgcctgtaatcccagccactcaggaggctgaggcacaagaatcactttaacccaggaggcagagactgccgtgagctgggatcgtgctactgcactttagcctgggcgacagagcgagaccttgtctcaaaagaaaaaaaaattccctaaagtaatttataacttaaagttactccagccaaaatttcagtggaatattggggatacttggaaccactaactcttaagttcttttgggagaataaatgtgaaaatagcaggggaagatgacaaaatgagaataatgagagagaacttgccttatgtcgtattaaaatatgctctaaattcataataatgaaaatggcatggtactgttgctgggcagatagaaatgatgtagactagaaagtccagggacagatctaagtttatgtaagaatttagtgtatgatggctgggcggggtggctcacacctgtaatcccagcactttgggaggctgaggcaggtgaatcatgaggtcaagagatcgagaccatcctggccaacatggtgaaaccacatctctactaaaaaaaaaatacaaaaattagctgggcgtggtggtgcgcacctacctgtagtcctagctactcgggaggctgaggcaggagaatcacttgaacctgggaggtggaggtttcagtgagccgagatcacaccactgcactccggcctggcaacagagcaagactcagtctcaaaaaaaaaaaaaaagaatttagtgtatgacacgcagggtgaccagccatcccagttcctgtggaactgagggtttcctgggacatgagactttgagtgttaaagttgagatggttggtcactgtaaaacatgagaaacagaatagtctatttagtaaagggtattgggttacctgagtaaagctgtggtgcccacactttgctgtatattggaatcacctgggaaacttttatgaatactgatgcctagttcctatctgagacattctaggttcattggtatgtggtgtgacctgggcatcagggttttcaatgggtaacaaaacttgaaaatcactggggtaaccatcgtggagaacatgaagctgctccctaccttgtgtgtttacactttctgatgggttaaatatttcagtgtcaaaaataaaggattctagacagtgactggatttgcttgctccaagggaagaggtttgacccctcccatgaaaagtctggaacttctggagctagggacaggtgcagcacacagactcagggagtttcaggggagcaccttattcctgtgcctctaggaagggtggacattttccctggaagcaagcagatctggctgaggacagcctatctctgtcatacctaaaaaatacaggcacctcttcacatctcaacagtgaagtcccagatgaccaccctgactgcctccagctcaccataaaatcctctcccactgtatcttacactgcccagccatccaccagtcgctgaaagacatgcactggtgtctcaggggccctttgttgccagcaagagcaaagacaggtcacatgctatatcttgctgaaaagtgagttagtgttttggaaggtcaaatggaggaactaatttataccacacagaaaaaaatgtgaaatgggtgctatgagtgtaaagttcagtgatttggagggcaaattccagagatattccagaaagagaaaaaggccattagggagagaaataaaaaagaaatagcaagaatcttcctgtaactaaagtaagatgtgggacttgattcggaaagggctcaccaaatgaatctcacataaaattaatgagaccctcataaaattaaaaaagacccttatctagacatagtttgctggaatttctgaactctaagagtggagaggaaattgtatcagcttccagacggaaggaatagatttttgtaccaaggtaaaaagaatctgaatagtattaaaatgcacatctgcgagactgtaagctagaagatagtggaacagtgttagcaaattattgtgaaaaggatgcaatacaataatcttatacctagcaaaggtatcattctatgtgagatcagagccattttatagatacaaaagagttacctcctaagtaaacaaaatgactctaacaattatttttacaaaataaaaatgaaatcccactaaatagttcaagagaaagaaatgcaaaaagtataggaagcagtggtaagttatgaattgagtaattatagtccaaattatattgttgtcgtagtgttatacatctggaataaatttttctgaaatcatctgaaggcttggagagctaataggaaacaccagtggaaaataaactcctggttctattgtagttctcctacaatgtcctcagtgttttcatttttgaaaacttgaataacattttaataggatctggactgttccatgttactgtaatgtgtattttagtccttatgtcctatattggcctagagaatattttatttagtgttggtatacatatttatatgtgcatattacagattttatccccccgaatgacagagattttgaagttaagatagcaagagtactgtgtactttagtttgttctcttaacaaggatgtgcataccttcaacgtgcacagcttgatgtcagagcctggcgagaaacagggatgctgtagagatggcaccgctatgcaaggaatgggagctgtgtgctcatgtgccagtgatgtaccatctgccctttgccgtcctgacgtcaagacatggacgtctggttgcatgttagcagctgcattcagcacatgcttctgagagaccgttttgaggaatgtagttactggagattgtgtctgagagttgtggttgctaagtccctgacatcactcctgcagcctctctcttgtggctggctgtcctctgtgaagataagaaatctggtgacaagttatatgtggtctttgaggcagctcagtgttcttgatgtgtcctctgacacatctgggttgcagatgtcttagtgagtgctggccccttgttctcttctagggaacagctctttcgaattgtcctgccagtttcagggtttgcgaatggggtgacgggccctgcagggtccatctcagtgacaattttcctggtgtgggacatctttgctgtctgtgggccactctagggggagtgctgtgaattgctccgcataccagtgatgctcctgaaacacggccatggacaagcctgtgcaggtggcggagtaaacattgcttctttagatgtcaagtgtccttggagtgaattcacacgttggaagcatgtggctccatcagtaattgtgcccacactctgagtgtctggactggatgaaataattatctccttcttcgttcttttgggaatattcatactgctgtaaccgtgaccatctggtacactcagtctcataacaagatgtgttttgggcaccactacaaacaaggtgctgtgtttggagctctggggggatacacaatatggaaggccttgagtttgtggcctaaactaaagagacaagaggggaagaggaggtacaggaaggcaagatgagagcccgggcagtgactgctgagggtcactgatagctcctctttcatcttcacttcctgctcccatctgagcccagatccctttgcttctgccacctaaggtcctcactgagccacttctccactgtcctctctactgttttagtttaagctctccttttttttctttttaaaaattgcagtaaaatagacataaaaaatttagcattttaagcattttcaagtgtgcaagctcttaactggactactggaatatgtttttttaaataattgaactatcatgcaagcaaaaaggcatgtgtaatgtaagagtacagtttaaagaatatgacaaacatttggggaagcaattagctgaagaagtagaacgttgctgggcgtggcggctcacccctgtaatcccagcacttttagaggccgaggtgggcggatcacgaggtcaggagatcgtgaccatcctagctaacacggtgaaaccccgtctctactaaaaatacgaaaaattagctcggcatggtgggggacacctgtagtcccagctactcgggaggctgaggcaggagaatggtgtgaacccaggaggtggaacttgcagtgagctgagatggtgccactgcactccatcctgggcgacagagcgagactccatctcaaaaaaaaaaaaaagaagtagaacgttaagcaaacttttggacgtcctctgtgccactttcctgatgctagccccttgctttcccccagaagagagaatagccttttcactggtctccctgcctctagcctctagcctctgtccccacgccaggcccagagagacagggctaaaagaaaaaatgttgaaaatggctcagtgactgtgcacatgtcttagtctgttttctgttgctataacagaatacctaagactggttgattataaagaatggagatttgtttctcacagttctggaggctgggaagtccaaggtcaaggtgccagcatctggtaagggccttcttgctatgtcatcccaaggcagaggtgagaaggtgagggagaatgagaaagagagcaagagagagccaaactcacttttataacaaacccactctcacaataaagaacttcctcccaagataaagacattaatccattcatgagagcacagccctcatgacctaatcacctttcaaaggtcccacctctcaacactgttgcattagggattaagtctccaacgcatgaactttgggggacatattaaggccatagccgtgtggtttgggggataaagtgcagagtcctgggcactgggtccaggccctctcccagtttggcctgccaggtctctgcagctgccctgtcaccccacgatacctgcaggctgcggctgcaccctttgtcctcttctccccatggccgagcagtgctgtcccctctgctgagccctccagcctgccacgctggggacttgtgtagagcttttctgcacattgctcagcctggatggtccctgcgcatccagttcctcggtgaacattgttcagtttgagggggaagaggagggagaggatgggataagcctgaaggggaaggtacccaagatagtctttgaggggtcatggatttagattgggaagagttattgtccctcctcattggtcctcattatgtcttcttaatgaaagctgctcattttcttcgtgagagcaaacaacctgatcttctgaccatttgtcttggtcacctgggctacccaaactgagtgagaagtcaggaatgagccggtaggttcctggggagaggcgtgtgtcctcgtgagttgccggtgcctcccttgactgcttttcccggagctctgtgtgccctcgttctccttggtgtggatgcgtgttgttctgatgatgagttagcgggggtggggatggcgcactgtttgaacagatgtgccctcacatggctgcgggaggacgtggtgggaggtgctgtggtgaagtggccccacacatggctgggctttgtggggttttgactctgtccttcccaatgttcctccccacagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtaggaccctggctgtcctggggaagggagcagaggggcccgagagcaagggacctcagggtacaggccttgcagatgctgaagcgaggcggtggggggtgctgggtgcctcacagttctaatggtggctgagctcttcattggtccagttgggagacatgttgcgtggatgctccggccactcttaagctcaccgctcagactcaggactaaagccggttgagggctgagtggcaactcgtgtctcgcagaagacacccctcctcccaccctagaagagaggttcgatttcttgcccactgccctggtctgctcatggtggggcagtatgtgtgggagagcccctcaatcctcaggggtgtactcagaccagcagggcagtggcaaagacgtgggggtgctggtgctcacccactgctgcggccagtgttgggtggcctggtggctggggtcggggccagagtgcatttcacaatggacgggtctctgaaagcccgggggccttggcctgatgggcaatcagctgtgaatacctatttggaaaaggattttttgaaggtttgacaaaacctcggggaagaaacgcatgctaatgagggcagtggatgtcagcataactgtattttaattatagcaaagtcagcgtgcattctaataaacacatttgaaaagccaccttccaaaaaaagcctcactgtgagtatataaagaagatgtgattattggacttgtgtgaaggaacttctatttggccaattatgtggacttctgtcatatttttttacagccttaactgttaaatatttttttccgagaagagttcatgaatttgagtgtgtgtgtgtgtgtgtgtgtgtgtgtgtgtgtgtgtgtgtgtactgagagcttgggtttggaatggaaatcattggattttcagcacttatattttaattgactcctggattttcagcacttgtattttaatgtcttgtattctctctaaagaacgttaagtgtcagttgacttcactttgggggtgttcctgtcattcacagcaattccgtgtttacagggggctgtgggatgcataggagctcccatggtactagtgggtgttgggagagttcacccctaaggccaggaggctctggaccctgggtctgggctttaggccaaagcaaagtgtttctttggtctttagcagggcctgggcttgtcccacaacagtggtgaaggcacctcagggattgacgtgggctgtgcagagcgtgtgacatgctgcgtcttattgtgacaaatggcatcgctagccaagttcttgtcaaagaagattatctttagagcgtggtggggagtaagcaagacctgatattttctggttttgtgcttcatgctaaccagatggtaatttgggtaaaaacacagagatcttgcgattggagagctgggaggtaaatgagtgggaatgaatggatggatgggtgatagtagctgtttaaaagggcaggtggaggtaggggaagtccccagccattgtggaggatcaagaggatgtctgttcttcccagaagaggcattgaatgaaaaagtatgtcacttctccccctaaggagaatgtgtccttgaaggacatgctcttgtctgagacactggaaaagttcatttaaactggttaatgattgtatagcttttgttttgttttgtttttccctccctccctcctttctgtcctttcctcctttcctcccttcctcccttcctccctccctccctccctccctccctccctccctccttctctccctccctccctccctcctctctctctctctctctctctctctctttctttctttctttcctatcagttcacaaattaattctgtcaaggggaacacctgctagttccagagttccaggctgacaagtaccctggtgccaggggccctgactactctttctgaagactctaccaggcccgctgcacgtgggcagggtctccacattcttagatttgagtaccccattccagatgaggacctctttgaaacctgaccagaaagagccgtagaattcatcttgaaagcaagattttttatgaaggatgtgcactgggagatttggtgctgccttgcttgaaataacaacctgctttcctaagaacaatccccttcctcccctgggggacagccaggccgtgccaggagccaacaaaggcctggcctcaagcaggtgcacagggtgccatgtgtcccatgctcacctctctgatcccagtgctgtccacatagtgtagtgatccctatggttgaggctgcagtaaaaaaaaaatctgaagggagaaatgggcaatattggtcacttagatgctgtagactcctgtttttaaccctaacccagcagcattggcattactggggagccccgcccccacattgctgaatctgaaatctgcatttcaacaagatgccacattccagctgtgatgctgtaggagactcacttggaggaaattgtgtagcaaccctcccctctcttctactcattttacagcttgaaaaagtgtgtcctggatattttgaagaggactgaatagcatttagtcattgcacgaatggcaatagtaaaatagagttagaaaaaatgggaagatgaaaaatgtattctccatggtccctactaccctaacggatgagctatttcatcagtgtgccttttcagaccatagcattgagcataaatgatgtacgtagctgtcatcataacccagatgtatttttgtcatacagtttttaaaatctgatgtatgataaatgtttctccatgtcaccatataattttcatgattatttgtagtgacctttccatgatccatttgggcgatgatgtgctgtataacatatttctctgtacacactctaccattgagcatgcagattgtgagtggcattttctcttaggtgtaaggctgccacagacatctttgtacaaaccatgttttccttctttggtttattacctgaggataaatccccatgccgtacatcaacgttgaccatttcccctcgatgaccttgcctaattgtttcccttcttctgtggatgttggatgcatgccctttatcttttggggtttggatgcatttccatctcatagaagcactctctacactgtaggtgtgacttcctgttgcgtatgtcctcatctttagtacattttcttttgaattttggttatattattttcaccatctctgcagcatttttaagatgttaatgactcatctgtgacccctccacctcctttcggtacagagggatttaattggatgtttccttcttccctgtctgggtagatgtattcacagaggacattgctttggtctggtcgatacgaaaaatgagttgccggctgggtgcagtggctcacacttgtaatcccagcactttgggaggccaaggtgggcaaatcacctgaggtcaggagttcgagaccagcctgaccaacatggtgaaaccctgtctctgctaaaaatataaaaattagatgggcatggtagtgtgcaccagtaatcccagctactcaggaggctgaggcaggagaatcgcttgagcctgggaggcagaagctgcagtgagccgagatagcaccactgcactccaacgttggcaacaaagtgagactcccacctccaaaaaaaaaagaaaagaaaaatgagttgtgcctgtactaagaagtaggttgtgtggcctttggagccctcctgagctgtaggatgccatgcattttgaaaaggctccagtttgcagggagccctcccacctgtgccactctgctgagaccaagaggtctgcccgggggctgggatatgagaggcacaaaggtgatagagtttctaaaattgtaggaagacaggttggggaacagagatctacacttgaattattttagtaaaataaaaaaaggttatttcaaagcactgcaagtttactgaggaaaatttggaaaatacaggcaaaaaaatcttttgccatgtggcattgtagaattccactgtagagttttcaaatcaaagagacaaacctaggtcaggatttcccaaaacacgctcttagaggtgttgtgtaaacaaagtaccatttgatccttactattcatggatttgatatttgcaactttgttaacttgctaaaattgatttgtaaccctgaaatcaatactcgtagcactttcccagtcatttgtggaggtacagagaggggaagaatttgagtcacccaactctcacgttcccagctgaggttgaacaaggctttgccttcttgtttcagctctcatactgtaaacagctgttcttttcacaatctatttaatgttctttgcatttttgttgatatgtgtgtgtgtgtgtgtgtgttggtgataaaatggccctcaagtgtggtgctgaagcctagtgatcctaagcacagaatggctgccatgtgccttacatgtgctagagaagcttccttcagggctgagcgacagtgctgactcgtctatgctgccactctgggaggtgctaaagtaaacttctgtagcgtatgatgaagttaaggaaaaggtggaggaatggctaaatttgcagattcatgggacaataactgattaaaaaacacatagtggacaggtagaaaacccaagaactttactgtcttgtgatctagggtcagggaaatgttaaactcttctcagctagtgttttatgttaaagaaatattgcatataattaattatttataagaaatctatattaaacaaggtgcgtataaacagaaacacacataaaacaaggttctgtgttgattcattgacaaaaatgtgtcccgaggctcataggaacctaaccctgtatcgcccctaggagcaatgtattcagtattcatcaactcagtgctcagggcagctttacagaacataactatgtgaatgagaattggttgtatttggttggcaaatgactttgggaaactttgctgcaaagtttttcccttcttgggggtttactgatttctcacacacaagtagcataaagtcccacgttcgctatagcggagacaccagccagcctggccagtgcttcccaaacatggtgtatcagcaagcccttttccctccatgcagggtctgtgggagaatacagacccaagctttacaccctggggagtaaaggacccgtacacatgaactcccaaggcctctccctgtatgcttcagttccaagatgattcagcaaccccaaatggtgatgatggaaaggttgtcattgtgttatcatcaggacccttggcttctgcagatttaacctttcttattttgtggtttgtgtaaagtccgtgggtgccggtggaggtggcagcagtgttggcggtgactgccagcaccatgttaggggtgttaggaatatgatcgcagtaaatcctagagcaacccagagagagggagctagggttagtcccgtgttgcagatggcacagttaagtagctcacctgtgaatagactgtggactgtgttatgccaaaacccgtgcctctgaacagtgcataacacagcccttgaagaacctgagaagagaaagcgtccagttctgttcagtccgcgtttgagcctgcctgctggagggtgagtcagtgtgggggaactgtgcagtgttcctcctggagagtgatggtctcttctcctctgttgtctgtttccttgctgttgaaaggcttggcgtgccctgttgttctcagtgagtgggatacggtgccagtgaggtgaccagtagatacggaagcctccggtctgtaaaatgtccccatctcagtgctaacgtgtcctaagttcaccagggctcaggccacagatcaaacaagtcaagtaaagattgttcatgtggcatttttcttaatttttttgagctttgttgacataacgtattgattttttttttcatgcagtgattaaggaatacatgagttgggtccagcaaggctcgtattgtgtgacctgatggaattagtattactacacctacccatgtggccctctactatcaggcagtgaagcgtgagtggagggaggaccccagctgggcactggtacctggctcagtctcacagctccagggatgagcctgtggacctggcacgtccttggtgccttcccttgaagagagtagtttgctcatcagtgctttccctggggcaactcacccacactcctggggggcaccataagagcgtttgtccagcaccaaagatcctagttctgtgggtctgtggggtggccctggatggcatgttctctggatgcctctgggtggcctgtggaacataaagggtttggcgagggctggacggattgttttggagccccatcccacctgttaccttgtgacgtctatcaggagatacactgaaaaggtcagccctgcctgaaattctccctgtagagacttactcctttggaccttggagatttctggagctgcaggcattccttgtccaggacctccatggctaccgagttgaggtatttgatttactcagcaagtgtagaatagctccacaccttggaatggcaaaccaaatatgcgttttgattatttggggttttcatgatttctgtttatccctgacccagctggtgctttctagaaagagccttctgccaatagaaaaaagaagaaaaatcaatacatggtagccaacttaatacaagttaaagggaagcatggtcgagggccccgaggccacatcgaatgcagaattgtgcatcattgctcattgtagagatgctttggccgtgacttggcattcagtagaggcttgctttttgaagaaccttctgagagtgtgataggagtctggtgccaagggagagaaggtgctaaaagcacaggtaactgggtgtgtcccccaggtgggaggcagtggtaccgtgtgtgttctgagccacggcctcacacacatgccccgctgggcagcatatgaagtgagtgtcagtatctgctttacagaagaggactgagacaagagtggcatggggttgttggcacccaggcgccccccctccatcagcgtgtggtggggcagcaggtgtgcagatggggtggtcctgcacagaggggctttggggcttgcactgcgcccaggagggagtggtctggggtttgtctaaacctggcccacagtaggatggaacttgggaaagagcctgtaggtggtgctgagggcagggggttatggggggcattggggcatggtctgcctgggaaggggaaggtcctctccagcccccaggcctcagtggagtagtcggctccctcctttctgcagccatgcctcagattctagtgtcccttgccccgcccacccatggcgtcaggcctagcactcctgctctgcatacggggaggctgcacgggagggttcttggggtgctcctgtgtcccctgtcgtctgtactgaaccccttcccgtgcagctctgctcccagcactgtgacagggtggacaccgcacctcctgctactgattcccaggattgccttgaaaaataaaatcctacgggtgtgcattgacgtttcaatcctggctggctccgcatgagcttctgaacttgatgttcagaagctcagggcccatttgctgagtcagcacagctgccttctttgatttgtatgaagccttttgatgttttgatgacatgtcaccatgggtggctgttattttcagggagcagtttatctatcaggatctgggattgcttcgggtacttttaaaatctaggtaaagccggggtttctaaaacattgttctaaaacattgtcagggcagagcatgtaaagctctcccactaccactaatagtgatctaaaaagtgcctctcccctcaaacacaccctagtcctcggggagaaagcagagtgcggtggttaggaatgctggagccacagtcaggaagccggcatcccacccggctgcagcagcttggggcccgggaacattctggatgggccacctgtgccagcagccccccatctcgtggggctgtggggaggggagttgatctgggtcagtgtctgtatgggtggggaggggagttgatctggtcagtgtctgtatgggtggggaggggagttgatctgggtcagtgtctgtatgggtggggaggggagttgatctggtcagtgtctgtatgggtggggaggggagttgatctggtcagtgtctgtatgggtggtgcggggagttgatctcggtcagtgtctgtatgggtggggaggggagttgatctggtcagtgtctgtatgggtggtgcggggagttgatctggtcagtgtctgtatgggtggggaggggagttgatctgggtcagtgtctgtatgggtagggagggaagttgatctggtcagtgtctgtatgggtggggaggggagttgatctggtcagtgtctgtatgggtgatgcggggagttgatctggtcagtgtctgtatgggtggtgcagggagttgatctggtcagtgtctgtatgggtggtgcggggagttgatctggtcagtgtctgtatgggtggggaggggagttgatctggtcagtgtctgtatgggtggggaggggagttgatctgggtcagtgtctgtatgggttgggagggaagttgatctggtcagtgtctgtatgggtggtgcggggagttgatctggtcagtgtctgtatgggtggggaggggagttgatctggtcagtgtctgtatgggtggtgcggggagttgatctggtcagtgtctgtatgggtggggaggggagttgatctgggtcagtgtctgtatggatggtgcggggcatggagtgcttgtgcagatgatgatgatgatgatgagttttcagtccatgggaagctcatcgggtctgggggaggtgggtgggcaagtccctgcacccagtttgggtacaggccatgctgggcaggggtgaggacactagtggacctgtcctcgggagtgacacaaaggaggtggtgagccctgcttgtgagataggatgagaggaggaccaggactggtcagggccacactggagctgctgggggtgaggtcgggtaagggcctcccaaggtgcccccacgctgtcccctctgcagggccctcctgaatgtggcttgtgccctgctggagaagttctcacatgcctctttctactccagagtcactgatttgggagatggggcaacagctgcacagccccaagggctgccctgattttctcacaccgaatatctaataggaagttagctgagaagcccacacacctcttcttccaggtaggcaagctgggcctgggactacctgtctctcaccgactccaaatgatagccaagcctctcttaaccttgggcaccttttttccagtttccaccccgaattcacactcttcaaagccagctcctcctgctgggctgctcctgatgtggggggccggccctccctgcaaatctctggcatggcccttgcaaattggcacctgccacgtggttggcactgggactgcaaaggtgaaagtggcattatcctgcatttgaaactcattctagagggagacggatacatgagactctccccgcccccatccaggtgtggccaggctccagacgagttccaggcaggcttccaggacaggctccagagttagggacaggcggagaggctctgtgactttgagaggggctttgggaagtcagccgacaaggtggggatgaacatagaggtgtgtgggtgtcctcagcatggaaggggctggaatcgtgatgtggctttgagcctgaaacaagacaaagggaaggcgagggacatgggttgggggatggtgatgagagagagacagagggttccactgggggcatggaggggagccaggagagaactggggagctgaggggagggacattaggaaggccagatgtagcagggcagttaggagatatcttactggggaagaaagcacccgttggcggtggccacctgttggcggggtcccctgagcctgagcagctctggtggattgggaaggcagaggcatgggaatggtagatggacagtgtctatagagacttgcacggagggcccaaggaggtgccagcaagccgaggtgctcatagtgtgtgtgtgtgtgtgtgtgtgcacgcacgcttgtatgtgagatattgacttgcattgtactcatctgccggtggggtgtctagggcagattgtggggagtgagagcattgggtatgggacccaggctgtccacgtgcgtctgcttcttgaggccccgtacctcccgttcttgggcctccgtgacacctggcatcatgcctctcttgcaccagaggcttgagagacacccagttggcaaaatcagttagtctgtgacattccctaggaagtgcagggctcggtgcaagaagttatagaagtatctgtttaggaagaaagatcgcatggctgaacacgctgagatgcgtaatgtcacccatggtgtgcttgcccaagatgtgatagcgtggtgatggcagacatgggagttttaccccaaagcattcagatcacaaccagtgccagtcagttactatgaagacatgtgactatggtaatagggggctgacctattagaataactcctaatcctatgtcagataataccatgggcagctcaagaaaactacgcacaactcagacatgtggagaaaggagatgtggaatggaatggagccctctgggctgatagaggcctccaggacttgccacacccacgtctgcccccaattccccagtcagccttcacagaagagaagttggtctctctccagctgagaccaagccaagacccaaagtgctggagctgaaggaagtttgggctaggctcacagaagctattgtcccctcctccagtgtcaacagctacccatggtccaggcctccatctggtcctggtccttttaagagacactgggtgctgactcacttctgggtctgtcccacgggtggcctgcctggtctgctgtgggtgcagccagactgtgcaggttcgggagcccgaggtggacttcaggtagggagacgctgctccccaagagctgctcgggtgtgacgtcagggtggaggctgttgctgtgtgtggcggcatcagtcatttaccctctttctcattagcccctgtccttcggcccatgtgcttgcaggtggcctctgattctgcttctggagactgtctgccccctctgattcattcattgcggccccagttatgtgaaagatagcatgttcattattcattcattgggccccacttttagatatacttgtgttcatcttcgagagagggaggtcatccagccattccccagtcctcaaaacccactccacaggcaaagcagtggtgggtcagggctcctcttgctgcattgcggccttgtatttgctcttctgagccacaagcatagcgagaaagtacaaaagaaaaggatttcaatggtattcaccctgaaaaaggaagaaaattgtgacacaggctgcaatatggacaaaccttgaagacgtcctgctaagtgcaatgagccagtcacaaaaggacaagtactgtgtgattctacttctgaggcacccacagtagtcagagtcatagaaacaggaagtagagtggcggtggtcaggggctggagagagcagggagtggggagctggtgtttaatgggtgcagaggttcagttgtgaagatggaagcattctggaggtcatcggtggtgatggtcgctcaacagtgtgaatgtacttaatgccactgaattgtacacttaaaaatggttaagatggtaaattgtatgttatgtatacttaccacaataaaataaataaagaaaagaagaggtttttcagtgaataactggtttgaaccaatttggatcctctaaaaccaagttgagccagtctgaacccatgtagccattatcacaccgtgttaggctattcttgcactgctttaaagaaatacctggggctgggtaatttataagaaaagaggtttaattggctgacagttctgcaggctgtagaggaagcataatactaacatctgcttctggggaggcctcaggaagccttcaatggtgacagaaggcagagtgggagccagcacttcacatggtgagaatgggagcaagagagagagtgggggttggagggggaagcgccacacacttttaaacaaccagttctcttgtgcactcaaagtaaaacctcacttactaccaaggggatggcccacatcattcatgaaagattcaccccatgatccagacacctcctaccaggccccacttccagcattggggattgcatttcagtatgagatttgggcagggacaaatatccaaactatatcacccacaaagaagcaaaaacattttgggccaaatcaaaactatttagatgtagccacagtggggatgaactgtgattatacccattcaggcctgtggacctgtggacctggcgtgtgtggtcgtgaggcggtgggtcggcacatccctgggaggtttcaggaggacattcaagaccaaaatgagccatgagtaaataacacaaccacatcctgagtgggagtaggggagcctccccttctctcctaggtcttgtatgggtcatgatcccgccttggcaggagtggaaggaacagatcccacaggctgtggcttatggtaaagtgattgtggtcatgccttgtgagtgtcattaaaataaacatatatcgttaaatccaccatcaaataacagctatttctgccatcctctcgccttttccacaagtttaaatatcccagatattctactgtgtatattcctaaaagcagacaggtagatttagtaaagttaactggatcattggtaccttctttatagatcatctggtgaaacttgtttttcaaattatgagttgtagggctttgttttaatgtctgtagccttaggcagttccattgagactaagtttttttcttattaagactaatcttattgactggaactgtggactcctcgtattaggagaacagagatgtggcctacataaattagtggaagttaaatactgtagaaaatgctctctggaaaccaaagtctaacatcgacttactactggtcattcaatttccttttggcttgggcaccatcgttacattcatttttcagatgtcaagctagttttctcagaatgtgtgcagggctcgaggccaagtgtggaggccacaggggaggtcacaggtcaagccttctgggagaactgcaagcttgagcctctgataaagtcacgcgattgaattttagccccagtaggttgctgtcgttaaactgtgcacacagggcttcttgcttttaagttagcaggatggaaaaattgcggatgtttgcagcaaatgtgtagaaccagtggcagaagcagccatgctggcccctaagcaatggtattagaaagggttgatgaagattttctcatttgagagttgaacaaaaccaaatggaattctccctagttccgcagcactggtgggtgactctccctgggccggtctcagccctgcagaaaggggcactgtctgcttagcttggtcagcgcagggtctactgcagcagagtgccaggtggatcacagccctcttgtgggggaaggatgggcggagctcccaccttccccacaaatggacacagaatggcacctggtatgtgaggcaggtgcaggtgaccaggagaaggggctgtcagtggttgatggacagctgcctctgctgcctggatgacccaccccctcccctggaccatctcccactttgcctgggtgtcagtcactggagggttagctcagtacaagctggcggatgacctccgtagagcttaggtgaaggggctctcacagggcagtatgtttgagacccttagagggctctctttactcttgcttctcctattatttttaaactgtagtaatacacacgtaacataaagtttaccattttaaagtgtacaattcagtggcatttatcacaatgttgtgcaaccacctctgctctttagttccagaacattttcgctgcccccagaggagaccctgtatttattaagcagtcactccccattcttccctccgcccccagcccccacagtgaaaaatctgttttctctcactttggatttgtctattccggatattccataaagataggatcagacaatatgtgccctttagtgtctggcttatttcatcatcatgttttcagggttcatccctgttgtagtgtgtgtcagtactttgttcatttttgtggctgaatgatattccactgaatggctattttacattttattaatccactcatccactgatggacatttgagttgtttctaccgcatgattaatgtgaatagtgccactgtgaccatatgtgtacaagcttttgtgtagacacttgctttcagctcttttgggtgtatcactaggagtggaattcctgggtcatgtggttattcagtgtttaccgtttttaggaaccacagatgttttccacagtgacagaacattttacattttcaccagcaatgcatgagggttctgattactttcaaaggaaaaaaattaagcagccctgtcaccttgatggtttggtctctggcctcaccgcttcagctcctctggcctgatctcccagggcctgcttttgttcatgtgtgtgtctgtttataccctggctcatcctgtggagggtctgaggctggcaggatcactgggttctgtctccacattggaaggtgagctgtcctaggtcagggtctttgttgcatgcatcgtcctgtccttagcaagagctaccctgtgccatatgggacatacaacaggcacctgttcaggcctggccatgtgggcccacctttggatggtacttgacaaagcctcaaaatgcagtgacaagtttagataaatatgattctgttctgaaatgctgcactggacacagccatccactgcctgccctttacagggctctgtgaagagacagtgaacaatgaagtggaggacgtgtgcaggtggccccagtggtcggtgatggaggagagatttcagcagaccaagcacggagaataaagccaggccagagtgtgctatcagcctgtctgccccctagagctgatggactcagcaaataacagtatagggtacccagttacattcgaatttagacgggtataggattttggtttttcaagatgaaaaaacttatagtggtgagggttgtacaacattatgaatttaataacactgaactgtacactcaaaaatggttaagatagtatattttattgtatgtgtattttaccataataagcaattgaaaaaataagttgtatttcaggtagatagcgaataattttttagtataaatatgttccatgagatgtctggataccgggatgcaggagggactccccttcctcctcccattcacaggcctgcctagagatttgtaagtacagactgactggctgtttttcccagtgtgtcttgtcgtgatacttttaagccacagatccgctttgaaaagatatgatctcccccaggggagtaactattataagaacaaatactctatccaagcttccattctcctcaagataaacatcacaggagtgacctgaattgtaaagaggagtggaaggaaaagaacaataccgtaatgttttctgagccacgcagatgtcaggggacggatccaagggcgtctgaaagaagacgtccacgctgctgagtgagaccttcctctgtgctgctgagtgagaccttccatctgaccagggggtcatgctctcactgctcctgcttggagttctggtgctgtagcgggtctcggccgccccttctgagctgggtggaggaagaagtccctgttgaaatatcagatgagtagggatgatcgcctcttttgaaaacaggagccgtgaagggattcccagagaagattgtcatctaacggagtcattcgtccgcccaggacttctctgtcacagggttacgtttgggagaattttcacaggccactggggatggctgtggctagcctggctttccactgatgccctctatccctaacctcagctcctgacatggctgtcattccagagagtgcttggaagcatcctgactatgttgacgatggcctgagcggagtgagtgtgcactagtttggtgttgtttcatccaaagcaatgtgattatattgctgtactttcagtttcatcaagcaggcaaaatgagaattgacactttttaaaatccaagctttagtttcaccacctggagccaaggtgtttattagaaagatttattggcattagtgtatttttattacaagcatttatctctgtgctgaacagttgcccctgagtcccgtgtgctgtgaagagtctgtgccacaccacacattaattttctgtcctcagagctccggggacacacgctgattctcatgctgtgcctgccgccttctccgagtgatggctgatgtgggtttcaggccccactacagttactcagcgacagatgggaccccgtgtcctctgttggctgtagggagttgaggcgaccctggctggcatcttgttttgaggggtggctggctgctgtactttggggagggcataacaggatttaaatagtatctttatctaggatgcctggagccccaaatccatgtgggcctcccactgtgtgaatttcagatgctgccagccccccaaccccgccacccctgagatggaaattagagcaccagatgggctctcccaaggagaagcatcacaagcccaccctcctgcctctttggaaagtaaccctggctgtttattgtgagatgtggttgtcatggtgacaagtggacacccgcttgggagggagatagaggaaacgctgttatggaggaaaggtcacccctagagacaaccttgtgttgcccgtggacaccccatactatggcctccgtactggggagtcccatgggtagggcatgggggtgcagccatcagtctgtgtccccagccaagccttgagccctggcttgaagttgcatgaaggtacagtggctggcccagccctaacccgtggtggatgcagcccctgttgtgtcccccaacccctgacttatctggccgcctgatgagagtctgtcgccctacatctgtggcgctccctctgcctgacaaattaaatcccgcccagcttgcaggagggatgttgttaacctgatttcatttgctggtgggctggttgatttctttggggtttttttggagatgaccagcacctgtccagcaactagtaaggcagggaaggcctccaggaacccaagtccatgcagaagggcactgtgttggggaactttcagacaagtgggtaaaataccgacgtgtgctatgtgcaccttgaaatagcaaagtgtcctcaacagagctctctgggggatgtcccaaataaggtttactttaggagaatgtgagcggcatctgaggcgagattctcttgttgcatcctttggaagcttttgcttggtgttccttggccatagcaggaagatcagtgccagggatgggtgaggggaagaaaccttgcaggagcggtacctgggccagtctcagccctgcagaaaggggcgctgtctgctccacttggtcagtgcagggtctactgcaacagagtctcgggtggtcacagccctcttgtagggggaaggatgggttttgctcctgggatgctaggcttcgaaaagcagggcagtgtgccagcagtcccagacaaaccagagccgggcctttggtcatgccaggacagcagggtgtggtctggctaggcctgtgagcccctgtggggctcaggggtaggggcagcaggactgggggaggcagggaccaaccagacttcagaactgctgggtcccagctgcacccctgcaccacctcagctctaggaagggcagccccatgtagctttcttgagatgtagcagcagtgctctcccttctccctcgccatccttaaagcccggtgcccgctcccctgcatcccccactcccattgcctctgaaatccggtggtgtctgtgatcctggaggggaggcttagccagcaatcattccaactacctggggcacggcatatctgcccccatcagtgctgggagggtgggcccagatcctttaatttttctcaaaaccccagagaggcagagttccatcaaagagcaagacactgatagactaggacaggggatagggctggcagccatgcctcgtggcatcacctgactccgagagaagccagcccaacacttggggtctcagttttctcacctgtcaagcagggggaagaatattcattgtgtacacaagaggcttttgtaaaccctaaggtgctaggtaaattaggtaaatgtaactttttttttgagactgaatctcactgtgttgcccaggctggagtgcaatggcgccatctcagctcactgcaacctccgcctctcaggctcaagtgattctcctgcctcagcctcccgtgtagctgggattacaggcatccaccaccatgcccggctaattttttgtatttttagtagagacagggtttcaccatgttggccaggctagtctcaaactcctgacctcaactgatctgtctgccttggcctcccaaagtactgggattacaggcgtgagccactgtgcccagctggtaaatgtaacttttatcatcagtgtcttccttgccatcatcatattgttatttctcgataatttatttccagaaagttctggaactggacttaccatgcaggctccggaacctcctctgggaggtggacagggatttaagggctatggatctggcttctgtcttctggatgatataaggaactaaatagagaaaatatacctaaccttaaattttattaattgaagtagaagcagttgtagtttggtgtcttctttaagagaagacttatgacatgtacttggggcattttctatgttgtagtaacagattggctaatttgcatttattctcatccaagaatttaggttttttaaaaatatggcttttaactttttgggcactcttggtgggaacgtaaatagtactactgctgtggaaaacagtatggaaggtccttaaaaactgaaaaatagagttatcctatgatccagtgatttcacctccaggtatgtacgtaaaggaagtggaagtgaagactcaagagatatttgcacacccacgttcatagcagcaccattcacaatagctaagaattggaagcaacccaagtgtccatcaatagatgactggataaacaagaggtggcatgtacacacagtagaatgtgattcagcccttaaaggaaggaaattctgccatgtgcttcaatgtggacgacccttcaggacattttgctgagtgcaataagccagttccaaaagggcacatactgactgcttaatcactccacttacatgaggggcatagagctgcccaattcacagaaacagaaagtagaatggtggttggcaggggctcaggttggggttggggttgggcatattgaggagtttgtttaatgggtacagagttttagttttgggaagaggaagacattctgaaggtggatggtgaccatggttgtacgacagtgtgaatgtacttagtgccactgaactgtacacttaaaaatggtcaaatggtgaactttatgttatgtgcattttactgcaatcaaaagataacaaatttcaaaatgatttaaaataacttttttagaagtatgaaaatagaatattaagtgcatagcagtttaagtataattaaatagacgtctgcacacacacctatacacatacagacatacacatgcattttacaaaattgtatcacattgcatattcaggttttgcatcttgcatttctctaacatataaaatcacgatctttaacttccccgtttccaggtttgcaatggtctggagcagccaaggaagcagcagcgctctgatctcaatggacctgttgacaataacaacattccagaggtaatttttttcaaggatgagagttctgggctggaacactcatctaatgatggagtggcccaccgagttgtggtctgctcactttgtccatgatgttctcatcccacccggtgcctgggggagagggagtccaggtcaggccaagttggtgtcaccatatggtgaggaggtgagggcacactggcctgggaggagggaggagagggcctccctgatgttaggaccatgccatggagtgctcttgtgttgcagatggtgtgtgtgtgggggtgggggaccattggtactacttaattttataaaaagccattctattcattgtctgataaccatgttctaaactagggtttctcaacaatgacaccattaacattgaggcctaggtaatactttgttttggggactgtcctgtgtattgtagttgagcagcatccgtggcctcaacccactagatccttgtacctaccccatccccatccctgatttgtggtaaccaaaaatgtctccagacattgcctaatgatgtccctttgggaacaaaaatcatcccagttgagaaccactgttctaaatcaacaacaggttttaacaaacaatttcctataagctaacagtgctatgatggaagttatttcccctttctggtaacatagtttagatgagattatttaactttgatgaaataacgatggccaccgatggagtggtatccagtctcctttatcttgcttttaaagatgggcctggatggctctcatgccccctggttggagcgtcattgtgttggatggtccctaggctcccttctagtcaagatatgctagtctgagggcccctaagttttagatgatgggcttttgggccactccccaacatcatgttgcctgcagcagactggtttcctgtatggagctgacatcttcagaacaccatcactcatggggggtttgcttttctcattatggctcatatcacagccctgcttagccttcaccttgtgggctacctacttaacaattgttatgtgttttatttttccatatttcctaacagacaaagaaggtggcatcatttccaagttttgtggctggtaagtgactttgaattttatttctcaaggggcagttgcattttacatcaaaataaatggtgcttttagtttgggcattcacctgcaaagcttgtttacaaagcgtgcctacctaccagcaaggtgcttggccattgtctgtttgaacactgtgtagccccacttagtggggaggggaggtccagctgatctgcccgctttgatgcaaggaacagtagacgatctcctttaattataccctcactaattgcatcacagacgacactgatgactgaatagattgagatgtgtctttataagcagctggttatagctaacacttctgatcagggtggatataatgcattcaaattcaggctttttttttttttttagatcctttgtttttctttaccgttccaccctttttgaggaggttaatagtgcatttcaacattcagtaaagaatgaaactggtcgatatgttctgtgtcactcttggggatggggagcacacttgcctggctttgacggagctgagcatctggagaccttgcagggcccctgtaggagatccactgggtttgcttctagtgctccaacctcagagtaaagagcttgttcggcaggatttctgtctttgccaggaggatgtttcctgcccctgctaatgtgttataataaacaatgtgaatttcattaattctttcaataagctggtaattaattcttataaatatttatgggagcaaggtaaattagttttcagaaataaatgactttcagcccttcccatgctgcttttctttttttagcaaacaactaaagcctggggaactgaagcccccaaattcgcctttagagaactagtttgaaccaggctaatccagttccaattggttgaaactggattaactggctcaaatcaattttgactgttataactggcttaatgctgctcagattgggtgagaatctgttttaaaccatcagaattaatatcatgcaattgagatagacttggttccattttgaccaattcagataggctaaaatgggttttgcccagcagtttacatgtggttttaggtacattttatctggttcaaattggttttcttcaggccacagcaggttatgatgattcctggaagagaccacactccccacattcccgcttgtagtgtttgattgggttcctggtttataggagctggcacctcgtgagcagggcgaatgcagtacgtcactgtgccattttccttggcaggcagaagccagggtggggttgccagtcacactgctccagtgaggcagggtctcctggatccaagaagctcacttgtcagtgtatcatagtgtcatctggacagaactctcacactaggaggtgatttagacattaaattccccgacccttgaaccaatctcatatctgcagggagtgggatcgtgagggatcgggaagcagtgtcagtgcctggggtacctcggactctagctcctggcatcccagaagacttggttccctgcaccactcagactgttccaaagcaaatccaaacaaggccggtggcttaaaacaattcagacaggctaaaactgctgtgaccagctagaaccaatgtggaaaacctgaatttatagtttcttctgtaggagagaagccctttgattgttatgaaaacatagaaaactgaagcaaaacaacatcctttactattacagcatttatatgcagcgaggccttcatggaccaaaatcttactcagcaacaggaagagatcatcataatggtgatgccaaaccctagaatataatggatatgggaaaagtttctccaaattaaacaccgttatcagtttgaatgcctttgggtacaagtatcaaaatccccacctaacgttacacaaataggtgtgtgtcttacataaagaagtccagggttggacgtggtggctcacgcctgtaatcccagcactttgggaggccgaggcgggtggatcatgaggtcagcagatcaagaccatcctggccaacatggtgaaaccccgtctgtactaaaatacaaaaaattagccaggcgtgatgctgagcacctatagtcatgctatttgggaggctgaggcaggggaatcgcttgaacccaggaggcggagattgcaatgagccaagatcacaccagtatacgccagcctggcaacagagcgaaactccgtatcaaaaaaaatataaaaaaaatattaaaaagtctagaggtggccaggcacggtggctcatgcctgtaatcccagcactttgggaggccaaggtgggtggatcacaaggtcaggagttcaagaccagcttgaccaatatggtgaaaccctgtctctactaaaaatacaaaaattagccaggcatggtggcgtgtgcctgtagtcccagctacttgggaggctgaggcaggagaatcacttgaacccgggaggcggagcttgcagtgagtcaagatcatgccactgtactccagcctgggcggcagagcaagactccatctcaaaaaaaaaaaaaacaaaacaaaaaacaaaaaaaaaaagtccagaggcaagaggccgccggttcgatggctctgtgatgtcaggattggcgctgttgtgtctcttggcctcctcttcaggcttgtcacctcatcgtcacacagtgtgtgggcagccccagccattgcttctcgttctaggcaggaagaaaaaaggagaagggctgaagtccacaccagctggacgtcctccccttgacattaggaaagcaaaggttttctgtggattaagaggtgatgacttctctgcatgagaatcggaccctctgttacctttcatagtgtgctccctgggtaacctgaaaggcagcgtgtcagctgtgtctccaggcaacattgcttatggtgagatgctctttttgataaactgtatctagatgggaaaattctaatgcttgcggggcagggcatccagggctttgagcttctcacagtggtgactttcgtgactggcatgtctcttgaaggtgaccctggaagctatgccccacccatggggtgattgtgagagatactggctgctgggagcatgaggctcttagaccagatgggttccacatgcccttcttggtgggagttttgtacccttgcagctgacccatccagggagttctgtaccattgcagctgacccatccaggggcccatgagactagctgtgtgggtgcagtgtggactcccatcagagagtccaggaggcaaactggcgtctgtcttgttcccttggagtagacggccccatgtctagctgagccttaggacactgcatgcttctgaatatctagttgaaccttacttagaagacccagaagcctcttcgacacactgcttatttctttgtggccagagctgtgtcacatgaccagcctctcagatgttagtgttggccagacaatcaaaccctgggctttttatgaaggcagggcaggtctggaatcagccctgggtgcctgccgccacttcccatcccactgcgggcccttccagcctcctggcgtgtccagtgctgaggctgagtatgtgagttcctgggaagcccctgtgtaagggaggagcagctcctccaccctatttgtgtctgagaagttgccctgaagggaaatgttcctggagtattcatgagtatttggtctcagcttatgccttatttcatatcagataattgttgataataatgaaaaaaataatagtaacaatgcacatgataccgtctgaaccctcgttggggcctggtgtccactccctgtgccatgcagcatctctctatttcatgtcgcctggtcaaccaccacgtgaggagtaagtactttcccccgtctgataggttagaaaactgatgcacagtgaggctaaagtcacttgtgtgcagtcccatggctgtgcgggggacagagcctggacttggacccatgtcttggtgcttgacacataaactcgtagccgaggtcattcctccctacccagcatgccttcatataccaggaataggtaagacctgtcaggtgctttctttgagccaggcccagatctaagtgttttaagtatatcaacttaacaatcactatatccacagctcagggagagtgaatcccgggccgaaggtcaccaggtagcaagtggcagagttaggattcgaaccagtctggaatctgagctcatcaccacactgcactgcctggcgaccctcacgcagtgggtgaggaagaaccttcacttagagaagacctaccatgcaggtgccagagagttcagtggaggggagcgttccagatgccagagctcctggccttgtcaggcgcaggatcacagccttctctcagcagaggcattgtgaggaagggcctgccacaatcactgtctgtggaaagttctcggggtctagcgaccctctcagactgggaaggttaacgctgcagagaaaacctccttatgaaagtgcggattgcacagaggatgcactgcctgtcctgcggggaggaatccgaaagcagccaccctcaagatgtcccctcctacaggacgtggtgtctggcagcagcttgagcccaagctgcttagagggtcactgcctctggatgagtatatgtgaatgaccagcttttctatacaggtaaacacgtgctcattaaaaccaaaaggctgatgttagtcccaagcaatggggcctaacagtggcagcttcagtacaaaataacaaagactggtaaatcttactctgctttttgtactttgttctcctcatccaaagctcatacaggatgttttgaaacccaccaccccaccagcagcttgaggcttatgccaaaatgctgccaggccttagggtcctggggtcctttacagcctgtctatagctcatcaacttgcccagctccgtgtggatcatgtggaaggcatggagattacatgccccagacctggagctgagctcacctatcaccccttccttctctcaggggtcctcacagtggtaaagctgctttgttggtttcatacagtgggcacatgggatctgagacttagtttgctcttaaaataggcagttggggtgaacctgttcagataagactcttaaagtgaagacatctcccacctcctcctctttggtgtatttgggtgggggatggacgggaggaaggtcaccctgtgggaccagaggggatgtggcgcattccaaagaggagttatggaaacccagatgactttcctttttctacaaacaagatcatgtttctcctgtactacatgcagtcagcaggaatagggattcgtcgttttaaaatctgaacttttattcactaagtagaagttgttaaagatttctcagaatagtgcttgtatcagaccaagagctgcaagagttaaaaatgagaaatccccacagtacctcttgttctgcctatacatcccagatccctagtccttctgtatagtggaagccacttacatttcttgtgaatttctccaggaatttctcagctcatccataggcccttttccttaaatagacattgcactggccacatggctctgtacttagctttttcctttcttgctagatcttggaaacagcaataggtccacctgattatttaagcggcagcacaggatcggttgagtggatgtgggatggggtattaaccagcccccttggactgattgttgggagatttccagtcagtgcagcagtgaacagccttgtggctacgcctttgtgtttgggtgtgggttcttttatggaggcggttcctggctatggcaggggtacaggccaggagcacagcaactctgatagacacgggcagaatgccttcccaaggggggacagcgtacgctgctgttggtcatgtatgagagttggttacgtatgaggttcccacactgttaccaacactgcatgaccggctgtttgatataagctccaggccgatgggtgcaaagaggtgtcttgttgatttcacgtgtctttcataataagtgaagccaaacactatttcgtatgttcataggtggtttttcttttcagtgcactgccagtttgtttcctgtgctcattcctctgttagattttcacccccagctttattggcgtataactgacaaataaaagttttgtatattaagtcatacaatgtaatgtattgatataagtttacatggtgaaatgactaccacagccaagcgcattaacatagccatcacttcacatagctacctttttgtgtgtgtggtgagaacacttcagatcgattgtcttagcagattactagtatacaatacaggattattaactacagacatttactcatctcataactaaaggtttgtaccatttgaccaatatctccccatttcccccacccctcagcccctggcaattgggaatttgggtgtttcttattgatttgtattattctttacatataaaggaaatgaaccctttggtttgtactgtaaaagtttaccccagcttaccattcttttcttcttcttctttttttggtatgctttttactttgctaaacatgtcatttagtcaaatatatcagtctttttcctttgagcttactgagtttttgaggttagtgtgaccatcacactcctaagattatttttgaaaataaagttgttggccaggcacagtggctcatgcctgtaatcccagcactttgggaggccaaggtgggcaggtcacctgaggtcaggagttcaagaccaggttgggcaacatggtgaaactccgtctctactaacagtacaaaaaataaactgagcgcagcagcacgtgcctgtaatcccagctactagagaggctggggcaggagaattgcttgaatctgggagttagaggttgcagtgagccgagatcgtgccacagtgctccagcctgggcaacagagtgagacaccgtctcaaaaaaaaaaattaattgattaattagttaaataaaaagctgtcttccaggactttggtattattttaaattatttaaataattgatttatctggaatttatcttggtgtatttatacaggaaaagttacattttaggcattttgtcccaatagctagccagttatgccagaactatccaaggaatctttcccttgcaagtttgaaatgctgcctttaccgtacccaaatcgtcatgtgggtctcggtctgtttctggatctgttacagggacggtccattcaggttccagatccaggctgctttatttactggggatttatggtgcattttattacctggtagggctactttcagaccttgccaccatcattccatttcagatttttttcctaggtatttttgcacttttatttttccatagtaactttaaaactagcttgtctggttattcactgcaaactcttttgtttgttttgttttgttttgagacagagtctcactctgtcgcccaggctggagtgcaatggcgcaatcttggctcactgcaaccttcgccttctgggttcaagcgattctcctgtctcatcctcccgagtagctggaattacaggggtgcaccaccatggccggctaatttttgtatttttagtagagatggggttttgccatgttggtcaagctggtcttgaactcctgacctcaggtaacccatccacctcagcctcccaaagtgctgggattacaggcatgagccaccgcgcccgggccactacaaactcttactggtatttttattaggcatgcttaaagtctgtccatttaggggaaaaaatgtcagctttacaacatagtctttctagccaacaaaggatttatctgtccacttgttcaagctcatttatcttcatcggtaaagttttttcataaaaattcaacacatatcttgtttgtctgtttcttgttgttttatcccttttattgtttttgtaaatgctgactttcattatttttcaacatgttgctgtttgtaggtacaaagaaagctatcgatttttatatattaaatttgaaaccattgccttagtgaattctcttattttttaaaaatagatttttagttgttttcttgagtttttcctggcatgcaatcataccatctgcaaacaagaatgatttttgctgcttcctttcttgttttctattacttcttcttgcttaatcagattgggtagaacagaaggaacaattttacataatagtagaatatggcttcctaaaaataacacctttttgaaagatctatgcttttaattttgtcataaaaacttcaagcatatgaaaaaatagcttcagtatttacccattcatggctagtggtatttaatctacaccctgaccctttcccagattattctaaagcaaatctcagatcttacatcatagcctctttaaatatttcatattgtatctctaaaatataggagttctgtttttaaaaataatttcaatgctgttatcacaactaaagttaatatttgtttatgccattaaatatttgtttttgtttgcattttcccagtttacagggcgctgtttgaatggggatccaaacaaaacccgtctattgagattggtcaatgcatttcataattcttttatgtctcttttaggttgtccatccgtctcttttttctgtcttacaaatttttgttggtgttattgtggaagaatctgtcatttatcctgtagattttcctgcagtgtggattttgctgattgcatcttcatggtgttgtttaatgtgttcctctattctctgtgtcctgtaaaatagtggttgtttttagacatagaggcttgatcagattcagtttgattgggcaaaaactttcgtacatatttttgtgttgttctattgaggcacataatatctggtcatctcttttttggtgatattagcaaccattaatgatcattgtctagatctagtaattgattagaagttgccaaatggtggtgttctaatttcatcatttcttcttcattagttagctggaattcttctatgtagagaaactttccctcaagtatttggttaccctgaatattgttcatataagaaaagcagattaaatgcttgatttcttctcttttttgaaaaatttaaaaattaatgagttggctgggcgcagtggctcatgcctgtaatcccagcactttgggaggctaagacgggtggatcacaaggtcaggagatcaagaccatcctggctaacacagtgaaaccccgtctctactaaaaatacaaaaaattagccaggcgtggtggcgggcgcctatagtcccagctactcaggaggctgagacaggagaatggcgtgaacccgggaggcggagcttgcagtgagccgagattgcaccactgcactccagcctgggcgacagagtaagactccatctcaaaaaaaaaaaaaaaaaaaaaattaatgagtttccccgacagcctttaaaagataaccggtgaggttgtgtatgttgttgttagcacagttgatgtgttttgtgtgtgttaccatgattattggtgctcaagttttctatggccaataagagcttctttaggttgttttctgagtcccgtcaatgtgaacccagtagtctttgattgtttcctttctttctggtatattccaggatcatcttaaatatttcttgccccaggtctggaaccagttggttctttctccatggagccctgtgaaataacatttagagactgtaatctgggtagtgtggttgctcgttgttgtagatttggtgagagtgtatatgtctatgtggaaggcgcctcctaaatggcccccaaggacccctgcctcttggtattcatggctgtgagtccttccctccccctgtgtgggggatggacttactgagctgcttctattgaatagaatatggtagaagagatgggatatggcttccaagatcaggttacaaagagatgtggcttctgtctcagcttgtcctttcttgttctctcttacttgttccctctgaaggaaccaagctagcctggtgtggttggcagttgccccatccagaggcccacgtggcacaggactgatgtttctggccagcggcctggtgagagaacttggaagtggatgctcccctcttcaggcattcagatggctgcagcatcactgagtaccttgctgcctgtgacagacgagaggtcctgagccaaagtcacccagctaagccacacccagattcccgatccacagaaactctcagataatccacggttgttgttttgagccactaaattcccgagtaatttgttatgcagccaacaataactaatacacaacatattttttaagatcaaataacgtcatgattcctaatgatactttgtcaggtttataggttctaacatttgtagtttctttttcctgtgccccaaattcctgttctcaaggacaccagcataattttgcattggttttattccattaagcttacagcagtctcagaataacaataccaaacactgccaaggacacatgattgtagatacagattatgatttatttgcatttacttttgtgtttagaatacatcccacaagggatgtacagtcagacaactgtgttttaaaatattttggaatagatcacaactggatacacttttagattcattggtttcatttttctcttagttatttggactttgctttttccatttaattttgttttataattatataaaataattacatggtatgaaattcaaataaacaacacaggatgtatgcaaagaggtcagtttcttcccctatttatccccccacctcccaatttcttcccttccactataggtaaccattttgagcattttacatatttttattgtaagcatgtcttcccctttcttaggtaaatggtagtggattagactcccatatctccatcttgccttcttcacttcacactaaaccctggcggtgatgccacagctctgtgctgttcacaggagcatggagaggatgttctgcagaactccactgtgtggatagatgtctcctgttcaggagtgtttgggtggtttccaggtttttgctattacaaatagtgctgctgcagtgaaccgcctatgcatatgctttttcccatttttgccatttttttttaaaaaaaattatttattatgctttttctgggaagtcattctccccactgcaagggttaggatctgtcttgggcaactctgtgcgttttcttgagcttggctttgaccttccttccctgactctctgttgtggcttctcttcctcccagcatccagtgacttaatcttgctcattgggtgtctaaagttcaacactgtggaacccccaaatcccttttatcagtgacaaagcctgtgctgcaggcccaggtgtggccactccctggtgaatgtcccataggtgtgattttcagatggtgtcttctctttcgtatcagccatattatagggtcaccttcagtgggggcatctcaaggcacaggccctggcagtactggagagtcgggcctggaggccacgccttagctctgcagcagaaggtctcacttgagacgccagttacacgactctgatactcacccactcctgcctcctttccccactccagacctagggggcacttcagggggcaggctctcctgctgatctggtggctcgcctcctcccagtcctgtcctgccccattagagctgcagcccctcctcccagttgaggccaggtcccgtctgcactttggaacctcacacgatctgatgtcgtttgtctcctgtcccttttgctcgcccctccactggcttttgaccacgtctgtcccaccctgcatctatccacaccaccccgctctacctgccccttttctttcacagccggaatctgggagtggcagcctcattgtctgcacctcccctgcacctctcagccccctctctggctcctgccccggttcctctgaaacagctctttgaggtcacgactgacttccttgacactgtgcccaatacacgaggtctccttgtagttggcctcctgctagcatgggtgtagatgggcaggcctccctttctaagccccttcttttcttggtacttagcagagcagagtcctggggcttcatcctgcccccttgcccatgaccttccttgcagactcatccatgcctgcagcttcacttggcacctgcagatggttcattcccaaatctgtttttctaaccgggactcccgagtccagccgcctactgagcatccaggctcctgccactaaacttgcctggaatccccaacccaagctcagtcctcttccaggcaccctttctcagtgaggggcaggtctgtccatcgagctctgcaaccattgtctagcgtcctcatcttctctcagactccagtccacctttccgtcctgttgatggacccctaaatccccatctgttgctgtctctccatttccgttgtcaccctgtccgtaccatcatcaccactcatgtgctgggatggctacagtagcctctcagctgctctcccttcttcctctctgctgcctgcccctctgccagagttcatttctaatgaaggagtggttgggccacttccctgatggataccctggagtgacagtccttatggcctgtcacccgtggccccagggtcctcacatctggccagcgcttcctccccaccctcgacttgtctcagctgctggcccatgccctaggcctcggcagtccagacatcctatagatcttctaaggtgtcattgtctctgcaccctagggcctttgcacctgctcccgcctcagcctgggaggctttctcctccttttgccttatggcttgttgattccttctcctcctccagacctcagcttaaacagcagccacccccaaattcctcaccagagcagcctccctgtcccttccttcccagggccatagcctcccttttgagcattcaccatggcccatcctgatgcatttgttctgtggctgtgggactgatgtcagcctcactgtgtagcctgtgagctccatgtttctgtcttaacaccggtctttatacagtgggttcagaaatgctgagcacctgaactcatgacagtgaacttgggcaaagccacgtgacccacttagatggtccttatttgtaaaattgggaccctgagattgcttcatggcgtggttgaggactgggtggaactgtaccattgttgcacagaggtctggtgtgttgggcatgagggctgcactccaagactccgtgcctttgcagagagcagcgggccttgtggatgcacccccacactcccacatacacctgtgctccagctccacccagccacctcctcccagacccccaggatatacagggacaggtcttggagctaatgagaccccctggggccacactggcaccttagaagcctctgtccaccacccatgttcaggataattttcttcaaaggtggcaggagtggagaccctcaggcttgaagctgtgggactcccctccccttccctctccagagggcctagggttttcctaagcggtgtttcaaacagaggcttcctctggcaggggagaacctggagcgccttattcttctccagactgtgcagatacactgtgcatatgcctatgtgagtaagatatacggtgtgaaaaggataaatcactctctggggagacaagatctttaaacctgtatcttgattatcttgtcattttgtctccctctggtggtctcagcttagggtcagtgcaagacttgagcaaaataacagcaatttctacccaaacatgtagggctagctgctttcattttctaacgaagctgttagatttgggttctgcgtttcctgcggaagttgagagctgtgcccatgaatctgatatactccccacaccatgccgcccccactggactcttctctgggtctgggttctcctcccgtggtgcgtgtgagtgggaggcaggatgctggggccaccttggactcgattgtttctcgctgaacaaaagagcaaggcaggcatggaaggcccccaggcagaggtgggtggtggctggagttgcagcaaggcccttgagtgcttcactggcctcatcccggaagcaggcatccgtgggtgccagtggtgaccccctgcctgggatggggcatccttcacacacagcagtctgtgcccagatgggccccagagctactgacgctcacttcagggggagacgaggccagtctttcccaaatctactcaaggacatgggtcaacatggaaatgtgaacctcagaagggtctggtgcactgaccagggccaccctgggggctggcgagggagaagccaaggggcagtgcctagaaaggtaggagtcagattccaaagggagggctggcctcccagcctccccagggcctggggctgacagggtgccaggcagcccctgccacagaggggacataaggacactcgcccaaggccctgctcacctgctggggctgtgaggctggggtacctggggcgcctggaagaaccagagctttcctgcagaacaaagtgacgccatctagtggtcaatgagagccactgcattgggccccactgggtgactggggcttcactggggggtgcctgttgagccatgctcactggggacggcaaggtggtgtgaggtagtagaaacaggcctacctcaggcgctgggagccttcccagccccacagccagatgccataaaaggcagcacagggcatgtctggcgagcctgtggcagccagggctgtcatacacgctctccaagccccccagctaggcagatgtgcacacttcactctgaagaagcgccagggtatggtgggggtactgcattgggatagatgggtcctgttccctctgtggggctgcctctgattctcctggtgacaggagaatcccggtgtaccctctgagagacaggtggacaggggttcctcccctggtgccacccctgaatcccgcagtcccccacattggtgcctgcagccctgcccagctgggagaaggtttatcggctccagggcaaggggtgaatggaggatatttaaaagccgtgggaggaccccattgataggactcagttagatgcacaggggagggatgggggtccctgtggggagagacggctgggagcacaggtgatcctctgaccccaggggcacgcagacccactactgcccaggaaagcaggaaggagggccaagtgggctgagcaccaacgcgaagctccccacttggtctgtctgagcaggtgagggaggggcagccaggagtttgaggcagtggaggggtctggaataactcttgcatggaggaagagtctgagtttcccagagagatagatgagagttgtgaggttgtttggggggcatttggggtcaagaatttataatacatttatcatggcactcatttgccctcttgggcagctttttccagcctcaggtccagagaaaacaggttggagatttgctgaactcctgtgggcagatacacaggactggggtcagggaactgaggatactgggcggatgttattgaagtggtggatggcagcgcccaagctgggccagttgatgattttagcaacagaatgggttagaggtgagaccagggatcagctggctgagggagggaagaggtcaggaggttgctggcgcgagggctggggaagtgcaggatggctgggcccgtgatgctggagggactcagggaggggccagctggagcaggaggggagccaggaagccagggccaaaatccccagtggaaggggctctggccaggaggtgggcagtcgggagggataaagcaggtgacatggccaacatgggtctgagaggacagccaagccacggtctaggatagctcagaggtcggctgactgcagccccaatcgcaaatcctcctggccccctgattttgcatataaagtttccttggcacacagccacacctcctgttttacatactgtctacggctacctttacgcctcaggtacaacggtgaatagttgcaacagagaccacaaagcctaaaacacgtaccatctccccctttacaggaaaggtttgcccacccctagctggagccttattgtctggcataggagccactcaagattggtttgtgggcaacatggacaggacttgggggttggttggatatgactctaacatgtggctctttatatttcaattaattaaaattacatacaagaaatgggtccagtccctcagctgcaggagcctcagtgccagtgctcaaagccacatgtgggtagcggatcctgtattggacactgcagagatagaaccttccattgtggctggcaggaagtttgttgggtcacgatggtctaggggcagcagatggaacaagcatgatgttgccaagcctgggcctgcggtgtgatgggtgtgaggagctacacgggtgtcctgagaggctacagacaggcaggagcccctcaggacagatgcacaaggacaggccaaggagaagcccagggcacagtttcaggtcaccagcatgagttccggggctgtggggaaggcatggaaagtgctgttgtgtttgggatgtgacgccttctggatttgcagcctgtgattgtcatcttgagtgacagtcaactggaatgctggcattgtcctcctgacactgtttgtgcagagttttctggcccaagtgttgatttcgcgcagttacttgcagcacggggtagtgagggaagcagaccggccgcccgtggctggctgcagatggcaatggttgggcccttctagtttgccccgcatcctggctgccgtgttccttgtgctatggccaggcatgcaagttctttgttcaggggacttctcctctaggaagactctgactctgtgccctccttcagttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaaggtagaggtgcttcgagggcccctcgcggatgcccgcacactttggggggcactagcaggagggaatatggcggggcgtaggccctcttccagctcggactgcacagccctcagcacagggggcaggagcggcccaggtgccaacgaggctgagggaggcttgcgccttggctgggagaaagctggctgggcagaggcaaccagctccttaacaagaggcccacggaatcccagaaatacgacctttaaagatcatcgttccaaagcattctagtcatcaaacaatcccaaatcccagttcaacagtatgtgtatttttagtgccattcagagtgcttcaagaaagggtgaaaaataaatcacgttttatttaaattcaggacctcaagaaaaactttgacctgcttgtagctctaagtgctcattggattgtctggttttgaacatcgggtgaggccgggcaaggggaagatgaggccacgtcagcaaaattaaatggggtcggcggggaggggatgcagccatctgaggtctcagctctctgagcaagacaggatctgcagaggcccgccagcccaggggtgagaaatggcagcaacctcctccccagccctcaccatacacaacctcctctaacagaagcagagaagcaccatgaggccatccggggtgggcaggagaaagccaggtaacccagggcagtgctgagccctgctggccagtgcctctcagcagaggcccggccctcccatcccagacccttgccttgctccgctgcctggagctcagctccccttcctgccggctgatggcatctttcctgtcctccatagatggggtggttggcagtcatttctagcgctccagggacacctgtgtgggcttctcttggtcagtgtgtgtgcttgaagtgggcaatggctgtccacccgtccctgctgggctttgctaggcaccagacctgagagtgggggcatcaaccaccaaagtgacataacctcacgcaccttccttctctctgtgccaacttgtttttcttttctcttccatgctgtcagaggatgcaaaaggctgctaagatcaagaaaaaagcggtgtgtagggccttgaggccctgggacagtgttgtttgcttgtgtttccgtggcttgtcctgggcagtgggggctggggggttcccctggggatctaaataatgttgcaaagcagcttttcctcttcccttggtaggtgaatcttagatgtttgtaaatgaaactacagacacttcatttttttaaccacccatttatggaaggatttattaattcttctttcttagcatctcctgtgtactgtatggataatgctgtgatgttcctgttttacgtggacattttaaattgatatgacatttagttgatatgacaacgtggtgggtgtagggtctgggcctcctgtgcagtattactgaattgttctgatagttaaagattccttaagcttaatttactaagtcaggagggtgagtagctcagtttgcccgtgtggtgctttctttattggaaatgagtttttgggctgggtgctgtggctcacacatgtaatcccagcactttgggagacagaggcaggaggatcatttgagcctaggagtttgagattggcctgggcaacacaatgagaaccctgtctccacaactttttttttttttttaattagctggtcatgatggcacatgcctgaagtcccagctgcctgggaggctgaagtgggaggagcacttgagcctgggagtttgaggctgcagtgatctgtgtttgcaccactgcactccagcctgggcgacagagtgagaccctatctcttaaagaaaaaaaaaagaaacaaaaaaagaaaataagtgttgaaacactggcagacttttaaaaatgggttgacactgaggccgggcgccgtggctcacgcctgtaatcccagcactttgggaggccgaggcgggcggatcacctgaggtcgggagttcgagattagcctgaccaacatggagaaaccccgtctctactaaaaatacaaaaaattagccaggcatggtggtacatgcctgtaattccagatactcgggaggctgaggcaggagaatcacttgaactcgggaggcaagaggtcgcagtgagccgagatcatgccattgcactccagcctgggcaacacgagcgaaactccatctcaaaagaaaaaaaaaaaggattgacatcgagtcatttgtttgtcacctggtcatttagtaaatgctagagcttttccaatcctcctcatacagaaaatatcaaaatagttggtgtcacaaggcctggggcaaaccccggggtccttggcactggcttattgcccactgttttcttctgtttaaacagcaggagatttagttccccctccctgctttgaagtaatgccattttctggcgctttggccagaagacccatgtggggactccctcttctggagtgagactttggtccacctaggatgtctgccttttgcccagcagcgtctcctttgattctgctcaggagcaggagaggaaggatcatgctcatgctcctcttcccgggctgatttcctccaggcaaggcagaatgtgccacacattgcagacttgcagttggggtgtgcttttctcaaaagagaggggccctcgcttgcagcctcctagtccagctggagcagggagtccctacggactgcagctggcttctgggacctgcaggtccagcaatcctacagagtcgctgccgcctttagaggggttggtacaggcagacccagctcaaaaaggcctctgcggccagtcaggtggccgcctgattacatttaattacggtttgttcttcctttttggaaagtgggatgctcagtgtcattgctgaaggtccctttcctggcccggccacagccatggggatgactgcaggtcatgccccccatccacagacatgccgaggcccaccctgtggcctgttctctggtgtctgtaggatccgtactgtcgacaccctcccttcttctgccaaggaggatgatgggtgtcctctccctgccctgttactgatgggttttccactggaggctgggtggcttcaggctgcccctcttctcccatccagggatcccagcctcaggtttcctccacaattgtcactaatgccaaggtccacctgcaacttttctcacttctggcttgacctactttttagcaagaggattttgagccacaacccatgaatataacctttaaatgcatgctgatgctgaatataacccaattttaaaaaacagaaaaagttcctccgcggctgcggattgtcagctgcactgctttcaactcctttctctttctaatgagttaaaagcaaagaaagcccaaaagaccctttcccttgaaaattgagctaaaatacacatttattattacaataccgggcctctctaaaactcaaaattcttgaggaattgtcagcagggagatttcttatttcagattttctagtgaataattaaatcatagtttttgctgtttcgaaatggaaaatagaccaccctgggctccccagtgaccacggagaattattcacctcggtgggcaaaccaatagaacttgaaattcattgccaccgtgcagtggtaattaggattcttacaaatgtaaaaaccaattaaaggctatcctagtttggggcagactctgaagagttcactcagctcagaagagcccatgaaactcgtctcacaaccatatgccagacatactacagtggctacaggtgacgaattaggccatttgtgtggcacctctcttggcttctctctgtcgctgtgaggacagcacttaggccagccccagggctcagtcccccaaggacgctgtgggatggacatggtggtgactgattaaatcagaaggaaaggctgacattttcattcagcttctctgacaatgtcttccccatttcttaaggatacttagaatcccaaatccaggaaacgtaacctgagtctataaattccacaggggtcagccagagggccttgcttgccactggcaggaggggctgtggcgacagacccaggcgtcccgccccatctcggtcaagctcccgggggctggccctcctccctcccaggtgcctcttacagactgcctcgagaactcacacttagctagatgatgcggccggtggcgtgcaggtagatttctgatggccagtagcatttccttctacgtggactctgggtaattgttaaaattgccgagccttccttcgagttattactttttacattgacggataaaattgtatgtatttgttatgtacaacataatattttggagcatatacacattgtgaaatgactatatctagctaattaacgtgcattacatcacctagttttaatttttgtaatgagaacacttcattcactatcttagcaatttttaagaatatgaaatattattaacggtagtcaccatgatgcacaatagatctcttgaactcatttctcctgtctagcaggagctttgtgtccgtggaccaatacttcccccttcactcctttgccccagcccctgataaccaccattcagctctctacttctgtgagatcgacatttgtagcttccacctgagtgagatggtgcagtatttatctttctgtgcctggctgatttcacttcacagcatgtcctctagggtcatccatgtgttggaaatgacatggctttttctttgtgaaggctgagtaggcctccagtgtgtctgcgcgccacatttctttatccattcatcgtgaatggacttcgggttgatcccatgtcttggctgttgtggatagtgctgccgtgagcatgggagtgcaggtgtctcctagacacgctgatttcacttcctttggaaatatgcccagcagtgggattgctggatcacatggtggttgtagtttgaatttttggaggaaccgccattctattctccacagtggctgcactgattcacaccctcccacagtgtaccagggttcccttttctccaccccacgccagtgcttcttatcttttatctttttgacgagagccattctgacagatatgaaatgatatattgttgtggttttaatttggatttatctggtgattagggatgttgagcattttgtcataatgctatttgcatgtcctctattccgagttggtttttggactttaacaatatccactgtccttcttagaattctgagggggatgcccagacgctgacggaagtggacctcttcatttccacccagaggatcaaggttttaaatgcagacacgcaggtaagcgtttaagacagttgttcaaaatcaggtaaactcctaagttcgactccttcttgtcccatggtataggccctcgttctcagcagcttctctcctgtgctctctgcgcccatcaacccaaggcccatagcccgggctgcgggaggagcaaggagcgcacagcaggtagcagtcgtgctggcgtcaccccagggctctgcgggcgggaggtaggtgggaagacctgctgggctacctgggccctcccctgcttccccactcccgggtagcctgacctctggggacagaggaggcagcagcccccactatgtggctcacactgcagcccaccactcccaacccagtgccgtgccctgaccatcctccaggccctcacataccctgatacgggcacaggggcgcccttcctcatcccatgtctgtcctgtgtccaggcttgcaccttgtcccactgatctttgtgtcctgcacccccctaccctggaaccagccccctcctggagcctggcacttggtgaaaactcagggagacaggtgccagggctcaggcactgggcttgcgacgcttcacagactttgacttcattttctgatcttttgtgggcaaaccatctggactagatccccccaccaaccctccgagccccatgcctcatcacccacctgtgctgggtgtccccaagaccaccacaggctgggtggtttggaggactgacaggactcagtgagctcacagctgagatttatttcagcagatggctccagagcagaatcagcaaagcggatgcaggcttccagagccctccccgcagtcacacaggacacactgaactccctggcaaggggctgtgacaacagagaagttgtgtctaccagggaagctcatagacactcagcccaaggtgtttactgggagttggtcataggcaccctctgcctggcagctaccaaaattccagactcccagaggcaaaagaggtgtccagcctagaccacgttgtttgcacaaacggtttaggcaaaaggaaccatggttgtcagttcgggtgctgggtaccctcctgagatccacgttcccagatgccagagagggccagccttgcaggcgggcctttctgggtacagctgctaggcctgccccagtacctcttcttgccagtgtacatggagggtgccacacctggggtgggaggatgggcttggggattgaagctgagccccatcctcatgagctgtatagccttaaacaagttcctgaacatctctgaacctcctaatacccacagccccagctgaaagagtaactcttccgctggatcctgtgaaggagagatgagaaatctcctaggctggcccagttcagggttcactccactggccccttctcccttcctttcctttcccttctggatctttggattctggacagggcatgcaaattaaagctgttggggcagaggagctggagaggagggaacaggtgagagactgggaaggccaaagtagccattcagagcaggagagcagatgcggccatgttggtaggcagcctctgtgaggaggaggagggatctgccattgataggagctggggaaggaacatgtttctgacacctggggattgattcaggcatttatgacagtgacagaaatcaggagatgctgaagagccactccaactgtttcctttcagtgtccctccctggaaggtgactcttgtggttatgaaacagcctcatggctttggccagaaaaaaagtcagcagctgagacaaaggtgaagcagcatgcactgcaaagtggattctgtgaggaagaaatgaggtccagaggttgcagaaacactcgagtttcttttgtgaacagaggacaaaagcataaaagaccagttgattagtttttttgagctttgtgtgcagtcttgttaggtaggggttgtgggcaagatgctggctggagattcctgtccaaggacaaaaaaccatcaagagtcatgggcctgccagaggccgagggaattgaagtcaggtgggctaccttggtgtcttttgacccaggcccaggctgtttgggctccctgggaagagctcattgaatgacaaacattggccttgatgctttcctcttctgcacagcaggaaggccaggccaggccactcttgggcccataggagagcacctcgttcagaagggacccttctccagagccactggtggcctctcatccgggaatgtatgggtttcactatatggcaagcccctgctccagcagagacagcccgagagctcacctgacatcacgcctccctgggttctgcacagtccattttggaagctgggactgagatgagggcagagtgactttgactgtaaatcattaccctaaaacgctctgttaattagggccgtggttctcaaccagtgtgatttttgtccctcaggggacatttagcaatggctggaaataattttcattctcacacttgggaagagggaggtgctactggcatctcctggggagaggcttggaatgctcctaacaccttgcagtgcacatgacagccctccacaataaagaatgatccggccccaaatgtcaggagaatcagggttgcgaaacccgaataattggagtgccttttttttttttttcctttctttttttttgagacggagttttgctcttgttgcccaggctggagtgcagtggcgcaatctcggctcgatgcaacctctgccttcacagttcaagcgattctcctgcctcagcctcctgagtatctgggattacaggcacctgccaccacgcccaactatttattttatatttttagtagagatggggtttcaccatgtttgccaggctggtcttgaactcctgacctcaggtgatctgcctgcctcggcctcccaaagtgctaggattacaggcttgagccaccatgcccagccctggagtacttttcaatggattgtcccagtagtgttccctgacgtggcactgtctccctcccgacaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgtaagtaagcccttgccagggcactcccctcccaaagttcacagcccagggcggctccaggatccaggcgctgtggaaaccaccctcaggtggaaagcctccatgctgttactgatgtttccagtggatcagtgatcttttgcatactctttgggtttgcaaagatagtgaatacagttttattctacttcttgaaataggttcttcaggagctgtttataaattgagttgtggttaaatatatgagggagctatttgaagaaatccctttacaaaacattttctctactaaaaatgaagttaatctttgcataacttttgttattaaaatgcaaattttcgcatggccctggcatgctgtataaagaaagcacatctgcacatgaggcttagttctgcctttgcgtgtggtcttcagaggaagtaaaaagtgattctgaagtataagataccaaagactcaggaaaagatcacaagccctttggctccctccttggctggagaagagtgttgtttttagcctggagggggacagaggggctgaggaaggagcagcagggccaagaggggagctcagagaggaactgtccttcctggaggctgatcttactcacagaccagcagggggcgctgctggtgagccagttttgtggctgttgccagagtgaaattttaaaatatgatctatggctgggcacggtagttcatgcctgtaatcccaacacttttgggaggctgaggtgcgtggatcacctgaggtcaggagttcaaaaccagcctggccaacattgcgaaaccctagtctctactaaagatacaaaaaaattagccaagcttggtggtgcgtgcctgtaatcccagctacgtgggaggctgaggcaggagaattgcttgaacctgggaggcggagattgcagtgagctgagatcgtgccattgcactccagcctgggtgacaagagtgaaactccgtctcaaaaaaaaaaaaaaatctatccttcaggggcagttggccagggcgttctttttcacataaggacttgaggctgtctcagggacctgggcaatagggaagggtccccatattgtcatgatcctgacatacagcatggaaactgaagacagggttcaaacctttggctggcgcagtcatcttcttcctaagaacttgggtccacttgaagtgcttcggcgcaatggcagatttacaggagggagagagcatttcaacagcgcactcacacattccttccaccgctacacggagacccttcgaaacctggatgggtatttctgtgtgactgagggccgaggatgtgtgagagacctggcttggggatgggccacaggtactggcggaatgaggccaggagcaggcccggtggcgaagggtggcagtcagctggtgagagtttccaaggggcactgagagcccccaggtgcagccgatgcggagggttaaagccagggtatgccgtattgggtagatgaggccgcagggtggtcctgccagcaacagcagcctcctcttccccacctctccagcgcctgcaggctctgcccacagcccacttgcaggaggccgcttgagccctgaggtggggcctgggctgggctcctggactcacagcagtgaacgcccacaggcttggctgcgagttggggccggcagggcgaccccttctctgaagcgccagccgcagagagagccccctgaaccccacacctcccaggaggcagccggtacccggcgtggagtgacggggaggcggcggctggcggcacaccagcggcccagatgacaccggaaggaggcgcagccccgcggagccggctccccgggcttggagcttccgcgggggcggaggatgtcgtccaaggggaggaagaatggcggtggcccgagggagcccaagtggagtccgagggccgtgggtggtggagccgggcctccggggctccagggctctcaggccgtccttcccagccaggtggcctcgtcaggcggagacagaagcagaggcctgggggccgccctccgctcttcccaaaggcccgaccctctcctgcgcgggcgctgcccccggccctcctgccgagccccatcagctcgccaactccgcaggccagcccggcggcgccatctggcggtccccgggcgtcgcgcctccagctgggtctgtgcgcgcggcagagatgctgggcgtgggaaccggcaagtcctggaaacggcttagggcccgtcagggagggcagttccacgcctgctggagggcaggccgcctgctgcgcgcttctaatccggcccagcttgtctttcccaatgcatacattcatctgctgctcttacatcctgccacgtggagagtgggaagggaattgaggccaaagcccttgttttcacctgttttgggatcctgttgagtaggagtttgctgggggcgcccgtgcaggacccccttgagggcagttggggaggcacgtgaggagcaggacagcgcataaggagggctcacacagcccagagcctggcgggaggccccgctgtgggctgaggcgtcaccaaggccgccaagagccccgccgcgctcccagggctgcacagctgccagcctgcttggcgagctccgggagctcagtacagccctcacctcccactgtctcctgtctgcgcaccagcaggcggccggccaggccctgagtgctgtttcagtgtccaggcctttgccatgtcagagtcggtgatgtccactgaagcagctcagcggaagtagaaagaagtgacgtgcttcatggggcctgtgtggagtcccaggtctcatgtcttgcaggcctggcctggcacagccacacatccctagaagagcagccaggcacaccctctgcctccagtgggcactgggttctgttgctaccgataaatacatgcggggtagacaactagcagcacgatgctcccggaaaacacactgaaagtccattttcggcatcagatgagtggaaaggaaatacagatggggtcaggtgcagtggctcacacctgcaatgccaacagtttgggaggccaaggcaggaggatcacttatgtccaggagtttgagaccagcctgggcaatatggcaagacccctatctctacaagaaaactttttttaattagctggatgtggttgtgctcacctacattcccactccagtctgggcaacagagccagacctcatctcgaaagaaaaaaaaagcaacaaaaatatgacatgtagtaaataattcattgttgtcccagactttctttgaaacagctttgacctggagcatctgggccgtgccacagcttaggcagggacagtcaggagtagaccctttggggttcagggcaacactggggttcgctcacggtggagtgctggtgggagacagccttcatcagatgagggagggcccccagtttctttcttgttcttctaagcccgagcaagggctcccttgaaggcttatgggtgcatcctgcacccagccctgccgcagccccctgctgaggaggctgcggggagcctgtgccacgtgcctgtctccagctggcctgccctctgcacaggcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggaggtaagccacacccaccagcctcagggaggccacatttgccagcttctgctccctgagctcctgcagagcgagccttcccggggtcctcacgcacacccttgccttcctatcagactccagtggggcccggaatgtgcacctcgctcctgccttccagctgagcacttgggtgtgaaatgaggtgtttgtaacaaagaagctgattacagtcagctttaatgacctcgaaaatgcgccttttaatgctgctattatcatcaaccagcactcagcacccaggagatatttctgaaaagcatgtggcatctctaaagggagcctgggggctctggcagaggaggctggaagccaccagtagcagaggccttagctggtcccagtggcttcccccaggggactttggaaagttcttatgggcagaggagcaaattccctggggatggcccatacctggactgtttgttaaatggctgaatgattgtgtctgctgtggatgagtggatggtctctgctgcttgttgaatgggtgaatgcatgatcctggtttcttgctgaagacattccaggcagtttctgagacagtgacctttgagaggaaataaaagtagaaggacttttccaacaagagtgaaggccgggggcaggatatgggtatgggagcctgagaacattcctctggcctctgtgggtgtggaaggagcaggaaccaggacactggagccctgcttggggtgggaaggtcagtgttgggcacgggtggggttggggtcaatgccaggcacgggtggggatagggggtctgtgcttccaggttcccaggattgctgggtggaccccaggaaggtgtgggagccagactggggtgaggctgggggtgggtgggcagggctcccagcccaagacctctcctggctgagatgagccagccttggatcccagggcagggcgggatgtgccaggacagggtcagcctcatcctcctgtgggtccttggcagaggcctcggtccttgccgccagcccctctcacactgctgatccctttgcagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaaggtaggcaccctgggatcctccgcccaggggtcacctcaaccctgcctcacttcatccccactttgctgcaatccccacttcactgcaatccccacttcacccatggggaaactgaggcccagggagacccacccggtgactggtcgatgatggtatcagaatttgaactcaagaccattccccatgtctgaatcagaggtggacccgggctggcctggggtgggaagggaggggttgtctgagccctgtaccgagccatgtggccctgggcaagggcccaagaaccagtgagtatagggtgaccagcttatcctgctttgcctgggactttgccaggttagcactgaaagtccggcttctgggaaaccccctcagtgctggtgggctggggaggtggggcaccctgcatgggttgggttctgggacgcaggttcccttaagtaaggaggccaccctgaccgtcagactcgtgagcttgcagctttgggaggtgctgcctgtcgctgtgaggggtcaggcagaagggtcaccggcagctagggtgggggccttcacactggccgcctgcgaaggaatgggttctgcctgctgctggcggctcttgtgacccagctgtggcctggcccccagccctctgtggcatgttcctccccaccctgctgtggtcttggtgctggaggaagcgccttcctcctctttgttcggcatgagagatgaagggcattccccaggccagagcatcccatagactggctctcggagctggcccggcagagcgtctgcccgatgggcagccacacagagagacatgggagaggcctccaccagtggcaccagagggctcagcagttgaggccccccctcccagggctgcagctcccaggtggaggcttgggttcctccctgtgcctcctcacccccaccggaccccggcggcctggcgcacccgctgacaattgcgtcctcactcacagagatttgctgtgtggtcactccctgccctgcaggaggtccgtccttggagggcattgggttttgaggaaggtgtctccacatccttccgtaggaagctgtcccgaattcggcatgatgatggccccctcgacaccctgagggtgacctggtgccaggtgcgttggttctgcccagtggcactcagaacctgggctcgctcctgcagtggctaatcttccccagggcagaggcaccctgcgcatggtgggacagagggcgcagtgctgccctggaaacctggtagctctggtaagggccagggcgaggcttgtccccgctgcacagaggggctaccgaggctgagaggggactgcctgcctctcccattgtgtgttctcactgcccccggcctccaccaccctgccagcctcgctcatcctgggtcaggcttgatgtctaaggcccagcctgtgactcctgtccccgtgctctgcagggcctgaagaaccagacacaggtgaagctcaacattgtcagctgtcccccggtcaccacggtccttatcaagcggccagacctcaagtaccagctgggcttcagcgtgcagaatggaattgtgagttccccctcctgctctgggccaccaccaccactgcagggcccagggagggggagcagctcccgtccaatggggcaggctatgtctggcagcctggtaggacctggcctgtggttgcagctgcccacagccaggccacctggggcaggaactttccatggctctctgggaggtcctggctagaaggggagggccagggcatggccgtggattgggcccctccagcctttcccaggctcccttgtccccatggtggttgtcccctgctttggagggagggcagcagacttcaccagccactgtagcttggacacaaccaattgtggcatcacttactgtgctcaacaaacagacgttcactcattcattcattcatgtactcatcattcgcttgttcactcagccattcagcagacatttgtgaagtacctgctctgtgttaggctttgtaccaggcaatgggaaggcaggagtgctgcctggaggaggtgatgctgggcttgagtgagtgtggttctggccaaaaacctgtaccagttccccaggccagagttctttagcccagagtttccaccctctcactgacctgcatttgactggcctgaattcttttttcctttgtttttcctcctgcaaaagacccagagggcagagatgtggccactaagtggagtaaagaagaaaagggctggcaatacccaaattgtttaaaccagccctgagtatgaaggagcccaggaggagagacactgcgggctggagtgggagttttgtggaggtgatggggagggtgtgtgcccacccacagtcaggaaagacagtgggagaacattctagaaggactaccaaatcttctccattgttttctggtgaagcagcatggagggttacacccaccgtcagggtggagtcccagggcttgggtttagggtccatctctgaccctgctgtgtcagagcaaatttgctgctataaaaaagagtctgcaaatctccatatactgagagcttattgcttattcatgctgcagtttaatttgcagtgggggcggtgggggtgagcttcactccacaaagccactcaggggcccaggctctgccctcagctgggctttggcagcccccactgggtgctctgtgtctcgctggcactgcaggaagagaggcagctcagaagaccttgtgaaggttttcagggccagggcagaagtggcccttgtcatttctgcccacagcccactggccagatagctcagccacggacccatggggaggctgggaagtgggggccagctggtgcccagaacgaagagggacaggggcatcgccagcgtcagccataccttccctgctgtgtgaccctcaacaagtcactgaacgctcactggattcccctcaaaaggtgcttgtgaagatcagctgagaaaatccataaagtaccccaagctatccaaggtgggcccgctggtcctcgtctctgccaaggaggaggccccgtggcccctggacctggcacaggtgccaggacgagttgtctgcaccccacttgggacttcaggacagtgcgcctgccgcaggagctcgccagctggtggtctggcctggtccggctctgcctgactgctctgcacacatgtgacctgggcacaagcagttgccccagctaatttgggggctctgcagaaaatcagctggagccctgtctgcagctgctgtgcgcactttgtggatgggcatggctgggccccagggaggagggctgggacatccttctgggctactgcacccccgaccatcaccaggccctgcctgtgtgcctcccaccccagcactggggacagtggaggaagctggggactgacagccctgcagccctcatgaggagccgtgctgtgcagagcctggggtgctgtatggtgtcccctgggctgcccctgcctggctaaacctggtgaccacactgcctttgcctcctgagtggcactggggagctgcttgtcctgttcctgcacccccttgcccagcctaggaggcaggtgggcctgggttggtggccagtgctgctcactgacagccctgtcgctgtgagccctgcaggagaggctggctttccccaccatggggtggcctgggggctacctactcgtagggcctgtgaatatagccctgcccgggatgagtttgatgccccctcagtctgctggtcttccccaaactataaccccatgaggagcacaggaactggagaagctggggcacacagaggtttagtgacttgccccaggtcacacagccatgtggagcactggtggggagagggggagaagagatgaggaagggaaggactccggtttgtgttttgtgggggctaacatgaatgggaaaggaggggacagcctggagcagcccagccaagcccaggtgcagggttctgtgcctttcttcccagagagctggagagtgcaatgggcaggtgtgaagtcaaggcggagggcagcagacggggaccagggctcgctccagctgccttctggggcaggtgcagaggggtctggagtagctcccaaagatggggcaaggtgggtccgagtggccaggaagctgagggtggtggtgcggaagggggtttctcagaagatcagggggtgcagggttgagggcagcagcagacttgcggggcctgcagtgaggaaggagtcatgtgcaattctgaagacaacatctccggggtggcaatacgaaagagagggtgccacccacggctcggtgtctctgccctgggtctagggtctgagttccggagtgatggagggggccaagcgtctgtgaaacttggggggtggtctgggtcacgactggggacgaggagggtctggaggtcccagccctgcttgtggatgcgctgttgttccaccctctggctctgcctccctgtctgtgaaatggggtcccacttccttgaggcctcagtgctcaggatgcaggggagatgctggcagccgaggagaggggcaaatgctggctgtcaggggctttctccaggatacaggacagctcaccctgagagtgccagggagggttagatgaagcaaatgaataggcatggttatgatccatctccccagtgatccagaaaatggcatgcaggcggccatatggatcagtcaccatctctgagtggctcggctgcctggcggtaaacaccgggcccttcaggcccccaggtgcggaccacaccctctgcacctgctccatgagtgcccgtggtcatggtgggggttgagggtaggggtctggctgtccccatttggccctctgtgcacctagacacagaggctgtcacagtggctgccacttgtgcccctgcaggccagggctcatccaccccagggccatgtccaggcatctgcctggctgaggtgcactggggctccactgcccagccgggacctccagggagcaatgagcctgggataacattcaggagacccgagggtgctggctactctggtccaagcccctcgtccctcacagcgtgctcaggataggacccgcagtcccaagggccctggcctctactttcaggagcctggaaccccgggctcctgctgtccccggccctgcagcagtggggcgcttcccttggtgtcacctctctgggcacccccatccccaccatgcccagtgaagctctcacctgtgtcctcccgtccttgccaggcccttcgcctgaagtcctagctccagctggcctggggcagccactcggcaccttgtatcccgggagctggtgggcagggactggggttcccctcagcctccatgtgcctggccacctggggagcatatgcaggcgctggaggatgcctggctaggagtctatcagctcctgtcccgacctgcagcggttctccctgatgaccacagaaacattccctgtggcaggtggcaatgcttagcacccagagcgagcagtcagatgagatatgggccagctgcagaaatctgggtgctggtgtgtaggagacggggaggccccctcacagttgtctgtgtctgcatgtgtgtgtacacgcatgtgtgtttgggacaggtgagtctgtgcttctcccatcccaggccactcgcctcctcccagggctcagcacagtctcctttctccaggataagagggccctggggtggcgaaggagctgccttgcggtatggaatctgcctctctccacccccttctcttctagtcctaattctccttggacatccatttttccggtttttgttttcatttaaaaaataactgtggtaaaatatatctgtaacttaaaatcgagcatcatagccattttgaagtgcagagttctgtggcagtcagtccatctgcatgtcaggcagccatggccactgcgctctcctgcacgtcttcctcctccccaacaggaactttgtccccactaagcaccaccgcccatttctccttcccagcccctggcggccccccacttctactttgtctctgtgattctgactaccccaggtacctcatatcagtggcatcacacagtgtttgttcgtgtgcctggcctgtttcatgcagcatagtgtccccgaggtctgtccgtgttgtagcacacttcagactctccctcctctccagggctgagtactgtttccctgcaggcctagagcacattctgtttctccgctagtccgtgctgtcaccctcggctgttgtgaacactgctgctgtgaacacgggtgtgcacggcgcctgttttccattctgtccagtctcgtggtcacaggcgctcccaggccctcctgtccatctgtttggcgtcacttttaggctggaatggaagcccccaccgctgcactccagcctgggtgacagaatgagaccctgtctccaacaaaaccagaaccagtatatttggcacaaaatgcccttacgtcacttggcgggggggggatgtaggaataaagtgactcttccctgtcgatgtagaccatttgggcatccggcaaacagagccttcccttgacagaacagatgccccacctttctggtggccaggggacaggctgcctctcctttcccgcccgcccatcagctaagtgcctgtcttccaggatggtaaccaggctgtgccgtaggaggccaggtggcagtggccttgggctgtgtcaccagtctctagcctgaccacaaagggagcggccctgggggaggtgcagctgggggacaggttccaccgtgggagtcagaaaacttggtggttccccacacaccatggcattaactctcttgttttaaagaaacatactgcatatcataaggatctctgtctgtgagtcagcgaattgcacgtgcacgtattcatcatgtggcgcttttccctctgcatgtcccatctttggggacgtggtggagcgcctgtcgggtgtggcgggaacacgtgtgctgacctggccatgtctgcttagatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagaggtaaggagggactttgagtgtgcctctgcatgccggttcccacgtgctcccgcctgccctccatgagcctcccccgctccagaggacacagggcatctgaaggtcagccaggctgtgtctcccatcggggctgctgtgacaagggtgaatggagcggcaggtgatgcggagccatcccggtctggctctaactgagcaaccgggagggcacaggctgctgggggtgctccctggacactacttttgggactggacctgtatgtccagttcagaagctctgcagggcacacagctctggccaccctggcaggcttgcctctctgcccttgctggccatcccctcccacagccaggctgcttgccctgtcccacttcactggctgaaccccccacagtccagttctttctggcatcgcttccacggcagtgtgaggatggtgtgggggaggtgcaggttttcctccagagctcacaaggaggcaggatcattgggaggggggatggtgctggggaggtggcacatacaccgggggaggcctggccagtgcgcagcgggtgtgcgtgtgtgtgtgtgtgtagtgtgagcgagtgtgggtgtgtgcatgtggatgtgtgagagcatgggtgtgtgtgggatgtgatgtatgagtgtgggtaagtgtgggtaggtgtgggaaatgagtgtgtgcgtgcacgtgggtgtataggggtgcatgagtggatgggtgtgggtgtgtggctgtgtgaatgtacctgagtgtgcgtgtggaggagtgtgtgtgtgtgggtgagtgtatgcggatgtacgtgtgtgtgtgagagcatggggtgtgtaggagtgcgagtgtgggtgtgtgcaggggtgtgtggctgtgggtgtgtgtgagcatggggtgtcaagcatgagtgtgtatgtgtgcacggctgtggctgtgggtctgtgagtgggtgtgaggcatggggtgtgaggagagtgtgagtgggtgtgtctgtgtgtgtgtaggggtgtgtgaaggggtgttcagcacaaaggggctgcaggctctctgggaagcgtggtggccgcacgaggcgggaggctgagagctgaggagcccggcctacagaggggcccgctggggaccgggcagggaatttgggtctggggacagcagcagcaggccgggccgtctgtggtgctccccctggtggctctgtgaggctgagtgcgtggcgaccatccttgcagcctgtgggtgggcgggtgggtggaggggtctctagttcctgttcttcggatgaggtctccaggagccacatcgggacactggtattttgtgcactgcagggtcggctgggagctgggaggcctgttttccctggactggtgggggcaggggtctggctcaggaggaggaggggccaggcggacaccagcctccctttgatggcttcaaagaaaggaaaagccagtgttcccaagtagatgctttgaagcggccgcccccacggccagcagccccacacctgtgaggaaatccacccgtggaggagcgggcgggagaacggggaagaggcaggaggcggccggggcgttggaatcctttcagccctgccgaggttatggtgcctgtttccagcagctctgagcccacgcggaacatgagtcgctgataaacaaggcttgcagttgcgaggggcctcggggtgggtttctggttgaggaacgccggggaatggctgatggaggaagcccctgccgggagcaggagcagcggaaacctacatcggccacacagatcccggcgggggagggagggcaacgctcagaagcagagctgcgcgatgtgcctttctgggctgctcagcccagggcccgagacctgcttgcctgaggaggggcagatgcacggcggctgcaccccgtggggaggccagcatgcctgcggcagctgaccctggcagtgcgagggccccccatccggaggccgcagcctagcacagtcccgggcaggacaggggagagcgtcgtgctcaggagaggagaagtgggcagtagagctccctttccgttcttgaagcagacgtttagagtctgctccttcccagtgtccgcaaagaaggattacaaggcgcgccacccacacggttggtctccctggggcggtctgaggccttgcttgtatacccagctcctttggagtcagggctcgaggccaggccccaaagggtcatttgctcaccgatccccaaaggctaagaacttgaggtgccctgggccccagcgagcctgttcccagcccccagcacactttcctggcccgtgtgtgttttgtaagaaggggtgtaggccgggcgcggtggctcaggcctgtaatcccagcactttgggaggccgaggcgggcgtatcacgaggtcgggagattgagaccatcctggctaacacggtgaaaccccgtctctgctaaaaaatacaaaaaaattcgctgggtgtggtggcgggcacctgtaatcccagctactgaggaggctgaggcaggagaatgacatgaacccggggggcagagcttgcagtgagccgagattgcaccactgcactccagcctgggcgacagagcaagactccgtctcaaaaaaaaaaaaaaaagaaggggtgcgtgtgtcttcccccattgagctcctcctcagtgaagcagagtgcatccctcgcagtttctgccgaggcctggccacccccagccagccccagtggatgggcaaactgttgtcaccactagaagtccaatttctcacccctcgggtgtcagctggactggaagcaaaactagcactcaactgtattgactcctctggagccaggggtggggacctggagtctcagtctgctgcatctggaaggcatcataagtgtccccaggcctgggcaggctggccttcctccttcactctaggagatgggcatttgaagcagaactctggggggtttgcctctgtcctttgctttcacctgattgtgggaggggaggtgggagggcagcggctcagcctcctgtttctgtccgcagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgaa

SEQ ID NO: 664 - DNA, 196677 bp, Homo sapiens; identical to SEQ ID NO: 663

SEQ ID NO: 665 - DNA, 82198 bp, Homo sapiens
ttcataaacagccacatccgcaaggtttattcctggatcacaaaccaaccccactgaccaaactcccaagtcactttatattaaacttgttatcaaatcacccacataaatatatataataaatacaaaaacagacaggattttttttttcagtctttggtatagagagctttctcctcctcttatttccccctctgtccctgtgctctaaagacatttcctcgcattcacattatttccttggatacaaaaattgcccagaagtaaactttgtgctggaacccctgcctccattgacagtcccgccggggacccagcccacagcagcccaggggagaagcaggctgtggggactcacacgtagtcgttcagcctgtacccgctgtgcgtggccgaggtcactgagggggcccgattgtctttgtaggcagctggtggctggtaggcaggtgcggtgtttgcagtggtcgtggtggccctgggcggggcctggtagggcctgtagggtgcctcgtcctggcaggacaggcaaagcagggtgccaccaatgagcgagagggacgaggagatgaagcccaggtacagggcctggccaatctcaaacttcatgccgctgggcagcagcgggttgtagaagttctgcaccacgtcgttggtggtccaggagacggccaccatgcacaggaggccggccaggatgaagagggtgccgccgaggatggcaaaggtggtcttggcgggtgtgcccttggcgcagcgcgtgcacttcatcccgatgacggcgcaggcgcaggctatgcccgagagcaggcaggagatgaccatgagggcgcgggcagcctggaggtcttggggcagcgccagcagggatcggtagatctggcactggtagatgcctgtgctgtgccacacacactccatccagagccctttcaggtaggacacggccgtgaggatgttggtgcccacgtgcgctgtcctccgccagtgcggcaggatggtggtgatcaacgtgcccaccatgcccaggaagctgagcaggaagcccagaagctgcacggccgtgctggccatggtgcggctgcctgcctaggccagccgggcagctccctgggccctcggggtcacgccgctcctcaggtgccagccggagccctaatgaagccaagggaggcgggagcagggagagaaaggaaatgggttaaagattatctcatgcacttatttctgtcaccgaaaccaagtttttcataggtggttggtgtggcaattagcatgttctcaaaaatagtttctgagacttcactgggtgggagagtaactgctttcctgggaaggtgggatctgaagggatgacagccggacgctggcctcagggaagggttccagccacctgccggaagttctgcttatgtccacccttgagcactgctgctgcattggcatctcctgtccttcctggttcatcagtaaccaggaataacagttgttaaatcaacatgtattattcatgccttggactgacagtgctaaggtgtgtgccagctgtgacttagaatatagccctgggcggttgtcaggatgaggggttttctgaagtaggcaacttccccacccacgtgctcgggcagggagaggtttagtcccctcggcaagtcagatgctgccttcagaattccagagctggatgtgacctagagattgtcagctgatgccggggcaggaatttccaaggtcacagctcctcaggagctgcggcaggagcacgggccagcatccctcctctccagcacggacctccgctcccaacacgctccccattcactatgcctgcttgtgactggtgagggctgtccgagggtgactttattataaaacagaggctgctacctggctttcagggatatgggaatgctgagccctttcaaaggcttttaaagaattcttagcataccaaaatccaggatactttttcgggacaaggacccagcatcaacatagggccaggcatatagaagacactaagggccaggcacggtggttcacgcctgtaatcccagcactttgggaggccgaggcaggtggatcacctgagttcaggagttcaagaccagcctggccaacatggtgaaaccccgtctctactaaaatacaaaaattagccaggcatcccgtaatcccagctactcgggaggctgaggcaggagaatcgcttgaaccaggaaggctgaggttgcagtgagccgagatcgcgccactgcacttcatcctgggcgacagagtaagactccgtctcaaaaaaacaaaacaagcaaacaaacaaaaaaaaacactaggaaatatagaaggaaggaaggagagagggaagaagaggagggagggaggaaggagaaagcaaggaagggggagcacagagaaaggaaggaaaaaaaggaagggatgaaggcagaaaaggaagggagtggaagtcttgagtggaccactagcttttctctcctgcctggggcaaggtaatcagcgagaccgggcattagcagcgagcattaggaggtcccagccctggctgcgcccatccagtgggcgacctggggctcagcttcttttttggttctgaagggagaaaagggaagcgtctctgctgatgacaagtcacttcagcgtcccaaaccagcaaagaatcagtaggcaaaacctgcttcttcttctgcagagagctgagcctcagttaagcagtgcaggctgcaggcaggaaaagcgggtctgcagggtgttgcccatgagaccctgggacattgtcaagaaatccccatcggggctcggcggctcacgcctgtaatcccagcactttgggaggctaaggcgggtggatcgcttaaggtcaggagtttgagaccagcctggccaacatggtgaaaacctgcctctactaaaaatacaaaaattagctgatcgatggttgtgtgcacctgtcatcccagctactcaggaggctgaggcaggagaatcgcttgaaccgggaggcggaggtttcagtgagactggatcatgccattgcactccagcctgggcaacagagcaagactctgtcttgaaaaataaataaaataaaatgaaataaaataaatcaataaataaatcctctactagatgtaaatcacttggtaagtaaataattaataactgatgcttccactgggagtctaaaccatcatcttgctaatttaaaaacatatactgggtttaaatactttggcattgtaggaggtaattggttctgtcctggtgaatgaacaaacaaaaataaataataacaaaacaacgtggtgcctcacaggacacggagtggactgaaggtgtgtccaggtgatagggtttggatttgtgtccccacccaaatctcatgtcgaatggcagtccccagtgttggaggaagggcctggtgggaagcaaatgaatcacgggggtggacctcccccttgctcttcttgtgatagtgagtgagttctcacgagatctggttgtttaaaagtgtgcagcacctgcctgctcccctctctctcttcctccttctccggccgtgtcatgcctgcttcccctttgccttctgccgtgattgtaagtttcctaaggcctccccagccacgcttcctgtacagcttgtgagagccaatgaaacctcttttctttataaattaaccagtctcaggtagttctttgactcaggttgcattgcgagaacggactgatacaccgagtatttttctgctgctgtttttctgctgctgctttgggtgactatttgttcacagcccagaatttgccacacgcactatgcacgatgctggctttgcacaaagcctctcttccctccactcagcaagcactcactctgtccaggggctagggacgccatcacagtccctgctggccagagaaggaccggggccggctgtcctatgctcactgccctgggggaggtgctggcaacaaggccaaggtggccaccctgataggcacagccagagggggtgccagcggacccaccctgcaccctgagcacaccgatggcaccagctgactgagcctgagcatggtttgaacactgacacatttcctagtttattcccaacaacctaatgtggcagtgactgttaccatcccctttttacacatggggaaacgagaggagcagaggatgaaagttctgtgcctggcctggctagtgttctccttgctgtcatttcccctttaagaaacactacctgcttcaatgacataggactgaagttagtgtaagggctgagggatggtgtgagcaacagattctccttcccacagagatctcagaacaatggccttgccccttttgcagtggtttgggcagccagggcaaccaactgccctgctttgctagggactgaggggttgcccaggacagggaccttcagggctgaaactaagacagtcccaaggaaaccaggaccagaggctcctccaggtgcccagatctccgaatggcctctgagatctcttcctgccctgctttgaggctgcctcaaggctgacggccacacagggtgtccctggtccaagcataatggggcttcttgcagctctcactgtcaaggtcaataattaagtatacagaccctaaagaatgtggcataaaagccaagcccattaggctaggcaagtggaccagaggtttattggaggtctaaatatttatggagagcaatgatggctaattttagaaaccattaggttgctatttttaaacgtgtgctataaggatttgctaatttaagaagtgagtgttaatgagcccccaactcccagacacaagctccccaacctgctttccttcttccttaccagcagctgctactggcattaggtaataattcaacttccccgcaactacttttcactttggggcctttcaagggaaaaacaactttaactgaacgcatctccctggaagccacataaaattcctccgtgatgctccggaagcgccctgccctgcagggctgtttgtataggaaggaactagcccaagcctggcctcccagggggagcagcccatgcagggctgaactggtgttcacctgtgggctaccattttcctgcagccacgtgtgtgcatgtgggaagatttgctagagagatacggatccaaaacaaatagggttccaagcatcaagctctagaaagccctcgacaggctgagtagtggtgggaaggcagaatctaacaagatgtgttagaggatcagtactgggtcctgcatttgggttcacaaaaccccaaaagtacaatcctgggtggggagtatgtggcttagctgcacctgagagcaggatttagggctgagtttcccaacgacagcatcttggaatgctgcatttgcaggatgtcttgtgtggaggacacaaatgtcaaatatgtttaagaaaacctgcgtgactgtaggacttctcatagctggaaacgtgtcaatgtgcatcgtgactctcccaggaaatgtctcatgggcagcatccgctaaacttatttgactagagacacccccctgcaccccctttaccaaagaacaatttgcaatgaaatcactttggcacaataacttggacttggcaatggtgagatagagtgggttgctgtattagtttgttctcatgctgctatgaagaactgcccgagacgggtaatttataaaggaaagaggtttaattgactcacagttccgcaggactggggaggcctcaggaaacttacaatcctggcagaaggtgaagcaaacacatcctctttacatggcagcaggaaggagaagaatgagggctgagccgagggtgaggccccttataaaaccatcagatctcatgagaacttactcactatcatgagaatagcatggtggaaaccaccgacatgattcaattacctcccactgggtccctccccacgacacgtggggattatgggaactacaattcaagatgagatttggatggggacacagacaaaccatatcattctgccctggcccctctcaaatctcatgtcctcacatttcaaaacacaatcatgtccttccaacagtcccccaaggacttaactcattccagcattaactcaaaagtccaagtccaaagtctcgtttgagacaaggcaagtcccttctgcctatgaatctacaacatcaaaagcaaattagttacttcctagatagaatgggggtacaggcattaggtaaatacccctattccaaatgagagaaattgaccaaaacaaagaggctacaggccccatgcaagttcgaaatccaatagggcagtcattaaaccttagagttttggtcgacttcatccccagcagagagagtatcagaaaacgacagagcggtaaagaattttgaaaatctgtgaaaggcaattgtgaaatgctagagctgctataggcccttccaactggctctggtttcaggatcaccagctctgaagggagggggtttttctgtgtgtgtccatataaacttttatgttgtctccctctgttttctctgagctatgtttttctttaaaaaagcagggttctggagcacacagtagggtgccctcattttgctcacctcctggcccacctggaccccagctgcgtcaactttggctccaaattaatcatcatttcaacagcagtggccatggggatcgcctggccaggactgaggggtggacgtgttgtttaccagcctgcgtcttgactgcctggggtccctccctgggcatgtctgtttcatccttcactttgtcctatcttcagaagtcctttctctagttcttcagggtgtgtgctggggcctctgtcagtccaggcttcttggaggggtgcgggggtgggacgaggccaccctatctcaccattggtccaagtgactgtgccaaagtgattttactgcaagttcttctttggtaaaggcggtggtggggggtgtctctagtcaaataagtttaatggatgctgcatatgagaccaggcttcttggaggggtgcagggatgggatgggtggggtgtttgagtcccttactctccttaaccctcagcagtctcacctgctactgtcacctcatcccttgcaaaatcagcccctgtgatgaaagctttcctatggacacacattgctccgtggcccttgtctacccaccttggtgaaagaaatgtcagccccagatgggaggggtggaggacatcagcggggagctggggcacaagccaggtgtgtggtggaagtttctttacccagaactgccctgagccctactgtgcaggtagagaattggaggatgtggccaccagtgccttttgcctgccatgtggtctgaatggctctcgagatgtttgggaacgagccattatatatgtttgccctcaaatgctctgacatgatgttgggtccattatagaaacagcgtaaaacttgatttgctttctgtaaacttattagagaaaaatgaagtgccaccttcaaatgaacatagtcattggcccttcaacgttgatgttcagccacttcagaaaatgtctggttcaaaaacctgaatgtcctcactgtcaccccaaccaaatggcctcttcattactgtttagctatttcataaatgctttaggctggagatggtggctcacacttgtaatcccagcattttgggaggctgaggtgggcagatcacctgaggtcgggagtttgagaccagcctggccaacatgatgaaaccccgtctctactaaaaatacaaaaattagccgggtgtggtgatgcatgcctgtaatcccagctacttggaggctgagggaggagaatcgcttgaaggttgcagtgagctaagattgcaccactgtactctagcctgggtgacagagtgagactctgtctcaaacaaaagaaaataaacaaaatcataaatgcttgaatttaggaactaaaaataaactcaggggagatttggattcatttagataagacatattagcaaaactacctaacacagagaaaagaaagtaactcttacgctatgatgtatctgcatgaagtaacttcaactagtattacttttttctttttctttctttctttctttcttttttttttgagacagaatctcgctctgtcacccaggctggagtacagtggcacgatcttggctcagtgcaacctctgcctcccaggttcaagtgattctcctgcctcagcctccagagtagctgggattacaggcccccactaccacgtctggctaatttttgtatttttagtagagagatggtttcaccatgttggccaggttggtcttgaactcctggcctcaagtgatccacccacctctgcctcccaaagtgctaggattacaggtgtgagccactgtgcccggactcagctagtatttcctaagggcatcttggacactgtgtttcttaatcatgtgcgaaacaaacgcatatcttttcaagaagcttagggatactttagaggggctatttttagcacatcttcttacagaaatatgtaagaatgatgagaaagcgatcaagcaataccttggaaaaaccacttcatattcatttcacatgggctatactgtggggtgttggctctaaaaataatattttcttcattactattccaaactttctgtaactttccttgggttatttttcagactggcaggcatctagattttaaatgtgtgaggactttctataccatccgcatagagtctttgatgcactctttccatgagaggcagagacgggatacttacgtgactacgacttattactatcatgatagttactgcttgctattgttatttaggaaaaccaatgtgaagtatcttactcaaaatcacacggaaatgacacgttccatgaattcctcctgtctcttttggatgaagaaataaaaatctatttttttataacaagaactgattcgaagaaaagtttatgtgaatacaaatgaaaaccatggatgcagttaaatgctaacagaggctattttcaactcagtaagattgaatgacctattgatttaccgaaaactacaaacttaagtcaccatgaccacaaaaattaaaaccctttctggaggcattatctctctcatttcaactcaccaaatttcattagaattcatttaaaatgcagtagatcaacatttagaaatgaaatgagtttcatttacttaaatacatgagtgccttttcagagcgatttttcccgacaagacagtcaggcaggtttgctatgttgctgtttttgttgttgttgtttttcatttttcaaggtgcaggtcattaaaaacttgtcatctgagattaaaaaaaatactagaaaagtaaaacaaaacaaaaacaaaaacaacaacaaaaaaacaataccccaaaaaacccaggtggacatacaaacatttcctcaagccttagctgattgttggatgacttatggttaagtgttctgtgggaacactttatctaggggatgcaatggattgacctggtcccccaaaagagatatgttgaagtcttccctgctcccagtgcctcagaatgtgaccttatttggaaatagggtcattgcagatgtaattagttaagataaggtcatacgtaaaatagagtggcccctaagccaatagggctggtgtccttataagaggatgggcatatgaagacggagatagaaagaacatgtgcagacggaggcagagagtggagcgagaagttaccaagtcaaggaatgtggaggatcgccagcaacccgcggagaatcgccagcaacccgcagaggcccagcaggaggcccaggacagatgctccctcacagccctggaaggaaccagcctgcccacaccttagtttcaagcttccagccttcagaatcatgacagaataaatttctgttgtttcaggcctcccaggttgtggtgctttgtcatggcagccccaggaaacaaacacagcagagtagctgaatggtggcacggggaattacagagaaaatgctcggccaggccccatggcacaggcctataatcccaacactttgggaggctgaggtgggaggatcacttgagctgaggagttcaagaccagcctggtcaacatggtgaaaccctatttccactaaaaataaaaaaaaattagctgggcatggtggctcaagcctataatcccagctactttggaagctgaggtgggaggatggcttgagcctgggaggcatagattgcaataagcagagattgtgccactgcactccagcctgagtgagagagcaacatcgtatttcaaaaagcaaacaaacaaaaaaacctcatttgtgattataagaactgcgtccccttccaggacaggcattgagtgtgatctggtggcttcacatttgtcattgataaaaacaggccaggtgcagtggctcacacctgtaatctcaacatttggaaggccaaggtgggaggactgcatgattccaggagttcgaggccattcctgagcagcatagtgagatcctgtctctacaaaaaacaaacaaacataaaaacaaaaaacaaagccatggttagcttcatgtctcaaagtgtggaggacaaaatctaaggaaaaggtagaggacatggagaaagaagaatctggaaagtcccctgcaaatttgaaaattcaagtgcaaacacaatctatagtaagtaagccatatagtaatcaaatgactcagcttctccaggcttaaaaagtgtgtgaattcacttagctcacagagagtttgggggggctcatgtctccagcttgtgtgcaattggctggggtataattggtgactgaccttttcaggctgggtgtctggttttcttaagtcaacatgtcttgatttcatagagcataaaagccccaaatttggggcagagtccagatttgaataaggtgactcagaagcctgctgaagctttaccttggaaatccagcagagcccactaggctccgcctttagtcaggacttacagcaaaatagaaaaagaaagcaaaccccaaacaagcaataggacattgtcacacctggctgaaaaccttcatgaattagacaactattctgtgaatttcgtaagcctctgaaaattatttacttgagaattgaactggggataaactgcagtggttaaaatgtgtcaaatgaaaacataaggctaagattttctaatggtaaggaaaatactattaaacatgaggtttaaaactcattctctgtaaatttagcctttgaagcccaggtgctccaaagcagttagttgttaatgataagagtaaaaacagtcatagttaaagttccagagtgtttatgatatgccaaacatgtgctaagtgcttctgtgggcatgcaatgaactcttaaacaaatcgcaatgcgcattttgccatctttatttacagatagggaaactgaagtgtagaaaggttacataacttgtccaaggttacgtctgggctgaattagggagaccaaacaggaggttcttgtgatctttcaggtaagagatgccaggaggccgagccaaggtggtggaaataaaggtgggtgccaggaagaggtcagtttctatattcaggtgaggctagcgggatgtgctgatggtttagctgcggggtgtgagacacaggtgcctaaggttattgtcttgggcaactggaggaatggagttgccacttattgagagcttgaagagggttggagatctgggtttggaggatgtgatgatcaattttttgtgtcaacttggctgggccatggggtgcccagatatatgattgaacactattcttcatgtttctgtgaagttagtccttggacaaggttaacattgaaagcagattgccctccatagtgtgggtgggccacacccagtcaggtgaaggccagactggaaccagaaaaaactggtgtctccatcagctcaggctgccacaacaaaataccacagacttgctggattaagccacagaaattaattttctcacaattccggaggctggaaagtccaagaccaaggttctggctgcttgggttcctggtggaaattcacctgacgtcttctttgcatgcaggcagaggaaatctttctctctttcccttctttttagagcacgaatctcattgtgagggcacccaccctcatgacctcattgaaccctaatgacctcccaaatgtcccgtctccaaatactatcacatcggggcttagggctccaacataggaattttgggagaatgcaaatgtttagtccataacatgcagcttcacctgagcaagaaactctctccaacagactgtgtttgacctttatttccaacatcagcccttctcagctctatagcaggctgccttccaactgaaactgcagtgtccgtgatcctgggtctccaaactgctagcccaccctgcagaatttcattttatagatgggctcttgctatattgcccaggctggtcttgatctctcaggctcaagtgatcctcccacctcagcttcctgagtagctgggactacaggcatgtgccatcacacttggctaatttctaaaaatgttttatagagatggaggtcccactatgttgcccagcctggtcttgaactcctgggcttaagcaatcctccaaccttggcctcccaaggctgttggaattacaggtgtgagccactgtgcctggcccaccctgcagattttggacttgccagccttgagaatcatgcaagccaattccttagaataaatagatctctttctatataaatgcatattcgattggctctgtttctctggagaactctgactgatacagaggatgaagggcagaagagaggaattttcttttggacttgttcagtttgagatgtctgtgcctacccacctggggataaccatggttgcatatgtaagtgcagggttcagggagggactgaactggagaagtctgtttgtgtcaccaccgcatggagatgggattaaaatatgggatggagtctcttaggagggaacgttagatagagaggagcaggggctccagggctgattctaggaaccctccaacatcaggggagggatgaggatagaggtaggaagaggagccagccacgggctgtaggaatgggcgatagtgaacggtcaacccagaggagactggtgagggaggacagagctccatgttggagagagcaatctactctgtcaagtcaagtaatctgataaatcaagtcatctgagcactgagaagtggtcactggattagcaacatgaaggaaattggagaccttgataagctcagtttcggcggagttgattggagtgggttcaagagagaatagggacagagggacaggagggaatgagcccagagaattctttcaggaacttggaccctccaggggaatcaggaaatgaggcaacagttttaggatgggttccagggcccatagacctcaggatatctgtcaactcagccaggaaaaaaagtgacatcttctatttcatctacctctcactgacaattagcatttccttcaatcctgaatgtaggcagccacctacagcaatatgaccagtgcctgtgccttaatcagcaatagagaccatgatattttgcatcgcattacaggcgttgcagatacctgcaaaggacatttatcactctaacaatttcaaatgatacttataagatgcttgctagacctcatgatgtaatgcattaataaggaaggtcgtccattactaggaacagaattgcactaaaatattttgataactatgttttactataattcacttcctttataatcctgcatgttatgtgttatattacacatttaaaagtattgtgctgagaagaatacatcagcttcgccagattgccaaaggaatcccaggcaatccccatcccgccacccagaacaacaccgataacaaaaaactaaaccaaaagagttagaaacctctgccagtgggatgtgtaggcaagagaggacccttgttttgctgttgttttgaagatgagaggcatggaagcatgtttgcatgcctgaggaaatggttcagcgaggagggaaacatctgtaggggcagtagggatcctgtgtgcacatggagagaccagctctgaccagcatgcagagaactcactccagaacgggaggggaggcgggagcaggaggctgggggagatgtcagtgggcaataacgcatgttctgagtttgctccaagtttctcagggaaataagaagcaacatgatgtcttgagacaggagatgggggaggaggtgcgggaggcttgagcacagaggaggagaccatggtcatccaggagaatgaccgcaggcctggaccaagtcaaggggtcaagtgctagtcagtgccgggtgcaggtggggcaagtggtcctgcgggtaccatagactatcacgccggacagcctttcccagcaccatcaactgcactgcgagggtcccaagtggacaaagggctggactggacctggtggggattttcctaggggaaaatgatgaaggcagacagccaagggaaatatgcgtgcacacaaaggtgtgaacatcatggcgggccgtggcgtcaaagctgggatggagggacattgaggacaatagagaaggtctgttcatcgtggagaagtcacctggatcagtggctctccaccctcctgctgtagccgcagcccttggagagctttaaaaagatccggatgccctggctacctccagagattctgattcgctgactggggtggggtccatgcatgggaattttcgagctcctctcccccacccggtgattctgatgtgcaggcaggtttgagaaccaatggcttatttatttcattaaaaattatttttcactctgttggccaggctggagtgcagtggcacaatcacggctccctgcggccttgacctcctgagctcaagtgatcctcccgcctcagccttccgagtagctggaacttcaggtgtgagccactgcacccagccccgctggcttcattgatttaactttttttattttattttattttatttttttgagacagagtcttgctctgtcacccaggctggagcacagtaggattacaggtgcacgccaccacacccagctaatttttgtatttttagtagagacggggtttcactccgtctaggctggtctcaaactcccgacttcaaatgatctgccctcctcggcatcccaaagtgctgggattacaggcatgagccaccaccgtacctggcctgatgtaacttttaaaggtcctattaggagctttaaagagtccaaaacggtttaacagagagtcatagttcagatgtctgttctgctgggcctgcctgctgagtgcaggctctctttgggatctcctgagatggagacaggtgtctctggcctgtccctggaatattgtctcacctacccataaggctaggctctcccactcccttcgcttgaaatcctcttctccagctacaatcttaccttccctcctgtggccctgcacccttgccttctgccatctagaaaaagtggttgggggggtggttctttatttatcttgctgccttctggctcttaccttcccagagccccacggaagcctgttcttacaacctgggtcctcttcctgggaccccagcccactgtgggcactgagcctccctcattgttaatcttggccaagaagttaccccacaggcatttatattttaatggatgactatttttttttttttttgagtcagagtctcactttgtcacccaggccggagcgcggtggtgcgatctcagctcactgcaacctccgcctcccaggttcaagtgattctcctgcctcagcctcctgagtagctgggattacaggcgcctgctaccatgtctggctaatttttgtatttttagtagagaccaggtttcaccatgttggtcaggctggtctcgaactcctgacctcatgatccacccgccttggactcccaaagtgctgggattgtaggcgtgagccactgccctcggcccatggatgacctttgaaaacaaatctcctcctggcccaggccccaaagcatacactcacagtggtgagaatgattgggtgagtcttccagaaaagcctgtgatagtttgatataaagacatttagaattaattgggtcaggtatgagatttcagattgcagaaatccttgtgtaagcaaaggccttgcagctaaagtagtgcatggcaggtgtggcttagcctttagacatacacacagtggccagattgtgcatttgctctgaagagtaccaggccctgtaggttacctttgcctgctctcaggacttgctagataatttgcagaacccagtgcaaaatgaaaatacagaaccccttgttcagaaattattaagaatgtcaagatggcgtctgcagaacatcaagccaagtgcaagcctgtctgagcacggggctccctgtaactgcacagatcatgtgcctgtgaagctgtccctgcctgctatggacatgctgggaactggacattgggattttccccccttaaaacaatgagtgcattgagttagaatgttgaaaggaacagagacgctcttgcagtgttctgtagaatcgaaaatatggtttcatatgtttactttaccttcatttaagtgtagccctgatgcctctgcgaatatctgccatggaagagccttttaaaaacaaagctcttgctggtctccagtgcccaagagtggccgccagtggaaacagacctggtgttctaaatctcagtttttgtttctttcttcttccaagaaagctgtagatgagcatgtgcacttccaggcctagaagggaacagctgcctctgggtggctcgcctctttgcacaaggggctcagctcagagcttcccctaagcctggcaggtccccccgacacttctcttgggaatgaagtggacaaagtgagtgaatgagcctcagcttctcctgtctttttatagagtcacccgacagggagagataaaggaggtggtagcagcttaggcccaggagccctctcagcaaatggcccagagtagaaaattccccacactatgttgctgttggtcacccggtgaaaagtccctggccctggcagccacttgtcctgcaaatggtgcgagtgaagaatccacagattagctggaaggaggaacgtttgagtttgaaaacgccaagaatcattcctgaactggcaaggctggccacctgcgttttaaaaacacattggcactagccttgaaaacagacttttagacttcttactctgcgtaatgaaagatcttttctgatatataggcaacagaatgatttttttaaaaacaataatggacatattccattttattgatctttacctaaaaactaaaaactaactggaaaacaggaaatatttaatagtgacattttcatagcaccaaaggaagaatctacgtgtcttcctttttatagatttttctgtagatgtcttaagaagcattgaaccctttatacagatgggtaaataaaacacagtaagcttgagatatgcaaatcagattggagccagataaggatgggggctggcgctggcttcaattctgactaatcttgggcaagctgctcagcctattactcactgtctacacaggaatgactgtctacataggaatagctcctctgcagagacatctagaagatgctgagataatatatgtaaaaactgacaagccctttgggacagataccagcaaatgcaaggcgtatgctatggaagttttatcatcctaacagataagcccgtccccaactccagtgagtgactgagagacacgggcatgaacgctgagctcagatgacagcatcttttcacagcagacctgggcccagcccctggaagcacacgatgatgaactgtcctctggtttcccaagacttcaaaaatgaaacccagtgatcaagagatgtttggctttgaacactgcgggaattaaagccagcacccagttaaagccagtgaggacagcactccaaggtttggggacggtctcaggacactaatcctggttccttttctattttgcctgggtccctcctgcccatcctgggaagccgtggcagctgttggggatgtggggccccaggtaactgaaggattaactcacgtctcaaattgcatggcatttctcctcttcagcaccattttttaccctcattgagagagatctatcacttccccccctctcctgccatgccaatatgtgtctgtgttggagggcaggggtgtatttagggagcaggagaatgttcccaagtctggaaactcggaacagtctgcctggccctctttgcagaaaaacgagggagtcccagcagacagaagggggcagtggcgctgagctccccgagctgagctgtggcctcaaaacactgaacagattcagtccttcctcccaaacaggcctggtaagcgatgaaaagagttctgcccaaacactcaggaactggattattgtcgttcctggctcattaggagcctggctgccctcatgccagctgcgtggggtcctctggaggccacccagaccagcctgcagcttcctttcctgtaggggccagcacggtcccttcctctggagaacgctcggacccctggctgcatgcacatctaaccggcagggcctaagggcttccaaaacagatgactgtcaaccccagcccgcccaccccacatccacagcttcaccccaaactcacatgcagaaaacctcgagtctcatcttcctgttcaggtcccttgccagccggagccgctctggagcctggctggactccagctcccatgtgcaagaggactcagccgggacgctgccaccctcctgccttccctcttctgccaaccagacgcttccaggacggagtatttgagagaaaattgtctagacaattacagtgttccttagaatggcctgcgtgggcacacgtgccacttggttagctagcatgagaggaggtggcttggccagagcagacattcaagaccaaccagaaatgtcatttctgcactgtggaaaaaaaatgcacgatacacctgaacctgggcatctccttcctaacacgcgctcaggatcaagcctccccttcccagcctggcagggttgcagggcgtccatagtccagcctacgcctgcccaggctctcggctccgggtccattggctgttcacactcacttccctgtgtcctggaactgcctgattgttgtagattactaaaaatccacagctcattccctcctgcgccctgaccacctgcccacagcgactgtgtcctcctctgagccaccacctggcggttgtcctcacactgctttggacttttctgctattgagtaactcagcttctcagcctttaggctgctatgggccctagatgcatgctggtcgattctgatcaacgagcaactgcttttgtttgtttgcttttttctacagctgcagctgtgggtgattcggatggtctgttggtggaatgtggagctggacgggtcaaggagcacagtgtggaaagagggacaatttgctacaagttggagataagagacatggcatactgtgaaaccagtgctgacggaagaaggtgactttcttggaaggtcaagacacttgcttgacagcgatgtccaggagggctagggagagttctgctggaagtgaaggcagcacctgagggtggctgagggaactggtcagggctgggaacgcctccagccctttgaggaatgattcgctgattaagagatgtttggccttgaaaattgcaagaatgaaatctcttggtgggaatgtgtagccaaaagccagcaccctgagtggctccaaggtttggggaccctctcaaggcacaaatcccagttccttttcaattttgaaaatcgttgtgggcgattctggaattgagaagtgtgctgagagccatggatttaacatgacaagaatttccgccccttcgtcactgagcacaccgcaaatgctccagggccagggacttacttgggcttctgcgtgtcttccacagtgtgcatcaatccgccgggctctggttggtgtttaaaaaaaaagatgcagcgaaggaatctggtgtggacaaacgccctgggcatggaccaaaagcctggcccttgtgtccctggcaatgggacggtgaaggacagaaagacagcacatccagtagtgtcaggagcttggagcaggcattcggaagcatctgttaaatgttattgatggaggattgacataacccacatctgcatagcttttttggtctgtttttggaagtgaacagtcacaaacaaaaacaactttggttcaggtcatttataggcccagatcctctatccttagaggtttcccaccagatatactatttcactatctatgccaggaaagttacgtaaaaccacgcagaattttacctgacaacgaaatagaccttttcgttagatcctccaccccacctaaagcagttacacaggctgaaatgaaactgttaaaggaatgaactaacttggagatagaatcatcgcctttgctgaacaccattttaagaatattggaatatataggggtaccagcataatagtaaaatgtgcccatattatctataattttatgctgggcactttttagaaattattttttataactttgtctttgagatgatttggctacaagttcattacatttagtttacaactggctttgatttcttggcattcgttgtgtattattaggaaaccccgcagagagaaaatgtaaactccaaattgctttaaaatattatgatagtttttagggatattacactgtgacagtgaatgaaatggacgtaacgttctgttttgtagatattttgtgaaatctttattagtcttgattttctttggaacaagtcattcctgttctgggctgaagcctgaaaattccctgacctgtgaccctggcccaaggctcctcttggataaaacagtgtttcctggaccagagggcaaagtcacagaaacatgatgtgacgaaatctaaatagaaaggtattgatttgttcttcgttcatcaaatagttattggactccagcacgtatgagtagcagggagcctggctagcactacaccttcccctcctgcctctcagggtcagggccacaggcacacacagagcgagggaaaatgagggggtagagaggctggtcccgagtctccagcccttctctcccaatcctctccctgagtgggcagggaactcttctcttggctcctccaacttccatcaacgtctgcccttgggtctggttttaaactctaaggtgtaaatgactcataatggctcaacattttgtccctcccaagaggtatttttaagtctaaggaataaagatttaatagtaaaacttcgaatgccaatcaggggtaagtgaggatttggaagaggaaggtcttgagcattttcctaacactgctaaaatcatcccattgagttagggcagcaactatcctgatgggctgggtatgatggaagttagtcaatgtttcaatagatggatggatggatggatggatggatggatggatagactgacggatggatggatggatggatggatggatggatggatagacggatggatggatggatggatggatggatggatggatggatagatggatggatacatagatcacctttattctgatctcaactggtctttgaagcttgattcattttttgatttctcacggagccagactagggtctgacacattaggaagctggcaaaagtttgttgactaaacaaattaatgaagggaaaattatgtatgcagagatgcctggggtttgggttaccgttttgggtcccctttgatttgagcgacacacatgctgacaacttgagtctgaagttagtggatccttagctaacttgctagagtaaaggttgtggtaaaacttgaccttgctctattcatcaacagcatatcctgtgaaagtcacgacgcttccatgaaaaccttggtgctaggcctgtgatatctttgcagaggtctgacctaaggagactgcttgtgtcaatagtaacaacaatcacaattgtcctgaacacaaaggcagcattctttgtgtgctagctgtggttttaagcatattacgtctatttactaatttaatcctgaaacagcctttgctttaggtactcctattaacctcattttatggatgggaaaatagactgtgagaagtgaagtcacccgcccaaggtcatacacctgtaagtggtggaggcagggtttgaaccgagcacactggcctcacttcgtgggctcctaccactacgctgcctcatgttactaccctgtatccacctccagaatgagttggcagctgcaagttctccccaaggccccactgcagcccttgcatctcagcatcagctccttgcacggccaggtggtgttgtttctgactcggggtctgcatctctctctgcgccgctgggttcaggaggccctgaggagcgagcccggtccagtgctagcttcgcagctcacagcccttgggcaaatgttacaactggagggctgcacaaatgcatcatgtggtttcaaaccatgcgtctctctgagcaggaattgctggaatgggcctcagaaagttcctgaccctttgtctggggtcacagggtctgtgtccagtgaggcctagaggccacgtgaggtccagagagagaagcacaaggcagctgctgaggcctcataggaaccatgcggtgaaggaaccagggtttcttctttctccatggcaactaggagtgcaggtcagcctcggaaaaggatcctccatctttggttaaaagaacggtgagcccaggtttggtaatgatgtagctgtgtgagttgatggatgcaaagtgcccggcgtggtgccttatccatcgtaggtattgccgaaggagagcttttgtcaccccttcctggagaggggtgttgtggtttgtgggttgagaccttttggattcctggcattgacaatggcactatttggggtggggaccttcttgttggaggagtctccttccctccctgctggtgatataggcaggaaaagaagccaagaactaggccaattgcaataaagaaagaaagaagcaccttctgagcctctcttgccctgtaaggagccaagggggacagggccagatacggacccactgcagggatgggcagtctccgcccttcactgaggaggatgcaggacttatggccccactgggcggcagggacacaggaacctagactgtccatgctcagacacggtctggatttagaaccgtaggccttggggccgttttcaaaaaatagaccctttccttaggaaaatcccacaaaactgccccaaagacgagtgaggtaggaagagcatgaggctcggattctatttacgcatgcatgtccattagattctggattcaaaagccccatgttcttgggtttaagattgtactttctgacgtgaacagtgaattgcaaattcagacttaagagatggttacttttccaccaagagaacagccccgaaacttggccagagcattggtgttttggtgctgctgtaacacagtgccacatgctgggaggcttgagacaacagacatttgtctgttgccttgcagttctgaaggccaagagtccaaaaccaagacgctagcagggctgtgctcctctgagactgggtagatgccttcctggcctcctccagcttctggtggtggccagcaatccttggcattccttggcttccagcatgaccactccaatctctgcctttttcatgacatggtggtcttcctgcatgtctctcctcacacgtcgttctcttcttataaggacacctgtcagattagatgagggccaattctaagaagcttttttttttcttttttgagacagagtttcattctttcttgcccaggctggagtgcaatggcgtgatcttggctcaccgcaacctccgcctgccgggttcaagtgattctcctgccttggcctcccgagtgctgggattacaggcatgcaccgccatgcctggctaattttgtatttttagtggaggcggggtttctccatgttggtcaggctggtctcaaactcctgatctcaggtgatccgcctgcctcggcctcccaaagtgctgggattacaggcatgagccactgtactgggctgataagggccaattctaatgggctcatcttaacttgatgacatccacaaagtctctgtttccaaataaggtcacattcacaggcaccagaaggtagggcttcaatatgcattttgggggacagacttcacccactgacagccatatgtgttctttacagttgccactatttctatgacttggagtgagactgtgattttgtttttcttttttttttgatggcgtcttagtctgtcacctagtctggagtgcagtggcgtgatttttggctcactgcactctttgcctcccaggttcaagcgattctcttgcctcagcctcccaagtagctgggattacaggcatgcaccaccatgtctggctaatttttgtatttttagtagagacagggtttcaccatgttggccaggcaggtcttgaactcctgatctcaagtgatccacccgcctcagcatcccaaagtgttgatattacaggcgtgagccactgtgcctggccaaggctctgattttcgttaggatcagacggatcacttctgtcaccagcgatacctgagtacaggttaatcaatacagcaagatgttgcactagtgatcgcagcagtcaagttcatttccaaatacagagcgaaagcaaggtgccttcccaatcctctgctctgtcctgttttctgtctcgggacaccctgtcatcctcagacaagtgacaatgaagagacagtaaaggcaaaccaagtcactgtccaaaaattgcaccacctaccttggagagcctctcatttcccatcagatatgaatgaaagatcagatataaacctgatgggaaatgagaggttccatttccttttttttttttttatgttgccaagctttatttaggctgtaatggttacagataacacacatctaaccctatattctctgcgtcccatgcagtcccctgagcaggctcagctaccctttccctccagtctcacttcttgtcttcctccttcttgtccttcttgccatccttggtggcctggcaggccagggagcccacagcgtttcaaatggcttcattgttgggatccacacctgggaggttctccaggacactctgaaggaactcaggatcctgcatcacgtcgtaatcatcctcctccttggctggctggcaagtgtccatggctgagctggcatcaatgtctactgattccgcctggccaaactctgctcctgcagggacatcttcatgacataagcaatcccctcttccttaggtcaggaagtccggtatggccaaactcttgttggctaatggtcatcttcagcaggacctcgtctgagccttcagtcccagttgtagcaatcctggcctcagcagcagaggctgcagctgctcgtctgggctcctcatcctgccgctgctgctgctcctccatagaaacccgagggccaaggccagctgaggatcagcactgggatctactccaaattcaaagtcactggcaccgagacccagcatggcacccccttccccagccaaaatcggagaactgatgagagcatcagccaagctgggcccaggaggcactgccaccagatgagaaccgcttccatctttgccattcaacgtgtttacaaaggctgtcagcttttctctgttcacctcctcttcccccaaatttatcatgtcaacatttactttctccttcttgaggaatttagccagtttcaccagatccttctcattgcctttgggcttcccacgaaggcaatgatatgcgtcttgtgattcttgccccgtcagcgcttcagagccagatgggccatgtggatgccagtgtagaaggtgatcttgcccttgggttggacggtgtgtagcttggacaggatgcggccggtgtctagagtgagtgtggtcagcacttcacagtcattagccagtgtgatgagggccatgttgttctcagggttgctgtggattttgtttaattttttttttttttttgagactgagtcttgctctgtcacctaggctggtgtgcaatggcgcaatctcagctcactgcaacctctgcctctcgggttcaagggattctcctgtctcagcctcccaagtagctggaactacaggcgcctgccaccacacccggctaatttttgtatttttagtagggacggggttttaccatgttggtcaggctggtcttgaactcctgacctcatggtctgcctgcctcggcctctcaaagtgctgggattacaggcgtgaaccactgcgcccggcctgttgtgggttttgaatgacatactatgttgacagcgtcttgctgggcctgcagctgggtggggaagaagtcctcattctgcacatactcactgttgtccacacacaccatagcgctttccaacaccatcctgccaccctcctccctcccatttcttgaaataatccttcatgtataacttaggttaatagtgcctcatagtctacttagaaagaatcagatagaattttctttagtaaggaaatttccaaatagagaatagaaaagttaattgatggcaatgtatttaatagcgaggatcagtgaggaaatgaattaaagaggttccttttacacttttcttctctgaagctaggtacaccttagttcatgttgcagcttctttggtgctgtcagatcatagttggtatgaaatgggaagtttctgaaagtcagatgacacatttgtgaaatgcaacctcactgttatctacccggcacccatcatttagctgacaacaatctcagcaacaggcatttcaatgtggtcctgcgtttgctaattgctggtgtgtactcaggacaccggaagatttaaccttttggatgagacagataccagtaacttcccagctgagcttcccaggaatgaactgatgagaagtgacatccaaaaaactgtctcttaaaatataaagagatcaaaagcatgaagtagagactcaaacaggtgtgtgcacactcaccttcatagcagcattatttgcaatagtcaaaaggtggcagcaggccaggcgtgcactgagagacgaatggataaacaaaatatgctgtaaccacacaatgcaacatccagccagaaaaaggaagttctgacacatgctccaacacggctgaaccttgaggatgttatgttaagtgaaatatgcccattgcaaaaagacaaatactgtgattccccttccttccttccttccttccttccttccttccttccttccttccttccttccctctctctttctttttgagacagagtctcactctgttgccaggctggagtgcagtggcgggatctcagttcactgcaacctctgcctcctgggttcaagcgattctcctgcctcagcctcccgagtagctgggattacaggcacgtgccgccatgcccagctaatttttgtatttttagtagagacggggtttcaccatgttggccaggatgatctcaatcccttgatctcgtgatccaccctcctcggcctcccaaagtgctgggattacaggtgtgagccaccgcgcccggcctgtgattccacttttatgagatacctagtatagtcaaattaatagagacagaaggtagaattgcgggtgccaggggctgagggcgggggggtggggagttacagtttaatgggtacagactttcagtctgggaggaggagaaagctccggagagggatggtggtggatggctgcatgatatgcgtgtacttaatgtcacagaactatgtacttcaaatggctgaaatagcacattttacgttatgtgtgttttactacaataaaaaatacagaaagaggccgcgcacagtggctcacgcctctaatcccagcactttgggaggctgaggtgggcagatcacctgaggtcaggagttcaagactagcctggccaacacggtgaatacaaaaattagctgggtgtggtggcatgcatctgcgatcccagctactcaggaggctgaggcaggagaatcacttgaacctgagaggtggaagttgcaataagtcgagatcaagccactgcactccagcctgggcaacagagtgagtgagagtctgtctcaaagaaaaaaaaaaaaaaatatatatatatatatatatatatatggagagagagagagagagaaagagaatggggggcgggagagagagagagaaagagagagagagagagagagaacatccaaaactgatattagccattctgaattggactgtcccatcaaatgtggtcttgcagctgtccacttgtttaggagtaaggagttttattggaatgaatgttctcagatattaatcaacacagtacctccctcccttctcagttccagctgatgctgagacaccaatggcaaatcttgatccatgcccaccccaggaggatgagcgacagtcaggattttgggccacaacacatgcagcttcctgcagtgtcctcttctccagggtgtgctgtgggaaggcctcaccagcttgggcaggggctcagctctcacgggacgaggcagctgagtagctgatggcagggcctggtggggggccggggacgacggcagagtcatccactgccactctggacaaaggccaaacctgtcctggatgccacctagttgctgccctcttaacctgaccctctggcctgcctcagaccttataatttcctaagcacgtctgcatagactgttatttagtcttgccaatgaccgcgagggagctgttatcactgccaggcatcatgtccagtcctcacggctggccataagaagatccgggcctcacctgggcctcccatccaagccccaagttctttcctcccccagtagccagccagagccaccaaccctccctcaagccatgagaggaagcagctgtgatgagcactgagccctcaaccaggagccgttgaatgaacaggtgtgaatctcaaacacaattttctgcaaggtcttctccactcccaggcccagctgtatctcttacggctgagggatcaggatgactttgctgcggcctcgctggaagcatctctctagattgccacggaccaggcagtctagagatgaggaagtcagaggctccacagacactcagatatcatcagatcccctcccaaagggagaagaatgctctgttttattttattctatttaactttgttaatttaatttttagaggcaggatcttgccctgttgcccaagctggagtgcaatggctcgaccgtgggtcaccgcagccttgagctcctgggcttaagagatcctcctgcctcagcctcccaaagagctgggactacaggtgcgaaccaccatgtctgctagttcaatttttttttaatttttttttttttttttttttgtgacagagtctcactctgtcacccaggctggactgcagtggcgtgatcttggctcactgcaacctccacctcctgggttcaagtgattctcctgcctcagcctcccaagtagctgagatgacaggtgtgcaccaccattccaggctaatttttgtatttctagtagagatggggtttaaccatgttggccaggctgctttcaaactcctgacctcaagggatccacctgcctcggcctcccaaagtgctgggattacaggtgtaagccaccatgcctggccaaaaaatttctttacttataattttttgtagagatggggtctctctatgctgcggaggctggtctcgaactcttggccttaagagatcctcccacctgggcctttctctgactgttcagtttgatacacgtggaaccaggtttgcttgcaccctcctcaccgcttctgctttctgctcctcccaaacacatgaacatattcagatatgcatcaacgtgcacatatgccaacacgtgtgggcacacacatgcaagtgcacagacacacacacacacacacacacacacacacacacacacacccctggacacacacacattgttttctcaaaatgacttttggcagcagcaaagccaaacctttccaaaggccgaagaaaggccttcatttgcatcacgttaacttggggggctgcatctcctcccctgtttttagtacaaaacatgagtcaacggttcaaccctcaccccagcaaactaattagggtcaatgtgattaaagggctcagctctggtgcaggaactaggatccccagatatcctgaagaacttcactcacagtctctttcctaaggtttgtgccctaaaacaaggcactgactcactgtgttcagctcttaataacctcaagaacctcccttcccagctgggcgcctcttccataaaggggttaccagaaaacaagaagcaacacacaaagctttcaaaagcgaaacggcgaggaatgtagtgcgtgtcagcgagtcaacgaaaataagaaagggacctgatgtcaagcttgacacgatcattttaatttccgcgtactttttgggtcttttcatgttggcttcatggaaatttatgtttgctgagaagactgtatttgctacaggatctcgctgtgttcatttagcctggtaataaaaaccatctgcctgaaatcctttttggaacaaggaggggtataagcaaataagcaaatggtcataaaagatctggagaagggtggggctgtgtcaggaaagtggggagcctggagtacatgcctcgggagtggcgactgtaggaggccggggactactgaaggtcatgtgtgaggctgtacagctttcccagtaaatatggtgcatgttgggaggacaggtgcatgtggacaggccgcctctcttcccaagcacccgctctgggctggggtctcaccactggagtaagaacagtatcatgatgcattaagtgaggagtccttgacgtgggttgaatagtgtccctgcaaaactcacgtccacccagaacctcagactatgaccttctttggaaatagagtctttatgggtgtgattaagttagtatgtggctgactgcggtggctcacgcctgtaatcccagcactttgggagcttgaggtgggaggattgcttgaggttggtagttcgagaccagcctgggcaacatggcgaaactctgtctctaaaaaaaatgcaagggccgggcgcggtggctcacgcctgtaatcccagcactttggaaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtcccaaaaaaaaaaaaaaaaaaaaaaaaaaaatgcaaaaattagctgcagggcatggtggcgagcacctgtaatcccagctacttgggaggctgaggtgggaggatctcttgagcccgggaggtggaggttgcagtgagcagtgattgtgccactgcactgcagcctaggtgacagagcaagaccctgtctcaaacaaaacaaaacgaaaaaaaggtaaagatgaagttatactggcttccaatggctgctgtccttacaaaaaaaggataggcatggaagaaggaagacagccacgtgacgacagaggcagaggtggggatgatgcgactacaagccagggaaggccaaggagacctggagccaccaggacctgggaccagcaaggaaggggcctcccctagagccttcagagggtcgtggccctgcaggcaccttgattttggatttccagcctctggagctgtgagagaatgatgttctctgtaggaggaagctctctgagtccccctctctgcctgggagctctgagccactgtgtctttgtggggagagacgagtcagacaagatcgcaaagaagcatctcaaactcttggcctttaaagcaggcattgaagaccatgagcaggacagaaccaaccctgagaggatactgttgagcacgtgttttgtttaccggtttgtttttctgcccgcccccggggaggaggtcgagcctcctggactcaaggaaataaaagggcagcctcctggagagcagctgtgaggggctgtgagaggggccttcgtcctgtcctggtctctgggtccaccccacagttgggggtgtcaccacaggagtcctgagctggggtctgtgagtagagagggctgctcttctgccttccctgggaggcagggcacggaggagaaatggcaagacacattaagctttcttaatgtgggttctagtaacataggtttttatgttctcagcaagacagggttcttgtaagccaggcattggtaagagataatcttcaaggttcctttagctctgattaccatataaagacctgggcctgcaggtctgatctttgaggttcttataatccagaaaactcaggacactgcatgccagtgtcagcttcaaggagcaagggaagctcagttcttccagtcctggggcacgaggaggaggagggaaggcgaggaagggaagcctagcggccgcacacttgtcatagtctctctcacagctaacattgtggagcgggagcctctgcaaaatgggctttttttctgccccctgcttggaatcattggaggaggccccatttcagaatgggagtgtgggtgggtactgaaggaacacatgtggctggaggaaggtgggatggatgagcacacgctgggattcctcacagccttcatctcctccatggtgtggaggggacccaggatcctcatgtgttcccaaagcaggtatagagtggctgggcaccaagtcctggctgggagccagtggatgccaagagcccacttttgccaggatgggttgggaatcccactagatcttggggggatcaccatggtggacttgctcacacatgagagcccccaagagcaggacctcaggatcttctgcggggacatcaactggattcgcaaagagcccacccgtgctgggtggacacctgctgggcagcagaggctgatgtcggactagcctctggcacagaccgggagaccatcttctctcccagcgggggactgtgagatttcctgcacactggtcgccatgtaggatatgatgccagggaagagagaaacaggactgacgagagtggtatctacaaacaaatatttatctaataaggcccatttcaatcaaagaagcttgtttcaaacagacagggctgagaggatattcctaacaaattaaagtcccctgggctggccgtgggagagggtctcacgaggaggagaactaaagaagctctgtggtccctgcacactggcatgttcgagagaatctgaactgttactgccttggcatgaaaagatgattgttaggggctgaactgtgtcccctcccaaatttatatgttgaagtcctggcccccagtgccttagaatgtggctgtacttggagatggagtgtacaaagaggcgattcagttaaaatgagttcgtacgggtgggccctgacccaatctgactggtgtcctcccaggaaggggagacgagttcacaggcacatgcagggggatgaccctgggatggcacagggacaagacagcatctataagccagggagggggcctcaggagaaacccaccctgtgggtgccttgatctcggacttccagcctccagaactgtgagacaataaatgcctgttgtttaagccgccctgtctgtggagctttgttacaacattcttggcagatgaatacaatgattctgctcaaggaccacaggtcttcctgtgcatccccgtagacatctgtatccagacgaggaccacacaggaggcctggatgttcccaaacttccctcagatgcctgctgttacctgagttccctgggtggaggaacaaatccccccacacagaaaggggaaccagaggcccagcacggtgcctcacgcctgtaatcccagcactttgggaggctgaggctggtggatcacctgaagtcaggagttcgagactagcctgaccaacattgtgaaaccccttctctactaaaaaatacaaaaattagctggacatggtggtggacacctgtaaccccagctactcaagaggctgaggcaggagaattgtttgaacccgggaggcggaggttgctgtgagccgagatcgtgccattgcactccagcctgggcaacaagcgtgaaactccatctcagaaaaataaataataaataaaggggaaccagaaagtctgattggatcaagtttatcctgaattgactgaattttgtttaattgtcaagtttaagaactccattatggggtgggatgaaggcttgggacagaaatcatattcagttatggaaaagggaatctgaaattttttgctacccatttgagttttgaagtctcaggaaatcacactgacttcatcaaaaaagcaggtgctgccatgcacattcgatcaatgcagatgctgatgtttacaatgagcagttgcagcttccctcctgacagcctggagcttggggctagagcccctggcccacaggctaagaagcaagggtgattttacaacccatgcactgagttagagagtgttcttaccccacgaagttcttgtccactcagaacctcagaacgtgaccttatttggaagtagggctgtaggtgtaatgagttaagatgaggtcacagtggattagggtggtccctacaccaatgccactggtgtccttataagagcagaggagacacagggggaagagggctatgtgaagactgaggcggagattgcagctgtagggcagggaatgctggggatggccaggccccactggaagttggaaggggcaaggaagccttcttttctagagcttcagagacagcatggtcctcttggcactttgatttcagaattctggcttccagaactgggagtaaatttcggttgttttaagccatcgaatttgaagtactttgttacagctgccctaggatgctaatatactgtgttataaaaatcagggtttctgccgggtgcagtggctcccaaaatgcctgtaattccagcactttgggaggctgaggaaggaggatcattggagtccaggagtttgagatcagcctgggcaacatagtgaaaccccatctctacaaaaaaatacaaaaattagctgggcatggtgatgcacacctgtggtccgaggtacttgggaggctgaggtggaaggatctcttgagcccaggaggctgaggccgcagtgagccatgatcacaccactacactccaactagggagacagagtgagaccttgtttcaaaaaaaaaaaaaaaaaaaaagtcagggtttctagagcctgtgctctatctgaaatgatttagaagcctttcttctagggacgaatccctccaaatttagaaccaggcaggagatttaggcacaagagcatcccctgctcccccttcctagtctaaatcagatgacatggacccctgagagcgaatgcttgcaaatcactcaggatacccgcccagccaatggagaagaaagcagaggaaggaaggaaagaagggtggaaggaaggaagggaggaggggaggaagggagggaggaagggagggaggaaggaagggagggagggagggagggaggaagggagggaggaaggcagggaggaaggaagggagggaggaaggaagggagggagggagggagggaggaagggagggaggaagggagggaggaagggaggaagggagggaggaaggaagggagggagggaggaagggagggagggaggaagggagggagggagggagggagggaggaagggagggagggaggaagggagggaggaagggagggagggagggagggagggaggaagggagggagggagggaggaagggagggaggaaggaagggagggagggaggaagggagggagggaggaagggagggagggagggaggaagggagggagggagggaggaagggagggaggaagggaggaagggagggaggaagggaggaagggagggagggagggaggaagggagggaggaagggagggaaggagggagggaggaagggagggaggaagggagggagggaggaaggaagggagggagggagggaggaagggagggaggaaggaagggagggagggagggagggagggagggagggaggaaggaagggagggagggagggagggaggaagggagggagggagggagggagcgagggagggagggagggagggagggaggaaggaagggagggagggagggaggaagggagggaggcaggcggcaggcacacgcacacaggctctctttgctttccaacaggaaggggctcagggtctgttttcttttcccttcctttcagatggatctttcatatctccaataactcttatctttcagcaaactccaacaggccccaaacgagctgagaaaatatccaacttcaaaggttttgcacaaatcatcttaaaggcctgacctaagcccggaaagccggaacgaagcccagaaatcagtcctcatttcatcgccgtttagccaagacacctttcccgtccacagatcacatctgcccccttctgcccccgcccaggtcccaaccaccttgagacacctgcgtgatccatcctcaaagcaatgagttaggagccgcactcctggtccttggccggtggcttcagtgttattccggggggctgggtgggggcacctgtggggactgccccgtgaggctgtggtttaatttcctttgctactttccttagctcttcagtctcagtctcagccactgaaatgtgtcttggccactggtggtacagcacagggtgacactgttgtcagcgagaggaagatgctttttttttttttgagatggagttttgctctgttgcccaggctggagtgcagtggtgcaatcttggctcactgcaacctccaccgcccggggttcaagcgattctcctgtctcagcctcatgagtagctgggattacaggcacccaccaccatgcccagctaatttttgtattcttagtagagatggggttttgccatattggccaggctggtgtcgaactcctgacctcaggcggtccacctgccttggcctcccaaagtgctgggattatagacatgagccactgcgcccagacaggaagatgcgtttgtgagccgggacaattgtgagtggaaagagaagaaaaaaagtaaaataataatactaataatgccttttctctggtcctggaagatctatatgaacttgtattttacatctcttgtctggatttagctgtgaaagaccagtagaccaactggtgggaaaaatacttgcacggcagcaggttgtttgaataaaataggagatttccagtctcagattggatacatgcacttaatatcagcagacttgttgtgagtataagcctctataaactgagcactgttgcaggcgatggggacgtggaactggtaggaccgatggctaagctctcttcccctccaccctggaaaaaatgaacataggatctggctgtggcagacagcagcctacagaaaggtgggggcacctctcagctggccttcagctccaatacagacacgggaaaaccagtctcagttcaggtctgggccccactggctgcgtctgcctggacaccatcagccctgcacgaaggtggccgctgaggggccctcatgggggctgaaattcaaccaaggcttgattcctgcctgaggtgccaggaacctgtccctttcttctaggtggttcgctcagcaagggtactttttgtaattcagccacccagatgggagtgtcctcttgcactccatccatctggatgaagcacctttattttctaatttggccagtttcagggcacatgacaatcaccgatatgacagaagggtaacctttctggggttgcatcttaggaaatttcattgaaggaggagtagagagatgatatcattgaccacaggactcaagaaataagcccagagcacacatcggttttgtgggggcaatgaaccccgcaactgcgggaaactgaccttcagcactttgatgtgaatggggccattgctttcagctttctccaaggtttttgtttgtttgtttgtcggtcttactctgtcgcccaggctggagtgcagtggtgtgatctcagctcgctgcaacctctgcctcctgggttcaagcgattctcctgcctcagcctcccaagtttttacttgaaacctgcatacacacagcctttttgttttatgggctgggttcctacagagagttatgaatggaggattgagtgcatttaggctattagtagaaagtgatcaagattagaatagagtggcttatctgtgtttagagtctctaaagttgttgcagggggcttgttgcaatgtccgtaccagggccccaacccagacctaccgaatcagaatttcaggaggggaggttaggaatctgtggttttatgtcagcccctgttccagtccacgtgactcttatgcatcatgatgttgagattcactgatttagacacgcagacaataaatactgattcttggactacagagccaaagacaaatcgagtgacgtattctagctcatggagccagctgggcaaagccagcagggatttattgctccttagatgatcaatgctgcccccagggctgctgtcatctcctgatgacgagcaacattttcacaacatcagggggctggtggagaaaatcggggggtctccggagcaaccccgggagcagtactgggcccagaagcctgccccagccgcgcacacagagtctacctgtcttccaatgcgagtcccgcgaggtgaagaattagagcatgttgttcatttataatgtttgctttgcttttggaaacaccctggggcaactcaggcaaggttttcaatgtggtgtttgacttggcttagctgcaaagttccccctttttggtctgtttatggcaagttagcacacggccccatatccaggagcctaacaccagccccagcagaaatcagggagcgggcaaggaagtgaaacattgggagggctgggttgggcttccctgtacccgccctctcagccgggagctcgcctgaggtcaggctgggcaccaggccacctcagactttgcagcctcggacctgttactgcagcccgaataacagtgacgcctcggacagtgacacgtcccgctgaccaaccacagggtctggaggataatttcccaggaaagagatacattccattcatttttttaaaattttattttaaatttagacagagtcttgttctgttgcccaggctggagtgcagtggtgcaatctcggttcaccgcaacctccacctcctgggttcaagcaattctcctgcttcaacctccctagtagctgggatcacaggtttgtgccaccatgcctggctaattttagtatttttagtagagatgaggtttcaccatgctggtcaggctgatcttgaactccttgcctcaagtgatccacccgcctcggcctcccaaagtgctgggattataggcgcacgtcaccgtgcccggctgatacattccattctttagctccctctttcttacatattttcttttctttttacaaagtcaacccactttcagtaggaagttgccgattctttctcatgtttacttttgagtttcaaatagacaccgccttatcttttaataagacttgctatcactgtgccagccactccatttacatcatttcatttcatctgcacagaactctacgcagggggtatgattagatcgcatttaatgatgagaaagcaaactcggagagcttaaatcagcggcccaaggtagcccagctaacacccggggggtgcggctcagccgcaggtcttctcagcgatgtggttgctgtctgcctggctaatggcctgccacatcctgaacccttcaatgtcaccctcatctttccttctctgccttagaagagaaaaggatgatggcttatctgagggctgaaagatttcatccacatcaagccccatttgcatgaaatgtatctgcccagtttatatcagcaacatgaagagcaaagaaaactgcctgtttatattgccacatctgcagggcattgaaatacattattaatgggagtttcagtcaatatctcacttttttttttttttttttttttttttttttttttttagaaaagtgaaaccatgattgggttacattagtgtgagttgtagaaaccaggttaaatctgacctttgggacatggagacggtcatctgacccagggcgggtcacattcaaagagcacagacaaggtccccctgaagtcagtgggacatttgggcctgagactatgaaactgaactagaacttatgggctttagggaacaagcccaaaagctcctaaatttcctccttgaagatctcctcgctactgtttttcttctagatattctgctgctttgacaggtacgccaccccctgtctccaaactcacacgttcaacccagtgatgggtggagactgggaggctctgttagtctctcttttcagtagcctggccctaaattaaagggcccatggttttctctagttgaacacaccccaggctcccagccagcccctggccctcgagaggggttgtttttgatggcaggagggagataaaagtgaatgtattttaggatcttgttactaggccacaaggaaacactggatggaaagtcttatgaatttgaaaagaccttttttttttttttaaatcaaatccaaggaacccaaaaggcgttaagctattgtttaaacatagacccagtgcccaaaccctgcacactagtttgtagaggttggaagaggcaggatggaaggggttaatggtgctattctttcttgaatattctgtaacacaccacaatgagccaaaagcagtcacagggaaccatcatgaggagtagcatgtttttacctatgttaactccaacatccgcaatagctgaaccttagaattattatccgaattgtgcataccaggaaacaacagatttgatgagtttaataacttgtccaacattacaaagttagcaagaggtagggtccagaaatgaacagcgtcctttcttctgcaggctggctcccatgaaatactattcttatgcctgttgaggtctgatgtggtatcacattatactactggaccagctagggggtcaagagcattatgccatctctgtagtatgcttaggggtcagtcctgaaatgagcagagttcactttcagccatgaaaaggatattccgaggaactgatatcttagattgctttcttttagtgcatagacatcacttgagaggcttcatgttactgagacatcttgtaaactttacagctactgttttacacttcatcagcattcctgatcttattatggtgttcacttcaaataatgttgggtgtgtaagaatcaaatgcaaattgtacagtatttgacacggatgtctttaggagccaatatttccttaaatatcatggtttcagtgttatccactaatgctttaatagatagggtttctttgcattcataaatggtaataaagatacgagttgtctactataaaaccaaacacttatatttcccaactactaaaacatctatgtaatcttgaatccatctgacctaaaggaaggaaaatgttctcaacccaggctacacattagaacacttgggaagctttgaaaaattcttaatgaatgggccccactcctagaccaattaattcagatctctgagaagtgtggtctgagaactgatggtttagaaaactgtacagacagttctaacatgcagccagcttgagaactactgggtttagacaagaatggatttttttgttttttgagatagagtctcactctttcgcccaggctggagtgcagtggcacaatcttggctcactgcaacctctgcctcctaggttcaagagattctcctgcctcagcctcccaagtagctgagatgacaggtgtgcaccaccattccgggctaatttttgtatttttagtagagacagggtttcaccatattggccaggctggtcttgagctcctgacctcaagtgatccacctgccttgccctcccaaagtgttaggattacaggcatgagccactatgcccagctaatatggtttggttctgtccccatccaaatctcatcttgaattcccatgcgttgtgggagggacctagtgggaggtaattgaatcatggggccagatctttctcacgttgttctcgtgacagagatctgatggttttaaaaatgggagtttccctcacaagctctctctttgcctgtcgccatccatgtaagacatgacttgctcctcttttctttccaccatgattgtgaagcttccccagccacatggaactatgagttttccatgaaatctctttcctttgtaaattgcccagtcttgggtatgtctttatcagcagcatgaaaatgaactaatacaccagccaagaatggatttttaaattaatggagttaggtctgattaatatcaatgcattaatgtataaatgtctacattatgcattacaataaacagttttgaatataacacaactaaaatatatgcaatgaatacaatacatacagtaagtcattagcttccaggtataagtagatgctcaataaatattactgagttactgaatgaatggcatcctacaaagttttatatgaaaaattatattttgatgaaattaagatgccatcaattgtaagatgtagtatcactgataaagaaaatagattcattaaattatgacatgctatctagtatgtcacaccctaacttcaaaaatgttaaaaaggccagatgtggtggctcatgcttgtaataccagcactttgggaggccaaagtgggaggatcacttgaagccaggagttcaagaccagcttgggcaacatagcaaaatcccatctatatgtaaaaataaaaaaattacctgggcatggtggtgcacgcctgtagtcccagctacttgtgaggctgaggtaaaaggatcacttaagcctagaagtttgaggctgaagagagttatgatcgtgccattgcactcaagcctgtctcagaaaaaagttaaaaacaagaaaaaaatacaatattttgaaattactgtattctctttttctgcttagtctaggccaactgttataccattaacttccactagatgccgctgtgacctgctacttcaggttccgaaaggcaatctgaaagccaattttctccaaggatttaaaattgaaataattcaccccctttaaagacaaaagatattttaaccacctcatattttagggggttgtggctcattctttctttgtgttaagacctatctgaagtatctcatgaagtgtacaattatttaaaaaggaaactgaaaagttttaatggcttgatagaaaacaattgcttcccttttatccacatccccaaatttcacattttgcgtgtaactcatgactagtctgcagtgggttatagagaagagatggtaacactgataggaaggctgatgttgacttcaatgaaataagaagtaaaacttgaaggaaagagtatgacatcttctgatttgaagacagcagatcatggtaccctgtacccatgagtcactgctcccagagataggaaaagctgggtggaaaagaaaatttgggctgataggactgggtcctgagcttgaagccaagcccagtgttaaccctgggcattgacccaggccctccctgactgaaaatctggaagattttccctgctgggtgagaatcactttttcagcaaaacaatacaagctttagggccaaaaggaagcccatgaagcttccagagacgtgcttagagcaatgctgctcaaattcttaccaatctccactatatgagaacagaaatggacagtaagtatctcaaaacttgtataacaaatttaaacaggtttacgtctgctaaatctaataaaaagaaatcaggattgtatttcatatgtctttgtttcatatttcatttttccagtaattcaattcttttagtattttacaaaagtattggtccataatagattggaattttttaaaaaatagcccttcagcccagatagcttttgaagcactgcagacagcccaccccaagctgctggaggaggcaattccaggacgatgaagccatcatactcctgaataatgttctagtagaccaaacagctaagaaagggctgaagaacaggagcacttagatgataaaggacaggatgactggagagctaaaaagaaatcctaagaacagaacacctcggggagtcccagcctctgaacccacagtcagcagctcaccagaacctaacatttctgcaaaggctcagagattccaccattgccactcccagcagttcgcctgcccaatgtagacaatcagcctagcactgactttgggacaagaggatctcaggtggttacagtgaaaagaaaatgcaaaaccactcaggattgcccaagtctgacatatttaggttcagaagagaaacacacagagaggtccattgttaaccccttcctggtttgatccacccaaagccagccggcttggatggaggggaggcgtaaggcactgtggacttccatttatgggtaactgtgagctggcttttgtcttctctgaaaaatgccctgttacactagcatactgtcagtgtcttttttggatagccatttggtaatatctatcaaaatgtaaacagtgaatactcttcaactcagctatttctctgctagaaattcatcccccagttatactcctaaagtaagcaaagacataaataatacaggattcaatactctctggctctttctgagagaataaaactggataaaatgtaaatgtcctttataagagattagttacataactacggtacatccacacagattagtatgcaccattaaaagattaaatgcttctgcagttactgatatgcaaagagttccaagacacaatgttaagtgaaggaagcaagttgaagtgcagtgtgtacagcatgatcctatttgtgtaaacaagaacaaatgcagtcaggtacggtggctcatgcctgtaatcccagcattttgggaggccaaggcaggtggatcacctgaggtcagaagttcaagaccagcctgaccagcatggcaaagccccatctgtactaaaaatacaaaaattagttgggtgtggtgatggatgtctgtaatcccagctatttgggaggctgaggcaggagaatcgtttgaaccgggggggcggaggttgcagtgagccgagatcgggccacttcactgcagcctgggtgaaagaccaagactctgtctcaaaaaaaaaaaaaaaagaaagaacaaatgcatttctgtcatgcagagagaccttctgagggctgcacaaaaagccgttcacagcgatcacctctggggggtggagccaagggtcaaggtcggggaggactttcatttttaacttcacactcttgtatgtggtctgacgttttaaaaagcaaaattgtatcaatttaatagggagcaaggtatctattgcagagcatcaagagttacaagaggccaggtgcagtgcttcccacctataatcccagtgttttgggaggccaaggcagaaggattccttgagtccaggagtttgagaccagcctgggcaacacagcaagaccctgtctctaaaaaaatgaaaataaaaaattacctgagcatggtggtgtgtacctgtagttctagctactcaggaggctgaggcagaagggctgcttgagcccaggagctcgaggctgcagtgagctatgatcacaccactgcactccagcctgggcaacagaatgagatgctccctcttaaaaaaaaaaaagcactacaggaaatggcagcaaatatcagtcagccaaagacacaacctgacacaagcggctgcacaaaatagtagttgcccttaagctcaagggacatcaacaaggaaaaaacacacaactcccagtgttctctcaacccatggctgtgtatatcttttagtgatgagccttggggaccccataaaacccagaggaacatgtggcagaggacccaaggcttccagggattgtggccatcaccaggtgagaaagcccagagacaaccgcttgagtgtttaattactatgtgaaaatggaatgagagggaaggaaattgggtttggttacttcaataaaaaaaggttgaccggacgtggtggctcacacctgtaatcccagcacttcgaaaggccaaggtgggtggatcacctaaggtcagaagtttgagaccagcctggccaatgtggtggagtcccgtctctactaaaaatacaaaaattagttgggtgtggtggcacgcacgtgtaatcccagctacttggcaggctgaggcgggagaatcacttgaaaccaggaggcagaggttgcaatgagctgagattgtgccactgcactccagcttgggtgacagagtgagactccatctcaaaaaaagaaaaaggttgcctggccctggttcataagtagagggagtgtcttgtgtcttgggaaccagtagcactgttaacatttacaaacgggacacacacatttcctgtttaattccaccctgcacagtgctgattcactatgataccattggtctcagaaatacttttcttaaaagttgtatataattaccacatatatacacataaataaaaatatacacacatatatgtgtatacatgcacacacacatacatatcacactctgtgctctcagccagggagagctggggaaggagattgtctttggagtccttagcacattacactatattacaaatgctcttggccgaagagtattctcagtgctgtcctgagttgtgttctgcaaaatgcactgtttattccactgtgatcttcctttctgccactcatttcatgttctagggaacagttttgactcacagttatgggtaaaaggtgtttgagtgattgttctagactcaccctaaagagaccaaggaagaatattatgccaagtgtcaaaaagctactttccaggcagctcaagttgccttcatggaaatgatgaaggaagcagagggtgaagtttaaggacaggtggaaatccttcacaatcctatcgggcatcattaacagcactgtaaggctgggagagatgaccaaggggatttgaaaacagcattagggtaggaagccggaattaagcttataaagacccatagagcacgcagtccttctatgtcatggcctatctgacagatgcgttggggggccccggagagccaggagtagtgggcagagggcaagcaagcacagagccatcctctacagtggtcagagggcaagcaagcacagagccaccctctacaaggacaccggagcactgaggccattgctcttgggaagaaaccaccgaggtttctgttagccagggtgggccagctgaatgtctgcaacatcactgaaaacagtcacaagttggagagacaatggtctttttagcactccccttgggggaagcagtgtgggagatggaaggttctggagtaaggggttatgcctcgaggggctggcttcaggacattgtcctgtgggttggtaggcgtccttaattgtggggcttttgttttgctgagaggaggctgcaagtttgaggcaaaaaatgaattctctggaggtaaagaagccgctgaggctgctccccgctggccctttcttcctgctgggcctttcctttatttatttagagtactcagcctttcctctaggtaaatattgaaagaatatataaaaaccaatagtttaaacagtgtcaaattattatcctgtctccacctggccctgggcatggctgcggtgtgtattgtgctaggttctgactctctttggttgagcaggaggcggccctagcgccacaggtggagatggctgcccacctgctgtgaaggcacttccggtgtccgccatcttgggagcagctcagaccggaaaccacaggctggagaacgcaactgggaatggaaagcaggagtggctctttgtgttgctttgggctgaattaggagaagggtagatgtttggaggtggtgttggctgcagggaagaaggagttagaatgggatgaaaatttttggcccagagaaggggagcagtggttgttggctgaggcatttattgaaggattcccatggagaagatacatatggttgggggcagagtccctgttgagagggagtgctgccagttccatacagaaattccttctccctgacaaccgcagatgtcttagcagcattgcttttattttttatttatttatttatttttgagactgggtctcactctgtcacaggctggagtgcagtggcgcaatctctgctcattgcaacctccgcctcccggcttcaagtgattctaatgcgtcagcctcccgagtagctgggactacaggcacacgccaccacacccagctaatttttgtatttttagtagagatggggtttcactgtgctgaccaggctagtctcgaactcctgacctcgtaatccgcccacctcagcctcccaaagtactgggattacagacgtgagccacccgcgcctggcccagcagcattgcttttagactgacagcttagaaaccaaaagtctgtttactggccacctacacaacctgtcaatccctaaacaacctgaaggtttagtgccctaccatagacaccctgtaacccattaagaggtccagcctttgctacagcaaatggtgtaaactcccacggcccagttatgtccagggctcagttgggtttttggcctctttatcctcaaatggggaaagcatagctctgggccagtcaagcgctgagctgatccaagacattcttccacccgccagactggaaataccggaaaagcggtggcagctgccctcagaggcagtgtcagtattttctttccttttggccagttccgttttgactagaaactggaatcataattataatgctacatgtttacagattttaagtaattgatcccttggagtcctcttttgggggaaaagcattctacccacctcatacatcaggaaaacaagaggccatatggtttggctgggctgggtggtctctggtgtcagtaggagagtggagactgcggcttcaacagttcttgacttcttggcttgtgtccagatctctgggccttgcagcccctagaaaggtgacacatgagaaaccgaagtggaccagaccataaactctcaggagcagttacctctagagaggagggcaggcctcgtggccctgcctgtgcctgtttctcttggagggacaggttggagaggaggaaaaccccttactacaggagtgtttcacctacctttaattaccagttaaaacaaaacattctgtaatgaaaattccccttgaaagaaactccaagttgctgtgaaggtttcatctttcccttttgaatcccaaggtctgcagccatgtaatccaatgttggtctggaaaaatatctggctacagaaaaacccacatggggtgttggggacgccagtaaagggcaggaggttggatcttgtacagtagcccttagcaaaatccttcaggtcaagccctggtctacttattaagaaccctcttaacccttttaataagaggtagatatgttttcttctgattctaccttctctattgccagcaatgtttgtcctcaataaattaatgtgagttggtggtggatgtagaaaaggggagaagggaaacctagttctccgatggtcatggctatttcaagataagggaagtggcagaaacacggagggaggcaggccggggagcctccaaccccaacaggtgaagacacacatagaggcatgcaagtcagcaaacaaattcaggctgggttcccagagggaaatgtttgtgtttttttctaagtgagcaggtgtagttaagcacacccttttcacggtgcgttgaagcagatttccagccctgtttggaagcacaacgttgccatctcaatgggttgtccttctgaacccataatagctgtttacttagaccagatcccgtattgccttgtgtcattgtccaattttcctatgtggattttaccaattcagttgtagatgtcttagtaacagggaccagaatttttccataatcaatagtagtttaaatgattgaacaaaaagtttcctcttgtgtgcaatcagctgaggaacgtaaactaatttcagtctcattcctagtgcctgatttttcttccatcattctaggtttcctgtctggcccacacttcgagagtcctccctgctgcagggagcacatctgtgagccatgtgtttcctttctttcctcctgtacaatggtaatttttttcttagctactacaggaagcccagcagattcagatgtacaagaagccacaccaagacctaagatgatattcactgatgttatcagcaggttgatgccaacatctgcctagagagtggttaccctgagaagtttaccccagttctaagtttggttggtctgttctgaggtgatagcctcgtactgaagtaatttctccccaccaaagggtctagaataggtttatttgtaatctattttatgtagctgtgactgcctcaagacacctcaaagggttattaagagtgtgtgtctaggcatgtgggtaactgttccagctcaacagcctgtgaataccattagtagcccttgaaatggatctccaggaagtgctgactgttaatgactctgccctgatgctcctatgtgagcagaacaaagagataatgtctaagtttgcaggtagctgagcgctctaaattgatgactagctcagggagagggaggtgctgtgccatcctaagcctagaagacatcgccaaaggaacagtgggagattaacaactctcccatgttaggaggttgacttgccaaactgatggaagagtgacaaactgatagactgtggtgctgtgtcccttctacgagctgagggagggcttcacctgaggcagtcagaagtgctaagagaagatttatgtggtaagggagagggaatctttccaacaatagctattaattgactttcattttgtagaagaatattgtattaagtgtttggagataggaaaagtatggcatgctctcaggatgtttataatttacttggggagataaggcacatgattgaaaagctagtaaaatacaagacaatagaatatccactctccggaataatattcagccattaacatggatgaattggatccgtatgtactcagacttgtgcaggaaaaggtcagtagcagaacaagacaccatctatgtaaaaattaaagcaaagcacacagatgtgtgtggacatatatgtgtatgcatgtgaacatatctgtgtatgcctgtgaacatatgtgtgtatgcacacggctgaagggggactggaggaaagcacgtggaaaaagagccagaggttcctcctggggagggaagtgagactggggaggacagagaagggcacctttcatatttttaccacacatacttttgtattgaatacattatttagaacaagaaagtctttctatatttcttatgtaaaaaaggaaaagaatgaaaaacatagcaacaaagcaagtacatgattgatgccaaggggtaaccctaaaggtaaaaatggtggcgtagtctgcccatcacctcacaaactctgctgccgctcctcttcctccttgtttacagaatcccatttttgctcaggaatctacctgcctgtgtctcacgagatatctggaaaaacataaaatcatggtggtcccatcccatcccatccctctgcagtgatttgtggcacttggtcatgtgatgccatcagggccaatgagattggaggaactgtccagggggctgctgagtaaagcttctttgctcttaaaaagaagaacaaagaagccaaaggaccactttttccttcaacaggatagcaccgtttctggatgtgatgactggcaatgcggcagccatttgagccttagggagctatcctggggaccaagccaaactctgaggatgttggtagaaagatggaaaagcctgaatccttgaagatattgttgagccactgaatcaacctaccctggagctgtcctagctcaggacttcagctccagtgacagaacacatttttctttttgttaaagccagctgaggtggggatatctattaccttccaactcacatgccagtcacaggaagccctgtttgtgaggcttcaagccccttgggtgcatttgaggggaagtttgagtcctcagggacatgccctctggggacaagaatgagaaggggtcataagccctctgtggctggggaggcagagaagtcatcctgagctagggtcactctttgccctggcacctcagtgggtgagaggaactgccagggtgaggtagggagatatatttaatacaagcagcccctcagtctggcccctgggataattgatacgagttctttctttctttcttttttaaaattgaaacagggtctaactttttcgctcaggctggggtgcagtggcacgacctccgctcgctgcagccttgacctcccgggctcaagcaatcgtcccatctcagcctccccaagtacctgggaccacaggttcacaccaccatgcctagcttatttttatttatttattatttattgatttatatttttttgtagagacagggtttctcacgttgcccaggctggtctcaaactcctgggctcaagtgatcctcctgcctcagcctcccaaagtgctgtgattacaggtatgagccactgcacccagtctacaagttcttaacagaatcagaaggtgtagctgggagacaaaagacccatcacagcttcgtgatatttggagggaagttttcttccttcagagcagaaaggatcactgctgtcatgggggaagaatattagcagcctcatgggagctggagtgaggctggagttgggacagtggccagccttacagagccatgggtaggttgcaagggctaggcaagcagagccccatggccgtgctgtggtggggaagaggcaggcagggggaaagcccactgcaggtatttccacagtgcgccagaagcaatgatggtttcaattggttggtagatgagtctccctgaattaaactccactcatcccaaactggtattgatttaaaatatcttaaactgggataatctcttgcagtatgttggagctgtgcacccgaagagagaaggggaaataaagtcttatcgtgagagaaagtgtgtgtgtgtgtgtgtgtgtgtgtgtgtgtgtgtgtgtagagagacaggagggagagaagaggaggacatgggaagagaggagaggagaagggggagaaggggagaatgagtcctcatttaacctggtcctgaggagggggtggctggtttctgcactgagatataggtgtttccttctcttgccttgcctccagcttgaaatcaaccacttccctcatttccttggaatgaagtcaaggaagacttgcttactcttacagtgcaaaacccagccccgggtcttcccactgttatctactgaaccctaaggtcactcagagcgacttgaaagtgtttcaggggccataaatgctcaactcaaatctcatttaaaaattttcccactttatacctgttaggatagcctgtatcaaaaaccaaaacccttgaaaacagcaagtgttggtgactgtgtggagaaattgaaacgcttttgcactattggggatgtaagatggtgcaccgactatggaaacagtagggaggttcttccaaaaatttagtacagaactattacatggcccagcaattccgctgctggatacatgcccaaaagagtgaacgcagagactcaaacagtctttgtaccccagtgctcatagcggcattattcacagtagccaaaaggttgaaacaactcaatgtccatcgatgggtgaatggataaatcaaatatgatgtatccatatcatgggacatgattcagccttaaaaaagtaatgaagtggccgggcctggtggctcacacctgtaatcccagcactttgggagcctgaggtgggtagatcacctgaggtcaggagttggagaccatcctggccaacctggtgaaaccctgtctctactaaaaatacaaaaatgatctgggcatggtggtgggcgcctgtaatcccagctacttaggaggctgaggcaggagaatcacttaaatctgggaggtggaggttgtagtgagccgagatcacaccattgcactccagcctgggtgacagagcaagtctccatctcaaaaaaaaaaaaaaaaatttctacttacaaaactgtagtaagaacaggacactcgggtactaaaaatacacacacggcccacctgtgtgctaagctgtgtttcccttttatcttctctttttttttttttttgagacagagtctcactctgtcacccaggctggagtgcattggcacgatcttggctcactgcaacctccgcctcccgggttcaagtgattctcctgtctcagccttctgagtagctgggattacaggtgtgcaccaccatgccaggctaatttttgtattttttagtagagacggggtttcaccatgttggccaggctggtctcgaactcctgacctcaggtgatccccctgcctcggcctcccaaagtgctgggattacaggtgtgagccactgggcccggccgttttcccttctctttgtgctcacctgggaatcaaagttctcccagcattttcaccagggagtttgcaattattgcaactataccagtggctaggaagtttgtatctcttgtatggatctattaaaaattcagacttgattttctccacttacataaagttgcgggaatacagctataacatgcccttatcacagccaaaagagccagttgtggataaacagcttgagacatgctgatattatctttgtcatttattgtaaagttttgatgcttcttgcctgacttttgttatgaataagaatacaagcgaccgttagatattgtccatggttctgcttcaaaacagaaacttccctctcgttctcctctctcaagcatctggatcagtttaagtaaagagcatcttgacacagccatctggaacttcctctcaatttctgtattcatcaaaaggtacaagtattataaatctgaacttgtgaaataaaattttaccaacaaagtactacatttgtttcagacattgaggtttccatcagatttgaattgcaaaaagattctgctgaaaacaaaaagtttgaaaagcactgtatttgcgcaattcccagtttggttcagttaaatgaatgctccttgaagattttgttcaattcttagctggacacacagtacattggtgagcgataagacataggaaagttaaattctgattgtccttgagctaagaatggttttacattttattttactttattttattttgcctttttgagatggagtctcactctgtcacccaggctggcttgcagtggtggaatctcagctcaccgcaacctccgcttcccgggttcaagcgattctcctgcctcgcctctgaagtagctggaattacaggcgtgccccaccacgcctggctaattttagtatttttagtagagacggggtttcgccaagttggccaggctggtctcgaactcctgacctcaagtgatccacccacctcagcctcccaaagttctgggattacaggcatgagccaccacgcctggcctggtctttacattttaaatggttaaaaaaaattaaaagaagaatatctgatgatgtgaaaattatatgaaattcaaatttcagtgtccattatataaagttttgttggaacacagccacattcgtttgtgtactctctctagctgttttcatcctaccactatagtgctgagtagttctaacaaaggccatagagtcccaaagcctaaaacatttattgtctggccctttacagtaaaagtttgccaacccttgcattagacaatgaccatatccatgtgaagtctgaacatcaaaacctgagaagttcaccttcttgatgctgccaatcttttggcaacattactgcagagttagacagactacatcagtggttctccagtctgggcaaacccagctcccaagagggtgtagagaaacgtgtgggcacagcttttgttgcaatgacaagactcgccatgcatatttagtaggcagggactaaaaatgttaaatttcaggcaatgttggatacagtcctgcacaatagagctcaaggtgtaccctgagaaacagggatccagagaattgctgtgattaattttacagggcaacttggctaggccatggtgctcagatatgtggtaagctgttattttggatgttttcatgagggtttttgggaggagatcaacatttaaatcagccaagttgaagtaaagcagatggcgctccctaatgtgggtggggctcacccaatcagttgaaggcaggaatagaacaacttctgacctctttgagcaagaaagacttctgcctgcagatggcctttgggcgtcaattgcaactcttccctgagcctctagactgttgcctaccccatcagatttgggactcactatggctccacaattacatgtcaattccgtaaaataaatctctctccacttacatacgtacacacacacacacacacacacacacacacacacgacctgttggttttgttactggggagaactctgactaatataattatcccaaagtttcagtttctggtctgaaagtgatcttcagtccacttattcctgtgctttgcaaattctacctctttttcaaatttcaaaattcagaacatttcaaaaataagttgacattgcaaatttcatctcatcaaatgctaaaaaaagttcatacttctggccgggcgtggtggctcatgcctgtaatcccagcattttgggaggctgaggcgggtggatcacctgaggtcaggagtttaagaccagcctgtccaacatggtgaaaccccatctctacaaaaatacaaaaattagccaggcatgatggcaggtgcctgtaatcccagctactcagaaggctgaggtggggagtcccttgaatctgggaggcggcggttgtagtgagccaagatcatgccactgaactccagcctgggtgacagagcaagactctgtctcaaacaaacaaacaaacaaacaacaacaacaaaatttacacttctgcatataggactctaattcaataaatgtggtgtttaattgaacaaatgtgtattgaactccagtgacccatttggaagatgctattggggagtgatataaagacaagatatagtctctgtcccaatttacccagaacagagaaagggcgactatcaggcacacaattaatgggaataccagggcatttctgagaggccgtattacagaggtacaaatcaggacctgtgggagtccttctcacaggagatcataactccaactaatgcaacctccccgctagtaaaacctatttttctttttccttctgaactatttctctcccagttattatcagtgaaaagccagaagcttctctggtttctcacccatgtccagagacagacaagccgtgggttcagaggctggtttttcacatcctccacttcacaccacgaggacctcacccactgcagctgcagaacaggaaggggtcatctacattggttacacgccccatttttagctggatgtagctaattattttctgtttaagactcttgtctttttaatcatacgaaggaactgcattattacgctctcattgtaaggatatgaaccatatggtagtgcagaaaataaaatgtgaaaatctgttctatctgttctcatttcctcatctcattcattactgcaacaaaaaccaattgtcctcactttgggaggccgaagtgggtggatcgcttgaggttaggagaccagactggccaacatggtgaaaccctgtctctactaaaaatacaaaaaattagccagacgtggtggctcttgcctgtaatcccagcacttgggaggctgaggcgggtggatcacctgaggtcaggagtttgagaacagcctggccaacagacgaaacctcatctctactaaaaatacaaaaattagcccggtgtggtggcacatgcctgtagtcccagctacttgggaggctgaggcaggagaatcttttgaacccggcaggtggaggttgcagtgagctgagatcgcgccactgcactccggcctgggcaacagagtgagaccctgtctaaaaaacaacaacaacaacaacaacaaaaccccaaaaacaaaaaaacccacaacctattgtccagtcaagtctttcttgctaccagagcaggggacatgccactgatgagagcgtcttctctgttccttccaaacactcagcccagcattcagatcattgctcacccagtgcagagtcacggtgccagggtatggagtacagatgccagagccacagccatcagagacagtgtttttgttttctagggccctgcaacaaatgaccacgagctatgtggtttgtagcaatagtaatgtattctctcacagctctggagtctggaagtcccaaatcaagatgttggcagggctgtgctccctctgaggcctcctccagggaggatccttccttgcccctccctggcttctaaacttttctggtcctcctcagcctgtcgctgcatctttctaatctctgcctctgccttcacatggccgtcttccctctgtgggtctgtgtgtccaaatttccctcttctcataaggacactgaccagtggattggggtctacactcctccagtgtgacctcatcttaacttgattacatctgcaaagacctttttctcagggaagctgatatggtttggctgtgtccccacccaaatctcatcttgaattgtagctcccataattcccatgtgttgtgggagggactcagtgggagataattgaatcatgggggtggtttccctcatactgttctcgtggtagtaaataagtctcaaaagatctgatggttttataagggggaacccctttcacttggttctcattctgtctcttgcctgccaccatggaagatgtgcctttcaccttctgccatgattgtgaggcctcccagccatgtggaactgtgagtccattaaacctctttttctttataaattacccagtcttgggtatgtgtttatcagcagcgtgaaaatggactaatacagaagctcacattcacacacaagggagttatgacttgaatagatcctctgaggggacacaattcaagtcacaacagatggagactccatacttctaagcaatccaccaggagccacaatggccccaagcaaaagatcatctctctcgaaggccagtcctgcttgactatggcacctgggcagataatgaaaacactaacccccttcaacgctccccatggactgggctcactgatctgcagaatgacccccgtggggacctagtccaaggtaacgtgctgcagcccaagcaactgcttgcttcaatttgcaagctgtgcagagcagacagcccaaaatggcagtggcttggggaaaagccagacgttcttgaaaagctgtcgtttcagaaagaaagaaaaaaaaatcacttattttttggataggcattgagtatcaaagatttaaaaatttggctctgaccacaatatatctgaaagtagaggtcattccgtaaagatcagcctcttcctaaatcaccaggctttccaaccagctcctggcagggtccgagggtcccgtcaaagtggccagtggactgccccaagggaagcatgaggaaagcacgtgaccccttctggtaacttggagaggagtggcaatggacagagagtaaagctagggcatgaatggggacattttataaaggcagcttccctcctctcctgggctcactggtacacaggagaggagagttggtggcttgctgaatagccattgagttaagaaatatagcttcagacataccatcttgtaactggagccatccaaacctctacttctgaatgttcccatggcaaaaacacagattttcacaacattccaggaaaatcctgaaattgagtcctgtagagggcttgggattgttttgccaaggaaataatattccacacattggaggtccatctgtgtgggcagatgtctgtcttgggaatgacagagtgaggccccaagctggtggtcactgctgggagtaggggccgggacatagactggagaaggcaaatggtaccacctgatgcagagataacattggcctggggtccttgtgtcagctgatggggacggaggtcagcaatagaaagaggactcaggaatgcatctatccttcctgttccctgtcccttcactctcaaggaaaatggcagcatcgtcacgattccccaaatgaaaatcacattggaaaatatctagtgttttatacaagaaggccagaggctgatatcatgaccttaggttttagaattttctatcagcagcaacatgtcagctaaaaaattccctatcaagttattacctgaagttttttatgccttaactttaaaaataaaggtctgcaactccaagcaaaaatcttggactcctctttatgaatcaaactgattcccaaactgagatcatagcccactccctggcccctgtgcttattataaaacccatcttcttttcacgtccaatataatcaaggcagccacaccccacacgcagcactccagccttactttccccaaatccaggccccacttcatgtgaaaatgcatattattacccctgtgggctcagagcctgttttgaaataaagcaaataagaaccacaggggagtgactcaagtccaaattgtgtgtcctgacttggcgcaaatgttcttccttgtccttgcttattaactttgggagacactgagcattccccaggatgcgctgggggtttgcacacaatcctgcccaaagctgggcaaagcctgcgtgcccagcagccaggaattccctcccctccatccccatttggggcctgttcagccgccctcgttttcatgaaccccacacaacccactgcgtttggaggaccctgtgatatatggcgccttccagagaacaggatgcagatgcgcgggggaggtaaccggagaacagcgcaagaagatgcggctgtccccggagcccaacacataaattacaaaaacaatttcgaattcaagggcaagcattgccattcctctcttttccaaactttggcttttttgtgctgaaggtaagtttgagaggagtgtagattttatcccaagatgacttcttcccattccattttaattatccgctgggtctcggtgactaagtcatgagtagggaggacccttgtcttcaatgccctgccattggccagccaagatccagtgttcactgtagccatggtcttttctgggagcagaggaatttgttcaggggaaaggggagaagaggtggcccacacggaggcaggcagaacttcatgtcactgcggaggctgaacccaagaccaaccaggcacttggcagtgaccacccctccccacctccccagggacactcactgtcctggctggacccttcctgatccccccagtgtcagggagcaagcttgattgtctgcgcccaggagtcccagacttgagggctacatttctcccgattgcctttgtgcagagcacacagatggcttcaaataacaggctggtttcatgcacctgtgctctggctgtcccaggttttagaaaggactgatccatctcctcttgaaacttccatctgaatacacatcaatagggtgtatatgtgtgatgaaagaaacactcttcagctacatgattagatgatctgtgttcccccaaacttttgcaaacaagagactgcactctggacttaaactttcttttcaataaaagcaatctaggaagtttcccagtttaggtagaaagtggattaggccaggtgcagtggctcatgcctgtaatcacagcactttgggaggcggaggtgggtggaccacttgaagccaggagtttgagaccaacctggtcgacatggcaaaaccccattcctactaaaaatacaaaaaattagccatgcgtggtggtgtgcacttgtaaccccagctactcgggaggctaaggcaggagaatcgcttggacccgggaggtggaggttgcagtgagccgagacttttccactgcactccagcctgggtgacagagtgagactccatctaaaaaaaaaaaaaaaagaaagaaagagagaaagagagaaagaaagaaagaaagaaagaaagaaagaaagaaagaaagaaagaaagaaagaaagaaagtggattcggcaccatccctaataacaggtgggaagggactgcccttactgcccactccgagatgctccagccctgccggctcctggagtgtgacctgagggacacaaagcagcactcttaccaccctgaatgccagttccaaacactgaatggggacacaggtgacctcaacagcaggacctgactgctctctccaagcacaaggaaacttgttttttagatctatacccatcagcagtgtgagctgcagggaaaatgcatctggctaagatttttttttttttttaatgagacggggtctcacttgctctgtcgcccaggctggagtgcagtggcatgatcacaactcactgcagagccttgacctcccgggctccagcgagcctcctgctcagcctcccaagtagctggggtcacacgtgtgtgccgccatgcctggctcatttattttaattttttaaagagacagggtctccctatgttacccaggctggtcacaaactccagggctcaagagatcctcctgtcttggactcccaaagtgcagggataacaggcatgagccacggcgcctggcctgcctcagactttaacctgcacaagggaatggggaactcagttatggcaagaaatgagacagataccgaccgtatgccactgacagaaaattctaaaacccaaagtcatgatatcaagtgaggcagataccgaccctgagctccacgtgaccgtgctgtgggcctagaaatgagggggatggggagtgtggctgccacatgacaggcaggatcgtatacctacagcctcctggacctgggcccagtagagcaagtgctgccacctgatattccaatgtcacattcagagacagccactggccacttcccagcagggctggtgggcacttgtgagaatgggaaactggacccatgtggaggtgtcctgcctggtatgctctgccgggctgtgactcacggagggacgggccctgcacccaggtgacatcagagcccagggtgccatcttttctcagctccttctagcccatgttgtggatgcaaggcatgggtgccaggtactttccccttccacccacccttggctgctgggccaccttgactgcccttggagttctgggccctcaagagccttctccatcacctgcttctcatgggcgctgctccgacacccaccccaggtgctctgtggaatgtgccagtcagggctccctcacggagggtgaacaccaaggcccacctcagcaagcatggccaaaccactcaacaagcagccagacactgatgtcctacccagcccagccctgtgacctcgagagaaggataagacggacaccctgacatcaagaatgcgtggtctcgtgtgcagcccaacgcaagtgcacagaatgagggggtgtcaggctgatgacatgcactaggggactctggggcaggagggatcagtgagcttcaaggagaaggtgaacgccatgctgagtcttgaaggatgaagaggatggaaggtgagtttcaagtcaaagctaaatgaaaaaaaaaagaaataaagacttgaagctggcagcgaggagaaagaaaaggttctgaggccagggtaatagggcagtggtcagagaggggatgatgatgggggttggaggatggcaaggagcccctcagccacaacaggggacaccaaagatgacagaagagccggcatgaggtcaaagggaggccagacaaaggaacttttggaaacctggcagaggtgtgaatggtgacttccaagctggtgagcagcaggatggaaagggcgggtgatgggtgtggcagccacatgtgtggtgtgctgggcagatgccctcatggtgaagccgaggctctgccattgaccacgaggcaccaccaaccacactctgactcctccagcgatacagctgccctctcatcaggaacggtaccaaggagccttggtaccatcaactatctgctgccaaccggttacatggagtctttaaaactggggctgggttttaaagacttgagaggctgagcgggaggattgcttggaacgtatggtccctgcccacaaaaagcctggcccctggaccagagggaagcggcacgatgaaggtatgagagtgtttctgttggcgggtccagcctctgcgctctgactttctccagctcagagatatcccttcacccaggttcctacagagccccatgctctttccttatctgagaaccacagattggaatccacaaggagtctagctgaagatcatttagtccagagggtgcaaaacttttcctggaaagggtcagacggtaaatattttcagtgttgccggccacagtgtctctgttgcacctgctcgactctgctattgtagtcccaaagcagccatagacaatacataagtgaaatgggcatggctgtgttccaataaaactttatttgcaaaaacaggcagcagggcaggtttggcccaccagtcatagatctagcgctcaacactcccatcctacagatgctgaagtgtagcctcaggaagatggaactgacttgaccaaggctgcatggctcccaggaccagaccagaactcagaacatctgctcctcaatcttcaaatctctttttaaatgctattcaaccagctgcttcctcctggcaaagtggggtcctggaaaagaccatgaatcttattgactcaagagatcggaaagtccagtagaacctgctgggatgtttgtgttttcaatggagtagagaaaacaaaaacagatgaaggacttcagcaatttttaaaaatggagtgttcattcaaataaactttaaatcccaccaggcaaccacgggcacttcacactcctgaggtaggcccagcaatacctgagacaaatctcacccctatttaattatcattaatcttccctccaggcttttccatacctgctaaatagctcaatccatctcattactgaaggcagctgctaggtatggttgtgagaaatctcattagcacaaatgtacttctgtatggtgggcctgataggcccacctcccgagacggggatgttgaatggcaaaatctcagctctgaggaccatcaaagcactgggttccccaaagttttggccacactcagtagtaagagccttttattattgtcattttcaactacagagatcatgccccccaaataagaagaaagcaaacaccttaaaagggcaaacttgaagattcacaataaataggtaacacgtgaggggtccaacactgtgaagctcaactgttcctcctctcggacgtgataatttcacatgttcagaccaccctgtcagcatgtcagatttaaaatattacacgtagaataatgaaaaattgccaacttctcaccaccgtcttttgattaatgaggagttccttagagattgattggtttatttgattttgttgccgggagtgactgatggctattttaaaaaatacttagcttagcgctaccctccatgagataattttcatatgccttgtgtagctgcgtccagaataattggactttattgccttccttccatgcatgaactgaagttccctggagaagcaaaacagcttcagactttgttgctttaatatttccatgtagatcagctgctgtgttcatggagatgcttccaccagatggccagcccgccttgaagtgacatttcccatttcccgtcgattactcaccaatggaaaataatgtgatacgaatccctcatttggggtaatatgtggccatatccttgttgtacctgcactaaagataaatcatgcaataatttctcaactgtccagggagaaaataggagaaacaacaggtcaccagtgtttggcaggaaaagggaatcgttattggtaaggcattcactgggacattgaaatctaatgtcctaatttctttcttttttttttcttgttgcttgttcttctgtatctcagggggaagaaacttattttggttgtttaaaacatttaagctctggtttttaggaagaatcctggttttggtcaagtccctagatgtctcttcccaaaagcacccattttgatgctgaggcgaggacaaaagtattagttttcaaaaagcccaactttatctcctgaacagactcaaatgattaattctcaaagtcattgtcaaattttacttttaaaaatcttagtaatttctcttcaatatttggtacaaagctgtcggttactctcagatcatccttgtttttcaacttctctgtttgattccagcaaattcttttagctggtcactcttgaattactgttaaagataagtaagtaaaaatgaaaatattattaataaggtatgaataattatcactaacagtttttcagcccttaacatgtgccaggcagtgtggttagggtattccatgctttaagccatttattgtcaccgcagttctgagaggccaggaatattatcatcatcttccagatgtggaaagtgagacagtccacgtcctacagccagagcaggattcgaacccacagtcctgattccaagctgttcacctctgttcactggggaagccaagtgttaggaaactcttctttctggaatgttccattttttcccttctcagagagaagtcagccctgttatttcccagtttctgctcttcctaccaggcttcaggtctctgcccactgtgtcctcacaggaaggcagcaataaggaactgggttagggtctcttcccccgtccacagatattggggtatgtgggtccctgagtcttcggtccatgcaaggggcatctgtccctctcctgcagacagtgatgcaccctgggccgcaggctggctgctcgcaagttgcttttcctcagtgaaagaatctgcttgttggaggcaccagaaggttcttgaagctgcagaaaattctacaagtggtggaaggttctggaaacagcttcctccctcctcctctcccccttctccaccacaggcagcatctgctgtagtgtgagccgcaaccctgcctggccctccaccaagcctgaggaggacgcgagctcggctgcggctgacagcattcagcagcagaactccaagcaagggggtcacctgcccaggagactacccccttagtaactcaagcttttatgcactcattggtattcatccagatggctgttttggctagaaagaaacacttcttcctcactagaattacaaataatttgagcagaaaactacaggcaagacatgttaattatgtttgaaaggatgtatcttttggtacaaagggttttcttaatctaaaaatgctttccccgatctcaacttatatctaatggtagtttttagcacacagagtacgtagcttattttgtttagtcctttcatacccacctcctgtgcaggtaaaaaaaaccacatcttttttttttgagagggtgtcttgctctgtctgtcgcccaggctagagtgcagtggcaccatcttgactcactgcaacctccacctcccgagttcaagcgattctcctgcctcagcctctcgagtagctgggattacaggcacccaccactacgcacagctaatttttgtattttagtaaagacagggtttcaccaggctggcctcaaactcctgacctcaagtgatctgccagaggcctcccaaagtgctgggattacaggtgtgagccacccacacctggccaaaaaacccatagattaatatgtgtcctttgaatcagtctcttccttagtaacttgcttcaggatccaaggagtgaaccactatggaaatttttctgtaataatttcccttaatccttatttagatttgtaagtctaaacacttaccattatctgacacatgaagtatgagctatggacgttgtctcataatcttttccttattccctatttatatttatttgttagtctaaaaattaattgttacctgacatataaaataaatgtcatgaaagcaactgttttatgcagaacaacgtagtgctgtgtagtttttatattatgctaatatcggagctagcactcctgcccccagcctccaatcctgctcatcgaccccgaataacagacacctgagcgggcacctgctgggggatggactttgttaggacgattagaaaggagcgtttccatgatttgcttatgcttcacccttcctttcagttaaagattaagtctttgcatcggatttcagttccgaggcgggccgggaagggatgtggatattttctttattttttaaaaaaacaaacccttgtagatagagttggtttatttttaacaagggtagaagcattgtgggaagctgtttttcagatttcatttcagccacagaccgtgctgtacaaatgaagacacagcctggattctccctaatgaaaagagtgtgtcggggatggggacagtggcggggggtgggtgggctctgagggagcagctccccctgcacagagatccgggccacatgcaggtctgcagtgactctgccttctctctagcctcaccttcatgcagcacttgccttaaaccagctcacatgccccacctcaggcaggtcaaccagcttttactgaacacctgctatgtgcagggcagaccaataggcataaaggaggtctctgtctttctagagatagtctggtagatgagacagatgtggaaactaataaatctaacaaagggcagaggccatgtgataacaaagacagtaagtgaaacccaagccacaacagatacaagcataggttgaggggatcatggagggagtgaccgattcccaccaaaggagaggggcagagagggctttggagaataaacaggtagcaaaagggagatatttcaaaaagtgggaggaggttgtgtttcagatgtacccgggggagtttgggagggagatgggaaatgaggagcaaaccttcaaacagccccccaaaaagaaagaaggctctaagacagcctgttgagtgaaacaacaagatgcaaaacagattgtattaaaacataagtttgggaaacaaattatgttcaataaagcaacatttaaaataatgttaaccgaggtgaagtggctcacgcctgtaatcccagcacttcgggaagcccagatgggcagatcacttgaggtcaggagttcgagatcagcctggccaacatggtgaaaccctgtctctactaaaaaatacaaaaatcagccatgggtggtggcacctgtaatcccagctactcaggaggccgaggcaggagaatactttgaaccccggaggtggaggttgcggtgagccgagatcatgccactgcactccagcctgggtgaagagtgagaccctgtcttgaaaaaaaattaataatgttatagaaattttagggaaataaatatatatatatttgctataaatgtttttttttttttgagacagtctcactctgtcacccaagctgcagtgcagtggcaccatcttggcttcctgaagcctccacctcctgggttccagcctcccaggtagctgggattacaggcacgcaccaccacgctcaaatttttgtatttttagtacagacagggtttcaccctgttggccaggctggtctcgaactcctgacctcaggtgatccacacgcctcagcctcccagagtactaagattacaggcatgagccactgcgcctggcctataaatgtatgtttaaaaggcctctatatatcctcaatcaataacagcctctggggtgggacaggagggaatgtccctcctggtggaatggggcaggagtgtcagagtggacttcagtctttgtctgttttttttttttttttaactaaggaaaatatattcttcattatctatgtaattaaaatacgttttaaaatctaataaatcacctatttacttttcactataacgtagggcacttaaggctattatgttatgtccaatacatctaggtttgatacttcaaagtcaagcggattctggagaagccaaaatactgacccagaaagtctagattcgcctagtttaattcccttattttacaaatggggaaccgtgggtttctcacggtctttttgttgataggtgcaggaagatgtacgtgaaataattcatggaaaagtcacagtggccttgaagttctccagataactatgaaaaactacgttaagatgctatttttcaacaaaattcattttaccaacctcaaaacgtatttcctccgaagaggatacgcactgacaaacaacacccgagtgtggcatgctagcaggagcactaggctgggagtcaagagacttaaattccacccggaagccaccacatgaccttggcatgagcccgtcaccaggctcctcagcgtcctcatcgcagcaccagggatttcccaagccctccggaaatactgtaacttgacaacaatggagaaagactttcacccatgcggttggaatgctagccttaaaatatatacaattgttacatgtcaataaaaataaataaataaatgtttaaaaaaaaaaatgtccttccagggaacatcacacaccggggcctgttgtggggtggggggagtggggagggatagcattaggagatatacctaatgctaaatgacgagttaacgggtgcagcacaccaacatggcacatgtatagatacgtaacaaacctgcatgttgtgcacatgtaccctaaaacttaaagtataataataataaaattaaaaaaaaagtccttccaacaggtttcaaaagtgaggttctaatttaagccttgcagggtctctaatgtgaagccagtttggtggggttgaacgccaaaaggataggaagggcttctctttcgagaatgcggggagaaagaaaaatcagtattttgactaaaagaaagtatttaagttacgatcagaaatatatttgtctagaaataaaaatgcattccccctgaccccccatccctttaaatagtcacagctggctctctggccatataaagttaccatgctgtcaaatgactcaacttacaacatctgcattggtgaccgacatcctgtatcatgggctatctaaccctttgagtcacgacacccctgtttgagtaaggtttattttactagcaccaagagactcctgcgtttaacatctgtggtgctcctcctgaaattcctagccataaaacaagtaaattcagcgtggtctgaaattccagagcgtagccacgaactacacagaaaacacattcggtggggccggtcggtaatggagcagggcttagctcgggtggggctgcacatctggctgtgccttccctccgcaagtgtgggaagaggacctgggaatgccagggtccagccaggcagagagtggctggatggtctgcacgggcaggggatgctctggacacatggccaggagggtgctccccacagtgcacccttaggtgccaggttggtgacattgggtgtgaccaactgttaaccactaaactccatctgttaatgtcctctgtaggccaaatactccatgtgcctgaagatgcttccggcttacaattgtgaactcagtttctgtgtccagcatcgagagtttaaagtggggcgcgcccattctctggatgggcacagagctgttaaaatggtgattacgtagacattgtaccacgtgggaaaatattgatgatgagaccacattagagaaaatgagcaaacagaatgcagggtggcaacgtcaccatggtaataaattggtaagacctcctggaacactatgcagccataaaaaagagccagatcatgtcctttgtaggaacgtgggtggagctggaggccattatctttagcaaactaatgcaggaacagaaaaccagaaactgcatgttctcacttataagtgggagctaaatgatgagaacacatggacacatagaggggaaccacacacactggggcctacctgggggtgaagggtgggaggagggagaggatcaggaaaaataactaatgtgtactaggcttaatacctgggtgatgaaataatctatacaataaacctccacggcacaagtttacctatataaccgacctgcacatgtacccctgaacttaaaataaaacttaaataaattggtaagatctgacgtgcctgtgcagctgaggactagaactgaacacagaaaaattgcaatagcttagttcactggagtgaagtggctttaaatttttttttttctttttgagacagagtttcactcttgttgcccaggctggagggcaatggcgcgatctcagctcactgcaaactccgcctcccgggttcaagcgattctcctgcctcagcctcccgagtagctgggattacaaaaaaattttttcatgctattcatgaaaattaataatttcaaagacataatcccagctttttaggggagtctccggcaaggcatgggggtggcatctgcatgcaacacacggttgacaggaaaaagggatgatggaagcccaggacgatccccccgtgggaaccagagcaaggtcgtgaacttcaaagctctttgacaagtacaggatgataaaaacatatgggtttaggacaactccccgtcacatcttctgtgtggccgatgcctggcaatccttcaagtctctcttccatatcaacatgccttgtgtgtggggtgagcgggcaataaggagaggctggctgacaatcaccatggcaccatcccatcaagatgacgcacagactcctcagcgaggcgcacacctggccttatgtgccagacattctactccaggggcaagcagcctctaaattatttgtcactgataccctgagtgtcccattttcacgatgccacccagctctgggttcaatcctgctcttgctcattcccctgggcaaggtgtcagtctcaggctgtgtaaagaggctgtgtccccgccccttatatttaaatattgagtgggttgcatctttcccagccataccaagaggaaatgcaaccatctccctccctgaggccagcgtaatctaaccatcacaagccaggaagggttgtggcaagccattgatcttattgtgtaattatggctagggaagtgtgaatgataatggatgaaaaggagaggtggaaacaacagactttgcctgaaaatgggatgagttaaattacagtgcattgattcaatagaaaatcatttatccatttttaaaaatgctttgtgggctgggtgtggtggctcatgcctgtaatcccagccctttgggaggctgagggggcggatcacctgaggtcaggagtttgagaccagtctggacaacatggcgaaacgctgtctctactaaaaatacaaaaattagctgggggtggtggcaggtgcctatagtcccatctacttgggaggctgaggcacgagaatcacttgaacctgggaggtggaggttgtggtgggctgaaattgcaccactgcactccagcctaggtgacagagtgagactctctcaaaaataaatacataaataaataaaagtaaaaaataaaatacaaataaaaatgatttataaagaccacatggtaatggaaaaaagcatgagctataaaattaagtgagaaaaagtactgtacaaaatggtatgtgaattataactataaaaatacatttaaagaccacaaaagaatacaaatatataggtatgcatacacatacacatctaaatgacatgtatagtcatgttttattctagaaaggagatgaacaggtgcatttcctttaatgcagaagggagtccacagagagtggctctgagcaggtgacttagttggtttcaggagtggtgagatcatggggaattttttctctgtggccaacaatttctgtaacgtcatgtataagcaactgaaaaattattatctcaaagcacatgaattttgtatgttttggcagcactttctgcagttcaaatggccatatgaaacccttcgggttagccacaggtacaccttagagcaaacccaccccatgggactgacaggaggcaaagtggcatgaaaggacaacacggtgctcccccaccctcggaaagtacaggaatccatcctcactgcaacaccatctgtaaacgttctccaggggaggagaacgcagccctgctgtgctgttcagcacttaagcagactgaaaaagcaattatcataaaatgcaagttcagctgcagcccagctctgtggggaggttgttggatgaggagctgtctgtctgggacagcccctgactcaggcttagcttcatccttgaggtccagccttgcacctgctctgtttcctcatctggggtccagctgacatctgcctgtacctgaggacctgcccagggaaggccgagggagacagtaggggactgaggacaagagtgggagccaggcagcccacccatcctcagttctccctcgtgttagatgcagaaatcaagttacctcgactgaactcattttaaaaatgactttactccattctgtgtcaatgttgcattcttggctttgaccttgtgtattaaagaagcagctcaatgaaaatgttccgacattacctgtgagctgtgaaagaggtggctgattattttgttggtatcatttgtctaaagctccatgggacaaattattttcataatcctagtgcaagtaaagatcatgtttcctaaaggtgatctttaaactattttttcattgacagtagaaagctgagagtgaaattttgcgtttagttatacgaacgacactaatgtgtttatagcacctctattcccctccttcctcccacccaccatccttctacatgttaagaaaatattttctctttttttcaacagactttctcttttattataaactgcctcaaattctttttaggagtagataagatgtcaataaacctgcatggcaacatatcttgaggaaattgcctattggcagagacacactttcttaccttcaacaaggtagtaacattgctcaactaaaaaaacctgggccaggcttggtggctcacacctgtaatcccagcactttgggaggccgaggcaggtggatcacctgaggctgggagttcaagaccaccctgaccaacatggagagacctcgtctctactaaaaatacaaaattagctgggtgtggtggcgcatgcctgtaatttcagctactcgtgaggctaaggcaggaggatcgcttgaacccgggaggtggaggttgcagtgagccggagatggcgccattgcactccagcctaggcaacaagagcaaaactccatctcaaacaaacaaacaaaaaacaaaaaacacacaaaaacaaatctgcagagagagagagagaaaaaaaaatccaggctgtggggttgtctataagacaactcagctaggcccttcagaaagtcagtcataacaaaaagtctgggagactgttctagattgaagttgataaaaagacgtaacaatgaacatactgatctttgattagatcctgctttattttttatttttttaaaaaagctataaaagatgttttggatgcaattgggaaaacgtgaatatgaactggatagtagatgacgctagagttaatttttttaaaaattaatgttatgaggtatgataatggtgtcgcagatacataggagaatgtccttggtagacatctaatgaaatatttatagtcaagtatcatgatcatttacaatttacaatttaccttcttttttctttgtttttcttttcttttctttttttttttgagacggagtctcgctctgtcacccaggctggagtgcaatggtgtgatcttggctcactgccacctccacttcctgggttcaagcaattcccctgcctcagcctcccaagtagctggcgttacaggtgcgtgcctccacgcctgactaatttttgtatttttagtaaagacggggtttcaccatgttggtcaagctggtctcgaactcctgacctagtgatctgcctgcttcagcctcccaaggtgctgggattactggcatgagccaccacactcagcctacaatttactttcaaatggttaagaaaaaatcaaaacaaaatgtgtgtgtgtgtgtgtgtgtgtgtgtacagagagagagagagaaaactgtatatgacaaaatataaacaatggttagagccagggagacagtctacaggtgttcattgtactatgcttctatctttgctgcctgtttgaaaattttcagtcagttggatggaggtctatgaaagtccaacacttatagatcaaccagaaatagatgaaatctgatggtaactcattttctggaacccctagtgtacccccaaacaactcaaatggttgagatcaatgttaatgggtttcagtcataaaacttagcaagaaaaaggaaaacaatcaccaccaccaccacagttttgctgctgtcactctgtgtaggacgggttgcagaactgcgtggcaagaagagacagcggatcacaaggtcaagagatcgagaccatcctggccaacatagtgaaaccccgtctctactaaaaatacaaaaattagctgggtgtggtggcacacacctttaatcccagctacaagggaggctgaggcaagagaatcgcttgaacccggaagatggaggttgcagtgagccgagatcgcaccactgcactccagctaggtgacagagcgagacatcgtctcaaaggaaaaaaagagagagaaaaaaaagaagagacagcatttcagaaggagtctctgcccagcgtccagcagcagtcggtaagagaagcccatgtatgagaatcaggatgctgcagtgctccctcaagtcacctccattgaaaaccattttttttccacagttggagtggccgattgctgcaggtatgacatctggccagtaccaagtcttcctaactcttcagagatcaccccaactcaggaatgggcagacataacggcatagggagacctgtacgagtcacctgacccccagcaccaggtcaaggctgcaggagtcccagtcgcgcccctgcccggcacacccacacacagagcttgcttctcaactaggcccggccagcgcagcttcctctgggcagggccctaaatgtggattcagagctggacagcatccgctgaccccactccagaatgatggctgggaagtctctgttgtaacccccgccaatttaagagatgccgagaatgagctttcagtcacatattcattcattttaaaaatgtttatggagaaacttctctgtgccaggctctgtgtcagacgggaatataagtttgtgaacaaatcagataagatccccacactcaaggtgtttaaggtctactgggagacatggcaatgaaataagcaaaaaatacgtgtgtggtgtgtgtgcagagtgagtgcgtgtggagtgtgtgtggagtgagtgtgtgtggagtgagtgtatgtgcggagtgagtgtgtgtggagtgagtgtgtgtggagtgtgtgtggagtgactgtggagtgtgtgtgtggaatgagtgtgtgtgcagagtgagtgtgtgtggagtgaatgtgtggggaatgtgtgtgtgtgcagagtgtgtggagtgagtgtatgcagagtgagtgtatgtggagtgtgtgtggagtgtgtgtggagtgagtgtgtgcagtttgtgtggagtgagtgtgtgtgtggagtgaatgtatgtggagtgtgtgtggagtgagtgtgtgcggagtgtgtgtgtagtgagtatgtgtgtagtgaatatgtgtggagtgagtgtgtgtgcagagtgagtgtacggtgttagtgtgtgtggagtgagtatgtgtgcggagtgagtatgtctgcagagtgtgtatgtggagtgagtgtgtgtgtgcagtatgtctgcagatgagtgtgtgcggagtatgtctgcagagtgagtgtgtgtgcagagtgagtgtgtgtgtgcagtatgtctgcagatgagcgtctgtgcagagggagtgtatgattggagtgtgtctgtggagtgtgtgtgtggagtgagtgtatgtgtagcatgtggagtatgtatgtgtgtagtatgtggtatatgtgtgtagtatgtgatgtatgtgtgtggtatgtgtatggtgtggtgtgtgtgtggtatgtggtatgtatgtgtgtggagtgagtgtgtgttgtgtggtgtggtccgtgtgtgaagtgagtgtgtgtggtgtgtggtgtgtgtgtgtttatacagtcatccctcagtattcacaggggattggctccaggacccctgaggattccaaaatccttggctgttcaagtccctgatattaaatggcgtagtgtttgcatgtggccaatgtacgtcctctcatacactgcaaatcatccctagatgacgtataatacccaacacaatgtaaagctatgtaaatagttgttatactgtgtttttatttgtattgttttttattgttgtgttattaatttttccaaatatttttgattcatgaatgtggaacctgcgggtatggagagccaactgtacatcacataggaacatatctaattaccagctgatttgttccagaaaagaaatcaatggggtgcagttgaatggtggccttaacctctcctactgatattgaacgctgggcagcatggccctctgaaatcccactcgttcctgccaggaccaggggggtttgaggagtgtctctttgagaaagtggctgtaggtcaagtgctgagagaggggagggagggactggggggcagggctccaggtggagacatcttgtgaggtacctaagagtggtgaattcagggtgtgaggagagggcagagaggccaacatcagccagaccttacaggtggtgataaatagttagatgtttattctaagggaagaggaggccacagaattgttgtaagcagtggatggacatgaggtgacttgggttttaaaaggccactatggtgactctgtagcaagctgattggaggtgggcaagagtagaaggtattttcacagtccaagtgagatatcagttccttaaacaaggacagtggctgtggagggggagaggagtggactgattccacatacactttgcaggtagaattgacaggctttgctaatgggttggatgttagagttgagaaaagaggagaaaccaaggataacttccaggtttctggtttaagccagtggtggtgccaattccagagagaggacttgatgtggacgggctggtggggagaacatggaagtcaacagtaagagttcttcatcttctgcaggatacctcctacctttccgtcagtcagtttatcaatcgggtacttgttgagggcttatcatgtattaagctctgtgcatttaccttgacatatttttaaagatgatttgaaatgacttctaataaaactcacaggtacaagaaaactactgaaaaggtgcataggtgaaagaacaagagccaagtaacaaaaggatgaaaagaatcatatctaagtcctaatcctaaaagagactgctgcaactacaagcaaaaaaccttaactctgagttccccaggaaccaaagcaaaaagggaaagttgagttttataaagccgattgtctaataaaaagaagcatgctggcttactcagagaaataaaatttcgcccttattttcaacttcgaaagcatttttcttactacctaccttctgtaagggccaatgatcaatatagtggaattgttatattgtcaataacaattttacacaaaatacaaaagatttctgtataaaacctaaaaaactggtgtcccaaatgcccggtagaatggactatcaagggcactggccaggggcacaggtctgtagcaagggaatactttggcttgtgtcttactgtcttaggttttaatagtgtctttgtgacgagtaccttgctacccactgacttaattacagtttcttttgtcttagaatgtaaatttcttttgttacccccccccaatcatgtgtgtgcatgtatgtgtgggtgtgtgtgaaccactggagttggctgtagactttcttttacttttgcagccagagtctccctctgtcgcccaggctggagtgcagtggtgtgatctccgctcactgcatcctttgcttcccaggttcaagggattctcctgcctcagcctcccaagtagctgtgattacaggcactcacgcaccaccaccatgtccggctaatttttgtatttttagtagagacggggtttcaccatcttggtcaggctggtcttgaactactgacctcatgatccgcccgcctcgacctcctaaagtgctgggattacaggcgtgagccaccgctcctggccggcaatagactttctaaaacatttaaataaacttcgcaccccttctcacgctgcccggaaaattctgacttccctcaccttgggagagcaaggctcatatagcagacgttgcagaccttgtttaggtcacacttaagataaaggaagatgcaaactcctttttttctgatcagctgatcccctgtgactgacggccggggagcccctatggcaccagtctgtaggctacagcctgagccagattccatgctaaaagtcccgaggctggcagtgaaagaaaccccccggggctggaaactcacccctcctgggcggctgcacaccagctcatggccgctctggggtctgtgagggcccggcgcccgttctccccagggagccgcgtgactctccttgatccggcctcccctcgagcgacaggcctcccagaggccccccagcagcccccgagcagtccccggagcgctgggggactctgcagcgcgcaggtgaccacgcagagacagccccagcgcgatgaataattgaggcgcagagtggaattacctctgtgggct

SEQ ID NO: 666 - DNA, 115948 bp, Homo sapiens
ttcataaacagccacatccgcaaggtttattcctggatcacaaaccaaccccactgaccaaactcccaagtcactttatattaaacttgttatcaaatcacccacataaatatatataataaatacaaaaacagacaggattttttttttcagtctttggtatagagagctttctcctcctcttatttccccctctgtccctgtgctctaaagacatttcctcgcattcacattatttccttggatacaaaaattgcccagaagtaaactttgtgctggaacccctgcctccattgacagtcccgccggggacccagcccacagcagcccaggggagaagcaggctgtggggactcacacgtagtcgttcagcctgtacccgctgtgcgtggccgaggtcactgagggggcccgattgtctttgtaggcagctggtggctggtaggcaggtgcggtgtttgcagtggtcgtggtggccctgggcggggcctggtagggcctgtagggtgcctcgtcctggcaggacaggcaaagcagggtgccaccaatgagcgagagggacgaggagatgaagcccaggtacagggcctggccaatctcaaacttcatgccgctgggcagcagcgggttgtagaagttctgcaccacgtcgttggtggtccaggagacggccaccatgcacaggaggccggccaggatgaagagggtgccgccgaggatggcaaaggtggtcttggcgggtgtgcccttggcgcagcgcgtgcacttcatcccgatgacggcgcaggcgcaggctatgcccgagagcaggcaggagatgaccatgagggcgcgggcagcctggaggtcttggggcagcgccagcagggatcggtagatctggcactggtagatgcctgtgctgtgccacacacactccatccagagccctttcaggtaggacacggccgtgaggatgttggtgcccacgtgcgctgtcctccgccagtgcggcaggatggtggtgatcaacgtgcccaccatgcccaggaagctgagcaggaagcccagaagctgcacggccgtgctggccatggtgcggctgcctgcctaggccagccgggcagctccctgggccctcggggtcacgccgctcctcaggtgccagccggagccctaatgaagccaagggaggcgggagcagggagagaaaggaaatgggttaaagattatctcatgcacttatttctgtcaccgaaaccaagtttttcataggtggttggtgtggcaattagcatgttctcaaaaatagtttctgagacttcactgggtgggagagtaactgctttcctgggaaggtgggatctgaagggatgacagccggacgctggcctcagggaagggttccagccacctgccggaagttctgcttatgtccacccttgagcactgctgctgcattggcatctcctgtccttcctggttcatcagtaaccaggaataacagttgttaaatcaacatgtattattcatgccttggactgacagtgctaaggtgtgtgccagctgtgacttagaatatagccctgggcggttgtcaggatgaggggttttctgaagtaggcaacttccccacccacgtgctcgggcagggagaggtttagtcccctcggcaagtcagatgctgccttcagaattccagagctggatgtgacctagagattgtcagctgatgccggggcaggaatttccaaggtcacagctcctcaggagctgcggcaggagcacgggccagcatccctcctctccagcacggacctccgctcccaacacgctccccattcactatgcctgcttgtgactggtgagggctgtccgagggtgactttattataaaacagaggctgctacctggctttcagggatatgggaatgctgagccctttcaaaggcttttaaagaattcttagcataccaaaatccaggatactttttcgggacaaggacccagcatcaacatagggccaggcatatagaagacactaagggccaggcacggtggttcacgcctgtaatcccagcactttgggaggccgaggcaggtggatcacctgagttcaggagttcaagaccagcctggccaacatggtgaaaccccgtctctactaaaatacaaaaattagccaggcatcccgtaatcccagctactcgggaggctgaggcaggagaatcgcttgaaccaggaaggctgaggttgcagtgagccgagatcgcgccactgcacttcatcctgggcgacagagtaagactccgtctcaaaaaaacaaaacaagcaaacaaacaaaaaaaaacactaggaaatatagaaggaaggaaggagagagggaagaagaggagggagggaggaaggagaaagcaaggaagggggagcacagagaaaggaaggaaaaaaaggaagggatgaaggcagaaaaggaagggagtggaagtcttgagtggaccactagcttttctctcctgcctggggcaaggtaatcagcgagaccgggcattagcagcgagcattaggaggtcccagccctggctgcgcccatccagtgggcgacctggggctcagcttcttttttggttctgaagggagaaaagggaagcgtctctgctgatgacaagtcacttcagcgtcccaaaccagcaaagaatcagtaggcaaaacctgcttcttcttctgcagagagctgagcctcagttaagcagtgcaggctgcaggcaggaaaagcgggtctgcagggtgttgcccatgagaccctgggacattgtcaagaaatccccatcggggctcggcggctcacgcctgtaatcccagcactttgggaggctaaggcgggtggatcgcttaaggtcaggagtttgagaccagcctggccaacatggtgaaaacctgcctctactaaaaatacaaaaattagctgatcgatggttgtgtgcacctgtcatcccagctactcaggaggctgaggcaggagaatcgcttgaaccgggaggcggaggtttcagtgagactggatcatgccattgcactccagcctgggcaacagagcaagactctgtcttgaaaaataaataaaataaaatgaaataaaataaatcaataaataaatcctctactagatgtaaatcacttggtaagtaaataattaataactgatgcttccactgggagtctaaaccatcatcttgctaatttaaaaacatatactgggtttaaatactttggcattgtaggaggtaattggttctgtcctggtgaatgaacaaacaaaaataaataataacaaaacaacgtggtgcctcacaggacacggagtggactgaaggtgtgtccaggtgatagggtttggatttgtgtccccacccaaatctcatgtcgaatggcagtccccagtgttggaggaagggcctggtgggaagcaaatgaatcacgggggtggacctcccccttgctcttcttgtgatagtgagtgagttctcacgagatctggttgtttaaaagtgtgcagcacctgcctgctcccctctctctcttcctccttctccggccgtgtcatgcctgcttcccctttgccttctgccgtgattgtaagtttcctaaggcctccccagccacgcttcctgtacagcttgtgagagccaatgaaacctcttttctttataaattaaccagtctcaggtagttctttgactcaggttgcattgcgagaacggactgatacaccgagtatttttctgctgctgtttttctgctgctgctttgggtgactatttgttcacagcccagaatttgccacacgcactatgcacgatgctggctttgcacaaagcctctcttccctccactcagcaagcactcactctgtccaggggctagggacgccatcacagtccctgctggccagagaaggaccggggccggctgtcctatgctcactgccctgggggaggtgctggcaacaaggccaaggtggccaccctgataggcacagccagagggggtgccagcggacccaccctgcaccctgagcacaccgatggcaccagctgactgagcctgagcatggtttgaacactgacacatttcctagtttattcccaacaacctaatgtggcagtgactgttaccatcccctttttacacatggggaaacgagaggagcagaggatgaaagttctgtgcctggcctggctagtgttctccttgctgtcatttcccctttaagaaacactacctgcttcaatgacataggactgaagttagtgtaagggctgagggatggtgtgagcaacagattctccttcccacagagatctcagaacaatggccttgccccttttgcagtggtttgggcagccagggcaaccaactgccctgctttgctagggactgaggggttgcccaggacagggaccttcagggctgaaactaagacagtcccaaggaaaccaggaccagaggctcctccaggtgcccagatctccgaatggcctctgagatctcttcctgccctgctttgaggctgcctcaaggctgacggccacacagggtgtccctggtccaagcataatggggcttcttgcagctctcactgtcaaggtcaataattaagtatacagaccctaaagaatgtggcataaaagccaagcccattaggctaggcaagtggaccagaggtttattggaggtctaaatatttatggagagcaatgatggctaattttagaaaccattaggttgctatttttaaacgtgtgctataaggatttgctaatttaagaagtgagtgttaatgagcccccaactcccagacacaagctccccaacctgctttccttcttccttaccagcagctgctactggcattaggtaataattcaacttccccgcaactacttttcactttggggcctttcaagggaaaaacaactttaactgaacgcatctccctggaagccacataaaattcctccgtgatgctccggaagcgccctgccctgcagggctgtttgtataggaaggaactagcccaagcctggcctcccagggggagcagcccatgcagggctgaactggtgttcacctgtgggctaccattttcctgcagccacgtgtgtgcatgtgggaagatttgctagagagatacggatccaaaacaaatagggttccaagcatcaagctctagaaagccctcgacaggctgagtagtggtgggaaggcagaatctaacaagatgtgttagaggatcagtactgggtcctgcatttgggttcacaaaaccccaaaagtacaatcctgggtggggagtatgtggcttagctgcacctgagagcaggatttagggctgagtttcccaacgacagcatcttggaatgctgcatttgcaggatgtcttgtgtggaggacacaaatgtcaaatatgtttaagaaaacctgcgtgactgtaggacttctcatagctggaaacgtgtcaatgtgcatcgtgactctcccaggaaatgtctcatgggcagcatccgctaaacttatttgactagagacacccccctgcaccccctttaccaaagaacaatttgcaatgaaatcactttggcacaataacttggacttggcaatggtgagatagagtgggttgctgtattagtttgttctcatgctgctatgaagaactgcccgagacgggtaatttataaaggaaagaggtttaattgactcacagttccgcaggactggggaggcctcaggaaacttacaatcctggcagaaggtgaagcaaacacatcctctttacatggcagcaggaaggagaagaatgagggctgagccgagggtgaggccccttataaaaccatcagatctcatgagaacttactcactatcatgagaatagcatggtggaaaccaccgacatgattcaattacctcccactgggtccctccccacgacacgtggggattatgggaactacaattcaagatgagatttggatggggacacagacaaaccatatcattctgccctggcccctctcaaatctcatgtcctcacatttcaaaacacaatcatgtccttccaacagtcccccaaggacttaactcattccagcattaactcaaaagtccaagtccaaagtctcgtttgagacaaggcaagtcccttctgcctatgaatctacaacatcaaaagcaaattagttacttcctagatagaatgggggtacaggcattaggtaaatacccctattccaaatgagagaaattgaccaaaacaaagaggctacaggccccatgcaagttcgaaatccaatagggcagtcattaaaccttagagttttggtcgacttcatccccagcagagagagtatcagaaaacgacagagcggtaaagaattttgaaaatctgtgaaaggcaattgtgaaatgctagagctgctataggcccttccaactggctctggtttcaggatcaccagctctgaagggagggggtttttctgtgtgtgtccatataaacttttatgttgtctccctctgttttctctgagctatgtttttctttaaaaaagcagggttctggagcacacagtagggtgccctcattttgctcacctcctggcccacctggaccccagctgcgtcaactttggctccaaattaatcatcatttcaacagcagtggccatggggatcgcctggccaggactgaggggtggacgtgttgtttaccagcctgcgtcttgactgcctggggtccctccctgggcatgtctgtttcatccttcactttgtcctatcttcagaagtcctttctctagttcttcagggtgtgtgctggggcctctgtcagtccaggcttcttggaggggtgcgggggtgggacgaggccaccctatctcaccattggtccaagtgactgtgccaaagtgattttactgcaagttcttctttggtaaaggcggtggtggggggtgtctctagtcaaataagtttaatggatgctgcatatgagaccaggcttcttggaggggtgcagggatgggatgggtggggtgtttgagtcccttactctccttaaccctcagcagtctcacctgctactgtcacctcatcccttgcaaaatcagcccctgtgatgaaagctttcctatggacacacattgctccgtggcccttgtctacccaccttggtgaaagaaatgtcagccccagatgggaggggtggaggacatcagcggggagctggggcacaagccaggtgtgtggtggaagtttctttacccagaactgccctgagccctactgtgcaggtagagaattggaggatgtggccaccagtgccttttgcctgccatgtggtctgaatggctctcgagatgtttgggaacgagccattatatatgtttgccctcaaatgctctgacatgatgttgggtccattatagaaacagcgtaaaacttgatttgctttctgtaaacttattagagaaaaatgaagtgccaccttcaaatgaacatagtcattggcccttcaacgttgatgttcagccacttcagaaaatgtctggttcaaaaacctgaatgtcctcactgtcaccccaaccaaatggcctcttcattactgtttagctatttcataaatgctttaggctggagatggtggctcacacttgtaatcccagcattttgggaggctgaggtgggcagatcacctgaggtcgggagtttgagaccagcctggccaacatgatgaaaccccgtctctactaaaaatacaaaaattagccgggtgtggtgatgcatgcctgtaatcccagctacttggaggctgagggaggagaatcgcttgaaggttgcagtgagctaagattgcaccactgtactctagcctgggtgacagagtgagactctgtctcaaacaaaagaaaataaacaaaatcataaatgcttgaatttaggaactaaaaataaactcaggggagatttggattcatttagataagacatattagcaaaactacctaacacagagaaaagaaagtaactcttacgctatgatgtatctgcatgaagtaacttcaactagtattacttttttctttttctttctttctttctttcttttttttttgagacagaatctcgctctgtcacccaggctggagtacagtggcacgatcttggctcagtgcaacctctgcctcccaggttcaagtgattctcctgcctcagcctccagagtagctgggattacaggcccccactaccacgtctggctaatttttgtatttttagtagagagatggtttcaccatgttggccaggttggtcttgaactcctggcctcaagtgatccacccacctctgcctcccaaagtgctaggattacaggtgtgagccactgtgcccggactcagctagtatttcctaagggcatcttggacactgtgtttcttaatcatgtgcgaaacaaacgcatatcttttcaagaagcttagggatactttagaggggctatttttagcacatcttcttacagaaatatgtaagaatgatgagaaagcgatcaagcaataccttggaaaaaccacttcatattcatttcacatgggctatactgtggggtgttggctctaaaaataatattttcttcattactattccaaactttctgtaactttccttgggttatttttcagactggcaggcatctagattttaaatgtgtgaggactttctataccatccgcatagagtctttgatgcactctttccatgagaggcagagacgggatacttacgtgactacgacttattactatcatgatagttactgcttgctattgttatttaggaaaaccaatgtgaagtatcttactcaaaatcacacggaaatgacacgttccatgaattcctcctgtctcttttggatgaagaaataaaaatctatttttttataacaagaactgattcgaagaaaagtttatgtgaatacaaatgaaaaccatggatgcagttaaatgctaacagaggctattttcaactcagtaagattgaatgacctattgatttaccgaaaactacaaacttaagtcaccatgaccacaaaaattaaaaccctttctggaggcattatctctctcatttcaactcaccaaatttcattagaattcatttaaaatgcagtagatcaacatttagaaatgaaatgagtttcatttacttaaatacatgagtgccttttcagagcgatttttcccgacaagacagtcaggcaggtttgctatgttgctgtttttgttgttgttgtttttcatttttcaaggtgcaggtcattaaaaacttgtcatctgagattaaaaaaaatactagaaaagtaaaacaaaacaaaaacaaaaacaacaacaaaaaaacaataccccaaaaaacccaggtggacatacaaacatttcctcaagccttagctgattgttggatgacttatggttaagtgttctgtgggaacactttatctaggggatgcaatggattgacctggtcccccaaaagagatatgttgaagtcttccctgctcccagtgcctcagaatgtgaccttatttggaaatagggtcattgcagatgtaattagttaagataaggtcatacgtaaaatagagtggcccctaagccaatagggctggtgtccttataagaggatgggcatatgaagacggagatagaaagaacatgtgcagacggaggcagagagtggagcgagaagttaccaagtcaaggaatgtggaggatcgccagcaacccgcggagaatcgccagcaacccgcagaggcccagcaggaggcccaggacagatgctccctcacagccctggaaggaaccagcctgcccacaccttagtttcaagcttccagccttcagaatcatgacagaataaatttctgttgtttcaggcctcccaggttgtggtgctttgtcatggcagccccaggaaacaaacacagcagagtagctgaatggtggcacggggaattacagagaaaatgctcggccaggccccatggcacaggcctataatcccaacactttgggaggctgaggtgggaggatcacttgagctgaggagttcaagaccagcctggtcaacatggtgaaaccctatttccactaaaaataaaaaaaaattagctgggcatggtggctcaagcctataatcccagctactttggaagctgaggtgggaggatggcttgagcctgggaggcatagattgcaataagcagagattgtgccactgcactccagcctgagtgagagagcaacatcgtatttcaaaaagcaaacaaacaaaaaaacctcatttgtgattataagaactgcgtccccttccaggacaggcattgagtgtgatctggtggcttcacatttgtcattgataaaaacaggccaggtgcagtggctcacacctgtaatctcaacatttggaaggccaaggtgggaggactgcatgattccaggagttcgaggccattcctgagcagcatagtgagatcctgtctctacaaaaaacaaacaaacataaaaacaaaaaacaaagccatggttagcttcatgtctcaaagtgtggaggacaaaatctaaggaaaaggtagaggacatggagaaagaagaatctggaaagtcccctgcaaatttgaaaattcaagtgcaaacacaatctatagtaagtaagccatatagtaatcaaatgactcagcttctccaggcttaaaaagtgtgtgaattcacttagctcacagagagtttgggggggctcatgtctccagcttgtgtgcaattggctggggtataattggtgactgaccttttcaggctgggtgtctggttttcttaagtcaacatgtcttgatttcatagagcataaaagccccaaatttggggcagagtccagatttgaataaggtgactcagaagcctgctgaagctttaccttggaaatccagcagagcccactaggctccgcctttagtcaggacttacagcaaaatagaaaaagaaagcaaaccccaaacaagcaataggacattgtcacacctggctgaaaaccttcatgaattagacaactattctgtgaatttcgtaagcctctgaaaattatttacttgagaattgaactggggataaactgcagtggttaaaatgtgtcaaatgaaaacataaggctaagattttctaatggtaaggaaaatactattaaacatgaggtttaaaactcattctctgtaaatttagcctttgaagcccaggtgctccaaagcagttagttgttaatgataagagtaaaaacagtcatagttaaagttccagagtgtttatgatatgccaaacatgtgctaagtgcttctgtgggcatgcaatgaactcttaaacaaatcgcaatgcgcattttgccatctttatttacagatagggaaactgaagtgtagaaaggttacataacttgtccaaggttacgtctgggctgaattagggagaccaaacaggaggttcttgtgatctttcaggtaagagatgccaggaggccgagccaaggtggtggaaataaaggtgggtgccaggaagaggtcagtttctatattcaggtgaggctagcgggatgtgctgatggtttagctgcggggtgtgagacacaggtgcctaaggttattgtcttgggcaactggaggaatggagttgccacttattgagagcttgaagagggttggagatctgggtttggaggatgtgatgatcaattttttgtgtcaacttggctgggccatggggtgcccagatatatgattgaacactattcttcatgtttctgtgaagttagtccttggacaaggttaacattgaaagcagattgccctccatagtgtgggtgggccacacccagtcaggtgaaggccagactggaaccagaaaaaactggtgtctccatcagctcaggctgccacaacaaaataccacagacttgctggattaagccacagaaattaattttctcacaattccggaggctggaaagtccaagaccaaggttctggctgcttgggttcctggtggaaattcacctgacgtcttctttgcatgcaggcagaggaaatctttctctctttcccttctttttagagcacgaatctcattgtgagggcacccaccctcatgacctcattgaaccctaatgacctcccaaatgtcccgtctccaaatactatcacatcggggcttagggctccaacataggaattttgggagaatgcaaatgtttagtccataacatgcagcttcacctgagcaagaaactctctccaacagactgtgtttgacctttatttccaacatcagcccttctcagctctatagcaggctgccttccaactgaaactgcagtgtccgtgatcctgggtctccaaactgctagcccaccctgcagaatttcattttatagatgggctcttgctatattgcccaggctggtcttgatctctcaggctcaagtgatcctcccacctcagcttcctgagtagctgggactacaggcatgtgccatcacacttggctaatttctaaaaatgttttatagagatggaggtcccactatgttgcccagcctggtcttgaactcctgggcttaagcaatcctccaaccttggcctcccaaggctgttggaattacaggtgtgagccactgtgcctggcccaccctgcagattttggacttgccagccttgagaatcatgcaagccaattccttagaataaatagatctctttctatataaatgcatattcgattggctctgtttctctggagaactctgactgatacagaggatgaagggcagaagagaggaattttcttttggacttgttcagtttgagatgtctgtgcctacccacctggggataaccatggttgcatatgtaagtgcagggttcagggagggactgaactggagaagtctgtttgtgtcaccaccgcatggagatgggattaaaatatgggatggagtctcttaggagggaacgttagatagagaggagcaggggctccagggctgattctaggaaccctccaacatcaggggagggatgaggatagaggtaggaagaggagccagccacgggctgtaggaatgggcgatagtgaacggtcaacccagaggagactggtgagggaggacagagctccatgttggagagagcaatctactctgtcaagtcaagtaatctgataaatcaagtcatctgagcactgagaagtggtcactggattagcaacatgaaggaaattggagaccttgataagctcagtttcggcggagttgattggagtgggttcaagagagaatagggacagagggacaggagggaatgagcccagagaattctttcaggaacttggaccctccaggggaatcaggaaatgaggcaacagttttaggatgggttccagggcccatagacctcaggatatctgtcaactcagccaggaaaaaaagtgacatcttctatttcatctacctctcactgacaattagcatttccttcaatcctgaatgtaggcagccacctacagcaatatgaccagtgcctgtgccttaatcagcaatagagaccatgatattttgcatcgcattacaggcgttgcagatacctgcaaaggacatttatcactctaacaatttcaaatgatacttataagatgcttgctagacctcatgatgtaatgcattaataaggaaggtcgtccattactaggaacagaattgcactaaaatattttgataactatgttttactataattcacttcctttataatcctgcatgttatgtgttatattacacatttaaaagtattgtgctgagaagaatacatcagcttcgccagattgccaaaggaatcccaggcaatccccatcccgccacccagaacaacaccgataacaaaaaactaaaccaaaagagttagaaacctctgccagtgggatgtgtaggcaagagaggacccttgttttgctgttgttttgaagatgagaggcatggaagcatgtttgcatgcctgaggaaatggttcagcgaggagggaaacatctgtaggggcagtagggatcctgtgtgcacatggagagaccagctctgaccagcatgcagagaactcactccagaacgggaggggaggcgggagcaggaggctgggggagatgtcagtgggcaataacgcatgttctgagtttgctccaagtttctcagggaaataagaagcaacatgatgtcttgagacaggagatgggggaggaggtgcgggaggcttgagcacagaggaggagaccatggtcatccaggagaatgaccgcaggcctggaccaagtcaaggggtcaagtgctagtcagtgccgggtgcaggtggggcaagtggtcctgcgggtaccatagactatcacgccggacagcctttcccagcaccatcaactgcactgcgagggtcccaagtggacaaagggctggactggacctggtggggattttcctaggggaaaatgatgaaggcagacagccaagggaaatatgcgtgcacacaaaggtgtgaacatcatggcgggccgtggcgtcaaagctgggatggagggacattgaggacaatagagaaggtctgttcatcgtggagaagtcacctggatcagtggctctccaccctcctgctgtagccgcagcccttggagagctttaaaaagatccggatgccctggctacctccagagattctgattcgctgactggggtggggtccatgcatgggaattttcgagctcctctcccccacccggtgattctgatgtgcaggcaggtttgagaaccaatggcttatttatttcattaaaaattatttttcactctgttggccaggctggagtgcagtggcacaatcacggctccctgcggccttgacctcctgagctcaagtgatcctcccgcctcagccttccgagtagctggaacttcaggtgtgagccactgcacccagccccgctggcttcattgatttaactttttttattttattttattttatttttttgagacagagtcttgctctgtcacccaggctggagcacagtaggattacaggtgcacgccaccacacccagctaatttttgtatttttagtagagacggggtttcactccgtctaggctggtctcaaactcccgacttcaaatgatctgccctcctcggcatcccaaagtgctgggattacaggcatgagccaccaccgtacctggcctgatgtaacttttaaaggtcctattaggagctttaaagagtccaaaacggtttaacagagagtcatagttcagatgtctgttctgctgggcctgcctgctgagtgcaggctctctttgggatctcctgagatggagacaggtgtctctggcctgtccctggaatattgtctcacctacccataaggctaggctctcccactcccttcgcttgaaatcctcttctccagctacaatcttaccttccctcctgtggccctgcacccttgccttctgccatctagaaaaagtggttgggggggtggttctttatttatcttgctgccttctggctcttaccttcccagagccccacggaagcctgttcttacaacctgggtcctcttcctgggaccccagcccactgtgggcactgagcctccctcattgttaatcttggccaagaagttaccccacaggcatttatattttaatggatgactatttttttttttttttgagtcagagtctcactttgtcacccaggccggagcgcggtggtgcgatctcagctcactgcaacctccgcctcccaggttcaagtgattctcctgcctcagcctcctgagtagctgggattacaggcgcctgctaccatgtctggctaatttttgtatttttagtagagaccaggtttcaccatgttggtcaggctggtctcgaactcctgacctcatgatccacccgccttggactcccaaagtgctgggattgtaggcgtgagccactgccctcggcccatggatgacctttgaaaacaaatctcctcctggcccaggccccaaagcatacactcacagtggtgagaatgattgggtgagtcttccagaaaagcctgtgatagtttgatataaagacatttagaattaattgggtcaggtatgagatttcagattgcagaaatccttgtgtaagcaaaggccttgcagctaaagtagtgcatggcaggtgtggcttagcctttagacatacacacagtggccagattgtgcatttgctctgaagagtaccaggccctgtaggttacctttgcctgctctcaggacttgctagataatttgcagaacccagtgcaaaatgaaaatacagaaccccttgttcagaaattattaagaatgtcaagatggcgtctgcagaacatcaagccaagtgcaagcctgtctgagcacggggctccctgtaactgcacagatcatgtgcctgtgaagctgtccctgcctgctatggacatgctgggaactggacattgggattttccccccttaaaacaatgagtgcattgagttagaatgttgaaaggaacagagacgctcttgcagtgttctgtagaatcgaaaatatggtttcatatgtttactttaccttcatttaagtgtagccctgatgcctctgcgaatatctgccatggaagagccttttaaaaacaaagctcttgctggtctccagtgcccaagagtggccgccagtggaaacagacctggtgttctaaatctcagtttttgtttctttcttcttccaagaaagctgtagatgagcatgtgcacttccaggcctagaagggaacagctgcctctgggtggctcgcctctttgcacaaggggctcagctcagagcttcccctaagcctggcaggtccccccgacacttctcttgggaatgaagtggacaaagtgagtgaatgagcctcagcttctcctgtctttttatagagtcacccgacagggagagataaaggaggtggtagcagcttaggcccaggagccctctcagcaaatggcccagagtagaaaattccccacactatgttgctgttggtcacccggtgaaaagtccctggccctggcagccacttgtcctgcaaatggtgcgagtgaagaatccacagattagctggaaggaggaacgtttgagtttgaaaacgccaagaatcattcctgaactggcaaggctggccacctgcgttttaaaaacacattggcactagccttgaaaacagacttttagacttcttactctgcgtaatgaaagatcttttctgatatataggcaacagaatgatttttttaaaaacaataatggacatattccattttattgatctttacctaaaaactaaaaactaactggaaaacaggaaatatttaatagtgacattttcatagcaccaaaggaagaatctacgtgtcttcctttttatagatttttctgtagatgtcttaagaagcattgaaccctttatacagatgggtaaataaaacacagtaagcttgagatatgcaaatcagattggagccagataaggatgggggctggcgctggcttcaattctgactaatcttgggcaagctgctcagcctattactcactgtctacacaggaatgactgtctacataggaatagctcctctgcagagacatctagaagatgctgagataatatatgtaaaaactgacaagccctttgggacagataccagcaaatgcaaggcgtatgctatggaagttttatcatcctaacagataagcccgtccccaactccagtgagtgactgagagacacgggcatgaacgctgagctcagatgacagcatcttttcacagcagacctgggcccagcccctggaagcacacgatgatgaactgtcctctggtttcccaagacttcaaaaatgaaacccagtgatcaagagatgtttggctttgaacactgcgggaattaaagccagcacccagttaaagccagtgaggacagcactccaaggtttggggacggtctcaggacactaatcctggttccttttctattttgcctgggtccctcctgcccatcctgggaagccgtggcagctgttggggatgtggggccccaggtaactgaaggattaactcacgtctcaaattgcatggcatttctcctcttcagcaccattttttaccctcattgagagagatctatcacttccccccctctcctgccatgccaatatgtgtctgtgttggagggcaggggtgtatttagggagcaggagaatgttcccaagtctggaaactcggaacagtctgcctggccctctttgcagaaaaacgagggagtcccagcagacagaagggggcagtggcgctgagctccccgagctgagctgtggcctcaaaacactgaacagattcagtccttcctcccaaacaggcctggtaagcgatgaaaagagttctgcccaaacactcaggaactggattattgtcgttcctggctcattaggagcctggctgccctcatgccagctgcgtggggtcctctggaggccacccagaccagcctgcagcttcctttcctgtaggggccagcacggtcccttcctctggagaacgctcggacccctggctgcatgcacatctaaccggcagggcctaagggcttccaaaacagatgactgtcaaccccagcccgcccaccccacatccacagcttcaccccaaactcacatgcagaaaacctcgagtctcatcttcctgttcaggtcccttgccagccggagccgctctggagcctggctggactccagctcccatgtgcaagaggactcagccgggacgctgccaccctcctgccttccctcttctgccaaccagacgcttccaggacggagtatttgagagaaaattgtctagacaattacagtgttccttagaatggcctgcgtgggcacacgtgccacttggttagctagcatgagaggaggtggcttggccagagcagacattcaagaccaaccagaaatgtcatttctgcactgtggaaaaaaaatgcacgatacacctgaacctgggcatctccttcctaacacgcgctcaggatcaagcctccccttcccagcctggcagggttgcagggcgtccatagtccagcctacgcctgcccaggctctcggctccgggtccattggctgttcacactcacttccctgtgtcctggaactgcctgattgttgtagattactaaaaatccacagctcattccctcctgcgccctgaccacctgcccacagcgactgtgtcctcctctgagccaccacctggcggttgtcctcacactgctttggacttttctgctattgagtaactcagcttctcagcctttaggctgctatgggccctagatgcatgctggtcgattctgatcaacgagcaactgcttttgtttgtttgcttttttctacagctgcagctgtgggtgattcggatggtctgttggtggaatgtggagctggacgggtcaaggagcacagtgtggaaagagggacaatttgctacaagttggagataagagacatggcatactgtgaaaccagtgctgacggaagaaggtgactttcttggaaggtcaagacacttgcttgacagcgatgtccaggagggctagggagagttctgctggaagtgaaggcagcacctgagggtggctgagggaactggtcagggctgggaacgcctccagccctttgaggaatgattcgctgattaagagatgtttggccttgaaaattgcaagaatgaaatctcttggtgggaatgtgtagccaaaagccagcaccctgagtggctccaaggtttggggaccctctcaaggcacaaatcccagttccttttcaattttgaaaatcgttgtgggcgattctggaattgagaagtgtgctgagagccatggatttaacatgacaagaatttccgccccttcgtcactgagcacaccgcaaatgctccagggccagggacttacttgggcttctgcgtgtcttccacagtgtgcatcaatccgccgggctctggttggtgtttaaaaaaaaagatgcagcgaaggaatctggtgtggacaaacgccctgggcatggaccaaaagcctggcccttgtgtccctggcaatgggacggtgaaggacagaaagacagcacatccagtagtgtcaggagcttggagcaggcattcggaagcatctgttaaatgttattgatggaggattgacataacccacatctgcatagcttttttggtctgtttttggaagtgaacagtcacaaacaaaaacaactttggttcaggtcatttataggcccagatcctctatccttagaggtttcccaccagatatactatttcactatctatgccaggaaagttacgtaaaaccacgcagaattttacctgacaacgaaatagaccttttcgttagatcctccaccccacctaaagcagttacacaggctgaaatgaaactgttaaaggaatgaactaacttggagatagaatcatcgcctttgctgaacaccattttaagaatattggaatatataggggtaccagcataatagtaaaatgtgcccatattatctataattttatgctgggcactttttagaaattattttttataactttgtctttgagatgatttggctacaagttcattacatttagtttacaactggctttgatttcttggcattcgttgtgtattattaggaaaccccgcagagagaaaatgtaaactccaaattgctttaaaatattatgatagtttttagggatattacactgtgacagtgaatgaaatggacgtaacgttctgttttgtagatattttgtgaaatctttattagtcttgattttctttggaacaagtcattcctgttctgggctgaagcctgaaaattccctgacctgtgaccctggcccaaggctcctcttggataaaacagtgtttcctggaccagagggcaaagtcacagaaacatgatgtgacgaaatctaaatagaaaggtattgatttgttcttcgttcatcaaatagttattggactccagcacgtatgagtagcagggagcctggctagcactacaccttcccctcctgcctctcagggtcagggccacaggcacacacagagcgagggaaaatgagggggtagagaggctggtcccgagtctccagcccttctctcccaatcctctccctgagtgggcagggaactcttctcttggctcctccaacttccatcaacgtctgcccttgggtctggttttaaactctaaggtgtaaatgactcataatggctcaacattttgtccctcccaagaggtatttttaagtctaaggaataaagatttaatagtaaaacttcgaatgccaatcaggggtaagtgaggatttggaagaggaaggtcttgagcattttcctaacactgctaaaatcatcccattgagttagggcagcaactatcctgatgggctgggtatgatggaagttagtcaatgtttcaatagatggatggatggatggatggatggatggatggatagactgacggatggatggatggatggatggatggatggatggatagacggatggatggatggatggatggatggatggatggatggatagatggatggatacatagatcacctttattctgatctcaactggtctttgaagcttgattcattttttgatttctcacggagccagactagggtctgacacattaggaagctggcaaaagtttgttgactaaacaaattaatgaagggaaaattatgtatgcagagatgcctggggtttgggttaccgttttgggtcccctttgatttgagcgacacacatgctgacaacttgagtctgaagttagtggatccttagctaacttgctagagtaaaggttgtggtaaaacttgaccttgctctattcatcaacagcatatcctgtgaaagtcacgacgcttccatgaaaaccttggtgctaggcctgtgatatctttgcagaggtctgacctaaggagactgcttgtgtcaatagtaacaacaatcacaattgtcctgaacacaaaggcagcattctttgtgtgctagctgtggttttaagcatattacgtctatttactaatttaatcctgaaacagcctttgctttaggtactcctattaacctcattttatggatgggaaaatagactgtgagaagtgaagtcacccgcccaaggtcatacacctgtaagtggtggaggcagggtttgaaccgagcacactggcctcacttcgtgggctcctaccactacgctgcctcatgttactaccctgtatccacctccagaatgagttggcagctgcaagttctccccaaggccccactgcagcccttgcatctcagcatcagctccttgcacggccaggtggtgttgtttctgactcggggtctgcatctctctctgcgccgctgggttcaggaggccctgaggagcgagcccggtccagtgctagcttcgcagctcacagcccttgggcaaatgttacaactggagggctgcacaaatgcatcatgtggtttcaaaccatgcgtctctctgagcaggaattgctggaatgggcctcagaaagttcctgaccctttgtctggggtcacagggtctgtgtccagtgaggcctagaggccacgtgaggtccagagagagaagcacaaggcagctgctgaggcctcataggaaccatgcggtgaaggaaccagggtttcttctttctccatggcaactaggagtgcaggtcagcctcggaaaaggatcctccatctttggttaaaagaacggtgagcccaggtttggtaatgatgtagctgtgtgagttgatggatgcaaagtgcccggcgtggtgccttatccatcgtaggtattgccgaaggagagcttttgtcaccccttcctggagaggggtgttgtggtttgtgggttgagaccttttggattcctggcattgacaatggcactatttggggtggggaccttcttgttggaggagtctccttccctccctgctggtgatataggcaggaaaagaagccaagaactaggccaattgcaataaagaaagaaagaagcaccttctgagcctctcttgccctgtaaggagccaagggggacagggccagatacggacccactgcagggatgggcagtctccgcccttcactgaggaggatgcaggacttatggccccactgggcggcagggacacaggaacctagactgtccatgctcagacacggtctggatttagaaccgtaggccttggggccgttttcaaaaaatagaccctttccttaggaaaatcccacaaaactgccccaaagacgagtgaggtaggaagagcatgaggctcggattctatttacgcatgcatgtccattagattctggattcaaaagccccatgttcttgggtttaagattgtactttctgacgtgaacagtgaattgcaaattcagacttaagagatggttacttttccaccaagagaacagccccgaaacttggccagagcattggtgttttggtgctgctgtaacacagtgccacatgctgggaggcttgagacaacagacatttgtctgttgccttgcagttctgaaggccaagagtccaaaaccaagacgctagcagggctgtgctcctctgagactgggtagatgccttcctggcctcctccagcttctggtggtggccagcaatccttggcattccttggcttccagcatgaccactccaatctctgcctttttcatgacatggtggtcttcctgcatgtctctcctcacacgtcgttctcttcttataaggacacctgtcagattagatgagggccaattctaagaagcttttttttttcttttttgagacagagtttcattctttcttgcccaggctggagtgcaatggcgtgatcttggctcaccgcaacctccgcctgccgggttcaagtgattctcctgccttggcctcccgagtgctgggattacaggcatgcaccgccatgcctggctaattttgtatttttagtggaggcggggtttctccatgttggtcaggctggtctcaaactcctgatctcaggtgatccgcctgcctcggcctcccaaagtgctgggattacaggcatgagccactgtactgggctgataagggccaattctaatgggctcatcttaacttgatgacatccacaaagtctctgtttccaaataaggtcacattcacaggcaccagaaggtagggcttcaatatgcattttgggggacagacttcacccactgacagccatatgtgttctttacagttgccactatttctatgacttggagtgagactgtgattttgtttttcttttttttttgatggcgtcttagtctgtcacctagtctggagtgcagtggcgtgatttttggctcactgcactctttgcctcccaggttcaagcgattctcttgcctcagcctcccaagtagctgggattacaggcatgcaccaccatgtctggctaatttttgtatttttagtagagacagggtttcaccatgttggccaggcaggtcttgaactcctgatctcaagtgatccacccgcctcagcatcccaaagtgttgatattacaggcgtgagccactgtgcctggccaaggctctgattttcgttaggatcagacggatcacttctgtcaccagcgatacctgagtacaggttaatcaatacagcaagatgttgcactagtgatcgcagcagtcaagttcatttccaaatacagagcgaaagcaaggtgccttcccaatcctctgctctgtcctgttttctgtctcgggacaccctgtcatcctcagacaagtgacaatgaagagacagtaaaggcaaaccaagtcactgtccaaaaattgcaccacctaccttggagagcctctcatttcccatcagatatgaatgaaagatcagatataaacctgatgggaaatgagaggttccatttccttttttttttttttatgttgccaagctttatttaggctgtaatggttacagataacacacatctaaccctatattctctgcgtcccatgcagtcccctgagcaggctcagctaccctttccctccagtctcacttcttgtcttcctccttcttgtccttcttgccatccttggtggcctggcaggccagggagcccacagcgtttcaaatggcttcattgttgggatccacacctgggaggttctccaggacactctgaaggaactcaggatcctgcatcacgtcgtaatcatcctcctccttggctggctggcaagtgtccatggctgagctggcatcaatgtctactgattccgcctggccaaactctgctcctgcagggacatcttcatgacataagcaatcccctcttccttaggtcaggaagtccggtatggccaaactcttgttggctaatggtcatcttcagcaggacctcgtctgagccttcagtcccagttgtagcaatcctggcctcagcagcagaggctgcagctgctcgtctgggctcctcatcctgccgctgctgctgctcctccatagaaacccgagggccaaggccagctgaggatcagcactgggatctactccaaattcaaagtcactggcaccgagacccagcatggcacccccttccccagccaaaatcggagaactgatgagagcatcagccaagctgggcccaggaggcactgccaccagatgagaaccgcttccatctttgccattcaacgtgtttacaaaggctgtcagcttttctctgttcacctcctcttcccccaaatttatcatgtcaacatttactttctccttcttgaggaatttagccagtttcaccagatccttctcattgcctttgggcttcccacgaaggcaatgatatgcgtcttgtgattcttgccccgtcagcgcttcagagccagatgggccatgtggatgccagtgtagaaggtgatcttgcccttgggttggacggtgtgtagcttggacaggatgcggccggtgtctagagtgagtgtggtcagcacttcacagtcattagccagtgtgatgagggccatgttgttctcagggttgctgtggattttgtttaattttttttttttttttgagactgagtcttgctctgtcacctaggctggtgtgcaatggcgcaatctcagctcactgcaacctctgcctctcgggttcaagggattctcctgtctcagcctcccaagtagctggaactacaggcgcctgccaccacacccggctaatttttgtatttttagtagggacggggttttaccatgttggtcaggctggtcttgaactcctgacctcatggtctgcctgcctcggcctctcaaagtgctgggattacaggcgtgaaccactgcgcccggcctgttgtgggttttgaatgacatactatgttgacagcgtcttgctgggcctgcagctgggtggggaagaagtcctcattctgcacatactcactgttgtccacacacaccatagcgctttccaacaccatcctgccaccctcctccctcccatttcttgaaataatccttcatgtataacttaggttaatagtgcctcatagtctacttagaaagaatcagatagaattttctttagtaaggaaatttccaaatagagaatagaaaagttaattgatggcaatgtatttaatagcgaggatcagtgaggaaatgaattaaagaggttccttttacacttttcttctctgaagctaggtacaccttagttcatgttgcagcttctttggtgctgtcagatcatagttggtatgaaatgggaagtttctgaaagtcagatgacacatttgtgaaatgcaacctcactgttatctacccggcacccatcatttagctgacaacaatctcagcaacaggcatttcaatgtggtcctgcgtttgctaattgctggtgtgtactcaggacaccggaagatttaaccttttggatgagacagataccagtaacttcccagctgagcttcccaggaatgaactgatgagaagtgacatccaaaaaactgtctcttaaaatataaagagatcaaaagcatgaagtagagactcaaacaggtgtgtgcacactcaccttcatagcagcattatttgcaatagtcaaaaggtggcagcaggccaggcgtgcactgagagacgaatggataaacaaaatatgctgtaaccacacaatgcaacatccagccagaaaaaggaagttctgacacatgctccaacacggctgaaccttgaggatgttatgttaagtgaaatatgcccattgcaaaaagacaaatactgtgattccccttccttccttccttccttccttccttccttccttccttccttccttccttccctctctctttctttttgagacagagtctcactctgttgccaggctggagtgcagtggcgggatctcagttcactgcaacctctgcctcctgggttcaagcgattctcctgcctcagcctcccgagtagctgggattacaggcacgtgccgccatgcccagctaatttttgtatttttagtagagacggggtttcaccatgttggccaggatgatctcaatcccttgatctcgtgatccaccctcctcggcctcccaaagtgctgggattacaggtgtgagccaccgcgcccggcctgtgattccacttttatgagatacctagtatagtcaaattaatagagacagaaggtagaattgcgggtgccaggggctgagggcgggggggtggggagttacagtttaatgggtacagactttcagtctgggaggaggagaaagctccggagagggatggtggtggatggctgcatgatatgcgtgtacttaatgtcacagaactatgtacttcaaatggctgaaatagcacattttacgttatgtgtgttttactacaataaaaaatacagaaagaggccgcgcacagtggctcacgcctctaatcccagcactttgggaggctgaggtgggcagatcacctgaggtcaggagttcaagactagcctggccaacacggtgaatacaaaaattagctgggtgtggtggcatgcatctgcgatcccagctactcaggaggctgaggcaggagaatcacttgaacctgagaggtggaagttgcaataagtcgagatcaagccactgcactccagcctgggcaacagagtgagtgagagtctgtctcaaagaaaaaaaaaaaaaaatatatatatatatatatatatatatggagagagagagagagagaaagagaatggggggcgggagagagagagagaaagagagagagagagagagagaacatccaaaactgatattagccattctgaattggactgtcccatcaaatgtggtcttgcagctgtccacttgtttaggagtaaggagttttattggaatgaatgttctcagatattaatcaacacagtacctccctcccttctcagttccagctgatgctgagacaccaatggcaaatcttgatccatgcccaccccaggaggatgagcgacagtcaggattttgggccacaacacatgcagcttcctgcagtgtcctcttctccagggtgtgctgtgggaaggcctcaccagcttgggcaggggctcagctctcacgggacgaggcagctgagtagctgatggcagggcctggtggggggccggggacgacggcagagtcatccactgccactctggacaaaggccaaacctgtcctggatgccacctagttgctgccctcttaacctgaccctctggcctgcctcagaccttataatttcctaagcacgtctgcatagactgttatttagtcttgccaatgaccgcgagggagctgttatcactgccaggcatcatgtccagtcctcacggctggccataagaagatccgggcctcacctgggcctcccatccaagccccaagttctttcctcccccagtagccagccagagccaccaaccctccctcaagccatgagaggaagcagctgtgatgagcactgagccctcaaccaggagccgttgaatgaacaggtgtgaatctcaaacacaattttctgcaaggtcttctccactcccaggcccagctgtatctcttacggctgagggatcaggatgactttgctgcggcctcgctggaagcatctctctagattgccacggaccaggcagtctagagatgaggaagtcagaggctccacagacactcagatatcatcagatcccctcccaaagggagaagaatgctctgttttattttattctatttaactttgttaatttaatttttagaggcaggatcttgccctgttgcccaagctggagtgcaatggctcgaccgtgggtcaccgcagccttgagctcctgggcttaagagatcctcctgcctcagcctcccaaagagctgggactacaggtgcgaaccaccatgtctgctagttcaatttttttttaatttttttttttttttttttttgtgacagagtctcactctgtcacccaggctggactgcagtggcgtgatcttggctcactgcaacctccacctcctgggttcaagtgattctcctgcctcagcctcccaagtagctgagatgacaggtgtgcaccaccattccaggctaatttttgtatttctagtagagatggggtttaaccatgttggccaggctgctttcaaactcctgacctcaagggatccacctgcctcggcctcccaaagtgctgggattacaggtgtaagccaccatgcctggccaaaaaatttctttacttataattttttgtagagatggggtctctctatgctgcggaggctggtctcgaactcttggccttaagagatcctcccacctgggcctttctctgactgttcagtttgatacacgtggaaccaggtttgcttgcaccctcctcaccgcttctgctttctgctcctcccaaacacatgaacatattcagatatgcatcaacgtgcacatatgccaacacgtgtgggcacacacatgcaagtgcacagacacacacacacacacacacacacacacacacacacacacccctggacacacacacattgttttctcaaaatgacttttggcagcagcaaagccaaacctttccaaaggccgaagaaaggccttcatttgcatcacgttaacttggggggctgcatctcctcccctgtttttagtacaaaacatgagtcaacggttcaaccctcaccccagcaaactaattagggtcaatgtgattaaagggctcagctctggtgcaggaactaggatccccagatatcctgaagaacttcactcacagtctctttcctaaggtttgtgccctaaaacaaggcactgactcactgtgttcagctcttaataacctcaagaacctcccttcccagctgggcgcctcttccataaaggggttaccagaaaacaagaagcaacacacaaagctttcaaaagcgaaacggcgaggaatgtagtgcgtgtcagcgagtcaacgaaaataagaaagggacctgatgtcaagcttgacacgatcattttaatttccgcgtactttttgggtcttttcatgttggcttcatggaaatttatgtttgctgagaagactgtatttgctacaggatctcgctgtgttcatttagcctggtaataaaaaccatctgcctgaaatcctttttggaacaaggaggggtataagcaaataagcaaatggtcataaaagatctggagaagggtggggctgtgtcaggaaagtggggagcctggagtacatgcctcgggagtggcgactgtaggaggccggggactactgaaggtcatgtgtgaggctgtacagctttcccagtaaatatggtgcatgttgggaggacaggtgcatgtggacaggccgcctctcttcccaagcacccgctctgggctggggtctcaccactggagtaagaacagtatcatgatgcattaagtgaggagtccttgacgtgggttgaatagtgtccctgcaaaactcacgtccacccagaacctcagactatgaccttctttggaaatagagtctttatgggtgtgattaagttagtatgtggctgactgcggtggctcacgcctgtaatcccagcactttgggagcttgaggtgggaggattgcttgaggttggtagttcgagaccagcctgggcaacatggcgaaactctgtctctaaaaaaaatgcaagggccgggcgcggtggctcacgcctgtaatcccagcactttggaaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtcccaaaaaaaaaaaaaaaaaaaaaaaaaaaatgcaaaaattagctgcagggcatggtggcgagcacctgtaatcccagctacttgggaggctgaggtgggaggatctcttgagcccgggaggtggaggttgcagtgagcagtgattgtgccactgcactgcagcctaggtgacagagcaagaccctgtctcaaacaaaacaaaacgaaaaaaaggtaaagatgaagttatactggcttccaatggctgctgtccttacaaaaaaaggataggcatggaagaaggaagacagccacgtgacgacagaggcagaggtggggatgatgcgactacaagccagggaaggccaaggagacctggagccaccaggacctgggaccagcaaggaaggggcctcccctagagccttcagagggtcgtggccctgcaggcaccttgattttggatttccagcctctggagctgtgagagaatgatgttctctgtaggaggaagctctctgagtccccctctctgcctgggagctctgagccactgtgtctttgtggggagagacgagtcagacaagatcgcaaagaagcatctcaaactcttggcctttaaagcaggcattgaagaccatgagcaggacagaaccaaccctgagaggatactgttgagcacgtgttttgtttaccggtttgtttttctgcccgcccccggggaggaggtcgagcctcctggactcaaggaaataaaagggcagcctcctggagagcagctgtgaggggctgtgagaggggccttcgtcctgtcctggtctctgggtccaccccacagttgggggtgtcaccacaggagtcctgagctggggtctgtgagtagagagggctgctcttctgccttccctgggaggcagggcacggaggagaaatggcaagacacattaagctttcttaatgtgggttctagtaacataggtttttatgttctcagcaagacagggttcttgtaagccaggcattggtaagagataatcttcaaggttcctttagctctgattaccatataaagacctgggcctgcaggtctgatctttgaggttcttataatccagaaaactcaggacactgcatgccagtgtcagcttcaaggagcaagggaagctcagttcttccagtcctggggcacgaggaggaggagggaaggcgaggaagggaagcctagcggccgcacacttgtcatagtctctctcacagctaacattgtggagcgggagcctctgcaaaatgggctttttttctgccccctgcttggaatcattggaggaggccccatttcagaatgggagtgtgggtgggtactgaaggaacacatgtggctggaggaaggtgggatggatgagcacacgctgggattcctcacagccttcatctcctccatggtgtggaggggacccaggatcctcatgtgttcccaaagcaggtatagagtggctgggcaccaagtcctggctgggagccagtggatgccaagagcccacttttgccaggatgggttgggaatcccactagatcttggggggatcaccatggtggacttgctcacacatgagagcccccaagagcaggacctcaggatcttctgcggggacatcaactggattcgcaaagagcccacccgtgctgggtggacacctgctgggcagcagaggctgatgtcggactagcctctggcacagaccgggagaccatcttctctcccagcgggggactgtgagatttcctgcacactggtcgccatgtaggatatgatgccagggaagagagaaacaggactgacgagagtggtatctacaaacaaatatttatctaataaggcccatttcaatcaaagaagcttgtttcaaacagacagggctgagaggatattcctaacaaattaaagtcccctgggctggccgtgggagagggtctcacgaggaggagaactaaagaagctctgtggtccctgcacactggcatgttcgagagaatctgaactgttactgccttggcatgaaaagatgattgttaggggctgaactgtgtcccctcccaaatttatatgttgaagtcctggcccccagtgccttagaatgtggctgtacttggagatggagtgtacaaagaggcgattcagttaaaatgagttcgtacgggtgggccctgacccaatctgactggtgtcctcccaggaaggggagacgagttcacaggcacatgcagggggatgaccctgggatggcacagggacaagacagcatctataagccagggagggggcctcaggagaaacccaccctgtgggtgccttgatctcggacttccagcctccagaactgtgagacaataaatgcctgttgtttaagccgccctgtctgtggagctttgttacaacattcttggcagatgaatacaatgattctgctcaaggaccacaggtcttcctgtgcatccccgtagacatctgtatccagacgaggaccacacaggaggcctggatgttcccaaacttccctcagatgcctgctgttacctgagttccctgggtggaggaacaaatccccccacacagaaaggggaaccagaggcccagcacggtgcctcacgcctgtaatcccagcactttgggaggctgaggctggtggatcacctgaagtcaggagttcgagactagcctgaccaacattgtgaaaccccttctctactaaaaaatacaaaaattagctggacatggtggtggacacctgtaaccccagctactcaagaggctgaggcaggagaattgtttgaacccgggaggcggaggttgctgtgagccgagatcgtgccattgcactccagcctgggcaacaagcgtgaaactccatctcagaaaaataaataataaataaaggggaaccagaaagtctgattggatcaagtttatcctgaattgactgaattttgtttaattgtcaagtttaagaactccattatggggtgggatgaaggcttgggacagaaatcatattcagttatggaaaagggaatctgaaattttttgctacccatttgagttttgaagtctcaggaaatcacactgacttcatcaaaaaagcaggtgctgccatgcacattcgatcaatgcagatgctgatgtttacaatgagcagttgcagcttccctcctgacagcctggagcttggggctagagcccctggcccacaggctaagaagcaagggtgattttacaacccatgcactgagttagagagtgttcttaccccacgaagttcttgtccactcagaacctcagaacgtgaccttatttggaagtagggctgtaggtgtaatgagttaagatgaggtcacagtggattagggtggtccctacaccaatgccactggtgtccttataagagcagaggagacacagggggaagagggctatgtgaagactgaggcggagattgcagctgtagggcagggaatgctggggatggccaggccccactggaagttggaaggggcaaggaagccttcttttctagagcttcagagacagcatggtcctcttggcactttgatttcagaattctggcttccagaactgggagtaaatttcggttgttttaagccatcgaatttgaagtactttgttacagctgccctaggatgctaatatactgtgttataaaaatcagggtttctgccgggtgcagtggctcccaaaatgcctgtaattccagcactttgggaggctgaggaaggaggatcattggagtccaggagtttgagatcagcctgggcaacatagtgaaaccccatctctacaaaaaaatacaaaaattagctgggcatggtgatgcacacctgtggtccgaggtacttgggaggctgaggtggaaggatctcttgagcccaggaggctgaggccgcagtgagccatgatcacaccactacactccaactagggagacagagtgagaccttgtttcaaaaaaaaaaaaaaaaaaaaagtcagggtttctagagcctgtgctctatctgaaatgatttagaagcctttcttctagggacgaatccctccaaatttagaaccaggcaggagatttaggcacaagagcatcccctgctcccccttcctagtctaaatcagatgacatggacccctgagagcgaatgcttgcaaatcactcaggatacccgcccagccaatggagaagaaagcagaggaaggaaggaaagaagggtggaaggaaggaagggaggaggggaggaagggagggaggaagggagggaggaaggaagggagggagggagggagggaggaagggagggaggaaggcagggaggaaggaagggagggaggaaggaagggagggagggagggagggaggaagggagggaggaagggagggaggaagggaggaagggagggaggaaggaagggagggagggaggaagggagggagggaggaagggagggagggagggagggagggaggaagggagggagggaggaagggagggaggaagggagggagggagggagggagggaggaagggagggagggagggaggaagggagggaggaaggaagggagggagggaggaagggagggagggaggaagggagggagggagggaggaagggagggagggagggaggaagggagggaggaagggaggaagggagggaggaagggaggaagggagggagggagggaggaagggagggaggaagggagggaaggagggagggaggaagggagggaggaagggagggagggaggaaggaagggagggagggagggaggaagggagggaggaaggaagggagggagggagggagggagggagggagggaggaaggaagggagggagggagggagggaggaagggagggagggagggagggagcgagggagggagggagggagggagggaggaaggaagggagggagggagggaggaagggagggaggcaggcggcaggcacacgcacacaggctctctttgctttccaacaggaaggggctcagggtctgttttcttttcccttcctttcagatggatctttcatatctccaataactcttatctttcagcaaactccaacaggccccaaacgagctgagaaaatatccaacttcaaaggttttgcacaaatcatcttaaaggcctgacctaagcccggaaagccggaacgaagcccagaaatcagtcctcatttcatcgccgtttagccaagacacctttcccgtccacagatcacatctgcccccttctgcccccgcccaggtcccaaccaccttgagacacctgcgtgatccatcctcaaagcaatgagttaggagccgcactcctggtccttggccggtggcttcagtgttattccggggggctgggtgggggcacctgtggggactgccccgtgaggctgtggtttaatttcctttgctactttccttagctcttcagtctcagtctcagccactgaaatgtgtcttggccactggtggtacagcacagggtgacactgttgtcagcgagaggaagatgctttttttttttttgagatggagttttgctctgttgcccaggctggagtgcagtggtgcaatcttggctcactgcaacctccaccgcccggggttcaagcgattctcctgtctcagcctcatgagtagctgggattacaggcacccaccaccatgcccagctaatttttgtattcttagtagagatggggttttgccatattggccaggctggtgtcgaactcctgacctcaggcggtccacctgccttggcctcccaaagtgctgggattatagacatgagccactgcgcccagacaggaagatgcgtttgtgagccgggacaattgtgagtggaaagagaagaaaaaaagtaaaataataatactaataatgccttttctctggtcctggaagatctatatgaacttgtattttacatctcttgtctggatttagctgtgaaagaccagtagaccaactggtgggaaaaatacttgcacggcagcaggttgtttgaataaaataggagatttccagtctcagattggatacatgcacttaatatcagcagacttgttgtgagtataagcctctataaactgagcactgttgcaggcgatggggacgtggaactggtaggaccgatggctaagctctcttcccctccaccctggaaaaaatgaacataggatctggctgtggcagacagcagcctacagaaaggtgggggcacctctcagctggccttcagctccaatacagacacgggaaaaccagtctcagttcaggtctgggccccactggctgcgtctgcctggacaccatcagccctgcacgaaggtggccgctgaggggccctcatgggggctgaaattcaaccaaggcttgattcctgcctgaggtgccaggaacctgtccctttcttctaggtggttcgctcagcaagggtactttttgtaattcagccacccagatgggagtgtcctcttgcactccatccatctggatgaagcacctttattttctaatttggccagtttcagggcacatgacaatcaccgatatgacagaagggtaacctttctggggttgcatcttaggaaatttcattgaaggaggagtagagagatgatatcattgaccacaggactcaagaaataagcccagagcacacatcggttttgtgggggcaatgaaccccgcaactgcgggaaactgaccttcagcactttgatgtgaatggggccattgctttcagctttctccaaggtttttgtttgtttgtttgtcggtcttactctgtcgcccaggctggagtgcagtggtgtgatctcagctcgctgcaacctctgcctcctgggttcaagcgattctcctgcctcagcctcccaagtttttacttgaaacctgcatacacacagcctttttgttttatgggctgggttcctacagagagttatgaatggaggattgagtgcatttaggctattagtagaaagtgatcaagattagaatagagtggcttatctgtgtttagagtctctaaagttgttgcagggggcttgttgcaatgtccgtaccagggccccaacccagacctaccgaatcagaatttcaggaggggaggttaggaatctgtggttttatgtcagcccctgttccagtccacgtgactcttatgcatcatgatgttgagattcactgatttagacacgcagacaataaatactgattcttggactacagagccaaagacaaatcgagtgacgtattctagctcatggagccagctgggcaaagccagcagggatttattgctccttagatgatcaatgctgcccccagggctgctgtcatctcctgatgacgagcaacattttcacaacatcagggggctggtggagaaaatcggggggtctccggagcaaccccgggagcagtactgggcccagaagcctgccccagccgcgcacacagagtctacctgtcttccaatgcgagtcccgcgaggtgaagaattagagcatgttgttcatttataatgtttgctttgcttttggaaacaccctggggcaactcaggcaaggttttcaatgtggtgtttgacttggcttagctgcaaagttccccctttttggtctgtttatggcaagttagcacacggccccatatccaggagcctaacaccagccccagcagaaatcagggagcgggcaaggaagtgaaacattgggagggctgggttgggcttccctgtacccgccctctcagccgggagctcgcctgaggtcaggctgggcaccaggccacctcagactttgcagcctcggacctgttactgcagcccgaataacagtgacgcctcggacagtgacacgtcccgctgaccaaccacagggtctggaggataatttcccaggaaagagatacattccattcatttttttaaaattttattttaaatttagacagagtcttgttctgttgcccaggctggagtgcagtggtgcaatctcggttcaccgcaacctccacctcctgggttcaagcaattctcctgcttcaacctccctagtagctgggatcacaggtttgtgccaccatgcctggctaattttagtatttttagtagagatgaggtttcaccatgctggtcaggctgatcttgaactccttgcctcaagtgatccacccgcctcggcctcccaaagtgctgggattataggcgcacgtcaccgtgcccggctgatacattccattctttagctccctctttcttacatattttcttttctttttacaaagtcaacccactttcagtaggaagttgccgattctttctcatgtttacttttgagtttcaaatagacaccgccttatcttttaataagacttgctatcactgtgccagccactccatttacatcatttcatttcatctgcacagaactctacgcagggggtatgattagatcgcatttaatgatgagaaagcaaactcggagagcttaaatcagcggcccaaggtagcccagctaacacccggggggtgcggctcagccgcaggtcttctcagcgatgtggttgctgtctgcctggctaatggcctgccacatcctgaacccttcaatgtcaccctcatctttccttctctgccttagaagagaaaaggatgatggcttatctgagggctgaaagatttcatccacatcaagccccatttgcatgaaatgtatctgcccagtttatatcagcaacatgaagagcaaagaaaactgcctgtttatattgccacatctgcagggcattgaaatacattattaatgggagtttcagtcaatatctcacttttttttttttttttttttttttttttttttttttagaaaagtgaaaccatgattgggttacattagtgtgagttgtagaaaccaggttaaatctgacctttgggacatggagacggtcatctgacccagggcgggtcacattcaaagagcacagacaaggtccccctgaagtcagtgggacatttgggcctgagactatgaaactgaactagaacttatgggctttagggaacaagcccaaaagctcctaaatttcctccttgaagatctcctcgctactgtttttcttctagatattctgctgctttgacaggtacgccaccccctgtctccaaactcacacgttcaacccagtgatgggtggagactgggaggctctgttagtctctcttttcagtagcctggccctaaattaaagggcccatggttttctctagttgaacacaccccaggctcccagccagcccctggccctcgagaggggttgtttttgatggcaggagggagataaaagtgaatgtattttaggatcttgttactaggccacaaggaaacactggatggaaagtcttatgaatttgaaaagaccttttttttttttttaaatcaaatccaaggaacccaaaaggcgttaagctattgtttaaacatagacccagtgcccaaaccctgcacactagtttgtagaggttggaagaggcaggatggaaggggttaatggtgctattctttcttgaatattctgtaacacaccacaatgagccaaaagcagtcacagggaaccatcatgaggagtagcatgtttttacctatgttaactccaacatccgcaatagctgaaccttagaattattatccgaattgtgcataccaggaaacaacagatttgatgagtttaataacttgtccaacattacaaagttagcaagaggtagggtccagaaatgaacagcgtcctttcttctgcaggctggctcccatgaaatactattcttatgcctgttgaggtctgatgtggtatcacattatactactggaccagctagggggtcaagagcattatgccatctctgtagtatgcttaggggtcagtcctgaaatgagcagagttcactttcagccatgaaaaggatattccgaggaactgatatcttagattgctttcttttagtgcatagacatcacttgagaggcttcatgttactgagacatcttgtaaactttacagctactgttttacacttcatcagcattcctgatcttattatggtgttcacttcaaataatgttgggtgtgtaagaatcaaatgcaaattgtacagtatttgacacggatgtctttaggagccaatatttccttaaatatcatggtttcagtgttatccactaatgctttaatagatagggtttctttgcattcataaatggtaataaagatacgagttgtctactataaaaccaaacacttatatttcccaactactaaaacatctatgtaatcttgaatccatctgacctaaaggaaggaaaatgttctcaacccaggctacacattagaacacttgggaagctttgaaaaattcttaatgaatgggccccactcctagaccaattaattcagatctctgagaagtgtggtctgagaactgatggtttagaaaactgtacagacagttctaacatgcagccagcttgagaactactgggtttagacaagaatggatttttttgttttttgagatagagtctcactctttcgcccaggctggagtgcagtggcacaatcttggctcactgcaacctctgcctcctaggttcaagagattctcctgcctcagcctcccaagtagctgagatgacaggtgtgcaccaccattccgggctaatttttgtatttttagtagagacagggtttcaccatattggccaggctggtcttgagctcctgacctcaagtgatccacctgccttgccctcccaaagtgttaggattacaggcatgagccactatgcccagctaatatggtttggttctgtccccatccaaatctcatcttgaattcccatgcgttgtgggagggacctagtgggaggtaattgaatcatggggccagatctttctcacgttgttctcgtgacagagatctgatggttttaaaaatgggagtttccctcacaagctctctctttgcctgtcgccatccatgtaagacatgacttgctcctcttttctttccaccatgattgtgaagcttccccagccacatggaactatgagttttccatgaaatctctttcctttgtaaattgcccagtcttgggtatgtctttatcagcagcatgaaaatgaactaatacaccagccaagaatggatttttaaattaatggagttaggtctgattaatatcaatgcattaatgtataaatgtctacattatgcattacaataaacagttttgaatataacacaactaaaatatatgcaatgaatacaatacatacagtaagtcattagcttccaggtataagtagatgctcaataaatattactgagttactgaatgaatggcatcctacaaagttttatatgaaaaattatattttgatgaaattaagatgccatcaattgtaagatgtagtatcactgataaagaaaatagattcattaaattatgacatgctatctagtatgtcacaccctaacttcaaaaatgttaaaaaggccagatgtggtggctcatgcttgtaataccagcactttgggaggccaaagtgggaggatcacttgaagccaggagttcaagaccagcttgggcaacatagcaaaatcccatctatatgtaaaaataaaaaaattacctgggcatggtggtgcacgcctgtagtcccagctacttgtgaggctgaggtaaaaggatcacttaagcctagaagtttgaggctgaagagagttatgatcgtgccattgcactcaagcctgtctcagaaaaaagttaaaaacaagaaaaaaatacaatattttgaaattactgtattctctttttctgcttagtctaggccaactgttataccattaacttccactagatgccgctgtgacctgctacttcaggttccgaaaggcaatctgaaagccaattttctccaaggatttaaaattgaaataattcaccccctttaaagacaaaagatattttaaccacctcatattttagggggttgtggctcattctttctttgtgttaagacctatctgaagtatctcatgaagtgtacaattatttaaaaaggaaactgaaaagttttaatggcttgatagaaaacaattgcttcccttttatccacatccccaaatttcacattttgcgtgtaactcatgactagtctgcagtgggttatagagaagagatggtaacactgataggaaggctgatgttgacttcaatgaaataagaagtaaaacttgaaggaaagagtatgacatcttctgatttgaagacagcagatcatggtaccctgtacccatgagtcactgctcccagagataggaaaagctgggtggaaaagaaaatttgggctgataggactgggtcctgagcttgaagccaagcccagtgttaaccctgggcattgacccaggccctccctgactgaaaatctggaagattttccctgctgggtgagaatcactttttcagcaaaacaatacaagctttagggccaaaaggaagcccatgaagcttccagagacgtgcttagagcaatgctgctcaaattcttaccaatctccactatatgagaacagaaatggacagtaagtatctcaaaacttgtataacaaatttaaacaggtttacgtctgctaaatctaataaaaagaaatcaggattgtatttcatatgtctttgtttcatatttcatttttccagtaattcaattcttttagtattttacaaaagtattggtccataatagattggaattttttaaaaaatagcccttcagcccagatagcttttgaagcactgcagacagcccaccccaagctgctggaggaggcaattccaggacgatgaagccatcatactcctgaataatgttctagtagaccaaacagctaagaaagggctgaagaacaggagcacttagatgataaaggacaggatgactggagagctaaaaagaaatcctaagaacagaacacctcggggagtcccagcctctgaacccacagtcagcagctcaccagaacctaacatttctgcaaaggctcagagattccaccattgccactcccagcagttcgcctgcccaatgtagacaatcagcctagcactgactttgggacaagaggatctcaggtggttacagtgaaaagaaaatgcaaaaccactcaggattgcccaagtctgacatatttaggttcagaagagaaacacacagagaggtccattgttaaccccttcctggtttgatccacccaaagccagccggcttggatggaggggaggcgtaaggcactgtggacttccatttatgggtaactgtgagctggcttttgtcttctctgaaaaatgccctgttacactagcatactgtcagtgtcttttttggatagccatttggtaatatctatcaaaatgtaaacagtgaatactcttcaactcagctatttctctgctagaaattcatcccccagttatactcctaaagtaagcaaagacataaataatacaggattcaatactctctggctctttctgagagaataaaactggataaaatgtaaatgtcctttataagagattagttacataactacggtacatccacacagattagtatgcaccattaaaagattaaatgcttctgcagttactgatatgcaaagagttccaagacacaatgttaagtgaaggaagcaagttgaagtgcagtgtgtacagcatgatcctatttgtgtaaacaagaacaaatgcagtcaggtacggtggctcatgcctgtaatcccagcattttgggaggccaaggcaggtggatcacctgaggtcagaagttcaagaccagcctgaccagcatggcaaagccccatctgtactaaaaatacaaaaattagttgggtgtggtgatggatgtctgtaatcccagctatttgggaggctgaggcaggagaatcgtttgaaccgggggggcggaggttgcagtgagccgagatcgggccacttcactgcagcctgggtgaaagaccaagactctgtctcaaaaaaaaaaaaaaaagaaagaacaaatgcatttctgtcatgcagagagaccttctgagggctgcacaaaaagccgttcacagcgatcacctctggggggtggagccaagggtcaaggtcggggaggactttcatttttaacttcacactcttgtatgtggtctgacgttttaaaaagcaaaattgtatcaatttaatagggagcaaggtatctattgcagagcatcaagagttacaagaggccaggtgcagtgcttcccacctataatcccagtgttttgggaggccaaggcagaaggattccttgagtccaggagtttgagaccagcctgggcaacacagcaagaccctgtctctaaaaaaatgaaaataaaaaattacctgagcatggtggtgtgtacctgtagttctagctactcaggaggctgaggcagaagggctgcttgagcccaggagctcgaggctgcagtgagctatgatcacaccactgcactccagcctgggcaacagaatgagatgctccctcttaaaaaaaaaaaagcactacaggaaatggcagcaaatatcagtcagccaaagacacaacctgacacaagcggctgcacaaaatagtagttgcccttaagctcaagggacatcaacaaggaaaaaacacacaactcccagtgttctctcaacccatggctgtgtatatcttttagtgatgagccttggggaccccataaaacccagaggaacatgtggcagaggacccaaggcttccagggattgtggccatcaccaggtgagaaagcccagagacaaccgcttgagtgtttaattactatgtgaaaatggaatgagagggaaggaaattgggtttggttacttcaataaaaaaaggttgaccggacgtggtggctcacacctgtaatcccagcacttcgaaaggccaaggtgggtggatcacctaaggtcagaagtttgagaccagcctggccaatgtggtggagtcccgtctctactaaaaatacaaaaattagttgggtgtggtggcacgcacgtgtaatcccagctacttggcaggctgaggcgggagaatcacttgaaaccaggaggcagaggttgcaatgagctgagattgtgccactgcactccagcttgggtgacagagtgagactccatctcaaaaaaagaaaaaggttgcctggccctggttcataagtagagggagtgtcttgtgtcttgggaaccagtagcactgttaacatttacaaacgggacacacacatttcctgtttaattccaccctgcacagtgctgattcactatgataccattggtctcagaaatacttttcttaaaagttgtatataattaccacatatatacacataaataaaaatatacacacatatatgtgtatacatgcacacacacatacatatcacactctgtgctctcagccagggagagctggggaaggagattgtctttggagtccttagcacattacactatattacaaatgctcttggccgaagagtattctcagtgctgtcctgagttgtgttctgcaaaatgcactgtttattccactgtgatcttcctttctgccactcatttcatgttctagggaacagttttgactcacagttatgggtaaaaggtgtttgagtgattgttctagactcaccctaaagagaccaaggaagaatattatgccaagtgtcaaaaagctactttccaggcagctcaagttgccttcatggaaatgatgaaggaagcagagggtgaagtttaaggacaggtggaaatccttcacaatcctatcgggcatcattaacagcactgtaaggctgggagagatgaccaaggggatttgaaaacagcattagggtaggaagccggaattaagcttataaagacccatagagcacgcagtccttctatgtcatggcctatctgacagatgcgttggggggccccggagagccaggagtagtgggcagagggcaagcaagcacagagccatcctctacagtggtcagagggcaagcaagcacagagccaccctctacaaggacaccggagcactgaggccattgctcttgggaagaaaccaccgaggtttctgttagccagggtgggccagctgaatgtctgcaacatcactgaaaacagtcacaagttggagagacaatggtctttttagcactccccttgggggaagcagtgtgggagatggaaggttctggagtaaggggttatgcctcgaggggctggcttcaggacattgtcctgtgggttggtaggcgtccttaattgtggggcttttgttttgctgagaggaggctgcaagtttgaggcaaaaaatgaattctctggaggtaaagaagccgctgaggctgctccccgctggccctttcttcctgctgggcctttcctttatttatttagagtactcagcctttcctctaggtaaatattgaaagaatatataaaaaccaatagtttaaacagtgtcaaattattatcctgtctccacctggccctgggcatggctgcggtgtgtattgtgctaggttctgactctctttggttgagcaggaggcggccctagcgccacaggtggagatggctgcccacctgctgtgaaggcacttccggtgtccgccatcttgggagcagctcagaccggaaaccacaggctggagaacgcaactgggaatggaaagcaggagtggctctttgtgttgctttgggctgaattaggagaagggtagatgtttggaggtggtgttggctgcagggaagaaggagttagaatgggatgaaaatttttggcccagagaaggggagcagtggttgttggctgaggcatttattgaaggattcccatggagaagatacatatggttgggggcagagtccctgttgagagggagtgctgccagttccatacagaaattccttctccctgacaaccgcagatgtcttagcagcattgcttttattttttatttatttatttatttttgagactgggtctcactctgtcacaggctggagtgcagtggcgcaatctctgctcattgcaacctccgcctcccggcttcaagtgattctaatgcgtcagcctcccgagtagctgggactacaggcacacgccaccacacccagctaatttttgtatttttagtagagatggggtttcactgtgctgaccaggctagtctcgaactcctgacctcgtaatccgcccacctcagcctcccaaagtactgggattacagacgtgagccacccgcgcctggcccagcagcattgcttttagactgacagcttagaaaccaaaagtctgtttactggccacctacacaacctgtcaatccctaaacaacctgaaggtttagtgccctaccatagacaccctgtaacccattaagaggtccagcctttgctacagcaaatggtgtaaactcccacggcccagttatgtccagggctcagttgggtttttggcctctttatcctcaaatggggaaagcatagctctgggccagtcaagcgctgagctgatccaagacattcttccacccgccagactggaaataccggaaaagcggtggcagctgccctcagaggcagtgtcagtattttctttccttttggccagttccgttttgactagaaactggaatcataattataatgctacatgtttacagattttaagtaattgatcccttggagtcctcttttgggggaaaagcattctacccacctcatacatcaggaaaacaagaggccatatggtttggctgggctgggtggtctctggtgtcagtaggagagtggagactgcggcttcaacagttcttgacttcttggcttgtgtccagatctctgggccttgcagcccctagaaaggtgacacatgagaaaccgaagtggaccagaccataaactctcaggagcagttacctctagagaggagggcaggcctcgtggccctgcctgtgcctgtttctcttggagggacaggttggagaggaggaaaaccccttactacaggagtgtttcacctacctttaattaccagttaaaacaaaacattctgtaatgaaaattccccttgaaagaaactccaagttgctgtgaaggtttcatctttcccttttgaatcccaaggtctgcagccatgtaatccaatgttggtctggaaaaatatctggctacagaaaaacccacatggggtgttggggacgccagtaaagggcaggaggttggatcttgtacagtagcccttagcaaaatccttcaggtcaagccctggtctacttattaagaaccctcttaacccttttaataagaggtagatatgttttcttctgattctaccttctctattgccagcaatgtttgtcctcaataaattaatgtgagttggtggtggatgtagaaaaggggagaagggaaacctagttctccgatggtcatggctatttcaagataagggaagtggcagaaacacggagggaggcaggccggggagcctccaaccccaacaggtgaagacacacatagaggcatgcaagtcagcaaacaaattcaggctgggttcccagagggaaatgtttgtgtttttttctaagtgagcaggtgtagttaagcacacccttttcacggtgcgttgaagcagatttccagccctgtttggaagcacaacgttgccatctcaatgggttgtccttctgaacccataatagctgtttacttagaccagatcccgtattgccttgtgtcattgtccaattttcctatgtggattttaccaattcagttgtagatgtcttagtaacagggaccagaatttttccataatcaatagtagtttaaatgattgaacaaaaagtttcctcttgtgtgcaatcagctgaggaacgtaaactaatttcagtctcattcctagtgcctgatttttcttccatcattctaggtttcctgtctggcccacacttcgagagtcctccctgctgcagggagcacatctgtgagccatgtgtttcctttctttcctcctgtacaatggtaatttttttcttagctactacaggaagcccagcagattcagatgtacaagaagccacaccaagacctaagatgatattcactgatgttatcagcaggttgatgccaacatctgcctagagagtggttaccctgagaagtttaccccagttctaagtttggttggtctgttctgaggtgatagcctcgtactgaagtaatttctccccaccaaagggtctagaataggtttatttgtaatctattttatgtagctgtgactgcctcaagacacctcaaagggttattaagagtgtgtgtctaggcatgtgggtaactgttccagctcaacagcctgtgaataccattagtagcccttgaaatggatctccaggaagtgctgactgttaatgactctgccctgatgctcctatgtgagcagaacaaagagataatgtctaagtttgcaggtagctgagcgctctaaattgatgactagctcagggagagggaggtgctgtgccatcctaagcctagaagacatcgccaaaggaacagtgggagattaacaactctcccatgttaggaggttgacttgccaaactgatggaagagtgacaaactgatagactgtggtgctgtgtcccttctacgagctgagggagggcttcacctgaggcagtcagaagtgctaagagaagatttatgtggtaagggagagggaatctttccaacaatagctattaattgactttcattttgtagaagaatattgtattaagtgtttggagataggaaaagtatggcatgctctcaggatgtttataatttacttggggagataaggcacatgattgaaaagctagtaaaatacaagacaatagaatatccactctccggaataatattcagccattaacatggatgaattggatccgtatgtactcagacttgtgcaggaaaaggtcagtagcagaacaagacaccatctatgtaaaaattaaagcaaagcacacagatgtgtgtggacatatatgtgtatgcatgtgaacatatctgtgtatgcctgtgaacatatgtgtgtatgcacacggctgaagggggactggaggaaagcacgtggaaaaagagccagaggttcctcctggggagggaagtgagactggggaggacagagaagggcacctttcatatttttaccacacatacttttgtattgaatacattatttagaacaagaaagtctttctatatttcttatgtaaaaaaggaaaagaatgaaaaacatagcaacaaagcaagtacatgattgatgccaaggggtaaccctaaaggtaaaaatggtggcgtagtctgcccatcacctcacaaactctgctgccgctcctcttcctccttgtttacagaatcccatttttgctcaggaatctacctgcctgtgtctcacgagatatctggaaaaacataaaatcatggtggtcccatcccatcccatccctctgcagtgatttgtggcacttggtcatgtgatgccatcagggccaatgagattggaggaactgtccagggggctgctgagtaaagcttctttgctcttaaaaagaagaacaaagaagccaaaggaccactttttccttcaacaggatagcaccgtttctggatgtgatgactggcaatgcggcagccatttgagccttagggagctatcctggggaccaagccaaactctgaggatgttggtagaaagatggaaaagcctgaatccttgaagatattgttgagccactgaatcaacctaccctggagctgtcctagctcaggacttcagctccagtgacagaacacatttttctttttgttaaagccagctgaggtggggatatctattaccttccaactcacatgccagtcacaggaagccctgtttgtgaggcttcaagccccttgggtgcatttgaggggaagtttgagtcctcagggacatgccctctggggacaagaatgagaaggggtcataagccctctgtggctggggaggcagagaagtcatcctgagctagggtcactctttgccctggcacctcagtgggtgagaggaactgccagggtgaggtagggagatatatttaatacaagcagcccctcagtctggcccctgggataattgatacgagttctttctttctttcttttttaaaattgaaacagggtctaactttttcgctcaggctggggtgcagtggcacgacctccgctcgctgcagccttgacctcccgggctcaagcaatcgtcccatctcagcctccccaagtacctgggaccacaggttcacaccaccatgcctagcttatttttatttatttattatttattgatttatatttttttgtagagacagggtttctcacgttgcccaggctggtctcaaactcctgggctcaagtgatcctcctgcctcagcctcccaaagtgctgtgattacaggtatgagccactgcacccagtctacaagttcttaacagaatcagaaggtgtagctgggagacaaaagacccatcacagcttcgtgatatttggagggaagttttcttccttcagagcagaaaggatcactgctgtcatgggggaagaatattagcagcctcatgggagctggagtgaggctggagttgggacagtggccagccttacagagccatgggtaggttgcaagggctaggcaagcagagccccatggccgtgctgtggtggggaagaggcaggcagggggaaagcccactgcaggtatttccacagtgcgccagaagcaatgatggtttcaattggttggtagatgagtctccctgaattaaactccactcatcccaaactggtattgatttaaaatatcttaaactgggataatctcttgcagtatgttggagctgtgcacccgaagagagaaggggaaataaagtcttatcgtgagagaaagtgtgtgtgtgtgtgtgtgtgtgtgtgtgtgtgtgtgtgtagagagacaggagggagagaagaggaggacatgggaagagaggagaggagaagggggagaaggggagaatgagtcctcatttaacctggtcctgaggagggggtggctggtttctgcactgagatataggtgtttccttctcttgccttgcctccagcttgaaatcaaccacttccctcatttccttggaatgaagtcaaggaagacttgcttactcttacagtgcaaaacccagccccgggtcttcccactgttatctactgaaccctaaggtcactcagagcgacttgaaagtgtttcaggggccataaatgctcaactcaaatctcatttaaaaattttcccactttatacctgttaggatagcctgtatcaaaaaccaaaacccttgaaaacagcaagtgttggtgactgtgtggagaaattgaaacgcttttgcactattggggatgtaagatggtgcaccgactatggaaacagtagggaggttcttccaaaaatttagtacagaactattacatggcccagcaattccgctgctggatacatgcccaaaagagtgaacgcagagactcaaacagtctttgtaccccagtgctcatagcggcattattcacagtagccaaaaggttgaaacaactcaatgtccatcgatgggtgaatggataaatcaaatatgatgtatccatatcatgggacatgattcagccttaaaaaagtaatgaagtggccgggcctggtggctcacacctgtaatcccagcactttgggagcctgaggtgggtagatcacctgaggtcaggagttggagaccatcctggccaacctggtgaaaccctgtctctactaaaaatacaaaaatgatctgggcatggtggtgggcgcctgtaatcccagctacttaggaggctgaggcaggagaatcacttaaatctgggaggtggaggttgtagtgagccgagatcacaccattgcactccagcctgggtgacagagcaagtctccatctcaaaaaaaaaaaaaaaaatttctacttacaaaactgtagtaagaacaggacactcgggtactaaaaatacacacacggcccacctgtgtgctaagctgtgtttcccttttatcttctctttttttttttttttgagacagagtctcactctgtcacccaggctggagtgcattggcacgatcttggctcactgcaacctccgcctcccgggttcaagtgattctcctgtctcagccttctgagtagctgggattacaggtgtgcaccaccatgccaggctaatttttgtattttttagtagagacggggtttcaccatgttggccaggctggtctcgaactcctgacctcaggtgatccccctgcctcggcctcccaaagtgctgggattacaggtgtgagccactgggcccggccgttttcccttctctttgtgctcacctgggaatcaaagttctcccagcattttcaccagggagtttgcaattattgcaactataccagtggctaggaagtttgtatctcttgtatggatctattaaaaattcagacttgattttctccacttacataaagttgcgggaatacagctataacatgcccttatcacagccaaaagagccagttgtggataaacagcttgagacatgctgatattatctttgtcatttattgtaaagttttgatgcttcttgcctgacttttgttatgaataagaatacaagcgaccgttagatattgtccatggttctgcttcaaaacagaaacttccctctcgttctcctctctcaagcatctggatcagtttaagtaaagagcatcttgacacagccatctggaacttcctctcaatttctgtattcatcaaaaggtacaagtattataaatctgaacttgtgaaataaaattttaccaacaaagtactacatttgtttcagacattgaggtttccatcagatttgaattgcaaaaagattctgctgaaaacaaaaagtttgaaaagcactgtatttgcgcaattcccagtttggttcagttaaatgaatgctccttgaagattttgttcaattcttagctggacacacagtacattggtgagcgataagacataggaaagttaaattctgattgtccttgagctaagaatggttttacattttattttactttattttattttgcctttttgagatggagtctcactctgtcacccaggctggcttgcagtggtggaatctcagctcaccgcaacctccgcttcccgggttcaagcgattctcctgcctcgcctctgaagtagctggaattacaggcgtgccccaccacgcctggctaattttagtatttttagtagagacggggtttcgccaagttggccaggctggtctcgaactcctgacctcaagtgatccacccacctcagcctcccaaagttctgggattacaggcatgagccaccacgcctggcctggtctttacattttaaatggttaaaaaaaattaaaagaagaatatctgatgatgtgaaaattatatgaaattcaaatttcagtgtccattatataaagttttgttggaacacagccacattcgtttgtgtactctctctagctgttttcatcctaccactatagtgctgagtagttctaacaaaggccatagagtcccaaagcctaaaacatttattgtctggccctttacagtaaaagtttgccaacccttgcattagacaatgaccatatccatgtgaagtctgaacatcaaaacctgagaagttcaccttcttgatgctgccaatcttttggcaacattactgcagagttagacagactacatcagtggttctccagtctgggcaaacccagctcccaagagggtgtagagaaacgtgtgggcacagcttttgttgcaatgacaagactcgccatgcatatttagtaggcagggactaaaaatgttaaatttcaggcaatgttggatacagtcctgcacaatagagctcaaggtgtaccctgagaaacagggatccagagaattgctgtgattaattttacagggcaacttggctaggccatggtgctcagatatgtggtaagctgttattttggatgttttcatgagggtttttgggaggagatcaacatttaaatcagccaagttgaagtaaagcagatggcgctccctaatgtgggtggggctcacccaatcagttgaaggcaggaatagaacaacttctgacctctttgagcaagaaagacttctgcctgcagatggcctttgggcgtcaattgcaactcttccctgagcctctagactgttgcctaccccatcagatttgggactcactatggctccacaattacatgtcaattccgtaaaataaatctctctccacttacatacgtacacacacacacacacacacacacacacacacacgacctgttggttttgttactggggagaactctgactaatataattatcccaaagtttcagtttctggtctgaaagtgatcttcagtccacttattcctgtgctttgcaaattctacctctttttcaaatttcaaaattcagaacatttcaaaaataagttgacattgcaaatttcatctcatcaaatgctaaaaaaagttcatacttctggccgggcgtggtggctcatgcctgtaatcccagcattttgggaggctgaggcgggtggatcacctgaggtcaggagtttaagaccagcctgtccaacatggtgaaaccccatctctacaaaaatacaaaaattagccaggcatgatggcaggtgcctgtaatcccagctactcagaaggctgaggtggggagtcccttgaatctgggaggcggcggttgtagtgagccaagatcatgccactgaactccagcctgggtgacagagcaagactctgtctcaaacaaacaaacaaacaaacaacaacaacaaaatttacacttctgcatataggactctaattcaataaatgtggtgtttaattgaacaaatgtgtattgaactccagtgacccatttggaagatgctattggggagtgatataaagacaagatatagtctctgtcccaatttacccagaacagagaaagggcgactatcaggcacacaattaatgggaataccagggcatttctgagaggccgtattacagaggtacaaatcaggacctgtgggagtccttctcacaggagatcataactccaactaatgcaacctccccgctagtaaaacctatttttctttttccttctgaactatttctctcccagttattatcagtgaaaagccagaagcttctctggtttctcacccatgtccagagacagacaagccgtgggttcagaggctggtttttcacatcctccacttcacaccacgaggacctcacccactgcagctgcagaacaggaaggggtcatctacattggttacacgccccatttttagctggatgtagctaattattttctgtttaagactcttgtctttttaatcatacgaaggaactgcattattacgctctcattgtaaggatatgaaccatatggtagtgcagaaaataaaatgtgaaaatctgttctatctgttctcatttcctcatctcattcattactgcaacaaaaaccaattgtcctcactttgggaggccgaagtgggtggatcgcttgaggttaggagaccagactggccaacatggtgaaaccctgtctctactaaaaatacaaaaaattagccagacgtggtggctcttgcctgtaatcccagcacttgggaggctgaggcgggtggatcacctgaggtcaggagtttgagaacagcctggccaacagacgaaacctcatctctactaaaaatacaaaaattagcccggtgtggtggcacatgcctgtagtcccagctacttgggaggctgaggcaggagaatcttttgaacccggcaggtggaggttgcagtgagctgagatcgcgccactgcactccggcctgggcaacagagtgagaccctgtctaaaaaacaacaacaacaacaacaacaaaaccccaaaaacaaaaaaacccacaacctattgtccagtcaagtctttcttgctaccagagcaggggacatgccactgatgagagcgtcttctctgttccttccaaacactcagcccagcattcagatcattgctcacccagtgcagagtcacggtgccagggtatggagtacagatgccagagccacagccatcagagacagtgtttttgttttctagggccctgcaacaaatgaccacgagctatgtggtttgtagcaatagtaatgtattctctcacagctctggagtctggaagtcccaaatcaagatgttggcagggctgtgctccctctgaggcctcctccagggaggatccttccttgcccctccctggcttctaaacttttctggtcctcctcagcctgtcgctgcatctttctaatctctgcctctgccttcacatggccgtcttccctctgtgggtctgtgtgtccaaatttccctcttctcataaggacactgaccagtggattggggtctacactcctccagtgtgacctcatcttaacttgattacatctgcaaagacctttttctcagggaagctgatatggtttggctgtgtccccacccaaatctcatcttgaattgtagctcccataattcccatgtgttgtgggagggactcagtgggagataattgaatcatgggggtggtttccctcatactgttctcgtggtagtaaataagtctcaaaagatctgatggttttataagggggaacccctttcacttggttctcattctgtctcttgcctgccaccatggaagatgtgcctttcaccttctgccatgattgtgaggcctcccagccatgtggaactgtgagtccattaaacctctttttctttataaattacccagtcttgggtatgtgtttatcagcagcgtgaaaatggactaatacagaagctcacattcacacacaagggagttatgacttgaatagatcctctgaggggacacaattcaagtcacaacagatggagactccatacttctaagcaatccaccaggagccacaatggccccaagcaaaagatcatctctctcgaaggccagtcctgcttgactatggcacctgggcagataatgaaaacactaacccccttcaacgctccccatggactgggctcactgatctgcagaatgacccccgtggggacctagtccaaggtaacgtgctgcagcccaagcaactgcttgcttcaatttgcaagctgtgcagagcagacagcccaaaatggcagtggcttggggaaaagccagacgttcttgaaaagctgtcgtttcagaaagaaagaaaaaaaaatcacttattttttggataggcattgagtatcaaagatttaaaaatttggctctgaccacaatatatctgaaagtagaggtcattccgtaaagatcagcctcttcctaaatcaccaggctttccaaccagctcctggcagggtccgagggtcccgtcaaagtggccagtggactgccccaagggaagcatgaggaaagcacgtgaccccttctggtaacttggagaggagtggcaatggacagagagtaaagctagggcatgaatggggacattttataaaggcagcttccctcctctcctgggctcactggtacacaggagaggagagttggtggcttgctgaatagccattgagttaagaaatatagcttcagacataccatcttgtaactggagccatccaaacctctacttctgaatgttcccatggcaaaaacacagattttcacaacattccaggaaaatcctgaaattgagtcctgtagagggcttgggattgttttgccaaggaaataatattccacacattggaggtccatctgtgtgggcagatgtctgtcttgggaatgacagagtgaggccccaagctggtggtcactgctgggagtaggggccgggacatagactggagaaggcaaatggtaccacctgatgcagagataacattggcctggggtccttgtgtcagctgatggggacggaggtcagcaatagaaagaggactcaggaatgcatctatccttcctgttccctgtcccttcactctcaaggaaaatggcagcatcgtcacgattccccaaatgaaaatcacattggaaaatatctagtgttttatacaagaaggccagaggctgatatcatgaccttaggttttagaattttctatcagcagcaacatgtcagctaaaaaattccctatcaagttattacctgaagttttttatgccttaactttaaaaataaaggtctgcaactccaagcaaaaatcttggactcctctttatgaatcaaactgattcccaaactgagatcatagcccactccctggcccctgtgcttattataaaacccatcttcttttcacgtccaatataatcaaggcagccacaccccacacgcagcactccagccttactttccccaaatccaggccccacttcatgtgaaaatgcatattattacccctgtgggctcagagcctgttttgaaataaagcaaataagaaccacaggggagtgactcaagtccaaattgtgtgtcctgacttggcgcaaatgttcttccttgtccttgcttattaactttgggagacactgagcattccccaggatgcgctgggggtttgcacacaatcctgcccaaagctgggcaaagcctgcgtgcccagcagccaggaattccctcccctccatccccatttggggcctgttcagccgccctcgttttcatgaaccccacacaacccactgcgtttggaggaccctgtgatatatggcgccttccagagaacaggatgcagatgcgcgggggaggtaaccggagaacagcgcaagaagatgcggctgtccccggagcccaacacataaattacaaaaacaatttcgaattcaagggcaagcattgccattcctctcttttccaaactttggcttttttgtgctgaaggtaagtttgagaggagtgtagattttatcccaagatgacttcttcccattccattttaattatccgctgggtctcggtgactaagtcatgagtagggaggacccttgtcttcaatgccctgccattggccagccaagatccagtgttcactgtagccatggtcttttctgggagcagaggaatttgttcaggggaaaggggagaagaggtggcccacacggaggcaggcagaacttcatgtcactgcggaggctgaacccaagaccaaccaggcacttggcagtgaccacccctccccacctccccagggacactcactgtcctggctggacccttcctgatccccccagtgtcagggagcaagcttgattgtctgcgcccaggagtcccagacttgagggctacatttctcccgattgcctttgtgcagagcacacagatggcttcaaataacaggctggtttcatgcacctgtgctctggctgtcccaggttttagaaaggactgatccatctcctcttgaaacttccatctgaatacacatcaatagggtgtatatgtgtgatgaaagaaacactcttcagctacatgattagatgatctgtgttcccccaaacttttgcaaacaagagactgcactctggacttaaactttcttttcaataaaagcaatctaggaagtttcccagtttaggtagaaagtggattaggccaggtgcagtggctcatgcctgtaatcacagcactttgggaggcggaggtgggtggaccacttgaagccaggagtttgagaccaacctggtcgacatggcaaaaccccattcctactaaaaatacaaaaaattagccatgcgtggtggtgtgcacttgtaaccccagctactcgggaggctaaggcaggagaatcgcttggacccgggaggtggaggttgcagtgagccgagacttttccactgcactccagcctgggtgacagagtgagactccatctaaaaaaaaaaaaaaaagaaagaaagagagaaagagagaaagaaagaaagaaagaaagaaagaaagaaagaaagaaagaaagaaagaaagaaagaaagtggattcggcaccatccctaataacaggtgggaagggactgcccttactgcccactccgagatgctccagccctgccggctcctggagtgtgacctgagggacacaaagcagcactcttaccaccctgaatgccagttccaaacactgaatggggacacaggtgacctcaacagcaggacctgactgctctctccaagcacaaggaaacttgttttttagatctatacccatcagcagtgtgagctgcagggaaaatgcatctggctaagatttttttttttttttaatgagacggggtctcacttgctctgtcgcccaggctggagtgcagtggcatgatcacaactcactgcagagccttgacctcccgggctccagcgagcctcctgctcagcctcccaagtagctggggtcacacgtgtgtgccgccatgcctggctcatttattttaattttttaaagagacagggtctccctatgttacccaggctggtcacaaactccagggctcaagagatcctcctgtcttggactcccaaagtgcagggataacaggcatgagccacggcgcctggcctgcctcagactttaacctgcacaagggaatggggaactcagttatggcaagaaatgagacagataccgaccgtatgccactgacagaaaattctaaaacccaaagtcatgatatcaagtgaggcagataccgaccctgagctccacgtgaccgtgctgtgggcctagaaatgagggggatggggagtgtggctgccacatgacaggcaggatcgtatacctacagcctcctggacctgggcccagtagagcaagtgctgccacctgatattccaatgtcacattcagagacagccactggccacttcccagcagggctggtgggcacttgtgagaatgggaaactggacccatgtggaggtgtcctgcctggtatgctctgccgggctgtgactcacggagggacgggccctgcacccaggtgacatcagagcccagggtgccatcttttctcagctccttctagcccatgttgtggatgcaaggcatgggtgccaggtactttccccttccacccacccttggctgctgggccaccttgactgcccttggagttctgggccctcaagagccttctccatcacctgcttctcatgggcgctgctccgacacccaccccaggtgctctgtggaatgtgccagtcagggctccctcacggagggtgaacaccaaggcccacctcagcaagcatggccaaaccactcaacaagcagccagacactgatgtcctacccagcccagccctgtgacctcgagagaaggataagacggacaccctgacatcaagaatgcgtggtctcgtgtgcagcccaacgcaagtgcacagaatgagggggtgtcaggctgatgacatgcactaggggactctggggcaggagggatcagtgagcttcaaggagaaggtgaacgccatgctgagtcttgaaggatgaagaggatggaaggtgagtttcaagtcaaagctaaatgaaaaaaaaaagaaataaagacttgaagctggcagcgaggagaaagaaaaggttctgaggccagggtaatagggcagtggtcagagaggggatgatgatgggggttggaggatggcaaggagcccctcagccacaacaggggacaccaaagatgacagaagagccggcatgaggtcaaagggaggccagacaaaggaacttttggaaacctggcagaggtgtgaatggtgacttccaagctggtgagcagcaggatggaaagggcgggtgatgggtgtggcagccacatgtgtggtgtgctgggcagatgccctcatggtgaagccgaggctctgccattgaccacgaggcaccaccaaccacactctgactcctccagcgatacagctgccctctcatcaggaacggtaccaaggagccttggtaccatcaactatctgctgccaaccggttacatggagtctttaaaactggggctgggttttaaagacttgagaggctgagcgggaggattgcttggaacgtatggtccctgcccacaaaaagcctggcccctggaccagagggaagcggcacgatgaaggtatgagagtgtttctgttggcgggtccagcctctgcgctctgactttctccagctcagagatatcccttcacccaggttcctacagagccccatgctctttccttatctgagaaccacagattggaatccacaaggagtctagctgaagatcatttagtccagagggtgcaaaacttttcctggaaagggtcagacggtaaatattttcagtgttgccggccacagtgtctctgttgcacctgctcgactctgctattgtagtcccaaagcagccatagacaatacataagtgaaatgggcatggctgtgttccaataaaactttatttgcaaaaacaggcagcagggcaggtttggcccaccagtcatagatctagcgctcaacactcccatcctacagatgctgaagtgtagcctcaggaagatggaactgacttgaccaaggctgcatggctcccaggaccagaccagaactcagaacatctgctcctcaatcttcaaatctctttttaaatgctattcaaccagctgcttcctcctggcaaagtggggtcctggaaaagaccatgaatcttattgactcaagagatcggaaagtccagtagaacctgctgggatgtttgtgttttcaatggagtagagaaaacaaaaacagatgaaggacttcagcaatttttaaaaatggagtgttcattcaaataaactttaaatcccaccaggcaaccacgggcacttcacactcctgaggtaggcccagcaatacctgagacaaatctcacccctatttaattatcattaatcttccctccaggcttttccatacctgctaaatagctcaatccatctcattactgaaggcagctgctaggtatggttgtgagaaatctcattagcacaaatgtacttctgtatggtgggcctgataggcccacctcccgagacggggatgttgaatggcaaaatctcagctctgaggaccatcaaagcactgggttccccaaagttttggccacactcagtagtaagagccttttattattgtcattttcaactacagagatcatgccccccaaataagaagaaagcaaacaccttaaaagggcaaacttgaagattcacaataaataggtaacacgtgaggggtccaacactgtgaagctcaactgttcctcctctcggacgtgataatttcacatgttcagaccaccctgtcagcatgtcagatttaaaatattacacgtagaataatgaaaaattgccaacttctcaccaccgtcttttgattaatgaggagttccttagagattgattggtttatttgattttgttgccgggagtgactgatggctattttaaaaaatacttagcttagcgctaccctccatgagataattttcatatgccttgtgtagctgcgtccagaataattggactttattgccttccttccatgcatgaactgaagttccctggagaagcaaaacagcttcagactttgttgctttaatatttccatgtagatcagctgctgtgttcatggagatgcttccaccagatggccagcccgccttgaagtgacatttcccatttcccgtcgattactcaccaatggaaaataatgtgatacgaatccctcatttggggtaatatgtggccatatccttgttgtacctgcactaaagataaatcatgcaataatttctcaactgtccagggagaaaataggagaaacaacaggtcaccagtgtttggcaggaaaagggaatcgttattggtaaggcattcactgggacattgaaatctaatgtcctaatttctttcttttttttttcttgttgcttgttcttctgtatctcagggggaagaaacttattttggttgtttaaaacatttaagctctggtttttaggaagaatcctggttttggtcaagtccctagatgtctcttcccaaaagcacccattttgatgctgaggcgaggacaaaagtattagttttcaaaaagcccaactttatctcctgaacagactcaaatgattaattctcaaagtcattgtcaaattttacttttaaaaatcttagtaatttctcttcaatatttggtacaaagctgtcggttactctcagatcatccttgtttttcaacttctctgtttgattccagcaaattcttttagctggtcactcttgaattactgttaaagataagtaagtaaaaatgaaaatattattaataaggtatgaataattatcactaacagtttttcagcccttaacatgtgccaggcagtgtggttagggtattccatgctttaagccatttattgtcaccgcagttctgagaggccaggaatattatcatcatcttccagatgtggaaagtgagacagtccacgtcctacagccagagcaggattcgaacccacagtcctgattccaagctgttcacctctgttcactggggaagccaagtgttaggaaactcttctttctggaatgttccattttttcccttctcagagagaagtcagccctgttatttcccagtttctgctcttcctaccaggcttcaggtctctgcccactgtgtcctcacaggaaggcagcaataaggaactgggttagggtctcttcccccgtccacagatattggggtatgtgggtccctgagtcttcggtccatgcaaggggcatctgtccctctcctgcagacagtgatgcaccctgggccgcaggctggctgctcgcaagttgcttttcctcagtgaaagaatctgcttgttggaggcaccagaaggttcttgaagctgcagaaaattctacaagtggtggaaggttctggaaacagcttcctccctcctcctctcccccttctccaccacaggcagcatctgctgtagtgtgagccgcaaccctgcctggccctccaccaagcctgaggaggacgcgagctcggctgcggctgacagcattcagcagcagaactccaagcaagggggtcacctgcccaggagactacccccttagtaactcaagcttttatgcactcattggtattcatccagatggctgttttggctagaaagaaacacttcttcctcactagaattacaaataatttgagcagaaaactacaggcaagacatgttaattatgtttgaaaggatgtatcttttggtacaaagggttttcttaatctaaaaatgctttccccgatctcaacttatatctaatggtagtttttagcacacagagtacgtagcttattttgtttagtcctttcatacccacctcctgtgcaggtaaaaaaaaccacatcttttttttttgagagggtgtcttgctctgtctgtcgcccaggctagagtgcagtggcaccatcttgactcactgcaacctccacctcccgagttcaagcgattctcctgcctcagcctctcgagtagctgggattacaggcacccaccactacgcacagctaatttttgtattttagtaaagacagggtttcaccaggctggcctcaaactcctgacctcaagtgatctgccagaggcctcccaaagtgctgggattacaggtgtgagccacccacacctggccaaaaaacccatagattaatatgtgtcctttgaatcagtctcttccttagtaacttgcttcaggatccaaggagtgaaccactatggaaatttttctgtaataatttcccttaatccttatttagatttgtaagtctaaacacttaccattatctgacacatgaagtatgagctatggacgttgtctcataatcttttccttattccctatttatatttatttgttagtctaaaaattaattgttacctgacatataaaataaatgtcatgaaagcaactgttttatgcagaacaacgtagtgctgtgtagtttttatattatgctaatatcggagctagcactcctgcccccagcctccaatcctgctcatcgaccccgaataacagacacctgagcgggcacctgctgggggatggactttgttaggacgattagaaaggagcgtttccatgatttgcttatgcttcacccttcctttcagttaaagattaagtctttgcatcggatttcagttccgaggcgggccgggaagggatgtggatattttctttattttttaaaaaaacaaacccttgtagatagagttggtttatttttaacaagggtagaagcattgtgggaagctgtttttcagatttcatttcagccacagaccgtgctgtacaaatgaagacacagcctggattctccctaatgaaaagagtgtgtcggggatggggacagtggcggggggtgggtgggctctgagggagcagctccccctgcacagagatccgggccacatgcaggtctgcagtgactctgccttctctctagcctcaccttcatgcagcacttgccttaaaccagctcacatgccccacctcaggcaggtcaaccagcttttactgaacacctgctatgtgcagggcagaccaataggcataaaggaggtctctgtctttctagagatagtctggtagatgagacagatgtggaaactaataaatctaacaaagggcagaggccatgtgataacaaagacagtaagtgaaacccaagccacaacagatacaagcataggttgaggggatcatggagggagtgaccgattcccaccaaaggagaggggcagagagggctttggagaataaacaggtagcaaaagggagatatttcaaaaagtgggaggaggttgtgtttcagatgtacccgggggagtttgggagggagatgggaaatgaggagcaaaccttcaaacagccccccaaaaagaaagaaggctctaagacagcctgttgagtgaaacaacaagatgcaaaacagattgtattaaaacataagtttgggaaacaaattatgttcaataaagcaacatttaaaataatgttaaccgaggtgaagtggctcacgcctgtaatcccagcacttcgggaagcccagatgggcagatcacttgaggtcaggagttcgagatcagcctggccaacatggtgaaaccctgtctctactaaaaaatacaaaaatcagccatgggtggtggcacctgtaatcccagctactcaggaggccgaggcaggagaatactttgaaccccggaggtggaggttgcggtgagccgagatcatgccactgcactccagcctgggtgaagagtgagaccctgtcttgaaaaaaaattaataatgttatagaaattttagggaaataaatatatatatatttgctataaatgtttttttttttttgagacagtctcactctgtcacccaagctgcagtgcagtggcaccatcttggcttcctgaagcctccacctcctgggttccagcctcccaggtagctgggattacaggcacgcaccaccacgctcaaatttttgtatttttagtacagacagggtttcaccctgttggccaggctggtctcgaactcctgacctcaggtgatccacacgcctcagcctcccagagtactaagattacaggcatgagccactgcgcctggcctataaatgtatgtttaaaaggcctctatatatcctcaatcaataacagcctctggggtgggacaggagggaatgtccctcctggtggaatggggcaggagtgtcagagtggacttcagtctttgtctgttttttttttttttttaactaaggaaaatatattcttcattatctatgtaattaaaatacgttttaaaatctaataaatcacctatttacttttcactataacgtagggcacttaaggctattatgttatgtccaatacatctaggtttgatacttcaaagtcaagcggattctggagaagccaaaatactgacccagaaagtctagattcgcctagtttaattcccttattttacaaatggggaaccgtgggtttctcacggtctttttgttgataggtgcaggaagatgtacgtgaaataattcatggaaaagtcacagtggccttgaagttctccagataactatgaaaaactacgttaagatgctatttttcaacaaaattcattttaccaacctcaaaacgtatttcctccgaagaggatacgcactgacaaacaacacccgagtgtggcatgctagcaggagcactaggctgggagtcaagagacttaaattccacccggaagccaccacatgaccttggcatgagcccgtcaccaggctcctcagcgtcctcatcgcagcaccagggatttcccaagccctccggaaatactgtaacttgacaacaatggagaaagactttcacccatgcggttggaatgctagccttaaaatatatacaattgttacatgtcaataaaaataaataaataaatgtttaaaaaaaaaaatgtccttccagggaacatcacacaccggggcctgttgtggggtggggggagtggggagggatagcattaggagatatacctaatgctaaatgacgagttaacgggtgcagcacaccaacatggcacatgtatagatacgtaacaaacctgcatgttgtgcacatgtaccctaaaacttaaagtataataataataaaattaaaaaaaaagtccttccaacaggtttcaaaagtgaggttctaatttaagccttgcagggtctctaatgtgaagccagtttggtggggttgaacgccaaaaggataggaagggcttctctttcgagaatgcggggagaaagaaaaatcagtattttgactaaaagaaagtatttaagttacgatcagaaatatatttgtctagaaataaaaatgcattccccctgaccccccatccctttaaatagtcacagctggctctctggccatataaagttaccatgctgtcaaatgactcaacttacaacatctgcattggtgaccgacatcctgtatcatgggctatctaaccctttgagtcacgacacccctgtttgagtaaggtttattttactagcaccaagagactcctgcgtttaacatctgtggtgctcctcctgaaattcctagccataaaacaagtaaattcagcgtggtctgaaattccagagcgtagccacgaactacacagaaaacacattcggtggggccggtcggtaatggagcagggcttagctcgggtggggctgcacatctggctgtgccttccctccgcaagtgtgggaagaggacctgggaatgccagggtccagccaggcagagagtggctggatggtctgcacgggcaggggatgctctggacacatggccaggagggtgctccccacagtgcacccttaggtgccaggttggtgacattgggtgtgaccaactgttaaccactaaactccatctgttaatgtcctctgtaggccaaatactccatgtgcctgaagatgcttccggcttacaattgtgaactcagtttctgtgtccagcatcgagagtttaaagtggggcgcgcccattctctggatgggcacagagctgttaaaatggtgattacgtagacattgtaccacgtgggaaaatattgatgatgagaccacattagagaaaatgagcaaacagaatgcagggtggcaacgtcaccatggtaataaattggtaagacctcctggaacactatgcagccataaaaaagagccagatcatgtcctttgtaggaacgtgggtggagctggaggccattatctttagcaaactaatgcaggaacagaaaaccagaaactgcatgttctcacttataagtgggagctaaatgatgagaacacatggacacatagaggggaaccacacacactggggcctacctgggggtgaagggtgggaggagggagaggatcaggaaaaataactaatgtgtactaggcttaatacctgggtgatgaaataatctatacaataaacctccacggcacaagtttacctatataaccgacctgcacatgtacccctgaacttaaaataaaacttaaataaattggtaagatctgacgtgcctgtgcagctgaggactagaactgaacacagaaaaattgcaatagcttagttcactggagtgaagtggctttaaatttttttttttctttttgagacagagtttcactcttgttgcccaggctggagggcaatggcgcgatctcagctcactgcaaactccgcctcccgggttcaagcgattctcctgcctcagcctcccgagtagctgggattacaaaaaaattttttcatgctattcatgaaaattaataatttcaaagacataatcccagctttttaggggagtctccggcaaggcatgggggtggcatctgcatgcaacacacggttgacaggaaaaagggatgatggaagcccaggacgatccccccgtgggaaccagagcaaggtcgtgaacttcaaagctctttgacaagtacaggatgataaaaacatatgggtttaggacaactccccgtcacatcttctgtgtggccgatgcctggcaatccttcaagtctctcttccatatcaacatgccttgtgtgtggggtgagcgggcaataaggagaggctggctgacaatcaccatggcaccatcccatcaagatgacgcacagactcctcagcgaggcgcacacctggccttatgtgccagacattctactccaggggcaagcagcctctaaattatttgtcactgataccctgagtgtcccattttcacgatgccacccagctctgggttcaatcctgctcttgctcattcccctgggcaaggtgtcagtctcaggctgtgtaaagaggctgtgtccccgccccttatatttaaatattgagtgggttgcatctttcccagccataccaagaggaaatgcaaccatctccctccctgaggccagcgtaatctaaccatcacaagccaggaagggttgtggcaagccattgatcttattgtgtaattatggctagggaagtgtgaatgataatggatgaaaaggagaggtggaaacaacagactttgcctgaaaatgggatgagttaaattacagtgcattgattcaatagaaaatcatttatccatttttaaaaatgctttgtgggctgggtgtggtggctcatgcctgtaatcccagccctttgggaggctgagggggcggatcacctgaggtcaggagtttgagaccagtctggacaacatggcgaaacgctgtctctactaaaaatacaaaaattagctgggggtggtggcaggtgcctatagtcccatctacttgggaggctgaggcacgagaatcacttgaacctgggaggtggaggttgtggtgggctgaaattgcaccactgcactccagcctaggtgacagagtgagactctctcaaaaataaatacataaataaataaaagtaaaaaataaaatacaaataaaaatgatttataaagaccacatggtaatggaaaaaagcatgagctataaaattaagtgagaaaaagtactgtacaaaatggtatgtgaattataactataaaaatacatttaaagaccacaaaagaatacaaatatataggtatgcatacacatacacatctaaatgacatgtatagtcatgttttattctagaaaggagatgaacaggtgcatttcctttaatgcagaagggagtccacagagagtggctctgagcaggtgacttagttggtttcaggagtggtgagatcatggggaattttttctctgtggccaacaatttctgtaacgtcatgtataagcaactgaaaaattattatctcaaagcacatgaattttgtatgttttggcagcactttctgcagttcaaatggccatatgaaacccttcgggttagccacaggtacaccttagagcaaacccaccccatgggactgacaggaggcaaagtggcatgaaaggacaacacggtgctcccccaccctcggaaagtacaggaatccatcctcactgcaacaccatctgtaaacgttctccaggggaggagaacgcagccctgctgtgctgttcagcacttaagcagactgaaaaagcaattatcataaaatgcaagttcagctgcagcccagctctgtggggaggttgttggatgaggagctgtctgtctgggacagcccctgactcaggcttagcttcatccttgaggtccagccttgcacctgctctgtttcctcatctggggtccagctgacatctgcctgtacctgaggacctgcccagggaaggccgagggagacagtaggggactgaggacaagagtgggagccaggcagcccacccatcctcagttctccctcgtgttagatgcagaaatcaagttacctcgactgaactcattttaaaaatgactttactccattctgtgtcaatgttgcattcttggctttgaccttgtgtattaaagaagcagctcaatgaaaatgttccgacattacctgtgagctgtgaaagaggtggctgattattttgttggtatcatttgtctaaagctccatgggacaaattattttcataatcctagtgcaagtaaagatcatgtttcctaaaggtgatctttaaactattttttcattgacagtagaaagctgagagtgaaattttgcgtttagttatacgaacgacactaatgtgtttatagcacctctattcccctccttcctcccacccaccatccttctacatgttaagaaaatattttctctttttttcaacagactttctcttttattataaactgcctcaaattctttttaggagtagataagatgtcaataaacctgcatggcaacatatcttgaggaaattgcctattggcagagacacactttcttaccttcaacaaggtagtaacattgctcaactaaaaaaacctgggccaggcttggtggctcacacctgtaatcccagcactttgggaggccgaggcaggtggatcacctgaggctgggagttcaagaccaccctgaccaacatggagagacctcgtctctactaaaaatacaaaattagctgggtgtggtggcgcatgcctgtaatttcagctactcgtgaggctaaggcaggaggatcgcttgaacccgggaggtggaggttgcagtgagccggagatggcgccattgcactccagcctaggcaacaagagcaaaactccatctcaaacaaacaaacaaaaaacaaaaaacacacaaaaacaaatctgcagagagagagagagaaaaaaaaatccaggctgtggggttgtctataagacaactcagctaggcccttcagaaagtcagtcataacaaaaagtctgggagactgttctagattgaagttgataaaaagacgtaacaatgaacatactgatctttgattagatcctgctttattttttatttttttaaaaaagctataaaagatgttttggatgcaattgggaaaacgtgaatatgaactggatagtagatgacgctagagttaatttttttaaaaattaatgttatgaggtatgataatggtgtcgcagatacataggagaatgtccttggtagacatctaatgaaatatttatagtcaagtatcatgatcatttacaatttacaatttaccttcttttttctttgtttttcttttcttttctttttttttttgagacggagtctcgctctgtcacccaggctggagtgcaatggtgtgatcttggctcactgccacctccacttcctgggttcaagcaattcccctgcctcagcctcccaagtagctggcgttacaggtgcgtgcctccacgcctgactaatttttgtatttttagtaaagacggggtttcaccatgttggtcaagctggtctcgaactcctgacctagtgatctgcctgcttcagcctcccaaggtgctgggattactggcatgagccaccacactcagcctacaatttactttcaaatggttaagaaaaaatcaaaacaaaatgtgtgtgtgtgtgtgtgtgtgtgtgtacagagagagagagagaaaactgtatatgacaaaatataaacaatggttagagccagggagacagtctacaggtgttcattgtactatgcttctatctttgctgcctgtttgaaaattttcagtcagttggatggaggtctatgaaagtccaacacttatagatcaaccagaaatagatgaaatctgatggtaactcattttctggaacccctagtgtacccccaaacaactcaaatggttgagatcaatgttaatgggtttcagtcataaaacttagcaagaaaaaggaaaacaatcaccaccaccaccacagttttgctgctgtcactctgtgtaggacgggttgcagaactgcgtggcaagaagagacagcggatcacaaggtcaagagatcgagaccatcctggccaacatagtgaaaccccgtctctactaaaaatacaaaaattagctgggtgtggtggcacacacctttaatcccagctacaagggaggctgaggcaagagaatcgcttgaacccggaagatggaggttgcagtgagccgagatcgcaccactgcactccagctaggtgacagagcgagacatcgtctcaaaggaaaaaaagagagagaaaaaaaagaagagacagcatttcagaaggagtctctgcccagcgtccagcagcagtcggtaagagaagcccatgtatgagaatcaggatgctgcagtgctccctcaagtcacctccattgaaaaccattttttttccacagttggagtggccgattgctgcaggtatgacatctggccagtaccaagtcttcctaactcttcagagatcaccccaactcaggaatgggcagacataacggcatagggagacctgtacgagtcacctgacccccagcaccaggtcaaggctgcaggagtcccagtcgcgcccctgcccggcacacccacacacagagcttgcttctcaactaggcccggccagcgcagcttcctctgggcagggccctaaatgtggattcagagctggacagcatccgctgaccccactccagaatgatggctgggaagtctctgttgtaacccccgccaatttaagagatgccgagaatgagctttcagtcacatattcattcattttaaaaatgtttatggagaaacttctctgtgccaggctctgtgtcagacgggaatataagtttgtgaacaaatcagataagatccccacactcaaggtgtttaaggtctactgggagacatggcaatgaaataagcaaaaaatacgtgtgtggtgtgtgtgcagagtgagtgcgtgtggagtgtgtgtggagtgagtgtgtgtggagtgagtgtatgtgcggagtgagtgtgtgtggagtgagtgtgtgtggagtgtgtgtggagtgactgtggagtgtgtgtgtggaatgagtgtgtgtgcagagtgagtgtgtgtggagtgaatgtgtggggaatgtgtgtgtgtgcagagtgtgtggagtgagtgtatgcagagtgagtgtatgtggagtgtgtgtggagtgtgtgtggagtgagtgtgtgcagtttgtgtggagtgagtgtgtgtgtggagtgaatgtatgtggagtgtgtgtggagtgagtgtgtgcggagtgtgtgtgtagtgagtatgtgtgtagtgaatatgtgtggagtgagtgtgtgtgcagagtgagtgtacggtgttagtgtgtgtggagtgagtatgtgtgcggagtgagtatgtctgcagagtgtgtatgtggagtgagtgtgtgtgtgcagtatgtctgcagatgagtgtgtgcggagtatgtctgcagagtgagtgtgtgtgcagagtgagtgtgtgtgtgcagtatgtctgcagatgagcgtctgtgcagagggagtgtatgattggagtgtgtctgtggagtgtgtgtgtggagtgagtgtatgtgtagcatgtggagtatgtatgtgtgtagtatgtggtatatgtgtgtagtatgtgatgtatgtgtgtggtatgtgtatggtgtggtgtgtgtgtggtatgtggtatgtatgtgtgtggagtgagtgtgtgttgtgtggtgtggtccgtgtgtgaagtgagtgtgtgtggtgtgtggtgtgtgtgtgtttatacagtcatccctcagtattcacaggggattggctccaggacccctgaggattccaaaatccttggctgttcaagtccctgatattaaatggcgtagtgtttgcatgtggccaatgtacgtcctctcatacactgcaaatcatccctagatgacgtataatacccaacacaatgtaaagctatgtaaatagttgttatactgtgtttttatttgtattgttttttattgttgtgttattaatttttccaaatatttttgattcatgaatgtggaacctgcgggtatggagagccaactgtacatcacataggaacatatctaattaccagctgatttgttccagaaaagaaatcaatggggtgcagttgaatggtggccttaacctctcctactgatattgaacgctgggcagcatggccctctgaaatcccactcgttcctgccaggaccaggggggtttgaggagtgtctctttgagaaagtggctgtaggtcaagtgctgagagaggggagggagggactggggggcagggctccaggtggagacatcttgtgaggtacctaagagtggtgaattcagggtgtgaggagagggcagagaggccaacatcagccagaccttacaggtggtgataaatagttagatgtttattctaagggaagaggaggccacagaattgttgtaagcagtggatggacatgaggtgacttgggttttaaaaggccactatggtgactctgtagcaagctgattggaggtgggcaagagtagaaggtattttcacagtccaagtgagatatcagttccttaaacaaggacagtggctgtggagggggagaggagtggactgattccacatacactttgcaggtagaattgacaggctttgctaatgggttggatgttagagttgagaaaagaggagaaaccaaggataacttccaggtttctggtttaagccagtggtggtgccaattccagagagaggacttgatgtggacgggctggtggggagaacatggaagtcaacagtaagagttcttcatcttctgcaggatacctcctacctttccgtcagtcagtttatcaatcgggtacttgttgagggcttatcatgtattaagctctgtgcatttaccttgacatatttttaaagatgatttgaaatgacttctaataaaactcacaggtacaagaaaactactgaaaaggtgcataggtgaaagaacaagagccaagtaacaaaaggatgaaaagaatcatatctaagtcctaatcctaaaagagactgctgcaactacaagcaaaaaaccttaactctgagttccccaggaaccaaagcaaaaagggaaagttgagttttataaagccgattgtctaataaaaagaagcatgctggcttactcagagaaataaaatttcgcccttattttcaacttcgaaagcatttttcttactacctaccttctgtaagggccaatgatcaatatagtggaattgttatattgtcaataacaattttacacaaaatacaaaagatttctgtataaaacctaaaaaactggtgtcccaaatgcccggtagaatggactatcaagggcactggccaggggcacaggtctgtagcaagggaatactttggcttgtgtcttactgtcttaggttttaatagtgtctttgtgacgagtaccttgctacccactgacttaattacagtttcttttgtcttagaatgtaaatttcttttgttacccccccccaatcatgtgtgtgcatgtatgtgtgggtgtgtgtgaaccactggagttggctgtagactttcttttacttttgcagccagagtctccctctgtcgcccaggctggagtgcagtggtgtgatctccgctcactgcatcctttgcttcccaggttcaagggattctcctgcctcagcctcccaagtagctgtgattacaggcactcacgcaccaccaccatgtccggctaatttttgtatttttagtagagacggggtttcaccatcttggtcaggctggtcttgaactactgacctcatgatccgcccgcctcgacctcctaaagtgctgggattacaggcgtgagccaccgctcctggccggcaatagactttctaaaacatttaaataaacttcgcaccccttctcacgctgcccggaaaattctgacttccctcaccttgggagagcaaggctcatatagcagacgttgcagaccttgtttaggtcacacttaagataaaggaagatgcaaactcctttttttctgatcagctgatcccctgtgactgacggccggggagcccctatggcaccagtctgtaggctacagcctgagccagattccatgctaaaagtcccgaggctggcagtgaaagaaaccccccggggctggaaactcacccctcctgggcggctgcacaccagctcatggccgctctggggtctgtgagggcccggcgcccgttctccccagggagccgcgtgactctccttgatccggcctcccctcgagcgacaggcctcccagaggccccccagcagcccccgagcagtccccggagcgctgggggactctgcagcgcgcaggtgaccacgcagagacagccccagcgcgatgaataattgaggcgcagagtggaattacctctgtgggctccgagtccctcccgcagcccgcacctgcccctgcccctgtccctgcctctgccccaaggactactgctcttttcagaaatgacgccagtaccagcacgtgcaaaatgccttgcagccttgctgggaacacatttgcatactcagtttcaggtttaaatgcctgcgcataaaacaggattaaatagcacaacctggcgggggcaggggggagcacaagggtctcccttccacctggccggaggtgggtgaaaatcccagcagatttcaacaacccgcctcccaccctacaccgcaagtaggtgcgcggagggactcaactgctggggcaggggctgccctctggggtagagggacccccagtttccaaagtgagggctcagagagcacccaacttctccgttctctccttttttcattcatttttcctccaacagatatttattgaacacctactatgtgccagcactgtgaagggggacagtagggtctatagcagtgaacaaaaaatgtccctgctctttgagttgggggagacagacaattagaaaaagattcaaagaaataacatagttcccgtatgaagataagagcaacgaccagggagaggcaaacaaaagagagtgatagggaagtttctcaggatgttcaggagggcctttctgtcctgctgtgcttagattctgcctataacttaataagtatgttatcatttgatagtaatacttaccaaacacttctcatgttctgggcactataataagtgctttagcactttggctttacataatcgttgtaactacctaatgacatggatctctaattgtgcccattttacaaaagagtacaattgaggcaatgggtcctgaggccagtagctgaagaatggcggagctgcgacttgaacccaggcatctagttctaggaccccactctgaaatactgcactgtaatttacatatattcatttcccctcgtttccaaatgtgggacacggccaaaagcaagcaaatatgcataaggagcttctgacacgtaaacagccacccccatactgtggcatttctcctgttcttgcctacagttctagttgattcctaaagtgggagagagcgtgcatgatgatagggactgtttacttagcaaagaaactgagtcagctcaggatccccaaggctgcagccagggaagcctgtgtcatggattcaaccgtctgtgctgagccgcacctgcactggctgaattgctagcagccgggtttcaatttggggacccaatgggtgacacccaggaacccagaagccacaccagcccttggctccctccaacccaggtttccattaccatggtgctgcctgccagcttggcaggatcacactacaccttgggcaggtccttgccctgggccccctctgctgccatccatccctctccctgaaaaaggtggtgggaaggacaatggccttttcttggctgaggagtgccagggaaccaagcctctcagtacagaaggagggagcagccgaggctgtctgacatccagaccccatcacagggtaggcctgctggattgtgggtgtcttacatttgctcatcctccaagactagaacaaagttctcccaggcctcagacagtcatccctgcctgcagctattgactgtttgcataggaggggatggagttgggatttaggaaggagaggcaaatttgaggctggggagaatttgaattttcctgtgcactaaccacaggcatcccctcctccagagcacactcactctcagacgcccagggagctaagcaaaatttctctgtattttatccaaatatgccgtggactttgaaatgaactctttacacctccttcctgctgacccgactgcaaatcagcttttgatgggattggacagcttggagagatgggcagcgatcacgctgaaatatgatgacaggggcaagactgcaaggacatccgcgaagtaagacatgtgcacagagcaaccatgtgaaaacaattaggacgacaaatttactaattgctgaaagtaacttaataacaaaaccacaatgctctctgttattaatcctggctactgcagcgggtgccaattgaagtttgcttgcaggagggattgtaagtatcaggccagtgccctagcatttgtggatactaagtgaaaagaggttgcatctctgttggtaactgaaaaataaaccgctgttcagcctcctaccaatgcaggtggccatagggatttgaggcatttctgaagcccatggagagagggaggcagggctctcttgcctttctgtgactctctcttttttgcattctccacttaaaccagagcaacgggcattactcagattttggagggttaagaattgatttttaagaaacacaaattcaaatgcaatattcttaaagcgttttaaggtggagtgggtagaaatgaggtagcaagggactccattcttgggttgggtgaggagccttcaaaagttctctgagttcccaagtctttcacaggctgcttgctacacataatccttcacagaaattaggtatcagtgcctaggcatcgggagtgaatgcagtatttctggaggcaagggagtcccttagccctccagaagatcaaagacaaccatcaaatgtgtcaccttcaataagtcatgggatgcaaaggaccataatttcccttactagaggggctctttgtgcctatatttctcttaagttgcctaagtctgcaaacatttggatcattcaagcctcattttttttccttgaaatatttataaaaaaggctgaattattattttttgaaatatgttagtatctgcccccactctgtatttgaccatttatatctcaatgagaaattgcatttattaaagctggcagctctgtgtgtactttattgtgatgtttttgtaattacaatgagcagtgtagcttttcttcccctcccaattaaaatgatcctggcccagaatttcagagtcttcaaggccaagtttgcttctcctggagcatccccaggagatgtctgcccaggcgggaggaggcaacgaaacctcttcttggacccaggacttcaccaaggtcctgcaagagcccttcagccctccctccagcaagagcgagaaccagtgtggtggcctcaatgggtcctcccgcccaacagctgcctttcaggaaacagagactgtaacctgggacttattaaaagtttggagagaaataatatttctgaggttgttcaacctctggctactttgaagtttattcttggattaatccagatcttcagagacctgcatatgggcatgcattattttcactttttgcagaatcactttcactaaattgcatgttagtcttatcttattgacctacttctaaagaatatttggttaagaaaacaaattctcaggcctcatcccagagcctgattcagcatttccaggaacacgctggaaagctgtcagtgtcaaagcgtctctgtggtcagggtgattgccctgtgacatatctttgagagttcatggctagaaacagctgtgcttgttctgagcaatgggcttattttttatcactagacactgtgatacttctaactaatcatgtcatttctttgggttgactgtaggaacctcagattcaaatccacccctagcaaaaatgtgcacggtctcagcacaggtaatttttgtttattttctagcaactgcctttaccttctttcccctctgttgaactttcctcaagcacttaccttttttattatggaaaatgtcagacacaatgtaaacgcttacctttttattacaaaaaatttcaaacataggcaagaagagcaaacataatgagttcttatgtatccatcaccaaacttcaataattttcaacttacagccaacctttaaatatttatttttaatcttaccaagattattggaatcttcgtaagtctcccaaattctttttctaatgagatagagagtacattataaataaccacaacaaatcagcagttcttacatttaaaagtgatgttgcctccccacccctaagaggacatttggcaatgtctggagacatttttcattgtcacaactgggcagggaggagtgttgctcttggcatctagtgggtagagtcagcgatgctgctcaatgccctacaacgcacaggacaatccccaaaacaaagaacgatcagcctcaaatggccatggtgctgaggttgtgcactaaattaaaatgagtatttttcaagttagactattcctaggaaattgactttaaagcacaacttgtgttttcaagttgacaaatgttctaaatatcataggtttggtggtttatagggtattcatggtatacacgctggaatatcagtaagaaactagttgacggtggttgtctctggggagaacttggtggcagggcaggataaagacttactttttcctctatccccatttgtgtcttttatattttataatgcatgcaggtcttacctacttgaaatacatttgaataacatggagtacgtggatgttttcaaaggatctgaaaataaagtttttattttaaagaaagcttttgaaatggttgtgtaaagagaccaaaaagaaccttccgacagagctttccagagtactgtgagcctgtcagacacctagtgtggctcagcagcgcccgggccattaagggaatcagaaacacgtggagaggcggccgctgctcccggcatgatggatcaattgttcgagagcgaagttaaatgcgagggtccctgtgccaagcctctgacactaatgagccctcaactccaggaagcaggtctcccagggccaggcagtgacgtggcttctgggcagcagacaggagggctgggagccgcctgcagcctggccggagctggccacaggataaggtccactcctgcctccatcagctggtggccatctgcaccaccctctgatcctccaaagatggtcactcacccgctgatcctccaaaggacacagctacgttgagctgtaaatggtgacagaagtgaggcaaaccccttgcttcttttgaaaagaaaggcccagcgaacacatctttggaaacattacctggcggtgtcacttccattcttaaaaccccagtggcttttggctgaccttggtccccctctttctcctcgcgtcctctgcctctcaactctggctcccgggctttttgtcagtcccttggattcactgcactcccctccactgcagggcccctgcagatgccgttccttccaccaggcacaccctctgtctcctcttttccttgttacctcctccaggaagccccccttcctccactcccctagtaagtcaacccccctcatgacaggccatccaaaacctgggtccttttcctcccagctcctggagagctgcatcttcaccatctgtgccatcatgtgataaatgccaatctcccggctgggccatgagctctggaagcagcatctaagtccagttggtttgcccgtcccagagctgcatcaggcccatattcactgggactcactaaatgttcattgaccaagagacctaatgaagaacacaaacagccccgccccagaggcaggcatcaatacgcagctcatcgagggaatcctggaagagcagccaagctcaggggagcagaagggtctccaagatgtgggggaatggggtctgggcagcctggaagcttccacggcttctccagggtggagaccaagtctgtggcaggttagagggttgcgtggatggttaccctgactgccccacggtatctcctgcttctcccctctcccgcatggtccccaatggagtaaggctgacttccttggtgccaaaggcatcgatgaccccctgggattggtcagttgatgtggggaggccaagggtggaagagctaagagctcctccagggtgatctggggagaatgaggaagccccttccacactgacccatgagaaaggggaaatgtcttcctctctccaaagcaaggccttccctgactgcagtgaccccagtggctgccccttctccaggctcccaccacaccctgggcacattccagttgctgcatagttcacgatgatgctctttctagatgtttggtggccagctaggctgtgagctccctgagggtaaggactgtggaatattttttcttaatactcaaaccatgcacaatggcccaattattaaggtacccaacaaccttctacagaatgagcttatcattgctatggggcatgacacagacgattcatagctggtgtttttttttttttttaacttgtccatcttgctacgatttctgtcagcatgagcagaaatggagattgaaagacagggctgttggcttcaagcaagacttttatattccttcatgtgtgcattacacacacactctctctctctctctctctcctccccacccctgcccccctccggctactgagagtcctcgctgaagccaaaagtggtagacatgtaagaaaatgctgcaaaatgagaaagatgtatttggtgttgaaaaggaaattgatgaggagaaggagcgtgtggcccccgggtaaggggagctgccctcccaactggcaggtgtgcagctttctcagggcaccccacagaggccctggaaggcattattcctttgcttgctttctgtggagaacaaatcacctctaaaacatttcccagaggaagggccggtggggcgagaattacttctgggggttgaccagccacaggctcagccagagagcagcagctgctgtcagaaagatcacggttggccagcatagccacttgtcagcacacaacggccctggaggaactcacctgccccaggtaaagacagtgagacaagggtggacatcggtgaacttcctctcttccttcaggtcttcactcaagtgtcacctccctggggaccctcccctggccacattcctactcgcaatcgtcccctggccttgtggcctgcacactttcccacccctgtcatgcctgatttttcccctgagcacggatgacgcttgaaagcccattcatgttactgattctcaacatctttctcctgtgattgcagctggaatgaggatagacactgcacctgcactgtcccctgctctgtccccagcagctacaacactgcctggcacatagcatgacattggtatttattgcatggttgaaagaatgaatgaattggagtcgttgaaggctgccttttagaatggtgactaccctgtattcagattcttttcaagatattgtctttctaaatgccccagagtactaggaggacacaacctacgtttaaatttaaaaacacccagtgcatttccaaaagaaagttgctttaagttcgctgcattaaattaaattcactgaactttctcagggctaccctgagatagcccagacatgcagcgggtcttgggaggcttggccattgtcaccatgataccaacttggctcctctccccctgaccccaaaagtcgaataagctctttaccttcattggtgtggaaatagagctcagggcagttttagtagctatatgtggagggagaattggaggggccctaaagtaagttggtttgctaagagccaccctttcaagagaagtcaaagggcagtgccaaatcctgctcatcgccagggtttctcaggtgctgtctggaaagttgggcccatggcatcagcccggtttctaacctggtccccaccacaggcctggatcacatgctcccagtcccctcccagttcccatcttaggtccgggaactcctcctggccttctctagttcttggagacctgtcaagaggtccctgctccatccaactctgctcatatcccacaaattctctatctgctcactgtctaatgccggcaacagtcacagtgcaaggcaagaggctctgggggcaccagccacggtccctacagagatggtagcaggttgaggagagtccttcccaaattcatgctcacccagaacctcagaatgtggccttatttggaaataggattgttgcagatggtgaggatgaggtcaccctggagcaagatgggccctactccaaaatgactgttgtccttagaagcaggcaccaggggaaggccacgtgaagagggaggcagagactgcagtgacacagctgtgagccaaggccaaggaatggtgtggccagccggcagccaccagagtggggagggggcacggaacagactccccttggagcctccagaaggaaccagcccttcctaccccgcaatttcggacttcctgttcccagacctgtgagacaataaatctcttgtactttgttacaactgtccttagcaaacaaatccagagagaccacgatggcttggccccctccccttggcctctgcgctgggagggaggaccccagtgagatctccgagcagatgcactgttccctgcggacaggatttattcctggagcctctgcctcccgtaagctggcgggcagacccagtccaaacttggcactacctcccactgcctccttttcttgcctctcttccctcttcagcccacaaactccttgaggtctgagcatcattttgtccatggctttgggcagggtggctggcacagggtaggggtaccacaaataactgttggagtgtagccagccccttgtttagggaagagatgggtctaacagctgggcatgctggtcttgtgatctggatctgagatgccgccttgggtggtgggtagagggatgaccctgagccagccctgttgcaacagctcctcctgaagatcccagatgctccaagtgccatctctaggttagctgtgctgtaggatcacagcagggggacaaattttcacgtgaaaagaacaatcacatcaagcaaaatgctcactcactgacagagatcaatgaagcagacagcaactcattgcaactgctcctgtcctgtcggtcgagaggagagtgcagcatgacccaacagccctgctgctcccagccgcagacaagccatccttcttggctgctgttttcatcattttttaaaggactgttgagggtgggaggaagtaggaaaggaggtggtttcatgtgagatttctacagtttgctaacagtaaaaaatgggagaagtgataaagttactacattcatcagtcatccaccccgaaacatttgcaactgattatgttcctcagaattggcactgagtcatgaggtattcttgtaagcagtttgctggcatgagccaaaggcaggaaaactagaaagtacctctgaaacacgttcagaagaaacattctcccaagtaataaaaaagatatggagaccagtagttgcttttctcagcggcaaaatatccagcgatactttaaaaaaatggaaataaaatgagaatggttctggcaactgcaaagacgcatgcacttttgctgcctatcttaacagacaagtgggctttctgagtcctgtgctcagtataagatgccccatgtgaaagggagctgatggccatgttgagcgggcacacttaaggacacttaggggtttatgttatatttatggccaagttaagttgatctgttacaggactcattatcctaaaagggtcactaatgacatttgctggaaattttgcccagaatgctttcagtttgaccctctagagatggccatggttgggttgaattaaggctcataactgagccagaaaaataaacctgatttatggccaaactggtttttactgacctgtgaagtaaatgaaacttgaatccctatgataaaacaagacaaaaacaaaacaaaacaaaacaaaacaaaaaatcttcctgaattggaaaaaaaaactctctattttctagaatgaatgcataggaatgtcaggccattctcagaacagcacgggtctcggctttgaaaccttggcctcgctgctgggaggaagctttgatcaccaccccttttcttgctctgagcttgaatgtctcttgctttgggatttctgtttctggcactttctggactactcccttggacatgtgttttaacctgcctgagacttgggggtgcagaggcccctcctcaacctcacctctaagtgggataacccaggtttcccgccacctagggcccagctgacgcacaccaaatcccttggccttgggcctcaacaggagagtgcgcaacagatgggagctaaagcattggctgggcgtcaccagctcttctatgaggctgttgagctaggaccaaggcattacacgtgaaggtagctgcagcctcgaggcccccgtctgttggaaggactcccctcgagctgaccaagggcactgatggcgtctgctatagtcttacctctgccttcagtggacccttggtttcctgaagtaggaggtgcaaaaggcgagaggaaggggaaggtggatttgggaagggggtagatttcaacacaggagggggccagctgctcagcaaggcagtgatgcccacctgaggaacaggcccctggtggtctctggtccagactctgctggcaagctcttgcagtatacgccttccggtgactgtccctttgatgcctccttctgagccaatgctagaaatggccaacaccagcatccaaggccctgcccgcccatttcttgccactcctttccccgcaccccatcttggcccactttggagactccttaggaagggaggtggttgggtgggatgccccacacttcgtggtcagccagccctcccctaccacagccaagcagaagacagctaaacttctgacattggcggtctcactgctagcccctagaaggacctgctacagtcagcaggacctgctacagtcagcagcacctgccaagaagatattcttactcccctttatggtgaggacaactgtgtgtgagatgagggatgaggcatggccggcccacatcattccatctgtggagacaaaagtgactccatcttggatgctaatcgccatgttgactctgtttagccaccgccctgagaatgttgatgtcatcgtgcatatcattggctatggcgaatatagcgtcctcgacagtcctggaggtggccttcaattgtctctagagagcatgtaccccctttccctatggtatataagcccgggtctgggggtaacagtgggacatctacgtgccttgcccctgcccaagtccatgcctctgtctgtaagttccccagtaagccaccctttactgacaaactggatgtgtctgccttgttctctggtttctctgctgttttgacatttggaggccactttggatatatggccctttcatgagacagcatcccaacccccccaggccctgggctcggcggtgcctcctgcagtaattcccacaaggaagcagctcctgctcattcattccttcaaggaactttgattgtttcctgctgcaggcctggtccctggcgctccaggaacacagacccagtctcaaaagaagggcttgtccaggtacaaccacaacacagggttacaggtgccccgtgaggaaagcagaggcaggtgcgtaacagccatcacaggagataaacggccacacaagagaagcttagtcgggtcaggcccgccttgttgggagtgtttcattcacttattccccacaacattcgtgcaagatggatactataattactgccgttttacatatggggaaggcaaggcacagagaggttaagaagcttgcccagagtcacacagctaggattctgaggtcagagtcggcattctgatttttgagccactagattgaagggttgccagcagtacaggcctatagatgtcttaccgccccaccacccgttgatagttaaagttccctgagggcagaggaggatgccacgggatgtgttatcatcaaggaggcacttggtaagtactgattacctcccgcccctgcctctgcagcactgacaggcctgggaagggtctgcaaagtctgatggtctccccatgaccctccaattctaaaagctcccctgacacatgccattccccaaattcttccatatttatagaattgcttcctcaatcattgagcatcttcaacacactgcagggtcccctgagagcaacagccagccccagcctccctggcattcctgaaatgcccctgggctaaccagaggcctggcacatggcaagccatccgcagggatttgtcaaatgaacgagtgaatggatacctataactccgtctaactcagaggctttgaagaggcttgctgttctagaatgcctataaccatgcttcactctgagtgttgcttttctagtatttggagtgcatgaggaggggtttcaagcgaattgccaagatatagcaggctaaaaccgccttggttttgccagaaatccctggaaaacacaagccaaaagaggaggtcttgggtctgggtgacccgtactcagcacgggaattgtcctgtggagaaggtggttcggctcccgtgccctgcacggggtgcgctgttatgcttcaaaacaggacttatcaacgatttagtctcattaagttgtaagaaaacaggcagcgtgttccaaggtcgtaagttttctcaacgttcaaatgtttccaatgttttgtaaaaccaaagagtgcaggagcccacggggctttgctggggtgatggatggatgtggagttggtgaggaatttttccaggctgccttgaaagccagctcattatgaccccatgggctccagacgttttctcgttcctaaggctggtcaggtggtatgtgggacattgcccaaagatgtctaggtcccaccctccatttttagctttaccagaagctcctgagactgcaaatgtgaacacacacagccaggcatctcccaattttctactcccgattttctataggtcagtgtgtgtgtgtgtgtgtgtgtgtgtgtgtgtgtgtgtgtgtgtgagagagagagagtgtgtgtgtgtgtgcacgcacagcatagggacactttttgcacagtgaatctgattttggccgcacttctctagaataaggaattttaagaattctcactttgatcatttcccatcccacatatcagttttatccccaaagatatcactcctgcaaacatcagctcccagtcacagtgtttcactcaggggcccaagctattggtggtcggtgactaatttcagcacttcactgcctggtgctgagagctgccccacagctcacctcggggaccctttcttcttccagtttgcagtttgtagagcaaagggacttagggacttgccatttgcttctcttgggtcctcaattgatcagtgtgtcctccagtactttctagttaaactggcttatattagaggtgggaatgtcttctaattatagcagattcacccagggccagaggtgacctaagtcagaagcctacacagcgatggatgaagaatcaggtggagtgctgcccatggtggccctggacctttttgtgcttggaccctatagtccactccaccaaagcccttttttgggatctctttatgggggtggtaggaagaccacagcttttgagtccaacaggtttggggtggaggtctggctctgcctctgccttgtgtatgagttttggcaaattttctaactccctgactatgtcgcttctttcctctacgaagaaaacaatgcatcctcagtgggaggctggtaacatcagccaggatgaccgatataaaaacacttagaacagcatcttggaaataaaaggtaccagctcccgtgaattctccgtgtccacagctgtcttcttgaaaagtctcaaccaatggaattgcatttcctgttgtttgttgatggtccctgattttggtggattctcttctctctctctatcttttggtggtaagaatatttaacatgagatccagcctcttaaattgtatgagcgtgcagtacagcactgttaattataggcacaaaattgtacagcatctctagaacttaatcatcttgcataattgtaacttcataccaggtgaaaagcaactgcccatttctccctccctctagttcctgacaaccaccatctactctctgcttctgtgagtttcactatttttgctcctcatataggtgggctcaaacagtatttgcctttctgtgactggcttactttatttagcataatggcctccaaatttatctatgttgtctcatattgtagaatttcttacttttttagggctgaataatattccattgtatgtatatacattgtctttatccattcatctgtcagtggacattttaggttgttggcacatcttgattattgtgaataatgctgtaatgaacatgagaatgataatatctgtttaagatcctgattgcattattttggataaataatattcacatgtgggattgctggaaaacatgataattctattttaacttttttgaggaaactccatgctgttttccatagttgctaaaacattttacatttccaccaagagtgaacaagcgttccaacttctccacatccttgccaactcttatcttaaaaaaaaaatgccatcctagtagatgtgaggtaatatctcattgtggttttgattcgcatttccttgatgattagtgacgttgaccatcttttcaaatacctgttggccatttgtaaatcttctttacagaaatatctactcaggtcttttgctcaattcctaaattgggttatttggttttctgctattgggttgaaagagttctcttatatattttggagattacccccatcagatacattatttgcaaatatttcctcccattctctacgttatctttttactctgtgggttgttttccttggctatgcagaagattttttagtttgatgtaatcccatttgcctatttttgcttttgtggcttacactttggttgtcatatccaaaaaatcattgccaagaccaatgtcatgaagtttttccttaatgctttcctctagaggtttcaggtcttaggttaatctttaatctattttgagttgatttgtgtgtatggttcaagataatggtccaatttcattcttttgcttgtggatatgtagttttcccagcaccatttgttgaagagactgtcctttctctggtgtaccggtattactgtcacccttgtcaaaaatcagttgattgtatatctgtgggtttatttctgggttctttattctgttcctgttcctttggcctatatgtctgcctttatgccagcaccatactgttttatttactgtagattgtaatatatttttaaattagaacatgtgatgcctccagctttgtcctttcttaagattgttttggtaatttggggtcctttctggtttcatatgaattttaggattttttttctgtttctttgaaaaatgccattggaattttgatagagattacaatgaacttgtaaattgctttgggtagtatgaatctttttaaacaatattaagtcttctaatccatgaacatgggatacttttctatttatttgtgtcttctccaatttatttcatcaatattttgtagttttcagcatacaagacttttacttccttagttaagtttattcctttgtgtgtgtgtgaaagccagtttataaagacaggaaaggaataaagaatggctactctgtaggcagagcagcctattattcctgttttttatttttttggtgctattataaaggaaattatttttaaatttccttttcagatagtttactgttggtgtataaattgcaactcatttttgatgttgattttgtatcctgtgcctttactgaattcatttattacttctaacaaggtggggttttttttttgtggaattgtgagggttttctacatatgagatcatgtcatctgcaaacagataattttacttctttcttttcaatttagatgcttgtccttgtctggagttatattttgatgccatgaagacattttatttatatgtaatgtttatatattttaaagatttgtgccaagggagtatacttaacaaaaatttaaatgactttaaaaatctttgccttactgctcttacaaggacttcctgtactgtgttgaatagaagtggtgagaatgggcatccttaccttgttccttatcttagaagaaaagctttcagttttttactgttgagtatgttagctgtaagcttttcatatatggcctttatgtttaggtcattttttcctattcctagtttgttgagagttttattttattttattttattttattttattttattttttagtttgagactaagtttcgctcttgtcgcccaggctggagtgcaatgatttcagctcactgtaacctccgcctcctgggttcaagtgattctcctgcctcagcctcccaggtagctgggattataggcacccgccaccacgcccagctaatttttgtatttttagtagagacggggtttcgccatgttggccaggttggtcttgaactcctgacctcaggtgacccgcccaccttggccccacaaagtgctgggattacaggcctgagccacccaggctggctgagagtttttatcatgagggttacaaaaacctgtcaactgtcctttctgcacctattgagattatcatgtgattttttttgataacatggatgaattcatttcttaagatttgagtgcaaacttaaaaacaagaacaaacaaagcttttcatcaaggataaacataaaatctaaacaattctgcaattgtgcattttaacagaaagtacaaatatgaatacattataatttgtaactgcatttaaaaactaaaatatttctctccaaatccaaaacaccacacaatctttaatctgttctcatcttgttaccctagaaacatttgtcatatgctatcaggaaaatataggcaataattactaatcagtttttcatgatcaaaggaacattattctccttaatggtgactttttgaatcatttatctgtatttcatttctgaaatatcataccattatacctccactctagagaaaaaaagaataaatacaaatatcaaggaggcaggaacgttcatggaattaaagcaaaagtcacaagtgtttgacttagaaatgtacatagtgtagcaaatttttaaagtacaactttagttgatggctgatgtgtatgtaataattgtgaacaatttaaacaggtataaaaatgtgagatcaaaatctttaggctcaaatacttatacacattttacgttagtcatttctttctattcctagtttgttgagaggttttttttttttttgagacagattttcgctcttgtcgctatgaatatggaaagatttgtttacataaatatctatatttttagatgaaaaatcaaggggtagtggcatcttcctggtcccttaactatatttggatttttgcaaagaattagtggcatccaaccttaagtgtgaattatgtgtttctaaaggacctatataacagattagttggcagtgttctaactttcgagagatgggggcggatcggaggtgcaaatatctgagataagtgcatatcatgtgatttttatcttttattctgtgaatgtgctattttacatgaatagatttttgcatgttgaaccgtcctggatttcccaaggatatacttcacttgtctttggtaaatgggtagtgatggtgtcacttagtcatggtgtatgatcctttttaattcttccttgtttctgagtaattttttagttgaaaactctctaatagtgggcatagaaaatgtgaaaatatttgttgttactacaattcagatgtgcagaaaatgttgctctttattttttccaaaatggatctgatcttccttaacaagtccctatccactagaagagaaaaaagtgtattataagcctagtcccatccataacacagtgcatctcaaagtatctgtggtaagaaattcttttttgttgttgtttgtttttaatttctaaccagttgcagatactttcataaaatccaagagaaatgaattactgggaaataaaagttctaaaagcatacaaaacataatcttatattttttatgattggtttcaataagcatgaaattattctgctacaagaacttctcaacacctaccctcaatttttgtacctttttcatcccatgccggcaacagtttgtggatgtgtcgcaatcctcagacccactctgagtggtttaaacagactccaagggcttaactagacctatcggttaagcagtgtctgggcctgtggaggaaagaggagagtttccatgctcagggacagggagaagagacctggtcttgttgcaggtctgtgggtggtgctggctgttccccactggggtgggcagccacatgatgtccatggctgatggaaccaagggaaattttttcttgacctgttaggaccaacgggctacctctcttgacttgggggaggacaggaaaccctttgggattctgccacagcctccatctgcctctggacaccatcagacacaggtcacttggttcccgccatagtgggccacttggctgccccgctgcccctcagcttagctatctagtggccacagtttagagccactagaccctctctgccacacgcagctcttccactctcttggtttctcagaggtcctctgtgttggtgaggaaccatccagcaaagtaatgttgccccagtagaaagcatgatgtgaaccctctgtcttctctactcacttcaatgtagcaaatgcacctccctctccctgagtctcagccaggagaggtgtattaagacccacacatctcatggctgactcctccttctgtagactacttatgtcccacagtcttctagggctggaaggagcaggcactactccctcctttttttctggatacaaacctctatggtttggtccttcaagcctggctcttggtatgccagtgggatagacaaagattgaaggaaccctttctctcaaaaagacttgactttcaagactcttgttttgctgcaaaaaaatcctgttttgcataacagaagttgaaaatgaatttttccttttctctgcattccttctgcaatattcctaagatccttggtgcatgaaaatgcagcaaagaaggctattattacaatcatctctgagggatgatagatcctctagctaatgtgtattcataggggtaatgtctctgattaatccatcagcaccattgtcacacagggaaacagataccctgaagaagaggactaggatgggtactgttgaaagagggtgggaaatctggcagggtatggctttctatggggcttcatgagcctgcatctcagaccctctttggcagatttgagtcaccaggagggacccaagggcaggaagtaggctacagccaagagatgggcaccaagaggaaacaggaaacacatgggacatccactttgtaattctgcacccagctcattcttcagctaagtactaagcttattcccattttctggctcttaaaccataacaagacctcttctgaaatattcctgaggaaaaggacctattttcttctctaaggaaaagccccaccaagtctccagagttgatcgcttccaacccatgtgtcatcttgtgtttatgattttcccatcagttttgctttaaaaattaatttttaataatctctaaagaaatgcgttcacccttatctttaaaatattcaaaggatcccctatccattctgtgcttttttttttttttcatgagcaaattacatctggcctctttcccgcctggggaataggcagtgatcatctgggatggagacttggctggttctcagcacagtcaagcggtgtagttttgtggtgagcccactggcctgggaattctaataaccctggcttcatgggtaatttggggtaagttattcattctgttcttcatctggctcctctgcaaaatggggcaaataataatatggcatgatttcgaagccataacaagatgatggaaatgaaagtggtcaccttcatctaaacatgaacttgggtgctgcaaaaatgcagaatgaaatgttatcattcttcaggggagtcatatttcatgaagacctctgtgttttaatcactaacttaaaagtaaaagaaggaaaggaaaaaaattaatgatagcagcctgagatgcatgggctacattctctgctgcttagagaacaagaaaatgcatgacactgttttgaaaagttaatcacggagggctttgaagggtttcatctagaacaagttgcaggtaatatgggaaaaagattggagtcatagcatctccgtgcattattggggttttaaatcctaaatcactacatacagtgcatattctggtttaggctacccaactggatatgttggcctggtttccttaccgtagcgctctctgttaataactaaacatgttggagaaaaaaaaaaagcagggcttttttcaaagttgcaagtcaatgtgctgtaaacatgggtctgaggttaggatattgaattccgtgaataacaacaatctgtcttactccattaatcagaggtttacaatccttacagtcttatgagccatagggccgtcactgataattctctgtcaaagagaaatggaatcatctagacatgtgcttaaagaggaatttttccccttgttgattttatgtaggaaacgattattagaaaatgttggctcccatggaggttcggagactgtgggaagagacctcatggtggggatagtggagatgcgaaagacacgtggagccttttggcagacagggctcagcaaaaagaggtccagcaatttgttgggcaaggtctctgcgtggtctcctctgggacctattccagagcagtgaaactaataatcctcaaattcactccctctcccccaggcgccattacgccatatttgaattatgttatcaaaaagacagacgtggattcagttctgatcccccaaactcttaaggaaacgtgccccttccctaatgggaaagtgtattcgatgacctgaaagttcacatgccttaaatctggccgccctactccccagtcctgggctgcaccctcgttctgtggagttctgagaaatgccgaagatgaggcaggtggcaaatgtggctccctgagagctaaacctgacatcaaaccaggagctcggctcagtgtttgtcagcaaaattagccttttcttgcagtgttatataaattttccatagaaatctggcatgtgtcaagaatatgtgtcaagaaggatgcctgttttcctaacttaggtgtaatcaccaggtgccctacttaaatttatgtgcaagggtgtaggcaccagagaaaactaccagctatcgctaagccaacaaaagccatcaattagggatgaaaagtgtgaagagttgggatggagttgccttccattaacacctctgatttggatccttaagatgacagaaccaccagtaaaacccatttccagtatctagaacaggtgtggtttcgcccctggaggacagccttggctgacactgagagaaggggctgggattgagtctctttggtgagcaacctcctagatgtaattctagagtcaattccagggcgtttcaccagagacctcaggtgatgtgtatggctgtggttgtaaaataatttcccaccaaagacgcccatgccctcatctccagaacccatgagtatgttatgttacatgcaagggcagtgaaggttgcagagggaattaaggttgctaaccaggtgacttcagaataaggagattatcaggtgagcccaatgtagtaccaagggttcttaaatgtgaaggagagaggcagaaagtcagagccagtgtgatgtgagtgagaaagacttgaccacctgttgctcactttgaaggtggagaaaggggccacaagccaaggaatgcaggtggcctttagaagctggaaaagacaagcaagttgattcccccagggcctccagaaaggaacatagccctgccaataccttgatcacaacccagtgagcctcatttctgacctctagaactgtaggataataacatttgtgtagttttaagccacttggttgtggtcacttgttacagcggccacgggaagctaacacagttcctcaatgttttcctctgattgacacaagttacacaagcacaaattttgctgtcctcagaatcattcacctcatggcatgtcaggttgagaacagaggttggctgcacccctcatgtgaatttgaggtgcagggggtcagtttgtctctcagcccagcccttgctgctgctgtgagaatgggcatgaggtcaccatcctctctccctggctctgttgaaagattgctgtctcaaacaccagagccattggtccttcagaaccaaccctgcaattgtattgcagcactatggtttccctttttcccaaatctttttttttttaaatatgcaactctgccttgttggaaagattcataaagcttaagatttcctttcctggtgttgtgctggtaaactggttctaaaagtggcagagtgctgtatatagcatttgcctatttccatcatggcaaatgtcaagctaccagcttaaggttgctgaatgcggagttggcaagagatgtccacagtctgcacagggtgggctccagccaactctgaacatcggggagagggctgtttatgtgccatgcccctgagccttcagaaagcccagtaccctgagagcaaattggcccctaccataaatagtgctgtggagtcttccaaagcagttgtgctttgctctacagctggtgctataaaaaagttctctcatcccccttgccacagctgctcaagatccatggaaattcagaagagccaaggagcagagtcacaagctgtcataagttgattacagacattgggaaccagtggtcagagccagttttaactccagatggtactttctataaatcttttgtcctttttacagttattttttagtctagtttgtttccagacataagtctagtttgaaaaccattgaaacttgaagccatcagtcttattttttatcatattagcatgtctaattttatatctatcatacagaaggaagttagtaaatcccacttctaccactgcctataccaggatctacctgttagtaattcagtatgaaatacttaaaccagtttgttggaggaatcttaacacacatataggagatagcatatgaatgtaataatataaccactaatttgatgataacaaggcatattttataggattgttagaaagattaagtgaattaatatttgtaaagcactcagtcaacagtaagagtttgttaaagaaatagaaaccagtaaatatgacttcttaaaattgagaacttagatctctgacttaggaggagacttagtcaaatatcacccagccctatgaatgcaaatctcagcatcactagatcacttctcccttccggttttcacagaagctttttttctttttggtgacttctcagtcgaactggacccatgcaatgactctgtcctctgagttgaggccctggggcctcacggtcactgcagcccctctgcacaagtgcttgctcttacaatttatgagatgcttcttgcagctgctccctcggaatgatttagatggccttggcttgatcccttccaaatgtgggcaccagcaggctgccatgtgcaaaagcgttttcttatgtgcacatcaagacaaaacagagaaccaaatctccaaaacctaaatgaggtggcccattcacttctagccccactttccctccaaattcaccccaaaggccaggtgagagctcagcctcagcaggccctgattgctgggttcaggaccataaatcagggggctcacgttgatgggtgaggaggccggaagacatccgtctgccatcgggaagaaggaggtgcttgcggccactgggctgattacaaactcgtaagctcctgggagtgtcaagtttgggataaaaggaaaaggcaaacatgaaagatgctggagctacattttccagggcatatcttcatcccatcgtgaattgatctgtggccctggattgcatcaagtacgtaatacctcaaagtcagcgagaaaagacaggctgacattcaggactcaccaactattaggcggcttggaggcagaagcctaccctgcctcacgttggagctttgagggcatgcacattcacatagatgaactcagagaaggctcttgcctagaaattgaatccagtttctttttcctgtatttgttttgcaatctgcccttggaagggaaagttgatgtagaatagcaataaatctccaaggcacatcgcttcaattaagagatagagaagcccagaggggcccaagagctccaaggggagccaaccgcagattaatggatgctgaagaatgctgccttccaagacgggaactggctgatttatgtctattcacatattctgaaggctttaactcaggggccttccttaattacagcacgattacatgaccactttcatttagggggctgggggtgaaagagtctgtttatttgattgagctttaataacctagctctttattacaatgctcttggtgaaagcatttttgtaaactgagaacagtttccatttagtgccctgggttgctctcgtctctagacccatatacatccactttggctgttcttcatatgcaaaacatttgaaactgtccaggctccattcacctcaaatcccaggggtctgagcaaaattaccctggccatttagtttatggaagggggaaggagggaaatcaatgcatttcctaggataagccaaagtcattcattttttttttcatacatttgtttcaatcaaagggcttttatttagtaccatttatttagtacctactatgtggacgtttaacctactatatgagattcacaaataaagatgtttccttttctcatgagctcacagtctagtagggaagacagacaagaaaatcaataattatggaagagcaagaggtctagagaaaggcaaccgggaatggttcggagaagcgctctgggatgagagggccctagagctgaatattaaaggacaagtgggaggttacagagtggatggggtaagccagcttgaccaggcagaaacttggtttaccgaggaattgcaggtcacctgggctggatggagcatgggtggtggaaacggagctgctaaggtggacaaagggttctacttgacctgtgtgacctacatgggatgccctgctcagaacttccttcaagaaagccttccttgccccactttagggtccacctgagcttttgagccaaggtcatgctgatttcagcattgccccagccaacccctgagcaataaggaggcacgaagtcccagctaggaaaaaaatgccaccagtgcggcatcttctatgggcagtctttgctctggagccctctgtctttccctagagcccctggcatggggatggggcagtgggggacagttccgacaaagtaactgcaaacatgcttttggctgatgacaaagcaagatgttaaaagcctaggctgggcaccatggctcaggcctgaagtcacagttacttgggaggctgatgtgggaggatcgcttgagcccaggaggttgaagctacagtgagccatgatcatgccactgcactccagcctgggccacagagtgagaccctgtcccaagaaaaaaagaagggaaatattcatttttctacaccctctttcctcttctcacagacacgccacatatgcctttcattcctttaacagttcagactggggctgtcagtatgatgccactgaacaggccatttgtatggcattgactgtcctttgaatccaataacccatcaacttatttgattaaccagtttgacttttttattattcatttctgaattgagtggttctactggatttactatgctctgctgtcttatagccctaaagttacatgagtgtggtaaagccatttccaccagtaaactacaaataatatggcatttacaatataaggacagtgaattattttatttcaaaacccccagataatgaagtcaatgtcttactctaaaaattagtaaatagtctcggggtgggggcgtggctcacgccagtgatcccagcactttgggaggctgaggcaggcagatcacaaggtcaggagttcgagaccagcctgcccaatatggtgaaaccccatctctactaaaaatacaaaaattagccaggcatggtggtgcatgtctgtagttccagctactcaggaagctgaggcagaagaatcgcttgaacccgggaggcaaaggttgcagtgagctgaaatcgcaccactatagtccagcctgggcaacagagtgagactccgtctcaaaaaaaaaaaaaattaagtaaataaagcgaaagtgttaggctatatatcagcattacaaaagaggcttgactttgagggaacactcttcattctgaaaaaatatgatcgctaactaacagatgtcaaatgaattatcaaattagaaaaccaccattttgtaaccttgaatgaattaactgattcggtccaggatcattaacggatgttacaagtattcagggaagagctgacggagaacctaataacccgcagaaccaaggtcctgtctcacaaatcatctgctggtcatgagggtgggaagatgcctttgtaatagggagagagagccatgggcagcctcccaacccaagcatcaatcttggaatcactgagtgtgggtagcctggcactgatgtgatacaatacaaaatgtacaacttcagcagtgaaggcttcttggcaaaaagtgtttaacctgaatttaatctgtgaacgcaaaagtatctgagacaggtctcaatccatttagaaagtttattttgtcaagtttaaggacacacctgtgacagagcctcaggaggtcctgatgacatgtgcccacggcggtcagggtacagcttgctcttacactttttatggagacacgagacatctattaataccagtaagacgtacactgatttgatctcaaaaggtgggacaactccggggatggctttcaggttataggtagatttaaaaatttccttattggcaattggatgaaagagttattatttaaaaacctggaatcaatagaacagaatgtctaggttatgatgataagggattgtggagaccaaagtttgtcatgcagatgaagtctccaggtagcaggcttcagagggaatcaactgtaaaaagtttcttatcagacttaaggtctgtgttgatgctaatgctggtcagcttttcctgaattccaaaagggaggagggtatgatgaggcatgtccgactccctcttcccatcatgacctgaactagttttttaggttgactttgggatgcccttgcctgagaggagggttccattcagatggttgaggggtacttaaactttcgtttttggtttacaagtcaatcttaagatctaacttccaatgtacagggaggaacaaggacggcaaacaaaatgcatggctgtaaatgaatgtattcttattttttagaattatggacatatatatattatggacatatataataaattaaaacaaacaatagattggcataaatatagaaaactacaaataattatttaatctggttggtgagtacatgagtgtttctcatgctatgtgctcttctcttctgtgtgtttaaatttttttacaatgtaaaataaaaacaggaggatgctgtaagaagaatattttaaaatgaaaacttctaaaagaatacatcccctttttaaaattttttgagatggagtctcgctctgttgcccaggctggagtgcagtggcgtgatcttagctcactgcaacctctgcctccccggttccagcaattctcctgcctcagcctcctgagtagctgggattacaggcactcgccaccacgcccggctgatttttgtatttttagtagagacagggtttcaccatgttggtcaggctggtctcgaactcctgacctcatgatctgcctgcctcagcctccgaaagtgctgggattacaggcgtgagccgccgtgcccagcctgcatctcctttttaccaaacattctaatgacactgtgtagaaagctgaatgttcttggaggttttgtgatattactggcttagattagaaacaactgaagttggaaaaataagccggttagagcacagaaatgcataggacattcctcccaacaccctgctgcagtgcattaataaaagtagttatgtcatgtgtggttaacagtatgtaaggttgtgcaatgaaggtgcttttaaaacctgctcctacctctcttgtaatgcagagctcatacaatgtcatgtggaggtttgctagctgttatttctattctttgtccacatcatggtcagtggtgttcagagtgacttacgaaatcccaagcgaacgtgcccttcaatgcttagaaacactcttaccttcacatctaaggttgcaaaccccaggtttcagagcagttcttagagttggaaggtttccagtgagatgaagggggtggtgcgtgtgaaggagtgaacttcaaacccacccataaactgaaaagatggacgctcttggaacgtagcgccttttgcaactaagaacataccgttacctccaagtgcccggattgatggagacaagccctgccaaattccattctctcggctggaaattccaggatagtgctggtaccggtaagtgacattttcttggaaagtcaccaggggttataaagtacttccccaacccctacgtttctaaggtatgaaaggtaaaggtcagcgtatagaaaatttaaattatcactaaaagcatggcagtggatttaactaagaaaaatccaaaaaggatagagttcaactgagtcattgcaagcccgtttcttaaggactccctccccactccgtgaaataagatctagcaacggaattgccaactcaaagtctcactgaaacacaacaggctttattttataagtgtgttctttatgattctgtaatctgtagcgtacaggggaacctttttgcaattttggtgccgatgctctctgggcttgttatccaaggcttttactgcctgtagtttggtttggtttgttttgtttaggggtcgctatgtaattccagccctggcgtaacctgaatctgtgcagggggcttgtgtgggttgtgtgtgtgtgtgaactgcgcgtgctccccaaacaggaagaccccaagggtgtaccatgcagccttctgtcatgagagtaatgtgaccctttgtgcttggtgctctgggtgaccttccctctgcggagtccaggtgtggggctgtttctccagccaccaacctctaccctccacccaggtctgcatgctggcccaagattgaagaggaaaacttggtctttgtagcaccacacttagccagctgacatgaaagatttactgccatcccttaacccattacatggtaataaatggaagttggcatcatttcttatcagtctaagaattttgaactctggctaaattcctttttctataatcagagggtgtagaaaatcacatttgttttttaaacggatgctttggaagaccctggtcaaaattgtgggctctggagtctgaaactttgatttaaaccttgactctactgcttattaactttgggacctgacatgtgacttaaactaagctttagtttccttgtttgtaaaataggtctattgatgagatggtgcatgcaaattgcttagctcagttcctggtatatagtagatgcctcctaaataatagctattactatttccaatcttgcgcttccctgctccctgccaaaactgaaaatgtgatttaccaaatgacaatcgcagggttatttcaaaacagtgtcttctatgtacgtataggaaatacactgtaagaattggaggggaggccgggcgtggtggctcacgcctgtaatcccagcactttggaaggccgaggcaggtggatcacgaggtcaggagatcgagaccatcctggctaacatggtgaaactccgtctctactaaaaatacaaaaaattagccaggcgtggtggtgggcgcctgtagtcccagctactcgggaggctgaggcaggtgaatggtgtgaacccgggaggcggagcttgcagtgagcagagatcatgccaatgcactccagcctgggtgacagagcaagactctgtctcaaaaaaaaaaaaaaaagaattggagggaaaattacaatactaggtattaagactacagttactgcaactcaaaaagtatatagaaaagggtgtgaattataagtagttacaaagttctggggcccatttaagtctgggtattatgtagaagcttaaccaggtggttgtgaaattttgcaattgatatgaaatatttatttcattaacttttctctctataaattatcctcatcaaaactatcaacaccactactataaaacttttagaagcaaagacctattaatacatggtgaaaactacaacacttcagtttcttaatttatttactatctaattagtcttaaattatttattttatatcaagaaaaatctatgaatctacaaaactatcactagaattatgtggatttaacaaggctataatatacaaagtcactatacaaaactcagttatatttctatatgccagtaacaaacactttgaagtgaaatttcaaaaatcagtaccatttacaatgacattaaaacttcaaatacctagggataaatctaataaaatatgtataagacatctacataaaaactataagacatttctgaggaaaatggaagaggcctaaataaataaagggatataccatgttcattgattggaagacttaatattgttaagatgtcttaaacttattcattggttctatacaatatatatataaattacagcaagtttcttttaaagaaataaatgagctgattctaaatgatatatggaaacatgaaggatctagaatatctgaaattattttgaaaaaaccccacagatttggaagacttaaataatatgagttcacatatgataaagctacagtagtcaagatagtagggtactggcataaagacggacatgcaaatcaactgaattaactaaagagttgctcaatagaccaacaaacacagtcaactgatattccacaaagatgtcaaagtaattcaatggagaaaggaaagtttttgtaataaattttgctagaactaggtatgccttattcatacaatggaatactatacagaaataaaaaactataaactgcagatacagccaacaacacagatgaatctcaaatacaacacagtaagcaaaagaagccaaactccgaagaaggcatagtttgatcaattcatagaaaattcaaataagacaatactaatctatatgtataaatatctacataaatcagaaagtgatgggggagaggaaattgactatcaagggctcaagggaactttctggtgtgttcaaaaatgttttatatcttgttttgattggtggttaccaaagtagatacaattctgaaagattgttgaactgaacccccggtagctgtgtattttatttatgttacttatacctaaattaatttttttaagtaagaaataaaaattccttagaggaggaaatgtggtagaataatttcccaccacagagaaccatcttttccatttatcctaaatgacaaagctttgattgaattattttacatccctgttacatttctctaggatccaggccatgaaagtccttaaagctatcaaaccagtttccaatgcttccttccctccaccccaccctgtcccctgcatctttagatactggcagagatgattttaagaaacaaaattgcatttagcagtaaaaatcaaactgaaaaacagacacacttgtctctccctaagaataaaaatggatagagccacctcactgcattatcttcttaaagaattctcctctattctctttttatggaattgaagtttctacttttgcaaatgaatcctgattaccaacgccggtcatgctgtttgctgtctcatctgccgtcatgcagtgtgcaggaccccttggtttactcctggcttctctcttggttctatcggctctaacttaccctgaggcttaggggtgccaaactgtgatactcagcaaatgatagctaataacatgaattgagcccttcctacatgccaggttctatcctatatcatttacttatattagctgaattgtatctccacaattctcctaagaggtaggaccatcattattcccattttacagatgaggaaacagaggcacaggagggtgaagtaacttctatcgagtatgtgtcagggttagggttttgactctagatagcttatctcagaatccatgtctttgtcgcaatgtcatgcaacctcactaatgctttagccaaagggaacaaaaaaaaccacaagcaagtgccactgctgtgcactgtgtctgataatgaagacagtcttggcaataggtacagtgctcgcatgaaacatggacaatgtttatcagcataagtaggcactcacaaatgtagttctgatttcatagaagcttatggtgttgaattttattacattgcagctgttgatgtcattcctctggatttatacctggtttcactgaactacctagaggaagaagccttcttgcttttggggcataaataagagcatcacccgccttccagggagatgagctcatagaccctgtatacgacctctttagagtttgttaatggagactgtaacgacatttctgcagtgactcccgaagaccctcgcaccatccagaaacgcattgaattttatcttttctttggaaatcgatcttgctattaatctacttgaaggcaaagtctgtgtaacccaaaattatcccatttccatgtactcagtaattaaaaaccaaccaaccatcccctcttaacaaagtgaggtaagaatagaagtatgttttgctgacattctctcaagcccagatatataaacctgcctagattctaggcagtcagggtcacttaaaacaagctggtgaactaatcattgacacccaatctactcattacaacacatagaagtttctctctctttccttacttccatctttctttctttccttgaactccttgcccaccctacacctaactcacctgcctgctctaattatttaaccttccatggttggcagaaactcaagccttgaaataaaactaagccgagatgtaatttacaagttgtgagtgccactcaccgtgctgctgtgtcctcagccaagtccagtgctatatctgaaagttcttccggagctcctcttgaacatcttactccctctcttggcaggtgcctggctcgtgacttctgcctggctgggctgcctgcctctctcagcttttcccagcttgccctcccc

SEQ ID NO: 667 - DNA, 5820 bp, Homo sapiens
ttcataaacagccacatccgcaaggtttattcctggatcacaaaccaaccccactgaccaaactcccaagtcactttatattaaacttgttatcaaatcacccacataaatatatataataaatacaaaaacagacaggattttttttttcagtctttggtatagagagctttctcctcctcttatttccccctctgtccctgtgctctaaagacatttcctcgcattcacattatttccttggatacaaaaattgcccagaagtaaactttgtgctggaacccctgcctccattgacagtcccgccggggacccagcccacagcagcccaggggagaagcaggctgtggggactcacacgtagtcgttcagcctgtacccgctgtgcgtggccgaggtcactgagggggcccgattgtctttgtaggcagctggtggctggtaggcaggtgcggtgtttgcagtggtcgtggtggccctgggcggggcctggtagggcctgtagggtgcctcgtcctggcaggacaggcaaagcagggtgccaccaatgagcgagagggacgaggagatgaagcccaggtacagggcctggccaatctcaaacttcatgccgctgggcagcagcgggttgtagaagttctgcaccacgtcgttggtggtccaggagacggccaccatgcacaggaggccggccaggatgaagagggtgccgccgaggatggcaaaggtggtcttggcgggtgtgcccttggcgcagcgcgtgcacttcatcccgatgacggcgcaggcgcaggctatgcccgagagcaggcaggagatgaccatgagggcgcgggcagcctggaggtcttggggcagcgccagcagggatcggtagatctggcactggtagatgcctgtgctgtgccacacacactccatccagagccctttcaggtaggacacggccgtgaggatgttggtgcccacgtgcgctgtcctccgccagtgcggcaggatggtggtgatcaacgtgcccaccatgcccaggaagctgagcaggaagcccagaagctgcacggccgtgctggccatggtgcggctgcctgcctaggccagccgggcagctccctgggccctcggggtcacgccgctcctcaggtgccagccggagccctaatgaagccaagggaggcgggagcagggagagaaaggaaatgggttaaagattatctcatgcacttatttctgtcaccgaaaccaagtttttcataggtggttggtgtggcaattagcatgttctcaaaaatagtttctgagacttcactgggtgggagagtaactgctttcctgggaaggtgggatctgaagggatgacagccggacgctggcctcagggaagggttccagccacctgccggaagttctgcttatgtccacccttgagcactgctgctgcattggcatctcctgtccttcctggttcatcagtaaccaggaataacagttgttaaatcaacatgtattattcatgccttggactgacagtgctaaggtgtgtgccagctgtgacttagaatatagccctgggcggttgtcaggatgaggggttttctgaagtaggcaacttccccacccacgtgctcgggcagggagaggtttagtcccctcggcaagtcagatgctgccttcagaattccagagctggatgtgacctagagattgtcagctgatgccggggcaggaatttccaaggtcacagctcctcaggagctgcggcaggagcacgggccagcatccctcctctccagcacggacctccgctcccaacacgctccccattcactatgcctgcttgtgactggtgagggctgtccgagggtgactttattataaaacagaggctgctacctggctttcagggatatgggaatgctgagccctttcaaaggcttttaaagaattcttagcataccaaaatccaggatactttttcgggacaaggacccagcatcaacatagggccaggcatatagaagacactaagggccaggcacggtggttcacgcctgtaatcccagcactttgggaggccgaggcaggtggatcacctgagttcaggagttcaagaccagcctggccaacatggtgaaaccccgtctctactaaaatacaaaaattagccaggcatcccgtaatcccagctactcgggaggctgaggcaggagaatcgcttgaaccaggaaggctgaggttgcagtgagccgagatcgcgccactgcacttcatcctgggcgacagagtaagactccgtctcaaaaaaacaaaacaagcaaacaaacaaaaaaaaacactaggaaatatagaaggaaggaaggagagagggaagaagaggagggagggaggaaggagaaagcaaggaagggggagcacagagaaaggaaggaaaaaaaggaagggatgaaggcagaaaaggaagggagtggaagtcttgagtggaccactagcttttctctcctgcctggggcaaggtaatcagcgagaccgggcattagcagcgagcattaggaggtcccagccctggctgcgcccatccagtgggcgacctggggctcagcttcttttttggttctgaagggagaaaagggaagcgtctctgctgatgacaagtcacttcagcgtcccaaaccagcaaagaatcagtaggcaaaacctgcttcttcttctgcagagagctgagcctcagttaagcagtgcaggctgcaggcaggaaaagcgggtctgcagggtgttgcccatgagaccctgggacattgtcaagaaatccccatcggggctcggcggctcacgcctgtaatcccagcactttgggaggctaaggcgggtggatcgcttaaggtcaggagtttgagaccagcctggccaacatggtgaaaacctgcctctactaaaaatacaaaaattagctgatcgatggttgtgtgcacctgtcatcccagctactcaggaggctgaggcaggagaatcgcttgaaccgggaggcggaggtttcagtgagactggatcatgccattgcactccagcctgggcaacagagcaagactctgtcttgaaaaataaataaaataaaatgaaataaaataaatcaataaataaatcctctactagatgtaaatcacttggtaagtaaataattaataactgatgcttccactgggagtctaaaccatcatcttgctaatttaaaaacatatactgggtttaaatactttggcattgtaggaggtaattggttctgtcctggtgaatgaacaaacaaaaataaataataacaaaacaacgtggtgcctcacaggacacggagtggactgaaggtgtgtccaggtgatagggtttggatttgtgtccccacccaaatctcatgtcgaatggcagtccccagtgttggaggaagggcctggtgggaagcaaatgaatcacgggggtggacctcccccttgctcttcttgtgatagtgagtgagttctcacgagatctggttgtttaaaagtgtgcagcacctgcctgctcccctctctctcttcctccttctccggccgtgtcatgcctgcttcccctttgccttctgccgtgattgtaagtttcctaaggcctccccagccacgcttcctgtacagcttgtgagagccaatgaaacctcttttctttataaattaaccagtctcaggtagttctttgactcaggttgcattgcgagaacggactgatacaccgagtatttttctgctgctgtttttctgctgctgctttgggtgactatttgttcacagcccagaatttgccacacgcactatgcacgatgctggctttgcacaaagcctctcttccctccactcagcaagcactcactctgtccaggggctagggacgccatcacagtccctgctggccagagaaggaccggggccggctgtcctatgctcactgccctgggggaggtgctggcaacaaggccaaggtggccaccctgataggcacagccagagggggtgccagcggacccaccctgcaccctgagcacaccgatggcaccagctgactgagcctgagcatggtttgaacactgacacatttcctagtttattcccaacaacctaatgtggcagtgactgttaccatcccctttttacacatggggaaacgagaggagcagaggatgaaagttctgtgcctggcctggctagtgttctccttgctgtcatttcccctttaagaaacactacctgcttcaatgacataggactgaagttagtgtaagggctgagggatggtgtgagcaacagattctccttcccacagagatctcagaacaatggccttgccccttttgcagtggtttgggcagccagggcaaccaactgccctgctttgctagggactgaggggttgcccaggacagggaccttcagggctgaaactaagacagtcccaaggaaaccaggaccagaggctcctccaggtgcccagatctccgaatggcctctgagatctcttcctgccctgctttgaggctgcctcaaggctgacggccacacagggtgtccctggtccaagcataatggggcttcttgcagctctcactgtcaaggtcaataattaagtatacagaccctaaagaatgtggcataaaagccaagcccattaggctaggcaagtggaccagaggtttattggaggtctaaatatttatggagagcaatgatggctaattttagaaaccattaggttgctatttttaaacgtgtgctataaggatttgctaatttaagaagtgagtgttaatgagcccccaactcccagacacaagctccccaacctgctttccttcttccttaccagcagctgctactggcattaggtaataattcaacttccccgcaactacttttcactttggggcctttcaagggaaaaacaactttaactgaacgcatctccctggaagccacataaaattcctccgtgatgctccggaagcgccctgccctgcagggctgtttgtataggaaggaactagcccaagcctggcctcccagggggagcagcccatgcagggctgaactggtgttcacctgtgggctaccattttcctgcagccacgtgtgtgcatgtgggaagatttgctagagagatacggatccaaaacaaatagggttccaagcatcaagctctagaaagccctcgacaggctgagtagtggtgggaaggcagaatctaacaagatgtgttagaggatcagtactgggtcctgcatttgggttcacaaaaccccaaaagtacaatcctgggtggggagtatgtggcttagctgcacctgagagcaggatttagggctgagtttcccaacgacagcatcttggaatgctgcatttgcaggatgtcttgtgtggaggacacaaatgtcaaatatgtttaagaaaacctgcgtgactgtaggacttctcatagctggaaacgtgtcaatgtgcatcgtgactctcccaggaaatgtctcatgggcagcatccgctaaacttatttgactagagacacccccctgcaccccctttaccaaagaacaatttgcaatgaaatcactttggcacaataacttggacttggcaatggtgagatagagtgggttgctgtattagtttgttctcatgctgctatgaagaactgcccgagacgggtaatttataaaggaaagaggtttaattgactcacagttccgcaggactggggaggcctcaggaaacttacaatcctggcagaaggtgaagcaaacacatcctctttaca

SEQ ID NO: 668 - DNA, 19469 bp, Homo sapiens
ttcataaacagccacatccgcaaggtttattcctggatcacaaaccaaccccactgaccaaactcccaagtcactttatattaaacttgttatcaaatcacccacataaatatatataataaatacaaaaacagacaggattttttttttcagtctttggtatagagagctttctcctcctcttatttccccctctgtccctgtgctctaaagacatttcctcgcattcacattatttccttggatacaaaaattgcccagaagtaaactttgtgctggaacccctgcctccattgacagtcccgccggggacccagcccacagcagcccaggggagaagcaggctgtggggactcacacgtagtcgttcagcctgtacccgctgtgcgtggccgaggtcactgagggggcccgattgtctttgtaggcagctggtggctggtaggcaggtgcggtgtttgcagtggtcgtggtggccctgggcggggcctggtagggcctgtagggtgcctcgtcctggcaggacaggcaaagcagggtgccaccaatgagcgagagggacgaggagatgaagcccaggtacagggcctggccaatctcaaacttcatgccgctgggcagcagcgggttgtagaagttctgcaccacgtcgttggtggtccaggagacggccaccatgcacaggaggccggccaggatgaagagggtgccgccgaggatggcaaaggtggtcttggcgggtgtgcccttggcgcagcgcgtgcacttcatcccgatgacggcgcaggcgcaggctatgcccgagagcaggcaggagatgaccatgagggcgcgggcagcctggaggtcttggggcagcgccagcagggatcggtagatctggcactggtagatgcctgtgctgtgccacacacactccatccagagccctttcaggtaggacacggccgtgaggatgttggtgcccacgtgcgctgtcctccgccagtgcggcaggatggtggtgatcaacgtgcccaccatgcccaggaagctgagcaggaagcccagaagctgcacggccgtgctggccatggtgcggctgcctgcctaggccagccgggcagctccctgggccctcggggtcacgccgctcctcaggtgccagccggagccctaatgaagccaagggaggcgggagcagggagagaaaggaaatgggttaaagattatctcatgcacttatttctgtcaccgaaaccaagtttttcataggtggttggtgtggcaattagcatgttctcaaaaatagtttctgagacttcactgggtgggagagtaactgctttcctgggaaggtgggatctgaagggatgacagccggacgctggcctcagggaagggttccagccacctgccggaagttctgcttatgtccacccttgagcactgctgctgcattggcatctcctgtccttcctggttcatcagtaaccaggaataacagttgttaaatcaacatgtattattcatgccttggactgacagtgctaaggtgtgtgccagctgtgacttagaatatagccctgggcggttgtcaggatgaggggttttctgaagtaggcaacttccccacccacgtgctcgggcagggagaggtttagtcccctcggcaagtcagatgctgccttcagaattccagagctggatgtgacctagagattgtcagctgatgccggggcaggaatttccaaggtcacagctcctcaggagctgcggcaggagcacgggccagcatccctcctctccagcacggacctccgctcccaacacgctccccattcactatgcctgcttgtgactggtgagggctgtccgagggtgactttattataaaacagaggctgctacctggctttcagggatatgggaatgctgagccctttcaaaggcttttaaagaattcttagcataccaaaatccaggatactttttcgggacaaggacccagcatcaacatagggccaggcatatagaagacactaagggccaggcacggtggttcacgcctgtaatcccagcactttgggaggccgaggcaggtggatcacctgagttcaggagttcaagaccagcctggccaacatggtgaaaccccgtctctactaaaatacaaaaattagccaggcatcccgtaatcccagctactcgggaggctgaggcaggagaatcgcttgaaccaggaaggctgaggttgcagtgagccgagatcgcgccactgcacttcatcctgggcgacagagtaagactccgtctcaaaaaaacaaaacaagcaaacaaacaaaaaaaaacactaggaaatatagaaggaaggaaggagagagggaagaagaggagggagggaggaaggagaaagcaaggaagggggagcacagagaaaggaaggaaaaaaaggaagggatgaaggcagaaaaggaagggagtggaagtcttgagtggaccactagcttttctctcctgcctggggcaaggtaatcagcgagaccgggcattagcagcgagcattaggaggtcccagccctggctgcgcccatccagtgggcgacctggggctcagcttcttttttggttctgaagggagaaaagggaagcgtctctgctgatgacaagtcacttcagcgtcccaaaccagcaaagaatcagtaggcaaaacctgcttcttcttctgcagagagctgagcctcagttaagcagtgcaggctgcaggcaggaaaagcgggtctgcagggtgttgcccatgagaccctgggacattgtcaagaaatccccatcggggctcggcggctcacgcctgtaatcccagcactttgggaggctaaggcgggtggatcgcttaaggtcaggagtttgagaccagcctggccaacatggtgaaaacctgcctctactaaaaatacaaaaattagctgatcgatggttgtgtgcacctgtcatcccagctactcaggaggctgaggcaggagaatcgcttgaaccgggaggcggaggtttcagtgagactggatcatgccattgcactccagcctgggcaacagagcaagactctgtcttgaaaaataaataaaataaaatgaaataaaataaatcaataaataaatcctctactagatgtaaatcacttggtaagtaaataattaataactgatgcttccactgggagtctaaaccatcatcttgctaatttaaaaacatatactgggtttaaatactttggcattgtaggaggtaattggttctgtcctggtgaatgaacaaacaaaaataaataataacaaaacaacgtggtgcctcacaggacacggagtggactgaaggtgtgtccaggtgatagggtttggatttgtgtccccacccaaatctcatgtcgaatggcagtccccagtgttggaggaagggcctggtgggaagcaaatgaatcacgggggtggacctcccccttgctcttcttgtgatagtgagtgagttctcacgagatctggttgtttaaaagtgtgcagcacctgcctgctcccctctctctcttcctccttctccggccgtgtcatgcctgcttcccctttgccttctgccgtgattgtaagtttcctaaggcctccccagccacgcttcctgtacagcttgtgagagccaatgaaacctcttttctttataaattaaccagtctcaggtagttctttgactcaggttgcattgcgagaacggactgatacaccgagtatttttctgctgctgtttttctgctgctgctttgggtgactatttgttcacagcccagaatttgccacacgcactatgcacgatgctggctttgcacaaagcctctcttccctccactcagcaagcactcactctgtccaggggctagggacgccatcacagtccctgctggccagagaaggaccggggccggctgtcctatgctcactgccctgggggaggtgctggcaacaaggccaaggtggccaccctgataggcacagccagagggggtgccagcggacccaccctgcaccctgagcacaccgatggcaccagctgactgagcctgagcatggtttgaacactgacacatttcctagtttattcccaacaacctaatgtggcagtgactgttaccatcccctttttacacatggggaaacgagaggagcagaggatgaaagttctgtgcctggcctggctagtgttctccttgctgtcatttcccctttaagaaacactacctgcttcaatgacataggactgaagttagtgtaagggctgagggatggtgtgagcaacagattctccttcccacagagatctcagaacaatggccttgccccttttgcagtggtttgggcagccagggcaaccaactgccctgctttgctagggactgaggggttgcccaggacagggaccttcagggctgaaactaagacagtcccaaggaaaccaggaccagaggctcctccaggtgcccagatctccgaatggcctctgagatctcttcctgccctgctttgaggctgcctcaaggctgacggccacacagggtgtccctggtccaagcataatggggcttcttgcagctctcactgtcaaggtcaataattaagtatacagaccctaaagaatgtggcataaaagccaagcccattaggctaggcaagtggaccagaggtttattggaggtctaaatatttatggagagcaatgatggctaattttagaaaccattaggttgctatttttaaacgtgtgctataaggatttgctaatttaagaagtgagtgttaatgagcccccaactcccagacacaagctccccaacctgctttccttcttccttaccagcagctgctactggcattaggtaataattcaacttccccgcaactacttttcactttggggcctttcaagggaaaaacaactttaactgaacgcatctccctggaagccacataaaattcctccgtgatgctccggaagcgccctgccctgcagggctgtttgtataggaaggaactagcccaagcctggcctcccagggggagcagcccatgcagggctgaactggtgttcacctgtgggctaccattttcctgcagccacgtgtgtgcatgtgggaagatttgctagagagatacggatccaaaacaaatagggttccaagcatcaagctctagaaagccctcgacaggctgagtagtggtgggaaggcagaatctaacaagatgtgttagaggatcagtactgggtcctgcatttgggttcacaaaaccccaaaagtacaatcctgggtggggagtatgtggcttagctgcacctgagagcaggatttagggctgagtttcccaacgacagcatcttggaatgctgcatttgcaggatgtcttgtgtggaggacacaaatgtcaaatatgtttaagaaaacctgcgtgactgtaggacttctcatagctggaaacgtgtcaatgtgcatcgtgactctcccaggaaatgtctcatgggcagcatccgctaaacttatttgactagagacacccccctgcaccccctttaccaaagaacaatttgcaatgaaatcactttggcacaataacttggacttggcaatggtgagatagagtgggttgctgtattagtttgttctcatgctgctatgaagaactgcccgagacgggtaatttataaaggaaagaggtttaattgactcacagttccgcaggactggggaggcctcaggaaacttacaatcctggcagaaggtgaagcaaacacatcctctttacatggcagcaggaaggagaagaatgagggctgagccgagggtgaggccccttataaaaccatcagatctcatgagaacttactcactatcatgagaatagcatggtggaaaccaccgacatgattcaattacctcccactgggtccctccccacgacacgtggggattatgggaactacaattcaagatgagatttggatggggacacagacaaaccatatcattctgccctggcccctctcaaatctcatgtcctcacatttcaaaacacaatcatgtccttccaacagtcccccaaggacttaactcattccagcattaactcaaaagtccaagtccaaagtctcgtttgagacaaggcaagtcccttctgcctatgaatctacaacatcaaaagcaaattagttacttcctagatagaatgggggtacaggcattaggtaaatacccctattccaaatgagagaaattgaccaaaacaaagaggctacaggccccatgcaagttcgaaatccaatagggcagtcattaaaccttagagttttggtcgacttcatccccagcagagagagtatcagaaaacgacagagcggtaaagaattttgaaaatctgtgaaaggcaattgtgaaatgctagagctgctataggcccttccaactggctctggtttcaggatcaccagctctgaagggagggggtttttctgtgtgtgtccatataaacttttatgttgtctccctctgttttctctgagctatgtttttctttaaaaaagcagggttctggagcacacagtagggtgccctcattttgctcacctcctggcccacctggaccccagctgcgtcaactttggctccaaattaatcatcatttcaacagcagtggccatggggatcgcctggccaggactgaggggtggacgtgttgtttaccagcctgcgtcttgactgcctggggtccctccctgggcatgtctgtttcatccttcactttgtcctatcttcagaagtcctttctctagttcttcagggtgtgtgctggggcctctgtcagtccaggcttcttggaggggtgcgggggtgggacgaggccaccctatctcaccattggtccaagtgactgtgccaaagtgattttactgcaagttcttctttggtaaaggcggtggtggggggtgtctctagtcaaataagtttaatggatgctgcatatgagaccaggcttcttggaggggtgcagggatgggatgggtggggtgtttgagtcccttactctccttaaccctcagcagtctcacctgctactgtcacctcatcccttgcaaaatcagcccctgtgatgaaagctttcctatggacacacattgctccgtggcccttgtctacccaccttggtgaaagaaatgtcagccccagatgggaggggtggaggacatcagcggggagctggggcacaagccaggtgtgtggtggaagtttctttacccagaactgccctgagccctactgtgcaggtagagaattggaggatgtggccaccagtgccttttgcctgccatgtggtctgaatggctctcgagatgtttgggaacgagccattatatatgtttgccctcaaatgctctgacatgatgttgggtccattatagaaacagcgtaaaacttgatttgctttctgtaaacttattagagaaaaatgaagtgccaccttcaaatgaacatagtcattggcccttcaacgttgatgttcagccacttcagaaaatgtctggttcaaaaacctgaatgtcctcactgtcaccccaaccaaatggcctcttcattactgtttagctatttcataaatgctttaggctggagatggtggctcacacttgtaatcccagcattttgggaggctgaggtgggcagatcacctgaggtcgggagtttgagaccagcctggccaacatgatgaaaccccgtctctactaaaaatacaaaaattagccgggtgtggtgatgcatgcctgtaatcccagctacttggaggctgagggaggagaatcgcttgaaggttgcagtgagctaagattgcaccactgtactctagcctgggtgacagagtgagactctgtctcaaacaaaagaaaataaacaaaatcataaatgcttgaatttaggaactaaaaataaactcaggggagatttggattcatttagataagacatattagcaaaactacctaacacagagaaaagaaagtaactcttacgctatgatgtatctgcatgaagtaacttcaactagtattacttttttctttttctttctttctttctttcttttttttttgagacagaatctcgctctgtcacccaggctggagtacagtggcacgatcttggctcagtgcaacctctgcctcccaggttcaagtgattctcctgcctcagcctccagagtagctgggattacaggcccccactaccacgtctggctaatttttgtatttttagtagagagatggtttcaccatgttggccaggttggtcttgaactcctggcctcaagtgatccacccacctctgcctcccaaagtgctaggattacaggtgtgagccactgtgcccggactcagctagtatttcctaagggcatcttggacactgtgtttcttaatcatgtgcgaaacaaacgcatatcttttcaagaagcttagggatactttagaggggctatttttagcacatcttcttacagaaatatgtaagaatgatgagaaagcgatcaagcaataccttggaaaaaccacttcatattcatttcacatgggctatactgtggggtgttggctctaaaaataatattttcttcattactattccaaactttctgtaactttccttgggttatttttcagactggcaggcatctagattttaaatgtgtgaggactttctataccatccgcatagagtctttgatgcactctttccatgagaggcagagacgggatacttacgtgactacgacttattactatcatgatagttactgcttgctattgttatttaggaaaaccaatgtgaagtatcttactcaaaatcacacggaaatgacacgttccatgaattcctcctgtctcttttggatgaagaaataaaaatctatttttttataacaagaactgattcgaagaaaagtttatgtgaatacaaatgaaaaccatggatgcagttaaatgctaacagaggctattttcaactcagtaagattgaatgacctattgatttaccgaaaactacaaacttaagtcaccatgaccacaaaaattaaaaccctttctggaggcattatctctctcatttcaactcaccaaatttcattagaattcatttaaaatgcagtagatcaacatttagaaatgaaatgagtttcatttacttaaatacatgagtgccttttcagagcgatttttcccgacaagacagtcaggcaggtttgctatgttgctgtttttgttgttgttgtttttcatttttcaaggtgcaggtcattaaaaacttgtcatctgagattaaaaaaaatactagaaaagtaaaacaaaacaaaaacaaaaacaacaacaaaaaaacaataccccaaaaaacccaggtggacatacaaacatttcctcaagccttagctgattgttggatgacttatggttaagtgttctgtgggaacactttatctaggggatgcaatggattgacctggtcccccaaaagagatatgttgaagtcttccctgctcccagtgcctcagaatgtgaccttatttggaaatagggtcattgcagatgtaattagttaagataaggtcatacgtaaaatagagtggcccctaagccaatagggctggtgtccttataagaggatgggcatatgaagacggagatagaaagaacatgtgcagacggaggcagagagtggagcgagaagttaccaagtcaaggaatgtggaggatcgccagcaacccgcggagaatcgccagcaacccgcagaggcccagcaggaggcccaggacagatgctccctcacagccctggaaggaaccagcctgcccacaccttagtttcaagcttccagccttcagaatcatgacagaataaatttctgttgtttcaggcctcccaggttgtggtgctttgtcatggcagccccaggaaacaaacacagcagagtagctgaatggtggcacggggaattacagagaaaatgctcggccaggccccatggcacaggcctataatcccaacactttgggaggctgaggtgggaggatcacttgagctgaggagttcaagaccagcctggtcaacatggtgaaaccctatttccactaaaaataaaaaaaaattagctgggcatggtggctcaagcctataatcccagctactttggaagctgaggtgggaggatggcttgagcctgggaggcatagattgcaataagcagagattgtgccactgcactccagcctgagtgagagagcaacatcgtatttcaaaaagcaaacaaacaaaaaaacctcatttgtgattataagaactgcgtccccttccaggacaggcattgagtgtgatctggtggcttcacatttgtcattgataaaaacaggccaggtgcagtggctcacacctgtaatctcaacatttggaaggccaaggtgggaggactgcatgattccaggagttcgaggccattcctgagcagcatagtgagatcctgtctctacaaaaaacaaacaaacataaaaacaaaaaacaaagccatggttagcttcatgtctcaaagtgtggaggacaaaatctaaggaaaaggtagaggacatggagaaagaagaatctggaaagtcccctgcaaatttgaaaattcaagtgcaaacacaatctatagtaagtaagccatatagtaatcaaatgactcagcttctccaggcttaaaaagtgtgtgaattcacttagctcacagagagtttgggggggctcatgtctccagcttgtgtgcaattggctggggtataattggtgactgaccttttcaggctgggtgtctggttttcttaagtcaacatgtcttgatttcatagagcataaaagccccaaatttggggcagagtccagatttgaataaggtgactcagaagcctgctgaagctttaccttggaaatccagcagagcccactaggctccgcctttagtcaggacttacagcaaaatagaaaaagaaagcaaaccccaaacaagcaataggacattgtcacacctggctgaaaaccttcatgaattagacaactattctgtgaatttcgtaagcctctgaaaattatttacttgagaattgaactggggataaactgcagtggttaaaatgtgtcaaatgaaaacataaggctaagattttctaatggtaaggaaaatactattaaacatgaggtttaaaactcattctctgtaaatttagcctttgaagcccaggtgctccaaagcagttagttgttaatgataagagtaaaaacagtcatagttaaagttccagagtgtttatgatatgccaaacatgtgctaagtgcttctgtgggcatgcaatgaactcttaaacaaatcgcaatgcgcattttgccatctttatttacagatagggaaactgaagtgtagaaaggttacataacttgtccaaggttacgtctgggctgaattagggagaccaaacaggaggttcttgtgatctttcaggtaagagatgccaggaggccgagccaaggtggtggaaataaaggtgggtgccaggaagaggtcagtttctatattcaggtgaggctagcgggatgtgctgatggtttagctgcggggtgtgagacacaggtgcctaaggttattgtcttgggcaactggaggaatggagttgccacttattgagagcttgaagagggttggagatctgggtttggaggatgtgatgatcaattttttgtgtcaacttggctgggccatggggtgcccagatatatgattgaacactattcttcatgtttctgtgaagttagtccttggacaaggttaacattgaaagcagattgccctccatagtgtgggtgggccacacccagtcaggtgaaggccagactggaaccagaaaaaactggtgtctccatcagctcaggctgccacaacaaaataccacagacttgctggattaagccacagaaattaattttctcacaattccggaggctggaaagtccaagaccaaggttctggctgcttgggttcctggtggaaattcacctgacgtcttctttgcatgcaggcagaggaaatctttctctctttcccttctttttagagcacgaatctcattgtgagggcacccaccctcatgacctcattgaaccctaatgacctcccaaatgtcccgtctccaaatactatcacatcggggcttagggctccaacataggaattttgggagaatgcaaatgtttagtccataacatgcagcttcacctgagcaagaaactctctccaacagactgtgtttgacctttatttccaacatcagcccttctcagctctatagcaggctgccttccaactgaaactgcagtgtccgtgatcctgggtctccaaactgctagcccaccctgcagaatttcattttatagatgggctcttgctatattgcccaggctggtcttgatctctcaggctcaagtgatcctcccacctcagcttcctgagtagctgggactacaggcatgtgccatcacacttggctaatttctaaaaatgttttatagagatggaggtcccactatgttgcccagcctggtcttgaactcctgggcttaagcaatcctccaaccttggcctcccaaggctgttggaattacaggtgtgagccactgtgcctggcccaccctgcagattttggacttgccagccttgagaatcatgcaagccaattccttagaataaatagatctctttctatataaatgcatattcgattggctctgtttctctggagaactctgactgatacagaggatgaagggcagaagagaggaattttcttttggacttgttcagtttgagatgtctgtgcctacccacctggggataaccatggttgcatatgtaagtgcagggttcagggagggactgaactggagaagtctgtttgtgtcaccaccgcatggagatgggattaaaatatgggatggagtctcttaggagggaacgttagatagagaggagcaggggctccagggctgattctaggaaccctccaacatcaggggagggatgaggatagaggtaggaagaggagccagccacgggctgtaggaatgggcgatagtgaacggtcaacccagaggagactggtgagggaggacagagctccatgttggagagagcaatctactctgtcaagtcaagtaatctgataaatcaagtcatctgagcactgagaagtggtcactggattagcaacatgaaggaaattggagaccttgataagctcagtttcggcggagttgattggagtgggttcaagagagaatagggacagagggacaggagggaatgagcccagagaattctttcaggaacttggaccctccaggggaatcaggaaatgaggcaacagttttaggatgggttccagggcccatagacctcaggatatctgtcaactcagccaggaaaaaaagtgacatcttctatttcatctacctctcactgacaattagcatttccttcaatcctgaatgtaggcagccacctacagcaatatgaccagtgcctgtgccttaatcagcaatagagaccatgatattttgcatcgcattacaggcgttgcagatacctgcaaaggacatttatcactctaacaatttcaaatgatacttataagatgcttgctagacctcatgatgtaatgcattaataaggaaggtcgtccattactaggaacagaattgcactaaaatattttgataactatgttttactataattcacttcctttataatcctgcatgttatgtgttatattacacatttaaaagtattgtgctgagaagaatacatcagcttcgccagattgccaaaggaatcccaggcaatccccatcccgccacccagaacaacaccgataacaaaaaactaaaccaaaagagttagaaacctctgccagtgggatgtgtaggcaagagaggacccttgttttgctgttgttttgaagatgagaggcatggaagcatgtttgcatgcctgaggaaatggttcagcgaggagggaaacatctgtaggggcagtagggatcctgtgtgcacatggagagaccagctctgaccagcatgcagagaactcactccagaacgggaggggaggcgggagcaggaggctgggggagatgtcagtgggcaataacgcatgttctgagtttgctccaagtttctcagggaaataagaagcaacatgatgtcttgagacaggagatgggggaggaggtgcgggaggcttgagcacagaggaggagaccatggtcatccaggagaatgaccgcaggcctggaccaagtcaaggggtcaagtgctagtcagtgccgggtgcaggtggggcaagtggtcctgcgggtaccatagactatcacgccggacagcctttcccagcaccatcaactgcactgcgagggtcccaagtggacaaagggctggactggacctggtggggattttcctaggggaaaatgatgaaggcagacagccaagggaaatatgcgtgcacacaaaggtgtgaacatcatggcgggccgtggcgtcaaagctgggatggagggacattgaggacaatagagaaggtctgttcatcgtggagaagtcacctggatcagtggctctccaccctcctgctgtagccgcagcccttggagagctttaaaaagatccggatgccctggctacctccagagattctgattcgctgactggggtggggtccatgcatgggaattttcgagctcctctcccccacccggtgattctgatgtgcaggcaggtttgagaaccaatggcttatttatttcattaaaaattatttttcactctgttggccaggctggagtgcagtggcacaatcacggctccctgcggccttgacctcctgagctcaagtgatcctcccgcctcagccttccgagtagctggaacttcaggtgtgagccactgcacccagccccgctggcttcattgatttaactttttttattttattttattttatttttttgagacagagtcttgctctgtcacccaggctggagcacagtaggattacaggtgcacgccaccacacccagctaatttttgtatttttagtagagacggggtttcactccgtctaggctggtctcaaactcccgacttcaaatgatctgccctcctcggcatcccaaagtgctgggattacaggcatgagccaccaccgtacctggcctgatgtaacttttaaaggtcctattaggagctttaaagagtccaaaacggtttaacagagagtcatagttcagatgtctgttctgctgggcctgcctgctgagtgcaggctctctttgggatctcctgagatggagacaggtgtctctggcctgtccctggaatattgtctcacctacccataaggctaggctctcccactcccttcgcttgaaatcctcttctccagctacaatcttaccttccctcctgtggccctgcacccttgccttctgccatctagaaaaagtggttgggggggtggttctttatttatcttgctgccttctggctcttaccttcccagagccccacggaagcctgttcttacaacctgggtcctcttcctgggaccccagcccactgtgggcactgagcctccctcattgttaatcttggccaagaagttaccccacaggcatttatattttaatggatgactatttttttttttttttgagtcagagtctcactttgtcacccaggccggagcgcggtggtgcgatctcagctcactgcaacctccgcctcccaggttcaagtgattctcctgcctcagcctcctgagtagctgggattacaggcgcctgctaccatgtctggctaatttttgtatttttagtagagaccaggtttcaccatgttggtcaggctggtctcgaactcctgacctcatgatccacccgccttggactcccaaagtgctgggattgtaggcgtgagccactgccctcggcccatggatgacctttgaaaacaaatctcctcctggcccaggccccaaagcatacactcacagtggtgagaatgattgggtgagtcttccagaaaagcctgtgatagtttgatataaagacatttagaattaattgggtcaggtatgagatttcagattgcagaaatccttgtgtaagcaaaggccttgcagctaaagtagtgcatggcaggtgtggcttagcctttagacatacacacagtggccagattgtgcatttgctctgaagagtaccaggccctgtaggttacctttgcctgctctcaggacttgctagataatttgcagaacccagtgcaaaatgaaaatacagaaccccttgttcagaaattattaagaatgtcaagatggcgtctgcagaacatcaagccaagtgcaagcctgtctgagcacggggctccctgtaactgcacagatcatgtgcctgtgaagctgtccctgcctgctatggacatgctgggaactggacattgggattttccccccttaaaacaatgagtgcattgagttagaatgttgaaaggaacagagacgctcttgcagtgttctgtagaatcgaaaatatggtttcatatgtttactttaccttcatttaagtgtagccctgatgcctctgcgaatatctgccatggaagagccttttaaaaacaaagctcttgctggtctccagtgcccaagagtggccgccagtggaaacagacctggtgttctaaatctcagtttttgtttctttcttcttccaagaaagctgtagatgagcatgtgcacttccaggcctagaagggaacagctgcctctgggtggctcgcctctttgcacaaggggctcagctcagagcttcccctaagcctggcaggtccccccgacacttctcttgggaatgaagtggacaaagtgagtgaatgagcctcagcttctcctgtctttttatagagtcacccgacagggagagataaaggaggtggtagcagcttaggcccaggagccctctcagcaaatggcccagagtagaaaattccccacactatgttgctgttggtcacccggtgaaaagtccctggccctggcagccacttgtcctgcaaatggtgcgagtgaagaatccacagattagctggaaggaggaacgtttgagtttgaaaacgccaagaatcattcctgaactggcaaggctggccacctgcgttttaaaaacacattggcactagccttgaaaacagacttttagacttcttactctgcgtaatgaaagatcttttctgatatataggcaacagaatgatttttttaaaaacaataatggacatattccattttattgatctttacctaaaaactaaaaactaactggaaaacaggaaatatttaatagtgacattttcatagcaccaaaggaagaatctacgtgtcttcctttttatagatttttctgtagatgtcttaagaagcattgaaccctttatacagatgggtaaataaaacacagtaagcttgagatatgcaaatcagattggagccagataaggatgggggctggcgctggcttcaattctgactaatcttgggcaagctgctcagcctattactcactgtctacacaggaatgactgtctacataggaatagctcctctgcagagacatctagaagatgctgagataatatatgtaaaaactgacaagccctttgggacagataccagcaaatgcaaggcgtatgctatggaagttttatcatcctaacagataagcccgtccccaactccagtgagtgactgagagacacgggcatgaacgctgagctcagatgacagcatcttttcacagcagacctgggcccagcccctggaagcacacgatgatgaactgtcctctggtttcccaagacttcaaaaatgaaacccagtgatcaagagatgtttggctttgaacactgcgggaattaaagccagcacccagttaaagccagtgaggacagcactccaaggtttggggacggtctcaggacactaatcctggttccttttctattttgcctgggtccctcctgcccatcctgggaagccgtggcagctgttggggatgtggggccccaggtaactgaaggattaactcacgtctcaaattgcatggcatttctcctcttcagcaccattttttaccctcattgagagagatctatcacttccccccctctcctgccatgccaatatgtgtctgtgttggagggcaggggtgtatttagggagcaggagaatgttcccaagtctggaaactcggaacagtctgcctggccctctttgcagaaaaacgagggagtcccagcagacagaagggggcagtggcgctgagctccccgagctgagctgtggcctcaaaacactgaacagattcagtccttcctcccaaacaggcctggtaagcgatgaaaagagttctgcccaaacactcaggaactggattattgtcgttcctggctcattaggagcctggctgccctcatgccagctgcgtggggtcctctggaggccacccagaccagcctgcagcttcctttcctgtaggggccagcacggtcccttcctctggagaacgctcggacccctggctgcatgcacatctaaccggcagggcctaagggcttccaaaacagatgactgtcaaccccagcccgcccaccccacatccacagcttcaccccaaactcacatgcagaaaacctcgagtctcatcttcctgttcaggtcccttgccagccggagccgctctggagcctggctggactccagctcccatgtgcaagaggactcagccgggacgctgccaccctcctgccttccctcttctgccaaccagacgcttccaggacggagtatttgagagaaaattgtctagacaattacagtgttccttagaatggcctgcgtgggcacacgtgccacttggttagctagcatgagaggaggtggcttggccagagcagacattcaagaccaaccagaaatgtcatttctgcactgtggaaaaaaaatgcacgatacacctgaacctgggcatctccttcctaacacgcgctcaggatcaagcctccccttcccagcctggcagggttgcagggcgtccatagtccagcctacgcctgcccaggctctcggctccgggtccattggctgttcacactcacttccctgtgtcctggaactgcctgattgttgtagattactaaaaatccacagctcattccctcctgcgccctgaccacctgcccacagcgactgtgtcctcctctgagccaccacctggcg

SEQ ID NO: 669 - DNA, 19469 bp, Homo sapiens; identical to SEQ ID NO: 668

SEQ ID NO: 670 - DNA, 117591 bp, Homo sapiens
tggcccggcagcatggcggcggcggcgggcgcccctccgccgggtcccccgcaaccgcctccgccgccgccgcccgaggagtcgtccgacagcgagcccgaggcggagcccggctccccacagaagctcatccgcaaggtgtccacgtcgggtcagatccgacagaaggtgagcccgcggcgcggcggcccgggcgcgcgcccctcacgccgcggcagccccggccgaggcccgtggccctgcccgagcggccgcccaggcccggctcggcccggcccggggtcccgcgggcgtcaccgcccctgtcgagcgtgccccgccgctgtaacgggccggcgccccgggcggagcgcgcggcccccgacggacggcgggcggctgtggggccgggcggggggcgcgcaggtgggcgccccgggcgccgcgcgctgggcggggggcgcgcgccgagttgggccgcgaggacccggaggaaactgaggcctagatgcaggggactgcgctcgtgccaccgagcgggtcccacgcgggggctcccggctgcgccccgcgggcgtccgcggtccccaaaccccggttctgcacgtttctcaggagcggtcgggtggtgtcccgcgagtgccctgcagacttccctgtggtgccctcagaagtccgctcggacccgggtgcgagggatcaccccttcaccccttcatcccaaaagggaaggaagggatgcgcgttcagtgaccgtctctctcagcaaagccgggaccgcgcacccgcttggcacccaactctccacggagaactcctgacgctaaatgttagataaagacgcacgtcctttttgcaggaggaaagttgcaccgtttgttttcccattgtgcttcctattgaaaacagcttacggtttttgctccaggtgagcccgcccggttagaacactgcttcctcaggcaggtggctggacaggtggctgcgagcaggctgggtccctggggcagctctggcagatccggttggcacggactttctcctcctgctgcagtgcgcttttcctccggggcggattaggttcagccgttcccttcaccgtgggagccttctcttctgtcagcctttgatacctgcgatgggggaacctgaggtcctaacatgttacaaacaggtttgttgtgaagtgctccagttattcagcaaataggtaccgaacacctgctttgttccgggtataacagtagcagtagtgatgataatgatagcaatagcaaataacaattctttaataagccttctatgtgccaggcactttcttgggttagctttacagcacttgacatggttagtttattagtactggtgagaacccaataagttggatgctatcatctccgtcttttggaattggaatagaaatagaatcaaggttaaatgacttgcccagggtgtcacaggtcgtaaatgtggatgtgtgttggaaccatggtcaggaccgtaagatggaaggcagtttctacacctagggattctcagtctagttgggagatggacgcctgtgcacctgacatgacaacattgtaagtgccgcggaaactcggggcagagacctgccctggggaggcaggagtggtttcctttaaggtgagatcttgagggataaagaattcaccaggctaagtgggtaagaaatggccttctacatatttgaaccttgcgtctagagctttaggcacaactgcgaaatgatcagaagttgggccagaggtggatcacgttgattagacttattagttggaagggttggttagggctgaatttcgaaggggtggtcctttgaggggtttgctttttggccttgggcaagaggtggccacagaggattgttcaaagtatgggggtgatggatcagatgtgcttttgggaagatctccacatagccctaaatgatactgataggagttgctttctcctgttgcccaggcaaggtactgaccagtgtggggtagatcatgtgatttacaaggttgattaagatcaagattgtgttgagagagatttgattcctgggagattccagtgtttagaattttgttggttaggaggtgtttttgctttccttcttttttctcctaaaacaatagctgctataccagctgttctggttgaggaggagtgatgggtagactgttaaaaatacaccccgaggacttagagtttctgaatacagtcacatctgctgtacagatagcttaaggctgatttttcttctgagttgttaagagattgtcagaatgtgggaatgcgaggttgactgtatgtaatagctccattttttttttttccagcagataagccattcacaaaattcctctggtatctatggtacataatagaaacatcaaaaatggtatggggtagcagtctgagtctaaaaagaaaaacagaactcaccttaagtatttggaacagaaggaatgtaatctaggggagtggtcacacaggtgatgtgagaactgagaatgcaggctgcaatgaggcaagccggagatgaggcaacaagcaggaaactgctgccacccctaagttggagggtgaaggaaggagatggcatttcagactccagggacagctgtcacccaccaaaaactggggtcacaaggggtccatctggcagtggctggagccttgcaagggcacagctgctgctgcggatgtactgttcccctcctgcctgggaaccctggccttgctggggtcacctcctccacaacttggactggagcagaaggacaaagaatggatctgaggacaagctggcccaggaccagaactgtatgtatgtcaggcttttaaaatattagtctagtgcaagtcagagctgtcttaatgaagagaaaaacaaaagagaatgtcttagggcagtgctcctcaaattttaatgtgcagacacatctcctagggatcctgttaaaatgatgattatggttgagtaggtctagggtgggtggggccttagaatgtgcatttctttttctttctttctttcttttttttttttttttttgagacaaggtctcactttgtcacccaggctggagtgcagtggtgcgatctcagctacggcaacctttgcctcctgggcttaagtgattttcctgcctcagcctcccaagtagctgggactacaggcaaatgccaccatgctggctaatttttgtattttgttgtagagatggagtttccccatgttccccaggctggtctcaaactcctgagctcaagtaatacacccacctcagcctcccaaagtgctgggattataagcttgagccaatgcacctggcagaatatgcatttctaacaagctcccagaagatgctgatgctgctggtccatggaccagactttgaaaaacaagaccttatggcacacatgtaaagagaagcctctccaaacttcaaataattcttcaggttatagatctttagcatattgaaaatttgatgtgtgcagatttgtgatggccatttatcagtttagcatttcatgcatgtctgattttttaatatgttcgagctctttagagttgaagctgtccacagcaaagacattacttcatttgtatttcctgactacagtacacagtaatgactctgtagaactgcatagctagaatggaaagaaagaaaatggagctaacactccgaccagcacattcaccagcacattataaggtattttgaaatttcagtgaagaaccgtgtaattctgcaaagctatcagttaaaagagtttaatttatttaaaagtttctagaaagttaacattttttggatatgagcatgaaagtgcttggattcctgattttaaatttaaacaaagcattttttccattgtgaaatgaagactagtaaaaattaggtaaagggtttaagttgtaaaaaacttaaaaaaatgcaccgcagttttatgagatataattcacatgggatacagttcagtggttgttagtatattcgctgttttgcaaccatcaccacagtcaattttagaacattttcatcaccccgtttcctctcaactccctcaaccataggcaacaagaatctactttctgtctctgtgtttgctgattctggtcattttacataaatggaatcatacaatatgtggtctggcttctttaacttagcataatatttttaaggttcatccatgtcatggcatgtatcggtacttcatttctttctgttgctgggtaatattccattctacaggcacactgtattttatttatccatttatcagttgatggacatttgggttatttctactttttggctattctggataatgctgctgtgaacattcatgcacatgtttttgtgtggacataggttttcatttatcttggctatacacctaggagtggaagtgctgggccatatggtaatactaccggactattttccagctaaaaagctgccgtaacattttacattcccaccagctgtgtatgaggagggttccaatttttccacatccttgtcagtaactgttattatctctcttttgatactagccatcctagtagggatgaagtaatgtaaaaggtttttaatgccattttattgtcggatttcaaagtctaaactttggtgtcagatgaagtcacttcagaccctgcgcttctagttatgaagcatgcgattgtggacagggtgtctaaacctcccttaagacgtggtttcctcatctgtaaacatggaaaatattagttcttgggttggttgtagtgaaagtaaatgttaactctgtgttcctgagtctcagtttccatgtctgtaaaatagaaataacagttgttatatccataaaataggaatggggatgttaactcatagaattaaatgggataatttgtgtagaacacctaacatagtggctgatgtatagtaaatgatcactaaatggttgcttttggttattttttgtctttctgatttttttttttttttatcccagataggaatcatttccctgattccatttttctccagctcaggctggtctgagtctccatctctcggctccagaagagcaaatacaaacaaatctggctgaaaattaacaaagaccattttttaaagaaatcgttaatttattgagtactagtgggaataccatgggctaggtattacattttgtatttcactggttcagtttaacagcaaatatttgagatcttaacattgttaactgttgtgcgaggcaccaggggtatcttattgagtaacaacaaaaatttttagagatgatagtctagaagacattaataaaacaatcacacagttaatatgaagttgtgatggggacgggtgctgatgaggagagggccagaatactttgagaggacatcataggtgaatttgacctgatatcagggaggtctaggagggcttcttgaggcagtgactggctgggtctggaaggtgagtagggagcagtgccttctgcttctggcagtggtgagctgagtgactgcagcgccactcttccaagcacagtctgctaataagatgatgctgaatttctggactaggatctggggtggctgaagatctgtggaagtgagtgtggtatttggggctgcttttgaccttggaatctgtagtggcgtctgtagtggatttggcatctctaccaaatttggtccacctagaacttcaggatgcccacataataagatattagttaaatatctttaaaaaaattttttttctttttttctgagacagggtcttgctcggtcgtccaggctggagtgcagtggcatactgcagtctctggctgggctcaggcaatcctcctgcctcagccacctgagtagctgggactccagatgcattccatgatgcctggctaatttaaaaacacatttttatggagacgagggtctcactatgttgcccatgcttggggtctcaaactcctgggctcaagcgatcctccccctttggcttcccaaagtgctagaattacagacatgagctactgtgcctggccaaaattttttattttgagatagggtcttgctatattccccaggctggtctcaaactcctgggctcaagtgatcctcctgcttcaggcttctgagtagctgggagcgtaggctcaagccactgtgcctggctaattaaagattttgagagtaaatcatcgtgaacttaggagaaactctaaatccagtgttggtttctttataagaggaaggggagggagatttggacagaaagacatgttgggaaaaaggttatgggaaaatagagccggagattagagttcgttgatgcaaaccaaggaatgcctggggccaccagaagctggaagagataacagatggaatctcccctagagcctttagagggagtgcggccttctgatcccttgatctccgacttccagcccccagagcagtgagacagtcaagttttttttttttttttttttttccaagttttgttttaagccttgaagttttatggcagccctagggcagccctggggaaagaacactgggccctgaacaaaacatgggagccaagaggctgagccctgtgagactgtctgagtgccttagcagggctgaggtgccaggttctgccaaagggcaacagtcctgggtgacaccctcccctcacaatttggattgggatccaaagaagccacttccaaggaatgcgcaggagccagaagtattggaaggactgcagccctgcttcaaatcacctcagtcctctgaaattaaagtaatcccagtgtactagtgtctctagattcccaacagaagcaaactttaatcctctctagagggagatatctccctctaatcctcccagttatcaatggaggcctctaatgactttcacgagtctgtttgtacgttcatgattgtgcatacagtaaaaaaatagacatcaagggaggcgaggcacttgagctaaaaccagtcgaaactacaggctgtagacagacccacagggcttccagactccagacccagactttataacaactgtgctcgttgtgttggaggagacacgagatcagatggagagttttggcagagaactagaaactatggaaaagaaccagatgaaaattctagtccacactggccagatggctcacgcctataatctcagcacttttggactgaggcaggtggatcattggaggtcacgagtttgagaccagcctggccaacatggcaagatcccgcctctactaaagatactagacattttttttttcttttaagacggagtctcactcttgtcacccaggctgtagtgcagtggcatgatctcagctcactacaacctttgcctcctgggttcaagcaattctcctgcctcagccccccgagtagctaggattacaggtgcccatcaccacgcccagctaattttttggtatttttaatagagacggagtcttaccatgttagctaagctggtctcgaactcccaatctcaggtgatctgcccgcctcggcctcccaaagtgctgggattacatgcgtgagccacctcacccagccaataaaagaaaattataaaattgaaaaagcatagtgatcaaaattaactaaccaaaaaaagagcagattagacccaggctgaaaaaattgtgtgaaccagaagatagctcagaagaaaatacccacaaggaagcctggagacataaaaaatggaaaaatttggagagggtgggagacagatatagtaagaaggtcttacttgtgtttaattgtcacaagagaggagaagtgagagaaaattgaggagacacaatatttgaaaagataatgtggccaggtgcagtgactcacgactgtaatcccagcagttttggatgctgaggtgggcggatcacctgaggttaggagttcaagaccagcttggccaacatggtgaaaccctgtgtctactaaaagtacaaaaattagctgggtgtggtggcagatgcctgtaatcccagctactcgggaggctgaggcaggagcatcgcttgaacctgggaagtggaagttgcagtgagctgagaccacaccattacactacagcctgggcgacaagagcgaaactctgtattaaatagaaaaaaaagaaagaaaagtaatacctgagaattttctacaacaaataacaggtaccatgaacagattcgatagccgtatgaactgaaagaaccatatctaatcaattcctggtacacccttgtgctctgcataatgatgtttccggatgatgatccacatggacaaaggtggtcccataagattataatgaagctgaaaaattccaattgtctagtgacgtggtagctgttataatgttgtagggcaatgaattacctatgtgtttgtggtgatgctggtgtaaacagacctactgcactgcaagtggtagaaaagtatagcacatacaagtatatacagtacataatagttgatgatgataataaacaactatgttactggtttatgtatttactatctatactttttattattttagagtatattcttcctacttatagaaaaaagaaaaacaaattgtaaaacagcctcaagcaggtccttcaggaggtatccagaagaaggcattgttatcataggaggtgacagctccatgcacgtcattgtccctgaagaccttccagtgggataggatgtggaggcggaagataatgatactgatgatcctgactctgtgtaggtctaggctaatgtgtgtgtttgtttcttagtttttaacaaaaatatttaagaagtaaaataattaaaaaaattaaaaatagaaaaaaggttatagaataaggatataaagaaaatacttttgtacaagtgtacagtgtgtgtttcaagctaaatgttactacaaaagagtaaaaaattaaattaaaagtttataaagtaaaaatattacagtaagctaaggttaatttgttattgaagaaagaaagtctttcaaaaaataaatgtagtatagcctaagtgtacagtgtttacaaagcatagagtactggtcagtagtgtcctaggccatcacattcactcaccagtcattcactcactcatccagagcaacttccagccctgcaagctccagttacggtaagtaccctatacaggtgtaccattttaaaaatcttttatgacatatttttactgtactgtttctatgtttagttatatttagatacgcaaatacttgccgttgagttatagttgcctacagtgtcagcacagtgatgtgctctatgggtttgtagtccaagagcaataggtcatgccatacagatgaggtgtgtgccatctagatttgtgaaagtacactctgtgatgttcacataggatgaaatcacctcataacacatttctcagaatatatgctcattgttaagcaactgataactgtagcaccgttgaaaaccatagatgaagagaaagagagaaaggcggaggttgcagtgagtcgagatcacaccactgcactccagcctgggcaacagagcgagactttgcttctaaaaacaaaaaccaaacaaaaaaagaatgacagctgtgttcttaacagaaataatggaaaccaaaagtctattgaaatttaagtcctcaaagaaagttactgtgaacccagaattctgtatgcagcaaaaatgtccttcagaaaatacagttgaaataaagatactttcatataaacaaaaacaatgtttttgccagcagacccacactaaaggaaacattaagtgttttttgtttgttttggctaaaggaaaatgctcaagttaagcgttagagttacaggaaggaatagagacttaagggtttctacgtgggaaagaccaaatgattattaactataaaaattatgcctttgggtttaaattatatagaattaaaatacatgacaacaatgtcctgtaggttagaaaggaggcaaatagagtagaacttttctaaagtctttccatttccaggaagaagaacaaagatccaattatattagacaagtcagggatgcatgttgtgtgtaatctgtgtggtggccaccaaaattgtgatagtgtgtgatagctaagctaaacaagaaaaatagaatcagagattctaaatctgaaagaaggcaagaaaggagagaaaacactgaacaattgggacaaagagaaagcaaacagtaagttagtagactgaaatcccagtatgtcagtaatcacattaaatctaggtggacttaaatgctccagttaaaatacagagattgtgagatgggatacaaaagcaaatcctgactaggctatttgaaagagatacgtttaaaacataaggatattaaaagattgaaagtaaaagaataggaaaagatactatgcaaacactaaccaaaagaaacttggtgtagctattttagtatcaaagtagattttaagggcaaaattattaataaagatatgctgataaatgagaaaaagttcattttggatataataatttaaaatttggaagtaatgacttcaaaatatatagaagaaaaattaacacaattgtaagggaaacaaattcataatcatagtgagatgttttaacacacctgtcttacatgctgtatacatcaagtagacaaagaaatttgtaaaagtgtagaattgaacaacacaagaacggaacttttttttttttttgggagacggagtttcgctctgttgcccagactggagtgtaatggtgcaatctctgctcactgcaacctccacctcccaggttcaagtgattctcctgcctcagcctccagagtagctgcgactacaggtgtccatcaccatgccaccatgcttggctaatttttgtatttttaatagagatggagggggggtctcaccgtcttggttaggctggtcttgaactcctgacctcaggtgatccacctgcctcggcctcctgaagtgctgggattacaggcgtgagccactgcacctgccacaagtactaaacttgacctaatggaaatgtatggaacactgtacctaacaattgtagaatctaagtttttttccaatgcacaggcacatttgtcgaaattcactatatgctggccataacacaagtctcaacagctttcaaaagagttgaaattatagagtatgttctgacaacagaattaagccaggatcaataaaaagaaaatctcaatgtatttggaaattttagatgtctatttctaagtaatttatgagtcacagaaagcttaaatattttgagttgaacaatagcaaatatgtatatataaaatggggtacagctgaagtcatgtttagagggaaatttatagcttaaaatacgtatattagaaaagaagacatgctgaaaatcaggtagttagaagaatagcaacacattaaactcaaaggaaatagagtatttttttaaaggatttatagaagaatgaggaggaggaggttgctgatcaaagaggtatgcaaaggccctgtggcaagagggagcttggggaaatcttggggctgaaagaaggctgtggtggttagggctggtaagcatcgggagcctttggttgggatctgacactggagagggttggaggctgtgttagggagctctgcctattttcccccagattagtgggatactattgctttaagattttaggaaggaccatgacctaattggatcgtggttgaaaagatggctctagctgcgctgcggttgcctgagtggatgctggctgacccaatgcagtgaaagatgctggcagcctgggcctgtgctgtggctgtggcgatgggggaagtagctggatttgagagatgctgaggaggtgacattgtgagaactcagtgatggtttggtgtgggtgttgggggagaggaggtttgtgattcctgtgatgagctggataatggaactcttctctgatataaggagctgtggttgaggacagctttggggattttgctgttacctggctctgctgcatgctatcctggaacctcttattctccactaccccagttttgccaatgaacgacatagattcagcagttaggtggcttgctagtgtgccatgaagccatgtaggtctcactgaacccagatagggcctcctttgtcccttcctccccagcccccagtcatgcagcagcagtgaggatggttcatctgagcccgagagtgaggacagtgtgacggggtcagggcccgattggatgctggggccgttggcttttaggaggtgggcagaagaggaagaggaggactagtcaaagaaggaaggactggcaggggaggagaaagaaagggggctgcagagaagccccagaaccagcacagtttacctctaaatacctcagtgtatgtctccacaacatgaggatattttcttatataacaataccattatacctgaaaaaactttttaacatttaatatccagatcattttcaaatttccccagttgaaccagaaatgccatttatgaccttccttttgggaaccaggtacccatcaagttttacgcatcatctttggttgttgttatctctttagtttgttaaattagaacagcttccactgttctctcttcccgttccctacctgcctataacatcaactttttcaagagacaagggcagttgtctggtattaatgacttttttttttttttgttcagacagaatctcactctgtcgcccagactggagtgcagtggtgcgatctcggctcactgcaacctccgcctcccaggttcaaatgattctcctgcctcagcttcccaagcagctgggactacaggcgcccgccaccatgcccggctgatttttttatttttagtagagacggggtttcaccatgttggccaggctggtctcgaacccatgacctcaagtgatccgcccacctcggcctcccaaagtgttgggatgacaggcatgagccaccgcacccagctgtattaatgacttttaatggcaaaaacctccattacttttgtaccaacctaataatctttctggatttttctgattgttttcccatcattcttttacattgttgttttatctcctatatttcctataaagtagaagtaagcagtttcaaagactctcacttctatattttggttgacattttgggcatatccctaaatatggaatgctctgtgctctaccgcatcccacttggaggtgggtgtgtcctgtcaggctgtccccctctgctgtgtcatcgcttggtttacagatttctaggtcttttcttcctcttttttttttctttttttttttttttttttaatagaagtgggatctccctacgttaagccagtctggtcttgaactcctgacctaaagtgatcctcctgccttggcctcccaaagttctgggattacaggcatgagccaccttgcctgaccagatcttttcattggagatgtgatttcccctttacagttaggaagtaataggtgattcctgggcactgtgcaaatatcctttaccccaaatggtttccatattcatacacaatacaggacttgcctgaagcaattttattataagagtttttaaaatggagattcctgccacccccattgtgtcatttattccacatttatctgttggtgttattctgtaaagatattttcttggggccaggcgcggtggctcatgcctgtaatctcagcactttgggaggccaaggctcaggcgatcacttgaggtcaggagttcgagaccagcctggccgatatggtaaaaccccatctctactaaaaatacaaaaaaattagctgggcatcgtggtggacacctgtaatcccagctactccagaggccgaggcaggagaatcgcatgaacccaggaggaggaggttgcagtgagccaagatcacaccactgcactccaggctgggcgacagagcgagactccatcaaaaaagtgaaaataaaaggatatttgctcacttcaaccgagttaaggaccacagttcctcctaaaaaggcaggtcaattgctggattctttgtttaattaccaatgttcgaggtaaggatttggtaaatagtcatccccagtagaggcaaatgtttctctccccccaaccctaaacccccacacccaccctgagtatcactatatggattcatggcaatttttattcagtgttttacaatcagttacagtcattctttttgatgctaaaattatcctgattttcctggaaacacaccttcatctggctctttggtctttaaaggcttgcttgctatgttgcgatctgttttcatcttctggatagagtcctggagctggagtttcaggtagaagggacagtgtgcgtcctgtggccgaggctgccagcccacagcgtgcattgctgcccatttcctgccagtcctgggacgagagtgcctaggagtttcaagatttcaggctggcaggtctttgttttccttttttggattggcttaggtttagggttgtctcagcctcataaagtgagttgggtagctttctgtgaggaaggcttttgtctctgcctctcatattgcatctccatttattttattttttggggggaggttctcatctgtaggttagaccatctgtctccttaccactctgtccatctcagtatttttccctgtccactgtatccatcagcattctgggggcctcagttttgtctttttgccaccagtgacattttctgtaatgtacatttttccctttgactccttccagttggattttaatttttccgtagtgtgattgtttttgttttctaatcttggtcagcatcttagcttgttgtcttttaatttcaacctattctcattttggtgctccctgtcttttaaaaacattttaattttaactttttaaataaaggccacgtcttcctgcatcttaggacaagaatcacatcttttctaaaatggtcttccattttctgcaatcattcatttcaggtttgtgcatgtactttatggcatgtttttccatcagcctctcccctccccctttctgttctgatgtgatgttccttgaatggcgtttgccaggctgcgggtttgaattgctgtttcctggggacttggctgggcacaatctggggctggccgtggggtgatcggccacgggcccaggctgtgtctctgctgctctgggcgggctctcccctcaccttgaattcatgtgcaatggccccattttccgtgtccatgtgtgttcctgagtagtgggtgtttgctgatcacctgctgcccactctgctggctctgctcttctgtgtctgagggtaaagggtgtctgcctccctttcccctgcaggaagggctggactctcatcccctgatgaatggtgctttgtccttatagaatgatggaagagggacactctttttcttttaaacctgctattttaaccattttaaagtgcacagttaagtgccattaagtacattaatggtattgtgtaaccatcacctctatctagtttgggaacttctgtatcccctacatggaaatcccttccccatcgtgagtcactcctcatttccccctcctcccagctgctgacaaccactaatctgctttccatctctatggatttgcctattctggatatttcatttattatttatttattttttagatacagtcttgctctttctctcagggtggagtgcagtggctcaatctcagctcactgcaatctctgcctcccaggttcaagcgatcctctcacctcagcccccccagtagctggcattacaggtgcactccaccatgcctggctaatttttgtatttttagtacagagggggtttcaccatgttgtggccaggctggtctcccaattcctgacctcaagtgatctgaccgccctggcctcccaaagtcctgggattacatgcgtgagccaccgcacccggccactgagcactgtgttttcaaggcttatttacgttgtacgtttcagaacttcttctttttttttttttttttttgtttgagtgaataatactctgttctgtcaatgtaccacattttgtttgctcattcatcggttgacagatatttgggttgcttctaccttttgactattgtgaatagaactgctgtgaacattcatgtacaaattattatttaaatacctattttcatttattttgtatttttttttaaatttttgagacagggtctctgtcacccaggctggagtgcagtggtgcagtcatggctcactgcagcctccacatcttgggctcaagcagtcctcccacctcagcttcccaagcagctgtgactacagatgtgtgccaccatgcctggctaattttttaattttttgtagagatgaggtcttgctgtgttatccaggttggtctcgaacactcgggctcaagtgatcttcttgccttggcctcccagagtgctgggattacaggtgtgagccactgtgcccagctgacctgttttcatttcttttgggtacgtacatgtgagttaaattgctggataattctgtgtttatcttattgaggagctgctaaaccacaaaggctgcaccattgtatgttccctccagcagtgcatgagagttctgatgtttccacacttgccaactcttgttactttccacttattataatataaatgttataatatttaataatttaagaatattatattattcagttcctcaatgactaacaatgttgagcatcatttcatatgtttattgaccatttgtatatattttttgaagaaatacctattcaggtccattgcccattttccaatcgggttgtcttcttgttgttgaattgtaagagttttttatatattttgggtactagaactttatcagatacatgatttgcaaatatttcctctcattctgtgagttgtgttttcactctcttgatagtgtcctttgaggcacaaaagttttgaattttgatgaagtccaatttttttcttttgttgctcgtgcttttggtgttatgcttaagaaaccattgcctaatccaaagacaagatttatacctatgttcttccacgagttttgtagtttcagctattattaatatatttagtctttgatccattttgagttattttttgtatgtggtgtgaggtcaggttccaacttcattcttcctgtgtggatgtgcagttgctccagcaccagctgttgaagaggagcgctctccagttggagtctgcctccccagctgtgcagacagccctgcagtattgaaaaacagccacagagctcctcaggagtgcttggaaatctcaatggagttcataaagtgattcttaatagaatcattcttatgtatggttatgagacatttacatatttaaagagtttaaaaggaagtatctgcatttcagaatttttactgccatggaactcatctacattttattttgttttattttatttttttcagacaggatctcactgtcacccaggctggagtgcagtggtatgatctccgttcactgcagcctctacctcccgagctcaagtgatcctcccagtcagcctcctgagtagctgggaccacaagcatgcaccaccacacctgggtaatttttgtattttttgtagagacgggttcttgctatgttgcctaggctgtcctcgaattcctgggctcaagcaatccgcccgcctcagtctcccaaagtggctaggattacaggcgtgagctactgagcccagcctcttctacattttatgtttgagaatatggacttgattcagttctttttatagtttggtaaacttgaaataacactcatctcattaaatccagtctcatttgacattctcagtatttgaactctgataaaaatggactagtactcagaagctgggcagaagggaagtctgagaagttgttctctatctcctttctctctgtggttgctgaacatttttgtgtgcttcaagagggcaagtagaaccaggtttgtcaagaattaagacataagtcttttttttttaatttttattttttttcttacatttaagggagatctggccaatgtgtatttttattgtccattagtcacaattgtctgtgtttttatatctaactagtgttttgtattatttgctgtttgtagaaactccttggtagttaactgcagcttctttgtcctctggcagcagaaatgggtataaccatttgggaaagtgacttagtgagtgtctgaataactccaagagactcttggtccagaattctaacactgggactctatcctgagaaaataatcttaaatataaagctcatgaacaacatgtttattgtaccattaaatataaaaagttgcaagccaccccagtgtccaagtccagcttaggacaaaccccaccagaacactccagtgtaatgactcagtgagttaatgataatagctgataaaatgggtactgcgggcgggtcccgtgctgtgctctgtgcgcgtgctgtcccacttcaccttcacaacttcatggtggctgcaccaggtcacaaagctggaaagtggcaatgtgcatggctctcaatgcctgaagctgccagccaggtaattgaggaggtcagcaacagggacggtactatgtgatgttggagaaataaagaggcgaagctgtgtttacagaatgcgtttcagcagtgtgtaaaacactggaaataagatggaataggaaataacacggaggaagtttcttatgatattgtgggtcgggttaggtggtgagatttgtattatttttatgtttacatctgcttgcctgcattttctaaaatgagcatgtattattttataccaaaggaaacaaaaaggcataacatgcttcccgtcaatggaagactcctaatggtaagaggggctgtgttgtgacgtggagatgattcagattggagaagcagctgccctcagccttatctggaatgtcctaaaacagctgaaacgatactgttggatcaaaacagattgaatttcaggagtcaaatatacaaaagggcatgcttgtgaaaatacaggatttaagtttcataatatcctaataaatgggtacattatatggaacgacttaattatgttcccccttgtttgaactttcaactcctgtgttgaaattaaatctacacttacctaagaagtgagctcaaggtcttgatatgaataggatgtattttagcttgagatgtaaactgtttgatgcgtgcaatgttatcagttctttagataatgttcataatgacattagcatccctaaacatttgaataaatgaaaaagaaataacatatagaataataatacacaaagtaaaagcagatctagttgcagtatattgttgtttggaaaagcaagttattgaataatttgtacatcatgtaactcccctttatgtcttttagtttaattttttttttttacacagggttttttttgtttttgtttgtttgtttgtttttgagatgaagtctcgctctcacccaggctggagtgcagtggtgtgatctcggctcactgcaacctccacctcccgggttcaagtgattctcctgcctcagcctcctgagtagctgggattacaggtgcctgctacgatgcctggctagtttttgtattttcagcagagacagggtttcaccatgttggccaggctgattacgaactcctgacctcaagtgtgccttctgcctcagactcccaaagtgctgggattacaggcgtgagccactgcgcctggccttgacacggggtctcgccctgtcacccaggctggagtgcagtggtgccatcatcactcactgcagccttggactcttgggctcaggtgattttcctgtcttggcctccccagaggctaggactacaggtatgggccaccatgcccagctaatttttagattttttgtagagatggcatctcaccgtgttgcccaggctggtcttgaactcctgggcacaagtgatttgcccacctctttctcccaaagtgctgagattacaggtgtgagccatagcacctgacaattttatttttacatttttctttttagaggcacggtcttgttctgtcatccaggctgcagtgcagtggttcagtcatagctcactggagcctaaattcctgggttcaagcaacttttctgccccagtttccttagtagctaggactgcaggcgtatgccaccatacccagccaattttaaaagtttttatagagatagagtctctataaaagcagagggatactttactatgctatgttgcccaggctggtcttgaattcctgggctcaagtgatctgcctgcctcgtcctcccaaagtgctgagattacaggtgtgacataccatgcccagccccacttttctgttttatttacacacttgaaaacagatggagccgggcgtggtggctcatgcctgtaatcccagcactttgggcgcccaagtccggtggatcacccgatgtcaggagttcgagaccagcctggccaacatggtaaaatcctgtctctactaaaaataacaaaaattggccaggcgtgatggcacacgcccgtagtcccagccacttgggaggctgaggcaggagaatcgtttgaacctgggaggtggaggttgcagtgagccgagatcgtgccaccgcgctccagcctgggcgacagaatgagactctgtctcaaaaaaggaaaaaaaagaaaaaaaagaaagaaaacagatgggaaggatgttatctcggcatgtgaatagtaggtgttagcgtggctgggctcttggtggtcttaagtaaataaaaagtaacctccagcaaacaagtctgccatgagttgggccatttaacacaggactttattctccaaatgtcagaaaacaggtgaggaagcagctggttgagcacatgccaggggagaggaggttgaatgctgatagtggcagcactgccgcattgttctcaggtgcttttctgtttggtgccttgccctctgaggtgggatccataggtcaggaagctggggaggctgcctctagtccaggcagcaccagcttcaggcctctggtgtgtttcactgacttccaagtttccaaagcgccctgtctgcacccctcttatgacacttgaaaacaatttatggaaatttccaagcagacacggaagtagagaccgttgaattaatcacatcagcctgtgtctttcttgtttcatctgtctccaccccctacccacacccctacttttctcctgagcattttaaagcaaatacttctggttcttcctactgtcaagtatccctctgatggagcagtttcctgaaaggtcaagggtcgagtccctttcactgtagtattgcaagccacactcagcactcaagtgttcaataaacatttattgaaacagagtgatttcattccacagctcgatagggagatggattttgttctgtaggtttcgcagaagctgaatctttcctaccttaatgaaccacagagcgcatgtgtgtattttgggatgtcgcacctgctgctgggggttaaggtttgtttcgcctttggtgtgtagtggagatgggtttgtgcataaattcactttcagaaaaagtagggtgactggttatggctataatttagtctgaacttgtacagacaaaaataatgaaaagtaaatcttccccagacataaaaaatgtttttcatttgctgtctaagcatggagagagttgaaatcagacagatctgggtctgaagtccacatctgtcacttcactgtagatgtctatgtcctctctggaccccaatttcttcattagtaaaatggggctataactattgtatggggcagattaaatacagattctacataagctcctggcacatagtaggcactccataaatactgattatttcttctccttgcccatggttctgtgaaatgggaatgtttcctgggcctcccttaggaggtcattgtatggatttttttttaatatatatgttttttattatactttaagttctagggtcctttgtagggacatggatgaagctggaaaccatcattctcagcaaactatcacaaggacagaaaaaccaaacaccgcatgttctcactcataggtgggaattgaacaatgagaacacttggacacaggaaggggaacgttgtatggattaaatgagtaatctttggaaagtgcttacacctgagcctggagcaagtcagagctcagcctcctgggtgctgctgcgggtgctgcccctgtcctgggagtccttttaaaatcatgtgtgtgccttccctgtctcatctaccctgttccctttccctagaggtaaccacttaaccatttttattattattttggttaatccttccattgtttctttttggaaaaaaaaaactaagtttatcttcttcacacacaaacaatgtcctcctttttacaaaaagatattaatagcgtagcatgttccttttttttttttttttttttggagacggagtttcactcttgtcacccaggcaggagagcaatggcacgatctcggctcacttcaacctccacctcctgggttcaaacgattctcttgcttcagcctcccgagtagctgtgattacaggtgtgtgccaccactcccagctaattttttgtatttttagtagagacggagtttcaccatgttggccaggctggtcttgaactcctaacctcaggtgatccacccgcttcggcctcccaaagtgctgggattacaggcgtgagccactgcgcctggccccttaatagcatgttctatgcatgttctgcacagttatctttttacttgctctgatttggagaggttccgtagtgtataaaaatatcttccacaatccttgtatagttatatggtactccatattttgaatgtaccgtaatttattcgaccactagcctgttggtgggtatttgggttattttcagtgttctgctataatagtttgtagcacatagccttgtacaaacttttttttctattttgccaaagtgtcttttgggatagattcctaggagtgggcttgctagatcagaagagtaaatgcatgaataactgctctggattttgccaaatgtttgtcttcagggccatcccgttttgcagtcgtgttgagtgcctgtctccccgttgccatagaagcagaatgtgttgcctctttggtttttttgtttgtttgtttgttttgagatagagtcttgctctgtcacccaagttggagtacagtggtgcgatcacagctcaccgcagcagcctcgacctcttgggctcaggtgatcctcccacctcagcctctcaagtagctggagctataggtgcactaatttttaaataattattattattttttgtagagacagggtctgtgttgctcaggctggccttgaactactggtctcaagtgatcctctcacctcagcctcccaagtagcttggaccacaggtgtgcaccaccacgcccagctattttttttttttttctaaatttgaggccgggtgtggtggctcacgcctgtaatcctagcactttgggaggccaaggcgggtggattgcctgagctcaggaggtcgagactagcctgggcaacatggtgaaacccgtctttactaaaatacaaaaattagctggatgtggtggcgggcgcctgtagtcccagctactcaggaggctgagacgggagaattgcttgaactggggaggcagaggttgcagtgagccgagattgtgccactgcactccagcctgggcgatagagtgagactccatctcaaaaaaaaaaaaaaaacttgtagagatggggcctcactgtgttgcctaggctggtctcaaactcctgggctcaagctatcctcccgcctcagcctcccgaagttctgggattacaggcgtgatccactgtgctcagccttgtttgttttttgtcagtctgatggtgcaaatagtattttcacttagttttgtttttctcttctgagctaggttgagcatcttttcctttgtttaagcgccttttgcatttttttctgtcaaatgttttcatattttttgcccctttttctaccagatttttagtctgttctcaatttttataatttctttaaagattagggatattagccctttgtagtattttgtaaaacttcctggcgaggtgtagtggcttatgcctgcaataagggaggccaaggcctgaggattgcctgagcaacatagtgagaccccgcctctacaaagcaaagcaaaacaaaacaaaacaagcgcacctgtagtcctagctacttgggaggctgagatgggaggatctcttgagcccaagaggtcaaggctgcggtgagctgtgattgagccactgtagcccagcctggttggcagtgtgagaacctgtttcaaaacaaaaacaaaacttcctgaggcactggcgtgattaagataaataaacccactgaacctgagggactgttggtctggggagggagacagcctcataatggatgttcatgtacttgcaaagcggtgatagctagttctgcctggggggaggtgatagctagttctgccttgggggagtctgggaagacttcccgaaggtggtggtatttgacttgggtctcaaagcttagtcatttcccagccaagagaagaggagctgaggatttccaggcggaggaaagagtatattcaaaaaagtggggaaataaaaggagttggttgtgtttgggtcaggtggttctgggaggggtgagagaggagcctctcagattgggaggagcccggtgggccacgtgaagccttcctagatgacaaggaaagcaaggagaggtttgggagtgggccctggctctgagactgtatgcttcttccagtcacctgggagtttttaacactgtggctccctgccccctcccacactgatgctcatcactggtggggtggggccagtggtcactgtttctcaaagcttgtcaggtaattgtagtggcagttgggatgaaatcctcccgttgagagaattgtggcagcaggttggaggaaggatggacagagaacaaacttggtgtgcttaggaaccacctgggctcttggcaaaaattcatatttccaaggctcaggaggttgggagtggagcagtaacttgctttttctttacttttttattttattttatttctatattattattttaataacctgtattttgtttttagagtagtccagtgaagtagtgagaatggggtagagaatagagcaaggagttcagtctgtaactgattgtgaaccatcgtttgagatagctcactgccttcaggccagcggtaacctgcatttttaacaaacgttccaggggttctgatgtggtggtctgggtcacacgttgagaggcactgaggcagagacaagaggcagaacaacttaagcctgaggtaggcggagctgaagaggaggggcagaatcttccattattttaacaaatacaatcaatgatcctaggtaggcaattagaaatggggagtgaaggaggaaaagagttgagcacctgctacttcttttagatttgatgatgctattaatattaactaaagaggaaacgtgggggtcagtgaacagtgagatgaggtacatttcagtgtggaggcctggcccctggggacgccagcctgcaagactaggttggattagcagtgatgctgacagagcgggagtgaactcagccaacccatcgttatcagacaggaatgcatttggctgtaggttgatgtcatcaggacccacactggctaccttgtggcctcagcatggctgctgcagcactaaatgttgtatgttcatttaaagcaaaggtggcactgagactacacgtgttcccatataccagccaagcacttgcctacctccccacccccaacagaactgcttaggtctccttgaccagtactggggcagtggggattagccctatgatgaaaggtcccccgcgaccaccacccccagttcagaaacaaggtcctgtgagcagtgaggatgtgtgtgtgtgtgtgtgggggggtgttaacaccacataccgcagcataccgcagtaagagaagcgtcctggctttaggaaagtgggtgtgaactccaaatgaggggcagacctggagccgctctcctgggggtttgggcatacacatcgttgccactttttggcttttttgggtttggtccttcctcacattagtgggggcaggaatgaggtgtctctcctcctgtcggtggaggctttggcataggagctttgggacatggtcgtttttaataatcctggtggcagtgcattgaaaaccagggtagtggcaatggggaaattggattctcttgatgggtaagggaaggatgactgtcctttttccatgagttggtgttttggagtcttcagaaaacctatgttgggttcctttctgtcagagttagcaccagactcagggcctggctctgcagagctgagcgggattctgcagtgcggcagttgcccggtgcgctctctcctgctggccgttggtgtcatgaagacgctgatgtggcacacactccgttgccaccttgggcgtgcacactccctcagcttctgccaggatgcggtaagatcagcttataggtagacaggtggtgggtaagttgcaggtagttcctgaatgaggatgaatctgtgggtagtgttttgagtagatacaggaatttacctttgcttaattgatttaaatccgttatcagcagacttttatgctgaagttttattttgccaacaagtattattgtctgggctctggtgtgtcattcattagccaagtggccttgggtgaattacttaatcctctggccctcagtttcgtaatgtgtaaagtgggaatattaccaccactttcaaaattggtgtgaagattaaaagatgaaaatggctcctacttgggtagtggctgtggtatgtgtgaagaagtgttggagataacctggaggtctttgaatatgttttgcatgccttacgttttgtgaacaaattattttctgattgcttcctatatgtgaatcatggtgcttgtaaactgcaaaccacagatgaagctttagagatagaattggagaggcctgggatttcttttgtgacctgtcattagttgttcaaccgggcaagttactcagtctctctgtttaccagttttcttatttgttaactggaatactagtttctgtctcatagaccagaagtgtttgttctgttaagaagacaagtaaatataaaaatactcatgaaaatttaaagtgatatgcaaattgggccaggtgcggtggctcacgcctgtgatcccagcactttgggaggccgaggtgggtggatcacccaaagtcaggagttcgagaccagcctggccaacatagtgaaaccctgtctctactaaaaatacaaaaaattaaccaggcatgtagtgcgcgcctgtaatcccagctactcgggagggtgaggcaggagaattgcttgaacctgggaggcggaggttgcagtgagccaagattgtggcactgcactccagcctgggcgacagagcaagactctgtctcagaaaacaaacaaacaaagagatatgcaaattgatagaaataagtttaccagcttctttccactgaaacatttgtatgttaattttttattccagtatttccacttttggggggctttgtgaatttgggtgatgttgcttaattaaccatagtcaggtttctgttttacctgcttttttgttgttgttgaaggaccggggaagtctaaaggacagataggtggctgaagtggacatttggctaattttctttcctttctgctactttttttttgtttccctccccagtttcccagctgtctgcctgcagcccctctgtccaggtcaccttgggcaggctgtggcttgctgccctcagcctctggacacgactcttggtcagtcccctccattttcttcacccccacgtggcagctgtttttcatttgtttgtcttttactgcgtaaatgtggaaatcctcactccttacatgctcaagacattaacactaatagtctgagattttacttctatccttatattgattaactatatttttccctttaccattttacatgcagaataatacatggagtatacacataagttgtgaagcacagtcacggactgtgcacacgtggacccacctgcgcggctgagtgccagggtgctcttctgtggcatcctccagggttaagcatcctttggggcttagtctccatttgacttactcttctggtaaatgccggttcacactttttacctattttctctttggtggtttttcttttttatcattccgtgggagtttctttttttctttctttctttctttttttttttttgagagggagtttcactcttgtcacccaggcgggagtgcagtggcatgatctcggcccactgcaacctccgtctgctgggttcaagcgattcttatgtcccagccaccgaagtagctgggattacaggtatccgccaccatgcccagctaatttttgtatttttagtagagacagggtttcgctgtgttgcccaggctggtctcgaactcctgacctcaggtgatccacctgcttcggccttccaaagtgctggaattacaggcatgagccaccgcgcccagcccgttccatgggagtttctgctatattctggttactggttactgactggctgtcagcagtagtgtacctttttttcccaccttggcttttcttttatctctttctgaggtgtctttgatgagcagaaattctcaattgcaatatagttgagtttagcagtcatagcttatatctaatatttttttctattacatttaagaaactcttcccaattccaaagtcattggaaattctctgtcgtctgctggacgttttgaagttcttctgccttttgctgtagcgcacccagagtctgccaggagctcacgcgtgtggtgtccttggctaacctgccatctcagcccctttgctgaagtccccctccctcccaaaccctggtttgcagtgctgcctgttacacatcaagcttccaaatctgcaagggtctgtttctgggctatctttggtccccaaattccgcttctcttaatttgctttaaggatagttgaggacataagcagatatttacttacgggaatatccactgaagttctgatgatagcattgagggaacgggaagcattctaaatgttccggcagtgggaagcaggtgaatgatggaggggagggtgtgtaggtgccgtgagatactctgtagccggtaaaaatgcatttgctgatgtggctatatggtgataatatacatgacaaaaaaatagcaaggtcacataacagtatgtacagtatggattccacgttcataaaaagaaagttgtaagttgaaaaaaacctgttatcttgctttctcctgtcctggtcacactcagggtgatttgatctggcttcgaccccatcaggccaccatgtccgctctggcaggtcctcggtgaccccctggtggctgcttcctttatcctcagctcagttctcatttatgacctcgctgctgcattggacatcactgatgcgatcttctcgacgtgctctctgctctcctccgcttctgcccactttcttcttgttctcctttctggctttccttccttggtattggtgtccctgggttcccatttccctgggcctccgtgtactccatgctttctcctttggggcccttggcaaggcatctcctgtgttaaaacttctacatcacagacctgcagagctggccgtcgccttacactgaactcccctgacgtcctcgaggcccgcagagtcagcacatccagaatgaaacccacatccccccactgagccacactctttggaggcatccaggatttctgtcctgtctcctccccttcgcctcggtcgattctcacatctttctgaacattcccatgcctgtgtccatctctcccctgccaccccagactcttgtcatcagctccccccttatgcgagtttctggagtgttctgccagcctccacatttcacccctcttctttcccacactgtggccacagtcagctttccagagtgtatttctgagccaccaccgggctctgtctgtagccccagggagcagctgccggcctctgcttgcccagcccctcctccctggcctgctcaggtacctgttgtctcaggcagctcccttatggggcattgctcactgccctgtgccccacatcccagagcactctggtgtgtacacatccgccttcctctggtctgagctcctggccatgcagccctcagagcccagtgtagtgaccagcatctggtgatgcagccacgtgtcagagagggggcaacctcaccctgtgcttgggcctgctagtgcctttcagacagagtccattctggactttccctgcctcctggtttgaagcccttttcaaggacattctcagagctgtcttactgttaagcaaggaccactggagacttgcgcttccccccaagcagctgcacgtggtagtcttggacctgtgggctgggcatatgtctgtcgggtcagtgggtggccgtggaccacactccagctcaggcccagtgctctcgccaacttcctctggggagcccagcactgggattggtgtcttgcctgtgtttgctggtgggcgcgtgttcactttccacctgctgctctctgactggagcttaagagttttctcggtgctgtgtgtgttgcaaatttgtctctgattggaataagggtatcttagatggcttgaacgacagttggcccttttgtttgtgcatagaacccaacaaagtgactctaagagcccggtggcccggcatggcccgagcgaactgtgcaggggcctggccctttcactcctgactctgctctagggggcaaggagaggcctcgtcagcctagcagcatttcctgtgggtgcctttcacagctgccacgtgcaaaatacagcacattattttggggtgttattttcttgaccacttttggttcattgcttttgactaaatgtttaaaaatattctgcagcatatctatagtactcacaagcagcgaatcaggagaagaaatgcagtttctgagaaggcttcaaagaaataatggtctttatcttttccccagccttttccgctgaaacccaccagtctttttctgagcactcttgttataaataaagcagcagctctccttgggcagcccaagatcgcagactctcatccgccctcagaaagattgtgcgtgtgcgtgtgtgtgcgtgtgtgtaagtatgtggtgcagtgagttgtgttttaattttgcttttcttttatgtatgagatgtgtagcaggagatgcaagaaaaaatactccagcatctgtcctttaaagataacttataacttttctgggttttgggttgttggttttgtcttttttttttttcccatttagggaagagatggaagtgattgctttccccacaaaggtaaggaagatgaatggggggccaggagagacgtcttcacagtgaggcctttgaggtcaacagagaaagggtctcgtggtatatgtttcaggcttccatggatggcattgttctgtgcagatgtatttgaaatgagtttcatccatgtgtacttggatgtgaaaaggatgtttggaaacaaataccatttcccagtccttcacactgaagactggtttatatcctcgctaccagaatcggggtgggactttctgtctgccttggatcacccttggtctgttttggacgggacctcagatgctaactgtatgctggggatccccgctgtctctaggggagggggtgggggtggggaggtcacttctggcaaacaagcgtcatcagaatgcttgatcgttggataatgttgggctcctctctttttccttcctggcactctttaattactggggagagggtgggtgccttcttcagaagtgtgaggtgaatgtataagccaagaatgagtcagtagattcttcagcagctctgccctgcgctgatcctctagagttggaaagggctgctgttgtgccactgggtcagtgccaaaagcagagttcaccatgattggcacatgctggtgagcaagaagctcttggaagtggtcgtgagtgcagccagttccccccaacccaggaagggcacagtgaggatggctggttgcgggataaggagaagagacccctaggcagtttgcattggcctgtgctgtccgggtgtggtcctggtgtccgtccacatgttgatggcgtgtcgggctgggggctttctgcagccttccctgttccactgtctctcctgttgtgaatgccggtggatggaacaggcagcgcagtgttctgcgcttgcattctggcataggtgggggacatgagcctcctgtgtcttgcttttgctggttttatcttagggagttttaagtgtttgtggatacttaagaactttgtacatgcactgtttgaaacatttacgtaaagtgcagagctatatgagattaggtagttaagcaaaagcttctctgaaccaatgtgcttgtctttgaacagaatttttaggaagcctccctccatttccatgctgaggctccttgtggactgggcatttccgtgaggtgggatgtaacatagtgtgcgaacgccgagagccaggttcttgtcttcatgcttgtcgtttattctttttgattgtgttaatggctccgagtacgtcaaaacatctcatgaccaagtagttagttacgcatttgatgttttggtggcatgggctgcgtaaggcgggagagcagctccgggagaagtagagcccccttcattcttggctttaattgagccaagatgagtggaccgtataatccatttctggattctcgtaagagaacgtcttgtgttggggtgaactcatcagcttttcgggttgagaggagttttagtgtctgtggccgaggcactttcctctcatggtgtgtgcagatgcacacgccaggcctgtgagtggtgggttgggctgagggcgcgggcctggagcttctgagccccagagccgctgacgtagacagctttggcagcagcatcctgagaaatggcagggggccagagaacacagagacagggccaagaatagctgaaaaataccaaatgctgaagttggagaatgcactggccccgcgtcccagtgtcctcccagctgctgtgtactgtggccctgtgagcctcagtgtcccttcttcatgtctgccagtgcgtccagggcacaccctgggcctcttgacacccccacccacacaggcacacattgccccttagaggacaggattggtgcaaccccccatgcccccggcagcgtgctgggcctgtgcataggtcaaggtctgttgagagtgtgagaaatattttctgttagagacacgaatatgtttcagccgcaacaggctgcgtttcagccggaagagtgaaagggcaccttgaaaacgcaagtttatgaatatgtttctgtactttcagaccatcatcaaagaggggatgctgaccaaacagaacaattcattccagcgatcaaaaaggagatactttaagcttcgagggcgaacgctttactatgccaaaacggcaaaggtgaggccccatgcaggaaagcacacgcgaggacatcacaggagccgtcccaggggaggaactgggggtgctgagtccttgtgtgggaaaagcttcaattctcagatctgttattgccagtgagttttgtaacactccacgctgtcaggttttacttgtctcaaggcatgttttatttcttatcaaaattaatttctgttcattttccttttctttaatgtcatcggtaatggggaaaaggaaaaaagggtcacagagacagccgcgttacagctggatatctctctctcagaaaggcggagggaatcacggggctatgaatttcatcttcttattattaaataatttttattctttaagtatattgaagttctttttttttttttttttttttttgagagggagtcttgctttgtcgtccaggctggagtgcagtggcgagatctcggctcattacaacctccgcctcctgggttcaagcaattctcctgcctcagcctcccaagtagctgggattacaggtgcctgcaaccacgcctggctaaaatttttatatttgagtagagatggggtttcactatgtaggtcaagctggtctcgaactcctgacctcaaatgatctgcctgcctctgcctcccaaagtgctgggattacaggcatgagccaccgtgcccggcctagagatggggtttcaccacattgcccaggctggtcttgaactcctgacctcaagtaatctgcccgccttggcctcccaaggtgctgggattacaggcatgagccactgtgcccagccaaagtagaaggagctgagcttcttgatgtgtgaacagaaatgggaaattctttatttttaggctttctagcaattaaccttgtttctgtgtgccctattgtaggtagatttaaagctagaagcaccaggtgggtgctgctggaggaggagcagccagtgaaagtcacagattactgccatgtttaagcggatgtggtgttagacattcagacaccagtgtgttggctgggattctgaatacctgtgttttttatcaggattggtgtcagtactaatattttggtatttaagaaatctggagtctgaataatttacattttgagacatatccctagaaagttactgcattaaaatttgaaatggaacaaagcagcttgtttagaaagggttctgaccacttccctcaattaaaaaaaaaaaaaaacacgacaaaataaccttttacagttagttctggtggtgcggggaggggaaaggttacttaaaagattgagtttcttttctgagttattagtttgattttctccagggttcctcatagagccatcgtagaatagaggggatggtataagggaaacaggaggcaggggctgtgccgggggaccctgtagggagtggagagggagacgggggaggtccccaggcctgactcccagccctgccctggagcatctttctctccaggaccaggatccttctgctctactcccttgtttcctttcacggccagaccctttccatttggacctgtctctcttctccagaagaatttgttttagccaggaccttccccctccatgtgctcgctggaggaacaagccaggaggacacggaatcctcagtccagaccccggccttccctcagctaaaacactgtgtgagaacatacttcacatgtaaaagtgaatactggtattgacagtagtaaatacagaaataccagcattgggttgtttgctttggttctctctctttcttccttcactaatgcaatgacaatgtttgtagatttttttaaaaaaatcatggcactatacctgtgagcccgagcttttggttagaagcaggtgggtgggttaatttggattggcttattgattggatgctacagtttcaaggtactggggcttctgtgggtgcttgttagggatcattggggtgtggtgggcagcgctggctagtgcttagggatgtacctgtctttatgtgccttagtccctgtgtttgtctctttctagtcaatcatatttgatgaggtggatctgacagatgccagcgtagctgaatccagtaccaaaaacgtcaacaacagttttacggtaagattcctcagtcatgcctttcttgattcttcactgaagttggctttcctttttgatctgaacatgtgtccaagcagttcaaacgttttcattcttttcttactgattggaatgattgctggtaaaatttgaatttaatgctgaaagtaatactgtggttggagaataaccaagaatttggcatgcataagcacaaaaggacaatagggaccaaatgaaaaatttttatatgtgttttggttcacgtctgttttgttttttttgagacggagtttggctcttgttgcccaggctggagtgcaatggcgtgatctccagctcacagcaacttccgcctcccgagttcaagcgattctcctgcctcagcctcccgagtagctgggattacaggcatgtgccaccacacctggctaattttgtatttttagtagagacagggtttctccgtgttggtcagggtggtctcgaactcccaacctcaggtgatccaccctccttggcctcccaaaatcctgggattacaggtgtgagccaccacgctttgctggttcacatcttactacctctgtacagagttttgttttttgtgattaatgtagaaaatttggaaaatgcagacaagtatgttaaagcaattaaaaagcagccataacagccacctcaaaaaacattgaatgttaatattttggtgtatttcttttttttttccttttttatgtttaaactttcttccttccaaatttataaaagttatgtaggactttctgcaaaagttctaaatgcacagaatcatgtgatctcaccacttggaagtggccagctgcttactctacagtgtttatctttatttctgtatatttatgtctttacctacatgtacccatgagatcatgctgaaccttttggtttacacctgtgtttttttccccccccaggacaatttatagtagagagttgctcatgtcagctgatctaaatgttcatgatattatttaatggctatagtagcattttcttgtaggattttataatttaggctttacgggctgactttagcgcctgcctgtgtaaggtttgactctaataacagcactagaacttttaaagctgtttttctttatgttattaggccatcccatgtagacaaaaagtgtgtaccctaattaaaaaaattattcttttataattcagtcaaggtgagtaattttcctcaagtttaggatctgatattttgggttagtgctagtttcaggtgctttcaagttttgttttattttatttattgatggattcattgttgatgttgccaatacaaatgggattttcctttctctgtctaaacctctgcttattttgtgttgattaactgctcttattttacttggagtatttgtagttttctctattaatttatttttaccagctgggaagagacatttttaaccacataaatagatttttctttgattcgtggtttttagagtctttaataggagtaggtgttgaatttctttggagtgttctgagcatcagttgattaattaatgaatttttttgagatgttgtctccctttgtcacccaggctgaagtgcggtggtgtgatctcggctcactgcaacctccgtctcccaggttcaagggatcctcatgcctcagcctccctagtagctgggattatagtcgtgcaccgttatgcccagataatcttcgtaattttagtagagatggggtttcaccatattggccaggctggtctcaaactcctggcctggagtgatctacccgcctgaaccttccaaagtactgggattacaggcatgagccactgtgcctggccctgggcattaatttagatgttcattttggtttcagttatttgcatatttcctaataaaaaaattattcttggtaatgttgaattttactcctttatcttgcaatttagaattttcccactggtatgtatgcatttgttttgggtgagaatgtagccttattgcagttttaaacaattgttttttctgtttttaattttaatggatacataatagttggacatactgtgttttgatttcagagttaaaccaaccccataaaattcatttagtaactttctatgagtttatgttttctgcaacattttatgtagctttgggattggttgtttcttaagttcgagagaatttattttaaattatttgtcaagaagactttttagggagataaggctgtaatagaaataaatcctaaaatatttatttcttgcattttgatcattttttgaaccttttcactttttgagtccacatctgtaatttactttcccacaaatttcacaccttcaaagttagtagcgtgtactgttgtgtagtttaaacacctgtgtctctggttgaatctcctttgcatttctaattttattagtttagtttgcttttcttgtcagatttcgtaaactctagcatttttgttttctttgtttttaaagagaactagttcttagattattgaacaattctccttttctgtttccttttttatttttttgagacggaatcttgctctgttgcccaggctggaaggctggagtgcaatgacgtgatcttggctcactgcaacctccacctcctgtgttcaagcgattcttctgcctcagcctcctgagtagctgggattgcaggcacctgccaccacgcccagctaatgtttttatattttcagttagagacggggtttcgccatgttggccaggctgttctcaaactcctgaccttgagtgatctgcctgcctcagcttcccaaagtgctgggattacaggtgtgagccaccacgcctggcctgtttccttttttttttttttttttttgagacagggtcttgctctgttgcccaggctgcagtatagtgctgtgatctcggctcatggcaacctcttcttcctgggttaaagtgattctcctgcttcagcctcctgagtagctgggattacaggtgtgtcccaccacgcctggctgatttttgtatttttagttagagatgggttttcgccatgttgtctaggctggtcttgacctcctgacctcaagtgatcctcctgcctcagccttccaaagtgctgggattacaggtgtaaggcaccatgctgggccctactttcctgttttctaattcagtgtctgtatttatgtgtattggtttttttttttttttttttagatggagtcttgctccgttgcccaggggggagtgtagtggtgtggtctcggctctctgcagcctccgcctcctgggttccagtgattctcctgcctcagccttgggtagctgggattacagacacatgccaccatgcccagctaatttttttatttttagtggagacagggtttcaccgtgttggctaggctggtctcgaactcctgacctcagtgcccaccttggccacccaaaatgctgggattacaggtgtgagccaccttgcccggctgtgtattagtttttatctgttgtaacttacgaaatatgttgttcaagtcctcttatgatcttgttttttatcgcttgagcttccataggctgttaatgaggagttagaatctctttcaggccagttacgtttaacactttgttcatgtatttctaacagttttcaccttctccattttgaagctttgttaagcgtgtaaatatttaaaaagataataccttcaatattgagtaatcatttgttaataaagattaataaagtagtagctttttttttcttctttcctagacaaggtcttgctctatcacctgggttggagtgaagtggcacaattatgactcactgcagccttaaactcctgggctccagtgatcctcctgcctcagcctcccagttagctgggactacaggtgcttgataccatgcctggctaatttttacatttttttgtagaagcaaggtctcgctatgttgctcaggctggtctcaaactcctggcatcaagtgatcctcctgccttggcctcccaaagtgctgggattaaagaagatctttttcgcaatgagtagtttgtgtcattaactgttctctcatgtatattagtatttctaagtcttcttttctttgttcagaatttacttgatatacataccccccacccttttccatcctaacttttatctttagttttccttattattttgaatttaattccctttttttttttttttttttttttttttttttttagagataggctcttgctgtgttgctcaggctggaatgcggtggtacagtgttagctcactgcagcctcaaactcctggtctcaagagatcttcctgcctcaccctccccagtagctggaaccacaggcattgtcaccacacccagctaattttttattttttgtagagatggggtctaactatgttgccttggctggtctctaacttctggccccaagtgatctgtcttggtgtcctaaagtgttggtattacaggcatgagccgatgtgccttgcctagatttaattcttgtaaacagtatgttgttagaatctgtcttattttagtcagaaaccctttgccttgtaaatattgtgcttcagccattttctgctgtcaggattcttgcatatctgatgcctgtgttttgtggctgaatgtattgtgctttcttgtttgtttgtttgtttatttatttatttttgagacaaggtcttgctctgtcacccaggctggagtacagtggtgcagtcatggctcactgcagcttcgacctcctaggctcaagtaatcttcccacttcagccttctgggtagctgggactccaggcacatgtgaccatacccagataatttttgtttttttgtagagaaggagtttcaccatgtcacctaggctattcttgaactttggggtgcaagtagtccacccaccttggccttctgaagtgctgaggttacaggcatgagccaccacacccagccatgctttcttattttaatggtctcttggtacctctcttctacttcccttctgtgttgtctcttaaacatttatagttcacagattttctttttcctttcttttcttttcttttttctcctcccctcccctcctctcctttcccctcccctccccgcttctctctttttctatcttcctttctttcctttttccttttttttttttaatttaaatttaagagacaggtcttactctgtcgcccgggctggagtgcagtggcatgatcaccatttaccgcagccttgaaatatcaggctcaagcgatccaccggcctcagcctcccaaaatgttcagattacaggcatgagccaccatgcctggccaagttcacaaattttattatgctagacctgtttgtagccagcccatatggtgacatcctttttttggtcaagctttgtgtattactgagggtttagtcacagagaacatgctactcaatgctttgtttcactagctcttattcgattcataccaaaccatgaaaatgaaaaaggactgaagaacatggaagaaaaataatgcaaaatggtctgttttccagaaaggaatcaaatacgatattttattagtgagctccgagaacatagtatttcccaatgttggtgttgcagggggttgtcgagagcaggctcgatgctgttgctgtctttgaaggcatttctgctcggagactcagagttgccttctctcttgtgcaatgcgggtttgctaactggttggtctgggatagagcaagcctgatttcttcctcactccagtttgggctttccagctttgaaaaactgttttttccttcttttctcttacacttgaaaaaacgaattctggttcatgtgctttgtcttgttctttgggaatttggctcgtttatttagtcattgttttggcaagcattttttttggggtctaccgtgggccacacaccatgctgagtgcggtgggtagaaatggagaggagccactctgcatcaagcttatattctcgtgggagatcagataagcacatacatagaaccttagttacaggctgagacaagctccgatggaagagcagtacatggtgcctgatatgtggaagaccccacctggccttggggaggggctgggcagtcttctcagaggaagtgaggtctcatagctgagacatgaagaatgatagtggtaaatccactgagggaagcatgagcctgagagggtatgtgtgtctgtgtgttggtgtgtgtctgtgtgtttctttgtgtgtgtctgtgtgtttcttgtgcaaataggcacctcggggatggggcaggtggagggaccagcagtgcgaagaccttgggatggggacaccacgtggagtgtgcaaagtggtggaagggccagggtggctgatggaggccagagcaagaggacaccagaggggaccagcgtggctggggggggccagagcgagaggacaccagaggggaccagggtggctggggggggcagagcgagaggactccagaggggaccagggtggctgggggggggggcgccagagtgagaggactccagaggggaccagggtggctggcagaggccagagtgagaggacaccagaggggagcagggtggctggcagaggccagagtgagaggacaccagaggggaccagggtggctgcggggggggccagagtgagaggactccagaggggaccagggtggctgggggggggggggtgccagagtgagaggactccagaggggaccagggtggctggcagaggccagagtgagaggactccagaggggaccagggtggctggggggggggccagagcgagaggacaccagaggggaccagggtggctgaggggggcagcagagtgagaggactccagaggggaccagggtggctggcagaggccagagtgagaggactccagaggggaccagggtggctggcagaggccagagtgagaggacaccagaggggagcagggtggctggcggggggccagagcgaggcgagaggacaccagaggggaccagggtggctggggggggggggcagagtgagaggacaccagaggggaccagagtggctggcagaggccagagtgagaggactccagaggggaccagggcagagcttgggacttactcctcaggacttgggctgctgttgaatagttttatttggtgaaattctcagatttgcaggtgtcagaaagttctactctggctgtagggtggagggtgaactggaaggggagggaggtttgtaggattgttaggagagagtggagtggagagtgcggaggtgtctagggggcagtgggcaggctagtgatcaggtcagaagggggtggagtagatgaaggtgtcagggcttctgctgagtacagcagcaggctggttaagtgagctcaggagtccagaagaggggctgtggggtggtgggggaggcttctttatcttccatgtctgtcacattctttagccttattttatttaatttgttggtttttttcctagttctagttatcaaagtttttatattgtttgttactacatttacttgcaacctcccctcccagctcccaccccccacccccgattttggcatactttgtatttatcctggcttattcttgtttgaaaggtaaaatttttttttttttgagatggagtctcgctctgttgcccaggctggagtgcagtggtgcgatcttggcttactgcaagctccgcctcccgggttcacgccattctcctgcctcagcctcctgagtggctgggagtacaggtgccgccaccacgcccgactaattttttttttgtatttttagtagagacggggtttcacagcgttagccaggatggtctcgatctcctgacctcgtgatccgccggcctcagcctcccaaagtgctgggattaaaggtgtgagccaccgcgcccggccaataggtaaaatattttttaaaagttttctgtttaacaaagtcattccctccagggaaagattttcctttgatcttctccattttctcttgggttttcacatgttttcattgacttaggatttctcccctgatttattaaactttgtgttatagtaattttagttgttgtcttcaagtcctacgcttgtttgctttttttgagacagtctcactgtgtcgcccaggctggagtgcagtgatgcgatctcagctcactgcaacttccaccttctgggttcaagtgattcttgtgcctcagccttccgagtagctgggattacaggctcccgccaccacacccggctaatttttgtatttttagtagagatgggtttcaccatgttggccaggctggtcttgaactcctgagctcaagtgatctgcccgcttcagcctcccaaagtgctaggattacaggtgtgagccaccatgcccagttttatcatcttcccttagcagcctagagctgtggaacactacaagactgtagggtccattcgagttttatgcttttatttacttatttctccaagtcagtgtttttcatcatttttaaacccatgttctcttttgatgaaggattaatttttattgcctcatttagtttttgaaatttcaaaatgcagcaaaaaggaatgaaagcagtgggctttattctcaccctccctgaccctcctggagagtcattcctacctgtattccatttggtcttatttatttataatatatgctacatgagagcaaggatttttgtctgttttgttcatggctttacaccaagttcccagcacacagtaggtgcacataactctttgttgaagagtggcttggtcacctccagttccagaatgatttgggccctgcccctcattgttcggctctgcaggaagcttcctgggaccagatgctgggcctggctgcaagatcaggtcttccttcctgcagggcacagtccatgtgcatcccagcagccacggcagggctggggaggaactgatgtgggttgcttctctgggcagggcatgggggttccctgcctgtggtgggggaagggggtacgtggctgtggggtggaagggatgtttcttgccagagggagtgggcgtgggaggtgcgctgggtgagcagcctctgaggcaggaagtgctttccaggctggggtgggtttgggcttttttgtcagagctgtgggaagccattaagattttaaagcagggtggtaaagttgggtttttgttagaagagtctgtctgctgctggaggcgagatctgcagggaagagttggctaggtggatgagaaggggtgcagaggggcctttcccccaacatgaggatgtggacagcctggatgtgcttatggaggtgagagatggggcctgaggagagccatgcactgcaggcgggcagggtccatgcttctgctgttgttggtacttttatttgttttgggtgactctgagaattaaatattaataacagtgttgaaggaacatactgtatcattggccatgatgcatgcctcctagaaagcagcgctgtacacagtgacatgatcacagcacccctgcaggactccagatgcacagtttcttctcctcactgagagtgttttggtattgctggcctttccagttctagaaatgtcccctttgagactgacttcatggtggctggtgtcagagtctgtgtcccttgtgaaggaggcagaatcagagctaaattcaatttagcaaagattttctagactaagtaggaagagggctcatcacccgaagtgggcgtgggtgctccccatagccaggctttgtctacaggacagcgggaggcagtcaaggcctgagccctggccaggtccctcggagggcagggagcctggagctaggagagagtggtgatgcagggtggccatttccactcccacagggccctttgcccttcacacccagtgcccactgccctgtctgagacgcctcatgctgtcctggcctgggcctccctggccacctgctggcatggcctctcccatttgtgggggtgccacttcctaactgcctctcctctcacggctctccttccgtgccccctaccttgggcaggatgtgggtgggatatagtttgagtccatctcgggtgctggttttatgaagcacacatttgactccctcagtgggtggtggagtgtgcagacctgagctccctgagctctctcgggtagccctggtcacctctcatgggcagggctgcttgcacagctggagggcaaggcctgagctgctgttcccggagagctagagctcgacaggcctggactgcccaggaggcccgtggaaaggctgatccttcctcagttgttgcagctgagtgtgtgtggcctcctgatgctacatgttcagttgccttttacttcctttatgagggaagttttatgctacgcggtatttccaaagtgtgagctccccagaggaatcagggactctgtctttgaatgtccagggtctgtgtatcctctaccagatagaagacccaaggcagcaggactgggctccttctcttcttttgatctctgaaagtacgggactctgcaaggtaacttcattctttaaggcaagccagagtgtgaatcctagctcagcttcttccaagcagatgactgggggcgagtcacaggacagctcgaagcctccattttctcatctgagaaatggggctagtaacctgccttgtggggtggtttggttgtaaggactaaatgagttaatgaatgtaggcatgatatatgtgtttgtgcctattaacactgtgattataggcacttactgattattcagtgaatgaactgaaagcaataaaccaaattcatttattatatcatttggtatgtggaaaattttcttctagtttggtgtacttaacgtttcatactttctctgtttactgaataataactttaattgaacaaaatcactactaattagtccagatttcactgggcttcagttagtctggctgtattattactactccctgggtcatggcaactgtagctgaggtgaaccttagagaggaaagacaagttttactggaatatgcctgaaatacagagccatttagaagggtcatattctgcccattgttaaaagcgctgtgaactaaggctgggcatggtggctaacacctgtaatcccagtgctttgggaagctgaggcggtggttcaactgaggacaggaattcaagaccagcctgaccaacatgatgaaaccccgtctctactaaaaatataaaaattagacagacatggtggcgggcgcctgtaatcccagctactcaggaggctgaggcacaagaatcacttgaacccgggaggcagaggttgcagtgagctgagatcgcatcatttcattccagcctgggcgacagagtgagactctgtctcaaaaaaaaaaaaaaaaaaaaaaaaaaaagcaagcactataaaccatcgaggggcccctcgtttcttacctaatgaagttcagggtctggtcctcatgtgccctcccagcctggcctctccccagccaagcccagtgcttcttagggagctccctgtgtgtacgggtcacctgctggccctggtctctgggggtctgtttccccaaattctccccaccgaccctgtccgtttcctcctcagggaagccttcctgtttacatggtgctcaggaaactgccatatgcttctgtgggactgtggttctcaaacttggccatgcccgagcaccttttggaactttccccagaagtttgcaagtgggtgctttttcaaagctttccaaaatcttagggtacaaccactttgggacccccttcttgagggtactttgtgtcactcatgtgatgctacattagcacaagctccctagtaatgtgtacttggccacaccttgagctcaaggccatggagtgtcttggcagcttagggtccccagtgctctgccctttggggtgactatgtgtatgaatatgagctggaagaagcaggttctgttgcttctttttgttagcacaacagagagaatgttgactcaccccttccttggcaagccccgctgaagaggtgctcactattgtggacccctctgtgggccaggctcccccttttacaatttcccagctcatgtccggccggcagcttggggacaaggttagcccctgtgctctgtgtgtgcgcttttagcgagtttgccagctggaaaacttgtttatcccagagaatggaggagtcatttgacaagtaaggcattaccctggccacctaatttcaaatcagttggaaaagatgcaagttttagaacttgttattccttatttgaactatcctgtatcacggcaaactgtctactgagtgcctgagggtgtacggggtaggtaagtgtgttccctactctgggagacttctaacagtatataaagaagtagttctagtgccctgtcataagtagagtggaagaaggtacaaagtacagttagagtggtggtggttagccttgggaggggaggtaagcttctctgaggagcggcatgagagctggatgtggggacgggtcccttttgcagagaggactggggaagagtcagggagtcggggacatccaggaaataggtggtaggagtgtctgttcatgtgacacactagcagtgcctgctttccaggtacaagtcctcctgtatggattcatttgttaacttagttcttaaagtgtttgaatcttagtaatgattttaaaggaaatttaaaatagggagaaaatgggctgggtgtgatggctcacacccgtaatcccagcactttgggaggccgaggcaggcggatcacctgaggtcaggagttcaagaccagcctagccaacatggtgaaaccctgtctctactaaaaatacaaaaattagctggatgtggtggtgggcgcctgtaatcccagctactcaggaggctgaggcagggagaattgcttcaacccaggaggtggaggttgcagtgagccaagatcgcaccgttgcactccagcctgggcgacagaacaagactccatctcaaaaataaaaataaaagtaaaatagggagaaaatgttcccacagtagctctgcagttgttttcttttttcatgtttctcttcagacttttttttttttagatggagtctcgctctgttgcccaggccggagtgtagtggcgcgatttaggctcattgcaacctctgcctcccgggttcaagcaattctcctgcctcagcctcctgagtagctgggattataggcgtgtgccaccacacccagctaatttttttgtatttttagtagagacggggtttcaccatgctggccaggccggtctcgaactcctgacctcgtgatccgcccaccttggattcccaaagtgctgggattacaggcgtgagccactgcgcccttcctcccttcagactttttaataggcacacattaaattttacatgtgttatatacatgtataattttgtgttttgtgttacaaagttaaattttgtgttttgtgttacaaaattacattttacatgtgttatatacatgtataattttgtgtttacatgtgttatatacatgtataatttacatgtgttatatacatgtataattttgtattttggctttatttgctgttttatcataagattccccatatcatgagtctctgtaatgatcgttttttatggtggcagatatttcattgtgtagatgtgtcatcactgatcagttaaactttatttgctcactcttgcagcattaggaactgagaatgtttcagtttttcctgttggagataatgctagaatgtgcatttcagatcacaggagggacatttagggaggtgagtttgttctcccctgcagagcagcttccatgctgagccctgtttgcccaggagagggtgcagtttgcccttcaggagctgctttggtttggtcttgggttcctttttgttacctgccctgagagttgagaagacaaaacttcctcctgctttgggtgattctagtttggttctggtttacagctttatttttgagtatttctgtatttcagcttctatttactttacaccattttagatagatcatcatttgaactttcagatatcctaagcctccagaatctctagaggattggcatgtcacataactttaaaaaagcaatatcaagaagaagttgggtttgttgaagggaagtggacagatcaggggactctggcttatatggctaagctggtggaggaagacatgtgagcagacattgggtgaacgtctgctgttccagtggcacatcctggaatgaggttgggtggagggtaggtagagagctgccccaggtatggaaggtggtagaagaagagttgagtacacacttgcatgagggatggggctggtttacaggaatggaaccagcttggaaagaagacagaaggtgagaagtgaatacttgttggtatcatgtaagaacagagtgaagaaaaaggacaggccggcccttggtttatttttaaatttcaggaaaatggattggccaaataatggggatcaaaaataaagggtgtttttattatgagccaagtgaaaattaaatttaagatatgtatgttgttatggtttgattgtgtcctccaaagttcatgtgttggaaactgaagcgccagtgcaacagtattgagaggtagaaactttaagaggtgatcagtgctgggtgcagtggctcacgcctgtaatcccagcactttgggaggccaaggcgggcagatcacctgaggtcgggagtttgagatcagcctgatcaacatggagaaaccctgtctctactaaaaatacaaaattagctgggtgtgttggcacatgcctgtaatcccagctactcaggaggctgaggcaggagaatcacttgaacccaggaggcggaggttgcagtgagccgagattgtgccattgcactccagcctgggcaacaagagtgaaactctgtctaaaaaaaaaaaaaagaaagaaaaaaaaagaggtgatcaggccaggagggctctgctctggggatggattaatgctgttattgtaggggtcagttcctaataaagggatgagttcatctcctcccccttgttctcactgtcacctttgacgcagcatgaagcccctcaccagatgccgcaccatgctcttagactttcgaactatgaggcaaataaacttctgttcatttaaaattatctagtctgtggtattctgttacagcagcgcaaaacagactaagacacatgtctagagggctgcttatgtgtaatagctatataatactgcatatataaagggcagtttatatttaatgctggtagaatatcatgaaggtagtgtatgttagagttaggtttagctactgtattagtttctcatggcttccatagcaaattatcagataacatgaaacagaagaaatgtaattctatcacattcctggaggccagacatctgaaatcatggtgttggcagggctggggtcctaggagagactctgtgacttgcttttcccagctcctggtaattccaggcattccctggcttgtggctgcatcgcttcaagatctgcctctgtctccacatggccttttcttccttcttctgtgtcttctcctctgttttcttaaacagacacctgtccttggatttagggcccactcagataatccaggatgatctcatctcaagatccttaacttgattacatctgcaaagactgtttttctaaataaggtcacattcacaggttccagagattagaacatggacataccttttggaggccatcattcgatgccctatagctacaaataagaatggtgtgaacaggcaaggttttattctttcacaccaaagaaagtagtccttggtgagtatggtcattctgcaaggtcgaccgagcccttccagaatgtgagtcttctagtctaagaggctatgaggtgctagtcaccactgtgtctcctgttgttggacggggagacgaggagaggagaaagtgtgttgcctggtaggagttcataaccaggattcatggccccctcaaagcggtctgtggatatgactatattgtattaaaattggtttccactgtaatcataagtattttatttttggcacttagagaaattctgagaaggagttcataggcctcaccagactgccagaaggggtccatggcacagaacagacgaggagctcttgtatgacttctccaaagtgtgacatggcacttctgcggacatcctcccggttgatctttagttatgtgctcataccgtatagctctcaggatgcttgccctgaaataatcatatcagaataaccatgttatgcagagagaagggtgatttttcatgtctgtatttatgacttccttttccccaagtaatatttttgaatagtttatggtatcaagaagtttgatgaagtatatcataaagaaggtcttccttgttagctgtgtgacctagggcagatacttcatctttctgagactcaattttctcatctgtgaaatgggataatactggactgtatctcaaaggtcattggattggcacagaagtgcgttctgaatgtttcctagtttctaatctccaccaccagtcatctctactagtaggaaagtaatagggtttaacttgctaacatgtaacagttattctgatttataggagtttcaaaggatttcaaacgaggccaactttacagatatattaaaaatagcttttgtagcagaagagtagatatccggaaaaagttatccttaaaagttttcaaggtataatcaatacaaacaggaaaaataaaagttaagggaaaaccaagtataatttaacatataagatgcctttaattggtagctaaataaaaaggaagctatgtaatggatcagagtattgcgtttaaatcttgtcatggcagagcacggtggctcatgcctgtaatcccagcattttgggagaccaaggcaggagaatcacttgaggctaggagtttaagaccagcctgggcagcataacaagatcctgtctctacaaaaaataaaaaaaattatccaggtacggaggcatgcacctgtagtcccagctacttgggaggctgaggcgggaggatcacttgagcccaggagttctaggttgcagtgagctgtgattgcaccactgcactccagcctgggcaacagagagagatcgtgtctcaaaacataaaataaatcttgtccatgtggcattcatatttgttgggtgaatgaaagttccctagtaggcctacctagcgtgaaactgtggctgagtttctcagctgtttctaacagacatcagcccagaggatggttaggactgcttcttgggtgaggaaccgtgatctttatccagatttcatcatcagttttcctttttagcatgtttggatttcagatattttctgggcaaaattcctaagccagttaactttggctcggagagaggaaaaactgtttttttttttttttttcagatgagtctcactctgttgcccaggctggagtgccgtgctgcgctctcagctcactgcaacctccgcctcccgggttcacgcagttctcctgcctcagcctcccaagtagctgggactacaggcatgtaccactacacctggcaaactttgtatttttagtagagacagggtttcaccatgttggccaggctggtctcgaactcctgacctcaggtgatccacccatctcggcctcatgggattacaggcgtgagccactgcgcccatccagagaaactgtatataattggcaaatgtctctgcataaaagactcttcctaattgctgcaactgctggcccaggtctgggacagggagaattgtatttgtgggtcccaaaagtcctcttgagtgtgaagtgtctttgctcttcctgttgggaagccccacgttcgttagcagctcctgccccctgggctcacttctgcaaagcaagcctgcctctatttctgctcaagtgcagtgttccaggagaacctgactgcatgtcccagctctgccagctctcagtggtgggttcttggccacctgtagcttcattctcccatctgccaatgagggtggtcctacctagcacagcaatggtggggcagtcgagcaccgggcagagtaggtgctcagtgaatgaaatactgtaattattaacacatgccatggacagcagtgcaggcctgcgggatcaggtgcagaaggaagttaacccagtgaattccacacctggtaatccacactgtgttctcaggttaaagaagcaggaggaagcaggcattgagtcaaattggtggctgtttgctaagtgtggggttttactgaaggcagcacctgcttctgcagcacagctggtctgaaaagccaggttgctccttgtgagggcttaggggtcggttttaacagtcactccaagcaggcacagggagaagatgctgtcctcttctggcagcctggctggtgagcagtggaaccaattgtggtgtctcttctttagagtttggggtgggagaagacgcagttactcgtctgggctgtttgtttagattatcagtggggtttgcatttgtgaaatctaagccattttcaccttatgattgtatgtgtttgaaaaagtatttgtgttgttaacacttgttatacttgttaatttttatgaacaagtgtagcgtacttgttaattgtctttatttacaaatggcagagaaaacaaagtggatagttgagagactgtcattggattatagtaatttagtaagggaaagagttctttgagaaaagacctggggggaagatacatggatttgattgaattttttcctagggtgcctaggcagtgaatactttttagccatctttactcagtatgcttttaaatgtgtcacggtgtgattgagccaagttccgtctgtctggtttttttttttccttgaaagttacaaaaatggtatcattctctaggaaatcatgttaaaaaaaaatcccacgttcccgtcccagaataacctggtgtttcacagtacatagtggtaggatctttttatttccttgaaacaacttgttatcaaattaagataatttcctgctctgtggtagggagactgctgtttattgacccagtccttcctcctcaccacacaattgaagaacctggtttgaagtgtaaacctaaaaaacatgtgatccccccataccgtttttttttttttttttttttttttttttaagacaggaggaggactgtgggagtggttatcagtagatctgtgcagaagggttggccctgcagactgggtctggtgtagaatgtgccctgtgggagctgcctccaggcctgtggctgggtgtgttaatcagtgctggacttcatacagaaaagtcgatgctgttttcttttctttttcttttttttaaatttggtagagatatgatctcaccatgttgtccaggctggtcaacatgatccaatcctcctgccttggcctcccaaagtgctgggattacaggtgtgagccactgtgcctggccaatgctgttttctttgtagctgaattgttcattggctgcaaagctatagagggtgggtcaagataattagatgtttggaaaatagttaagagggggattggcttccaccccattctttgattttttttctctttgaagaaagagggggggctcaagggacactgaccttggaggcaggagccttggggtttgtcctgtgcccgtcattgaccgggatcgcttccttttctgtaaatcaaggtcatgggcgcagctgacttgccaaggctgttgccagctctgcgctgccttctgaggaacttgatggtttgcttcctgtgaaaacttgatggtttgctttaaggtatcactagataccttggggtgatatctaatcacaccaatgaagagattgggtatttgtttttcccaaatccctaagtgctgatttctccagggcagtacacaacctcttatctttagcactcactttgacttgcataagtttcctggcttggatgataagctatatggtcaccctgcttattcagagaaaggttcatagtgttctttaatgactattctaatacatgaaaaccattttttgtgacttgagacataattgatgtacaataaactgcagtatttaaggtgtacagtttgatagtttttatacacacacactttctctctctctctctcataattacactgaagctgtcaccatagtcaggataacatttccatcaccctgagaatttccttgtaatccttccttctctgcctcttcacaggcaaacatggatggatttgttttctgtcattgtagattactctgcattttaaaaagaatgctatataaattgagtaatgcagcatgtactacttttttttttaatgtctggcttctttcactcagcataatggttttgagatttttcatgttacgaatatcagtagtccattgtatgcatattccagcatttgtctattctattggtgggcatttaggtagtttctagttttgggttattactaataaaactatgaacatttgtatacaagtcttttgtgtggacatattttcatttctcttgggtaaacaccttgaagtggaatcgctggatcatatagtaggtatatgtttaacttcttaagaggctgctaaactgttttctgaagtggtgatccaattttatattcccaccagcagtgtatagagagttccagttgctccacatcctcaccaacacttggtgtgatcagtctttttaattttatgtgtcctaatagttatgtagtgttaccccattgtggctttaatttccatttccctgatgactaatgatgtcaacatcttttcatgtgtttgttggtcatttgtatgtcttttgtgaaatgtgtgctaggacatttatccatttttttaattgggttcttattgagttgtaagacttctttatgtattttggatgtaagtcctttgtctgatacatgtgttgtgaatgtttttctcagtctgtggcttgtgttttctttaatgacacttttagaacagaagtctttctttttggtgaaattcaacttatcagttttttaaatggctcattcttctagtattctatccagaaaacccttgtctacctcggcttgcaaagattttcttctataagttttgtagttttaggttttacagttgggattattattgatgttcttcccccgacccccatatggatattcagtttttgaggcagcgtttattgaagatacattccattcctcatttaattacctttgctgccttttttcaaaagtcaattaaccttttatttttgagtctctttccagattttctattttgttttattgaactatattatgtctgcctttactgaaataattctacactttgttgattactgtagttttataggaagtgttgaaattagagtcatctttgttcttttctaacatagctttattctaagtacttagcattttcatataaattttaatattagtttgtcaatttctataagtgaggcctgctagaattttgtttgagattgtgttaaatctgtagatcaatttggggagaattgctatcttaataacattgaatctttaatgatgttgagttttccagtacattaacacgatctctctctctttatttaggtgctttaaatttatctcagcagtgctttgtagttttcagtgtagatgtctttaacgtcttttgttagattcatttcaatgtaatttatgtttttatttttattaactaaatggaatttataaacattttatatctgtttgctgctaatatataagaatacagtggattttgtgaccttgcaaaatactgcttgtttaattctagtagtcattgtgtagattccctagaaagttctatataaagttgtatcatttgcaaatagggacagctttacttcttcctttctgactcacatgccttttatttatttttcttgcttcattgcaaaggctaagattccagtacagtgttgaataggagtagcgaaggcaggaatccttccaccttttccagtcttaacatgaaacagttcggttttcatcattaaatgtgatgttagctgtaggctttttgtaggtatcctttatcagtttgaggatgttctttacttgatcgctgacagttttaattattaatgggtgttgaattttgtcaaatgcttttctgcatttattgaagtgaacacatggtttttttctcctttatattattaaaagggcaaattaaattggttgattttcaaatttaagacaacttttcattcttgggttaaaccctatttgctcataatatgttttttatttattgttggattcaatttgccattattttgttaaggattgttgcaccaatattcatgaaggtattgatctgtaatttatttctctccctttcttccctcatttcttcctttctgcctttgtcaggttttggtactttaaaaaatagagagtcaggccagatgtggtggctcacgtccgtaatccctgcattttgggaggccgaagcaggtggatcacttgaggctaggagttcaagactggcctggccaacatggtgaaacctcatccctactaaaaatacatatatatgtagtgagtcagtgttaccccgcctctgttttctgataaagtttgtgtaagcttggtgttctttctgaaatatttgctagagtttaccagtgaaatgatgtaggtatgcagtttttttggggtaaagtttttgataataccctgtgattttttttttttaatgttcagattttttgtttcttgtgtctgcagtgacattttctgcattctcttccttttccctctgatttatgtctgttggatggagaagtagaaactttatgagagaagggatatcatggggcttgttgatctgttttcatcccagcgcccccgaaccatgcctggcaccaaatagccacactgtaaatgcctgtggggttaattgatttgttgttgctgtatctctattccttggcacctctgggaagcatttttgtctccccccgtccacatgggaccgtgtcgtcactgtgctgtgacgggagctggctgagtcaggctggcaggctgtggctgccctgcatgccgtgccctcccacggtggctcttcaaattcttggctatgtgcccagcactggtacacagaccctctgagtcagggcttgccaatggaaaaaatattttcaaccttttttggtcttttaaaatattaaaacctatagttggaattacttcttttcatttttacaatgtacttgaagtatcagaggaataaggaaagccattgtaagcttggttagtggaaagggataaaccacctctgagcatccaaataaaattaggaagcgggggttctagatgagggaggacaattccaggaggctcttgaccttgtatatgattccctgactgggaatgtggtctgagatgccctttcctggacagattacaaatgacagcccctggagcaaacacatgaatcagccagggagttaaaaaagaacagggtagtttggactgggcctctctctttcaggacatgactgctgtggctacagactgcattcaggtccccagcatctggaaggagtctgtgcccacttatcctttgcatcctaaggggactgggtctttgtgcaccagcagcagccgtagaggttgggcttgggaatcaggggctcccttatcaaagctgggaaacttagaacaacagctgtgccgctcatggacctgtagtctctcctgttaagcagagtgctgagttcatgtgatagcaaacacagctctgccagaccacagggtcaccaggcaggcactccatccctccctccagggggagaccacggcatgccttggatgaggtgacttggccaactgtcttgtggccccagctcctgacattacaatgtgatgactgtgacacttggaagagaaatgtctcaggtatcgtggtcctgggtcctgtggtacaggaccttgtctctgcggtcctgtacttttgcttcacaattagaagaattgaaagcttcaggttgtttcaggtatgttttttcaagaagtgcaatagtagtgtgtttatagatgttttccttagagttagttttgggggagagaagatgactgcccttccatcctgcaggtggattggctggggaatgaggccatctcttttcagagtgagcagtgaaccatttttgtctgtacactgacctggggctgatttggcatcctgaccttccagtctgagggagttggtaaggggctggaagggcccattctttgtgtgtgtgggtattttttagagacggggtcttgctgtgttgcctgggccggtctggagatcctgagttcaagcaatcctcttgccttggccttccgagtagctgagactacaggtacatgctggacccacactttggactctgtccctgctggcctagttctttgccaagagcaaaacttgagagcaccctcacacaggtaacagttagaccttgtcaggagacatggctgttttcccagacagctgagctttcagactaaagcacagaaaagttggaggacatgggactccttagcccacaaaagaaactctattttaattttccatgtgaaataggagtagggtacgttagggtagggcatcttggttatgagatgcctgcagcaagtgccatcagggtggctgccagctgagtcatctccctcaaagagctttcctggaaccactctccccggtgatgtcagctccttcacctccattgctgtctctagctgcaggggtggttggagacccagtattttagctaggccctgccagaggccattgggatagcaggtcaatggatgaaggaggttgtataggcaaatgggagtaattatctctgatcttgatttttgtaggaaataggcgtagattaaggcatagataaatttgaaaaggcatagatacattaattaattaattagagatgaggtttcactctgtcgccctgtctgaagtgcaatggcgtgatcaaggttcattgcagctttgacctcctgggctcaagtgattcccgcaccttagcctactgagtagctgggaccacaggcaggcaccaccattcccagctaatttataaattttttttgtagaaacagggtctcactgtgttgcccaggctggtcttgaacacctgggctcaagggatcctcctgctttggcctcccaaagcactgattggcaggcatgagctgctgcgcccaaccaggcatagataaatttaaagacaccttttactgtagacaatttggaaaatagagaaaaccagagggaaaagaaaaaaaagaatctctcagtcctaccacttgatgtgtgaacctccagttttcccggctgcttgtgtcctgccttttttaaacacaatacgatgacatcagtatgtccccctttccctcatttatgttttattgtggtagaatactgttttattgtggtagaatacacataacataaaatttagcatcttaaccatttttaagagtacagtataaatatgcccttttataaattacttgtttttccctcctcgtgtggctttgttttctgtgtggtagccattctgtggtttacttaaccactctaagtattgaacacacaaacaggcttgaatcaattcatttgaaaaggtgtggacaagactttgtcctaagggtgacacctggcccagccagcagatgtgattgttctgccttggccaccttgctctgggaaattgtattgcttagtcaggttgaccttcagtgaccaaaaaagtggatggtagtgtcaagggcttcgggtagcttatgaaactctttttccttctcatcttgttactttcctcttgatacttacttgttaactacagtgttactatagacgcctttgggtatatgcagatttaccattagttaatcccagagaaaaatggataaattatgacagcgtggtggctgtcagacttaagaatgccaaagcattcccgtttctctccctccaccccatcccttccagacttactaccagggacctttggtttgcctttccttgtcaccaggactccgaggtctttcagctccttgtttcttctgttcagtagctgaaggatgcaggtactctgccctcctgctgtggtttgtttctctagcgagaagtccagcagcccagctactgaaagccaaggtcactaacgcaggatgcagtcagcccaggaggagcacagccctggacatgaagcttctggtcttacttctcccaccttcctgctacggtgtgcattgcagccgcaagctctgccttggaattgcttactgtgtcttagttcctgtgtgcatttttttattttttatttttttgagacagtcttgctctgtcatccaggctggagtgcagttgtgcgatcacagctcattgcaacctctgcctcctgggttcaactgattctccctcctcagcctcctgagtagctgggactagaggcacccgccaccacgcctggctaatttttgtatttttagtagagatgggatttcaccatgttggccagactggtcttgaactcctgatctcaggtgatttgcccacctcagcctcccagagggctgggattacagtcatgagcccctgcgcctagccccccttgtgcattttttaaaaggtgcagttctgtatttactgtagtgtttatgtggtaaaatttgttcatttaaaaacatttaatattgctgttgttcccttgatgcttggttacaaatttgcataagttctcagtggcctgccccagcttacctattcccatgggacttctttttacttttattgtgcccttttgtagagtatgagggtttttaggaactcaaaaattgcattatggcaaaaatacctggaaggttttcctgatgctaagattctttttaattccccttttaatacaaataacatgtatcattatagataattaagtgcagataacccaaacaaacaaaaaccactcaaaagtcttatcactgagattctagattaaacactattatatagacctgcgattctcaaacatgggtagggataaggcagtgggggaggtgagattggcctgaagaggacatttggggactccacactggtttgtcacagttgtgggtatggagagcaggggtacgtgctgctgacacctagttggtaaagtccagggaagctgctcagtgtccccagaggcacaacagtgttgtgcgacagcctcacaacaaagaattatttggctcaaaatgtcaatagtgctgaggttgagaaaccctgatatggacagatagttatggggcctttttctgtgaatattattaaatacactttagttttacaaaaatttggattatttatacagactagtttatgacctgcttttaaaacttattacttcatgaacatctttctgtgtccatgactatgggcctgtgacataccattgtgtgagcatgttggagcttacttcaccagccccctgtctggagactgaggtgctgccagcgttttgctattgaaaccacatttgtttgtattttgccttctgcatgctggttgactatggccagcccatgttggggcaccagctctacatctggggtgcctttcatgggtaataatattcccttcctgccagaggcccccccgccaaccatggcagtccccaatctctagttttctcacagttgaacataactcaagcttaatgaagtactgttgaaatagtgaataggtaagtaacacaatatttctgtcacgtttcatttttaagtagaactttcactttttgcttcattttactttatgggtttctaaaaaaataaataaattaaaacaacctatcttctggtaggttacatgtgactttaacttcttgccaagttggctttgctccatacctgggcttcctgagttcctggggaggcaggagtgggtcagatggaggatgccttgctctgactgtgctgtgggtggcacctgtcagttgtcatgctggggaccccctccttccccccaaagctgctctgaggctgcaggtgagatgcagcccaggagaggaagtgcatgacagctgtttgggcccacgttcccttttaggttgcagacagggcagcgtgcagagctggtgggctgggcggggtctgacacagtgctgtgcggagctcacccggacctgggcactcaggctctttctatatggggaactccaagagcttgtttgtgtggtggtgtctatttttgtgttttgtgtggtgctctgtgaggaagtctgttgtctacgcacatcccagctgctttgaatggtctgtctctgggggcttccaggtagggaattgtgtacggggaatccaggattcgggcagcatcggaacagcaggatgtgagtaacaggaagtgacagaaatgacccagggcgccagatgcttattctcggccacctttccaagcgctgcagcccaggagctatatttagcagagtgtttccgagtgcctcatcctgcccccagcaccgtccctttgcccctcttttggttggtggctgattgcacggtactgatttgctgctccagcgttcctgctctacttcgtaatctgtaggctcttgcccattgactttaacacccagtttttgtttgtgctgggtcacttcaattttgatacacgtggagcagctggaaactgttctgagcaggaagggcagcaggtaagagccccaggggacagtgtgccatcatactgggaggctgttgggtggtgagttcaaggtcagggtttggaattaagcggaaggaattgagcttccttgtaagatgctccagagggttgcttcttggcttgtatgtcttagaaatggaaggctggaatttttaaggtataggctttgtggtgtgactttactcatgtgctagaaacattctgtggttctcacctggccagacagaaagctgcaggtggaagaggcttgtgtgtggtgaattcctacagtctgagctttgtcacgggaaaatttccctccagtcccccaaagcaagcactacagagcccagatttgttctgctttgggtgtgggtggattttcaccttgtctgtcgacggtgcaggacctgtccctgtgtgctttgaggtttctagggtgtgatgttggtttgtggtttgtggaggggtgtgtgttgggagggaaggtgtttttgctgttctcctctaaaagctcccttctgagtggtcccgccaggacctccctttcctcccttcatgaagcatccaccttgttttcagacactcgagctatttgggattcaggaattgactctgggatgagaaatttgagagacaaattaggaacagttgtgtctgccatgagacgcgtggcagtcggcaggggcctggtggggtgtataaaagccctgggaaccctgcataaaggggttgggatggtaaaggagtgaattccaggctcaggcgctcaggagattcccctcccccagttccctcagcagagtctggctactggcatggtttcaggctgacctgttaaccttccgtatggctaaactacaaatatagggcatggctatattgtgtgtgtctctagttctggcttgggcatgttagcatatttttgtgccaaaacatttaaaacattcaaaaagtaacacatgaacccagctatgactgcttccagcctgagaaataaacataatagatataacagaggcacttggaattctctttcctatcctcgtttcttcctgctcccccttccctgggggcatcctaactttggtgtttgtcatttgttttcatgtttatatacttttttgataagtgtgtgtaggcataaacagtatatagcattgttgaactggttctgaaatgtcgaataaatgttatcagactggacagccacagcattacgcttcctggatttatccctgtggctacatctagctttagttaaatggttcaaggtttaatacaactgattcctgattcctggagttaaatcagaatttctggggaacgaggcatgaaccgcagagctcctgacaggcgcggcctgagttgaggcccacgatgctggttttcgtggcctctgtagtgttccagtacctaagacgtcctgttgtggacgtacactttcccagattccctgtgatcagtagtgctgctgtgaatatgcttatcttcgtcttcttggcacatgggcaagagtttctctagaatgtgtttctaaggatagaattgccaggtgtgtgcatcttcagcttgactggtgatcgtcaaattacctccagaactatcagcagcagtggtcacgtatgagtgatctcatttctatagtgtctttaagtttttcttttttaacataccaaactgagggcaagatgaagacctcatgagtgagataagacattggacattgctgagactttaatcgacaccgtgccctcagcatgtccacacggacctgctggccctgccgccaccccagctgtaaagcttgcttccacccacagtgtccccttcctgggatgggagcagcacccagccagctgctcggaggtcactgtggactcctctctgtctcaccctgtcccgtctgctgtcctcagagcacatccagagcctgcccactctcctcaccatcatctcgtgatggggttactgaggagcctcccaaaaggtttcctgccttctttcctgcatcttactgtcagctttcaataaagcaaccagaatgatgctttcaaaacttgagcttgcatggcttcttattttacgtggagtaaaagccaaagttcttacacctgcatggccctctgtggtcctgatgcttgcaggttggcccctggcccccttcctgatgccagccccagccacgcaccacgcgcctgcttctgctcagcccttcccacctccttccttgcttccttccagtctctggctccttcctcgcctcctccccgtttttgctgtggagtcccctggcccccagacctctcttttctggtctcccgtttttccatagggcttgtcaccagctactactctccatgctgtgtaattcacttctttaataagtctttaatttactgcctgcattcaaatgtaacttccgcaggagcaggaatcttttctgtttgctcaagtgaaagactgcctgaatttatttctgaggaagaaagaaagaatttggagcccaatgatgaagatagcacaggagagaggaggtgaagttgagggagcagtttctgacttgggaggttggggggatgggacaattactggtctctgggaggcagtggcagaaggaccttgaggccccctaagtgtgtagtaggacccccgaggggcatggccagtgggctgtggggctgcagaggcagcttcttttggggccttgtcttggcaccatctcggccactcccagagcatacattggtattgccgtagtgggtgctgggctggcccgccccacccaggaagtgcactactgtttgagggcaggagcctgcgattctgacatcctctcttcatggctgagctcctcaggttacatagctccactgattcctcaagcactgttgtgtttagaaatgaaaccttccatttccagggccctgccttgtgcaggctcaagtacccaggccacgtgtcagagcccatagcaaaatgagcagctcaaccggagggcgtggtccatgacactcctgcgtgtgcttggactcaggcgcagggacaggcggggcagctggcatttctacccacccctcctgacatagaggacctggtccttttctttgagaatgtgtaccaaaggtgtgtcggctgtgtccacataatattttcttggcgtcagatgtttcatgggttgcactaactacaaatacaggactttagataagattacacttttaacttgcgctgcccacatacgcccttgtccttaagaaacacagcattgttctggagttactccttggttttcccagtttaaacttaaatattgttgatggtggttacttatttttaattaaagcttttattttgagattctttgtaccctttacccagttgcatgcagtggtaacctcttgcacaactccagtacaatgtcacacccaggatactaacctcgttacagtggagatgggtagcctccaagccgcagagattttccttgtgcccttttacagcctcacacatgtccctctgtaacccctggcaaacactcatctggtctccatttctataatttggtcttttcaagatgtgatataaatggaatcttatagtatgtaacctttggggttggatttttcactcagcgtaattccctggagcctcattgaggttgatgagtcttatcagtggttgttcctttttattactgagtagtattccacgggtgtaccacagtttgttaatcatttaccccctgaagggcatccgaatagtttccagcttttggtgatcatgaataaagctgctgtaaacattcctgggtaggtttcggtgcaaacatgaatctccatttctctgggataaatgctgaagagtgtaattgctgggtcatatgctagtcacatgcttggttttttaagaaactgccaaaccgttttgcagagtggccgtaatgttttacatcccacccaacagtaagatccactttctccatattctctccagcaggtggtgttggcactagtttctgttgtagccatcgtgataggtgcgtagggctctctggttgtggtttcagtgtgtttctctgatggctaaggatgttgagtatcttctgtgtgcttatttgccgcttgcatatcctcttgtgctgtcgggggtgaggactcatttccaggtggtataggagacatcccggctctcagcttggcctcctctggatactctgttaggtgagtgctggagtgcctagctgcggcctgggagtggggtgggcatggttttttcttgtggcgctggctggagtaaggtgggtgttactgccgttgtcagtttctgtcttgtctgactgcccccttcctggatccttggcctggaagagcaggcttttgttggggctttccacccacccccccagtatccatcactgttttcggctgctgcttctttagctccaagtctagggtataccaggtaaaaagaaaacccagagggccaccacagtgtcatccctttggacaagacccttgtcaggctgccatcttctctctacctttcagggtctttttgtgttgattttctgatgcccatggttttcagttctcagtgagaggagtggggaaaagtacctccctgtcatctgaatttggacccgtgaaaagtgaagagggggtccattcagaatgttgtgcctctacccatccctgctcgctcgtcatgaccgttggaccgttgtggtccccgggcctcacattaattactcttaggcccttttggtttggcctgtggtttcagcgtgacacagtttgctggactttgatcttttttgtcatttaaagtgtcatttatgaatgagatccacgtccagatccctgcatgtccaaattcatggttagaaatggttggacaggacatagccatttgggtgctgtgattcagcctgatgtcaatcagtgaactgcctttgtcattatcctccagatcttatttctccaccttctattttgaactcttgggaaacctggtcagagtgggagggacaactagtcagatgacttaatgagatgttggtatcgtccttgtgctgatcctccaagccagtcaccctgccaaaacggaaatgaaatgtgccagacaccgcttgtactgagtgagcttgggagagctcgtggtgagtgccagttgcttccctgcctccggcccactggccctggtgtgaggcaccacccagatgaggagaggctgcgggatggaggtccagggctccgcctggagcccccctgcctggtgtcctggccacatcagctcatttgctgtgggactgtgagcaggcccctcagccgggttcgtcaggttgtggagaagctgaatggagcagataacctggaaaacacgcggtggattgccgagaccttctttgtgcctcgcccatattagccaaactgtcccttgttctatcagctgccatgtgtgtgtaagccagagtccaccctcttttccatttgagaaatcacgtctgcatgtctccagtatgtctcctttttcaccatgatttctcagagatcactccctgcggtttaataaccccctgggctaattcttcccaggacatgggaggacattttgtctggcttggcaactcatttagagtagcaaggtattttctcatttctcttggaaaatcatgtacttgaatcaagaatagaagccaaaattgttctttcaaatagaattttaaagcttttttttttaatccttaacatataaacgtaagactttatttttatttatttatttatttttaagatggagtcacaccctgtcgcccaggctggagtgcagtggcgtaatcttggctcactgcaaattccacctgccgggttcacgccattctcctgcctcagcctcctgagtagctgggaccacaggcgcccgccaccacgcctggctaatttttttgtatttttaatagagacagggtttcactgtgttagccaggatggtctcgatctcctgacctcgtgatttgcccgcctcagcctcccaaagtgctgggattacaggtgtgagccactgtgcccggccgactttattcttttttaatagctcatttttggattggcaacacatgcaagtggtacagaaatcttaaggctaaaaagatataaagtgtttcccagccactcagaggtcctctcagttagaggtgactaatattagtgttttctctgtacccatactcttcctgcaattggcttttatctattaacagtgtgtcttagaggttgttccatataagaacatgtagagtagcttcaggggttttagtggctgcatagttttctgttatatgaatgtactgtcattactgtagccagtctctaccagccttatattgatcactatttgtttggtttcaaatattttgtctttatagtgaatgccgccacaaataaccttgtatatacagtatgtgatttctcatgaagatacaggagaggataaatttatagaagcatggttgttgagacacaggtgtatattttcaagtctgacagattttaccaaatggtttccatagaggttgtattaatttttgccccagtgtatgagaatcagtagaccatattataaaacatttgatctctgtgaatctggtaggttaaaaaatgggatctcctaattttaacttgcatttgccttataagacagcgttttttcataaacgttgaaaatccatttctaacactgttttaacatagtgctgccagactctcatattcatgcttcatatttcatattcatattcatgtttccacctttctctccctgtctcttgtacagttattttctaaccagattttatgcaggagtctgggcagctctgcacacttttcttttgagttatgtggttatgtgtttttgagaaatcccaagttctgtatcctttttgactgaggtgcagcattcacatggaggagtgtactcattacagacgcacagcttgatgcatgttcccgaccacggagaacactgcagcccccggaatccctcctgtgtgcccctcctgtcaaagcagctgctaggagaagctagcatctaataccatagattagttatgtctgtttttttaactttatgtaatgcataaggaaattacacagagtatatgtcgtcttgtgtcaggcttatttctttcgctgttgtaagattcattacattattgcttgtctcccaatgtatgagtatactacagtgtattcactgtaggcctgtttagagtagtgatgctatgaacattctcgtatgctttgatgaggaaggtatgcgtttgcatttctgtgggatgcgtgggtggaattgctgagtcacagggtatatacaagttcagctgttttctgaagtagttgcaccaaattgcactgtcaccagcacttgatactgtctgttacagctcagccattgtgagagatgcatcaccctgtagctttaatttgtacttccctgatgactaatcaaattgagcaccgggtcatgtgctttattggccatttgtgaaatagctattcaagtctttcgtccattttactattagtttgtctgctcttactgatttttaagttctgttaccctcaagagaattccagcaggtgtgtaaaaattcacatctgtctatggctgttctagcctgcctcaggattctgtgagaaatgcatccaccattttatccactcctcctctgtgacatcacgtttctttctccagtcatcaagcatcaagatctgaggatattttctctctccagtgtgtaggtttccatgcagtcacctctgatgcagttctgctccttctcttggtgggacgtcctgcagcctggccttttgaatccctgggatgtcattcatttgtcctgttgagttcagtttattgccctgctttttttttttttttttttttgagacagggtctcactctgtcacccaggctggagtgcagtggtgcaatcttggctcactgcaacctccgcctcccaggttcaagtgatcctcccaactcagcctcccaagtagctgggattacaggtacatgccaccacgtccagctattttttgtatttttagttagagatggagttttaccatgttggccaggctggtctcgaactcctaacctcaagtgatctacctgcctcggcctcccaaagtgctgagattataggcgtaagccactgcgcccagccttattgccctgcttctgatttgcaattatcttttaagttgattcaggggtgtgaactgtttcttatttaatacatttgcttgaaaaatatgagccatcttttagtctccaaagacttttctttgtgaaggctggattttggagatagtttcagcttttttacaccattccttggttgccagtagttatgatactggctgcagtccagacatagggatgctcttagtattccttagagcatctccctgcaccctgccacctgccctggtgggcagggtgagcagccaggaaggcatagcctgagggcctgtatctagcccctgctttctcgcctgggtccttcctacccatgctgtctcccaaatcaagggattgaataggaagtgctgctcagaacatcccccagaatcagcctcccgaagagactcaccctcccctaccagaggttgggctgtggctggtgttaggggaacaggagtaggaggggagccagaggaggaggaggtgggcccttgcctaaggggtgcctgctggttggtgtgggggctggagctcgccaggaggggtgtgctgagaagatggaggcatggcatggaagtgtgagtcatggcaaatctcctgtgtgcagctggggaccgacatagagaaggcaggcccagttgtgtcccctctgtgggcagctaagaaggatggattctgacttatttggtgggactctcctgtgacatttcttgtggtttgggagagtggaccactgataccagagcagtcttaagaaagatgctcacatgggaaaggggtctcagcagtgtcaaatgatgacatcaaagctgagggcttcgaccccaaggtagcaccgatagtgacagtgcccagaacattatcaggttgcaccaactggcacctcacaacaacaaggctaggatgcgacactgctcttaatagctccggttttcagatggggcagtggaggcacagggcggagaagcacctgctctaagttacacagctagcaagggcttcagactcagggaatgtgccaggccctgtgcacatttggtcctgttcagtcccaccacagccctgcaggttgcttctagcatcacttttcttgacgagaagcaaagagggtctgcccccatttcgcaaatttatcagtggccaggtaggattcagatctgggtctctctcaggcttcttcacaacagaacaggcacaaataagaggtttttttttgttgttgttgttgttgttctgttttttccttagaagccaaaacccaggttctctgacatttatctgttgctcagtgtttattgtctgcaaacaacagcacaggtgaaggcaatgatgccattggtcacttgtatcttaactcactgtctttaaacctaatgcttttgtctataatttgctgtctagtagtgcccaatacccacaaagcaattctagtacaccctctccttcagtgtgtgggtcaggtgggcccaaagatccatcttctcaaacgctgaggctgagttctggagcaaagttggcacttcagctcgtaaaggctgccgtgggagtagtagactcaggacctaaaacatctccttgttgtcttctataaatatcctgttgcatgactcctaatataatccccgagttatgcacagtaaggtatattatctttctcttactatatttactatgctgacaaaagtgttcaaatattaaaactcacccagggtgaacagttcgggacgtgtgctcagacttgataggtagacagggacggtgccgatgacatgcacccactcggccttggcagctcccagtctcccatgaccgtccctcagtggctgtccagagactccctgagtcccactctcagggcccactttgtcgtcttcatggctgagtcagtgtgggaaatagttatctgcctgcctctccacgctgtgagttctgtgaggggaggaactttgctcaccatgttgttagaatccccagtctagaggagacacctagccagcatctgctgagccggggggtgtcctctggagggagaggggctgtttgtggtgctctcaagcttgaacagcagcagggcagaaggcagacggcccctccgggcctgcctttgccgtctctccttcgccctcactctctcccagctctgctgcttcccacgcccagcccggccccaggtgttcttctcccaccaacccaggatatgtggaagaagaagcgaaccatgcagtggcgacccagttccatttatcccctctgcggtgaaacttagtcactggagaatctccctgtaaagcactttctatggtttctgagccagaaacatggtcatttaataatttaaattgggtattcctaaattgggtcttcttaatgtaaattaaagctatgagatgtgccgaaatctaaaagttaaataacatattttgtttttgaatccatggggaagcaagcattttcctaacactgttggtgagaatgcaaaatggtacaacccctgtgggaataatttggcaatagctagcaaaattacatgtgcatttactctttgtcagggcaattctacttctaggaatttaccccagagatacactggtaaaaacaggaaaagatgcttgtaaagataattcacggcaacactatgagaaatcgcagaagaattttaaacagcacaaaattcccatccatagggcgctggctgagtcctatacagtggagtactgtgccactgttgaaagaatgaggaagccctggatattgctaaggagtgatggccgggatatgtaattaaatggaaaggcaaaggtggagaaaagtgtccatgctactgttgacaaaagggacaatgtgatatacatgtttgcatgtatcttaaaaatggaaggagaaaccttactttctctctctcttttttggtaaagcagcctatgggaaccaagataggggagagatataaaagctagatttctaaatctaccttgtttgtagatttgactttggaactccatcgctatattataatcattataaaacaaaattaagtaaaaggttatgacccttgaaaattttgatatacactatcaattttttctctaaaaagtttataccctgtttacctcctgtcagtacttgaggagaactctttttcccccacatgtttgtcagtactggatagtcatcttttaaaactttgccaatcccatgggcaaaaaatagattgctattttcatttgcattctctgatgactagagtgattaagcagctttttacttgcttattatccattttgtatttcttctgtgaggaagtccaagctagagcaatcaaacaacaacaaaaaaagaaataaagggtatccaaattggaaaggaagaagtcagattatccttgtttgcagatgatgtgatcttatatttggaaaagcctaaagaccccaccaaaaaaactattaaaactgataaattcagtagagttgcaggatccaaaatcaacatgcaaaactcagtagcatttctgtatgtaccaacagtgcacaatctgcaaaagaaatcaagaaagtaatcccatttacagtagttgcaaataaaataaaatacctaagaattaactgaagaagtgagagatttctacaatgaatactacaaaacattgatgcaagaaatggaagagaacacacaaaaaatggaaagatactccacgttcatggactggaagaatcaacattgtgaaaatgttcgtattacccaaagcagtctacagattcaatgcaattcctattaaaataccaatgacattcttcacagaaatggaaaaaataattctaaaatttatatggatccagaatagccaaaagacccagaatagccaaaattctcctgatgaaaaattggaggaatcacattttctgacttcacattatactacagagctatactaacccaaacggcgtggtactggcataaaaacagacacagaacaatggaacagaatagagagcccagaaataaattcatacatccacagtgaacacatttttgacaaacgtaccaagaacatatactgaggaaaggacagtctcttcaataaatggtgctgggaaaactggttatccatatgcagaagaatgaaactagactcccatttattgccatatgcaaatatcaaatcaaaatggattaaagactttaagacctcaaactatgaaactgtgaaaacactggggaaactttctaggacgttggactgggcaaaggtttcttgagtaattcccacaagcacaggcaaccaaagcaaaaagtggacaaatggttaaagctcctgcattagcaatgcaggaaaaaagcagtgaaaaaaagctcctgtttttaacaagttaaaaagttcctgcacagcaaaggaaacagtcaacaaagtgaggagacagcctacagaatgggagaaaatatttgcaaactgccaggcgtggtggctcatgcctgtaatcccagcactttgggaggccaaggtgggcggatcacgaggtcaggagatcgtgaccatcctggctaacacggtgaaacctcgtctctattaaaaatacaaaaaattagccaggcgtggttgctcacgcctgtaatcccagcactttgggaggccaaggtgggcggatcatgaggtcaggagattgtgaccctcctggctaacatggtgaaacctcgtctctactaaaaatacaaaaaattagccgggcgtggttgctcacgcctgtaatcccagcactttggaaggccaaggtgggcagatcatgaggtcaggagatcgtgaccatcctggctaacacagtgaaacctcgtctctactaaaaatacaaaaaattagctgggtgtggtggcgggcgcctgtagtcccagctactcgggaggctgaggcaggagaatggcatgaacccaagaggcggagtttgcagtgagcggagattgcgccactgcacaccagcctgggggacagagtgaggctccgtctcaaaaaaacaaaacaaaacaaaacaaaaattgaaaactattcctctgacaagggattataaccagaataaatcgagagctcaaataattcaaaaggggaaaaatctaatcatccagttaaaaaataggaaaagtagacatttctcaaaagaagacatacatatggcaagtaggtatatgaaaaagtgctcaatatcattgatcatcagagaaatgcaaataaaaattacaatgagataatgtcttaccccagttacaatgacttttatccaaaagacaggcaataacaaatgctggcgaggatgtggagaaaagggaaccgtacactgctggtaggattgtaaattagcacagccaccatggagaacagtttggaggttcctcaaaaaagtcaaaatacaattaccgtgtgatccagcaatcccactgctaggtatataccaaagagaaaggaaatcagtgtatcgaagagatgtctgcactcatgtgattatagcagcactattcacaatagccaagatttggaagcaacctaagtgttcatcaacagacacatggataaagaaaatgtacatatacacatggagtactatttagccatgaaaaagaatgagatcctgtcatttgccacaacatggatggaacaggaggacccttaatgttaagtgaagtaagccaagcacagaaagacaaacttcacatgttcttatttgtgggagctaataaaaaaaaaaagaaaacagttgaactaatggagataggcagtagattgatggttaccagaggctgggaagggtagtggggctggggggatggttaataggtacaaaaatgtagttagaataaacgagatctagtatttgatagcacaacggggtgacaacagttaataatttgctgtacatttaaaaataactcagagtatacttggattgtttataacacagagaaaggataaatccttgaggcaatggataccccatttactctgtgattattctgtgcctgtattagagtgtctcatatgccccataaatacatatacctaccatgtacccacaaaaaaaattaaaaagaacgttgatgtatttcttttgtgaaatgcaagttcatagccttttttatatcaggaagattttttttctactgattgataagaaccctttatatattatggatatcattttcatttgttgattattaccaggtcacagctttatttccagtcaagttgttcaggtcctgcatagtctgatattgaggttttctacaagaacatttatatgtgatacatgctcatggtattccagacttacagctgagcagacttccctcaactgttcaaatgctggccatcactgtgggctccctgaagcagtagcaactgtgtcttccactgttcggaaaacaacagttgttacttctttttttatttccttagggtttactactgtgtctaagtagcaagcaattataaatgtccacttaaattgattgctgatgaatatataaaaactaaatttcactgtctttttggtttgagatcattcttatttttaatttttagtgatccttgataaccatttttgttttcggttcagtgtgaatacctgaatgaaatagtaatttttatgtctgtgtgaggtcggttttaagaaagcgttcatagctatcagcacttgccttttgttcatggatctgttgaacctgtttctttctctaggtcataactccatgcaggaagctcatcttgtgtgctgataacagaaaagaaatggaagattggattgcagcattaaagactgtgcagaacagggagcactttgaggttaaaaaagaaaatacccttctccaaatgcctcctgttgcctccctcaccccagtgtctgctgtctgagtgtctcccacgtgcggacccacagtctggagctcacgttcttagcatgttctttatacaattaaagcttattgcttgtcctctcagcagacctgtcctttataaaccttcctcctctcctctcttggatactttgtttaatcttgtccaagttactgcatttaacaatttaaaagagaagtcttatctttgccctcttggtttcgttcttccagcccacccagtacagcatggaccacttctcagggatgcacaattggtacgcctgttcccacgcgaggccgacctactgcaatgtgtgccgtgaggctctgtctggggtcacgtcgcacgggctgtcctgcgagggtacggatgtgcgtttgttattctgtcaggaaaggtggcctggcattttacttgataaagccttggaaatccaaacccagtcaccataaataagccgttgtcacccatgtggtcagtcaagggcacagcgatttctgtgatgccattcttgtttattttacctgccgaagagtccttgataaatcattttttatagtgctcagagtgaaaagggaagtggtgggtggcaaaaggagaaatgggaaatctagagcacacagagggaaaggcactgaaggaacagtggtcggcccctgtgtctcacactctgcagccggggaaacggggctgtgcatatatggactgaaagtgtgttacagacttagaggtcagggctgcagggtttgggcaagggcattcagtctggtggcaaagcagtgggctagagcagggcttgttagctatagcctggaccacaccctgcctctgcctgtttttgtacagctcccacgcttcagactggcttttaaatttttaaatgattggaaaaaatcaaaagaagaatcatattttgtgacacatgaaaattacatgaaattcaaatttgtgcccgtaaaaaaacattgtctctggctgcttttgtgctacatgacagagttgattagtggtgacggaagctggttgcgacctgcagagtctccactgctcactctctggcctgttacagaaagcttactgatccccagctttccctgccgctgccggtcccaccgccatcagcctctaagcgtatcacagtagttcacttataaaatgggagtgccattggttccttccttgacttttctggagctggacggttctcacaacactgctcagcatgggaagctcttggcacagacacagcttgtaggctcatgtgccccttctctcacagtgtgcaaatttaaggcccacaagcgctgtgctgtgcgtgcaaccaataactgcaagtggaccacactggcctcgatcgggaaggacatcattgaagatgcagatggggtatgttaagaaataccacctgtggggccctgagccagggtcccccacctgcacggccccatgcaagcctcctccctgccctccctgccactgtttcatttgagatggtcacactggcattgggtggcacagtggaaattatatgcggtctccgtgtggttgtcgcacccccgagctccatcctgtccctgtgagtcttgtttgcacctccgacaggtgctatgggtagatggtacttcacaggccctgccatcccttccctcactggccatcagggaaggagcttgttctgggaagaatgccttggctgagttcacaacgagcatttcctggctgccctggacgtggaaccttgggagcgtccctagtgcgtgcctctgtttggttgcagattgcaatgccccaccagtggttggaaggaaacctacctgtgagcgccaagtgcactgtgtgcgacaagacctgtggcagtgtgctgcgcctgcaggactggcgctgcctctggtgcaaggccatggtgagtgtgggccctgcgcccgggctggaggggagggcttgctccctaccgtgcccatgcgggccttgcggctccgcatgatctgctggatcctggtaaattaatcccagaggcccctccggctgagagtgggtttttgaactgttgggtcattctccttcttagctatgttttggggtatttcttccttttgcatttattcctgtctttagacatatgcagatgtgtattgttatgacagatgtcaccctgcatcatgcggcactgtagccgggttgtgaggggtcacctgggacaattgagctggccgcctctgtggtgtggaagcaggaaagctgtagaggccatttggagcggcgttggctctgggcagtgttgacagtgagcacagccatgtggaaggggtgcagcccagtggcctcctgccaggtcctgggtctcatcgttgctctgggtggtgagatgtgcttccagggagagactcagggagcctccatgtacttgcttctgggttggtcattgtgaagtggctgctgcagtcacttgcctagcacatctggctgccaggaggaagccaagacacaggggacacatagaggcacatggccccaggagccctcaccctcgtcctgaaagtttgaggtagctgtggtcgaagggccagaaggttgggtacaggactgtagctcacacggtgtgaagcatgactggctcctgccgggtatttccgtgttatgccttctcaagtgcaaagccagggcccagggcccccgatgatagcaggccggcccagggcccctgatggtagcaggccagcccagctctgaaatcacctgcctcccccgaggccagctcatcagctacagggcaggaggatttctggtgtgtgtgaaggatgccagtgacccttggtgacgcggggactcttgtttcaggttcacacatcgtgtaaagaatccttgctgaccaagtgcccacttggcctgtgcaaagtgtcagtcatcccacccacggctctcaacagcatcgactccgatggtgggtaccacacatgcttatccttctcatgcacgcccacacgcttccttctccacgcactttctcttctccagctctggagttggttatcttggtgagatgtcagcaagaggtcaggcacagctgttgggggtgctggaggagttgcacagagcggcacacggcgccctgatgctgcggcattgcccttagatgggccagagacccaagcctggcacttgacgtggaggtgatgctgttgagtggcacccaggcttagacaggcctgagacccgagcctggcacttgacgtggaggtgatgctgttgagtgcaacccaggtctggggccttctccgtcatgagccattgaagctgtgccccatctctgcctagcacatgctggcacactggcttgcagctgctctcatgtctggctgggacatggtggcacctgttgacaagtactggtggaaagggggatgtggggtacatggctcagaggagatcaagaagagaagacagcagaaaggtggcatttggacagcttgtgaatgtggaggtcagatggatggggctcccggcctcacacatggagaccggctgtggggaactgttcactgacctcctcctgacttacaggtgtgcatgtgtcaggtgtgtgtcctttgggggggtctgctgctgctgattccatcagtggtgccctcagcgtcttccgtggcctatatattttcttctgttcgttcttgcgtccagggttctggaaggccagctgtcctccttcttgcacaagcccactgttggtcttcgtcaattcaaaaagtggggacaaccagggtgtgaagttcctcagaagattcaaacagctactaaaccccgcccaggtcttcgacctcatgaacggaggcccacacctcgggtaggaagcttgtaaaatatatctttcttggagttttaaaaattgtgtagatagtgtgtgcttgttaaaaaaaaaaagttcaaagacacaaagctttaaataggaaagaaaagttgaactgcttccttcccaaattgcacttgcagaggtgcccactcttaatagaggtgcatggccttccaactttgaacacagtgcgcgtgtgcacacacgtacatacatccatgtacacacacccatgcacgtgcatcttttgagccaatcaggattcttctttacctgccgttgcacaaatgccttctgtatgtgtctgcatacaacgttgtgggtgtattttctttcattttataattttttatttatctgtctatctatcatctatctatctatctatctatctatctatctatctatctatctatctatctatctatctgtgggtgtattttcctggcgtgcctcgttctttgtaacagctgcctaacattgaggaagaagctgtcctgcagcgaggccaggaggagtgtttgctgagaggcacaggaggccgctcggtgtgcaggtgctgcaaggcaggaacacgtaagggcggcgttgggccagagcgatttccactgtgcatcagcagcacagagattagactgttcctctgcttgctggagagccatgtgtgttctttgtagttttttacttttcataagtttgtagaaaacatttgcctttgtgaattttgccatttgaatgaatttcttcctctggaagcatcagttccaggtcggagctctaagaggacttgctggcactgccggagatgtccaggatacccgtagtgggaagtgcctgcagagcctgtggtctggcctgtatttctctgggaggagtcagtggggtctgtgtattaggagccaggggctactctgatgtgaacctcggccagctccctgcgtgtccttggcgtacatgccagggtaagaggaacatgctgctcgtcgttggtcctgtgggtgtcttctgtgttgctcatccccactcacagccaggcgcagtcggagagcagtcacagatggcagcattccagcctgcttccgcaaaggcagtactcccacattttctgtagaaagacttcttatctgaatggtggaggattgcattcactagtaggctgatcaagatattttaattttaattttactgttttttgagacaagagtcttgctaggttacccaggctgagtacactggtgcaatcctggctcacagcagcctcaacctcctgggctcaaaccaccctcctgccttagcctcctgagtagctgggactacaggtgtgtaccactatgcccagctaattttttttttttatgttttgttgagcctcacaaaacttttaaaatgttttgtagagtggtctcactgtgttgtccaggttggtttcaaactcctggagccaaatgatcctcttgcctcagcctctcaagagtgttggattacactgcctggcaaagaaataattttagttaaaaagtggggaaagtggagatataatacgtctgttatcacaatgcaccaagcaggctgaggttgttattaaacatggtaccaggggtgttggaggaatgctgtgaaatggctgtgggcagggcaggttacacagctgaactcgagaataacgaaatattcattttggtgtgcaagcaaaaccccatgtttcgtagtgggagttaagtatgagatgggatgatttaggaagcccccacagcggcgtaaggggagttgagtcgtcatttaccatttctggaagcagctcatctcacacagctcacagcagaatctggagctactgcttcatgttccagttcctggccttgacctgtcacctcttctcccgagagcagggggccttacaggtgtcagtgttctgtgtggagcctgggcttggtgccgcatcacctatgcctgtctgtcttctgagcactcattctgggtcagacactgagctcgaggcagggtgcgcaggtgagccaggcggggagtgcagatgcagggaatgggtaggagcacacgcagggtcccccggcacttcagtgggggtgacacagcttctctgggaacccggtgggggcagggtcgcaagtcaaactgggcgtccttccacgtctccccgagctggcatccgaggagctctagtgttctgaaggctgcagggaggcgggaggcttctgggctgagggcaccgcttgtgcagaggcgaggcaagagggaatgcagtggggccaggccaggcagcagcagaaaggtggcacctgccgtcagggagggctgcgggtgctggccaagaggttcgactccttcctgcaaatgaggggcagcctcataaagcaaggcccgtggccaggctcgtgttttagaaaggtcttcctggaactcatggggagctttcaggaagggtgtcaaggtgactgaggctcctgtgggactctgcgagagcacggtggtgacctgagcgggtggctgggttgggtgtggaggagaggctgccaggaggggctgggtcggctgcaggctgagaggaggtgggtctggcctctggactgggttggtggtcgagctaccattctccgagtagggatgtgtcctgttggatgtgccctgggataccagagtggtgtgttctggaggacaggtgcaagtgttggctttcaggagtggcctgggggctgttgatccagagtcacctgtgtggtccttgaaactggatgtggtcacacaggaagaggatgaggagtgagcagaagcggcactggtctcctgagtggggacgctgctgggcaggggcagggggagcccaggaaggaaggaaaccgaggagttaggagggtaggaggcgtgggtcacatcaccggaggactgagtgggcccaggcatatgtgctgcagtggggacacgcagcccgcagcaggtcaggcagcctggggctccagggtgaccagaacaagggccagggcggaagccagactgtggcccagggccggggagtgccaagactgagggtgcagggtgatgcaggcagcccagagggcatgctgggaaggctggcaggggccacatgtggatggggcagggacagtgacgcagggtgggctcacatggttaggggccacggcaggctgtgcccgtgagcctggcaggggatgcagttttggcccaccactttgcctgtgatgtctgcagagcgtgcagtggctcaccaagctgagtggtcttgtcgctgggtggggcgtggctggtgggagcagttggctggaccccagtgctgctgtcgtccctttgacaaagtggaccctgagtggaggcggctggtgtcacgtggcagggcctgtgcgtgctctgcctctggtgcaggtcagccatgaggagcacaggtggcccctcagccccgtactgacaagcctgtcatttgtcctgtggaatggatgtcatttcacggcctttctcttttctctgcagcttacggttattccagaagtttgacacattccggattctggtttgtggcggggatggaagtgttggctgggtcctctccgaaatcgacagcctcaaccttcataaacaggtaccaggacaggagggagcccagccaggagcagagagggtgcggaggttagagggaaatcatgcagtctcagctcctgttcatctcggagcacctgttctcaggccagaaaccattggtggttttggggagtgtgcagtttggtggccagggcagagaggggagagcctgggccaccccctggcattgtggaggcccgggggctctggccatgatgtatgagggggacctgaagggagctacgaaaagaattgcccacaaaggacccacatggggagcagggctgggtggggctgttgctttactgggtaatttttgtcttgaggcctcttgcttgtgagaaggggacggcagtatacttgagtttctcaagtcagagtcatggttcattggacttagttttttgtattaaaataaaaatagattttcctgattgtgtataaaaatgttcatatagtcatttaatttccacaccaagccacggcctccccaggtgatcagccagtgccaacattttgctgtctctgacctctcttgatcacagtacatacaatgcacagtgcacttgtaatttaaacgggctattctgttactgcttttgttgttgttgtttttgtttttgtttttttgaggtggagtcttgctctgttgctgggctggagtgcagtggtgcgatctcggctcactacaacctctgcctccccggttcaagtgattctcctgcctcagcctcctaaatagctgggattacaggcgcacgctaccacgcccagctaatttttgtatttttagtagagacagggtttctccatgttggccaggatggtctcgatctcttgacctcatgatccgcccaccttggcctcccaaagtgctgggattacaggcatgagccaccgcgcccggcctgttactgcttttaaaaaaccactaattaagatgttgcagacaccttgtgcctgtgtctgtaagtaggcatctgtgtgtcgttttccactggacacacccgggagcccagggccagctcacctccatgtgtgagcacggagatcacttcccagtggtctcctctctgagcgcacccaagcttaagtattgaaatgtgctgacaaactgcctttcctcagggctgtgccagcttccatgcctgatgcctttaaagctgtctttccccgtgcaccatccaagctgttcatctctttagtttttgtccagctaagtagaccaaaaaatgtctgacctttacttctttaattcctggtgaagttgaacgcctcctcagttggttatgaagttttaaataaatcacctgttcatatttttttttgcctcattttctctttgagtattcacctttttttcctttaaaaatgggtgtgtgaggattattgttacattaacttcttatctgtcactgcagatatttttttcccggtttgtcgtttgtcagttcaacatcctttttggggggtggtcttttctttcatgatttttgtcaacgtctgtcatatttgcagctgcctacaccccaagattaagatttgcatctgtattttcttatgtttattatggccccatttttaaaaaattcagtcttctgtgtgacgtggatgtatttttcagtgattctgtggtgcctacccagctctgctcacttggtagtatttccaggtgggtggatttgacagctcgggccgtgaggccagtggctcaggaggagaagtggtgccgcctgctggtggattagcatagactactctaatttttgattttgtgtattacttgcaagttcactgtcactagttaggaagacagtggaaccttgtggctgattttcatacgttcagccaaggtcagcacacatttctctcccctgcgtctctttgacacctgatgtggtggccatgccttcgctgggcccctgccgcctcggggtttcttgtcttcctggctgctactgctccatggtggcctctccctccttacccttcccttaacgctgtgtcctcagagccttgctggggcctctcctccttcgcttttgaacgctcagcgacttgcagggcttctgctgtcgtctctctcctgggggcgcctcaattgatagctgagccttgggcctctctggatgtctcctagtgcctcgagtttccaacactacaccacgttcagcccccaccctgcgttcctttccttcgagtctgaaaacatcatccatctagatgtctgagccaggaaatcggacagttgttcttggttcgtccgtctcttcctcctgcctgtttctcactaattgtgtcctcagtcctgccacccacagtaccctggcctctgtccatctgcagctcacccaggcgacctttcccggggcatttctgcctgtgcaccccccaagcacgatgcttctgggaaaagtccagacctttaagagtcccagctttgcctcctgcttgcttctctgcctgtctgcctcctgtttcctcgctgtcctcctcttcactgagctctgccttgccccctcccagtggtgtctccctgcctggagcaccatccatgcctgctgtgcgctgctctccttttcctttaaggctccaggaagccctcgcggagtcctcagaccctctgggcacccttcagcactgggttctctccatctagtgtgtcggctccggtgtcctggcctgctcgctcctgcctcccctactgccaaatgtccccttggtgaggcaggaccttccctggtgtttgctgtccccacaggcggcagggcctcaagcatggtcacctccacctggtgggcagagggctgtacggtgctgtaggctggaccacggcaggtttcctgcctcaaggacagtaacgcctccccacacactccaccgcagccttcatggccctggtcactctgttgtcagagtcaaaggctggtgagctctgggcagtgggcattttaagaggcctcctaagcaatggaatggtgtagtgggatctcattggagctctgaaatgggaatccaggtggagggtgaggcctgagtaatgcatgaggtctcttcctggaacagcaggcaggcgggcagaggctgagctctggcaaggctccagggtagcctccagactgaggatggtcctggcaccttttttggataggatttagaggagagaagtgatactagtgatgtttttggaagaagaatttggcattagtgagtgagatgctgtagtggatggagggacgggtggcgaggcatcagagtgattccttggggctgtggtcacggtggtgaaaatgggaagcagagggatttgggagacagatcagagagggtgtgaggggctgaccatcaagatgtgatgacagctgagagatggacctgtggctcatccatttctcccagaagcagcatcttatctcaagggcagtcatgtttctgtctcattgccaaggaaaatgccatctgtcccctccagtgggctctgcctgtaatgtgtaagctgcgtggttttaggtcacgtccccacattgctaacgtaaccctcacggtgggggacaaggagggctgcgggctgggaagtggcccctgcccccaggtgtttgcctgcgcatcgtcccccatgtttccttagtgtcagctgggagtgctgccgctcggcacagggaacgacttggcccgagtactgggctggggctcagcctgcgatgacgacacccagctcccccagatcttggagaagttggagagagccagcaccaagatgctggacaggtgagtggggatgtgctccggtgccgtatgaggagactttgagagacaggtccctttgaccaggtgttcttaacctggggtctgtggaaaacatgggccctctgaaattatttgtaaagatttgacctgagtatatattcggatagtctttgatatttggtcagattatgacaaggataaaaacaaaacaggttaagaaccagccatgccctaggatgatccagtcttcccagaaggccaagcctgagtgtgtcagggccgtggagaaggcagctgtgccatctttggctgcttcagcccgagatctaatacccatcggaagaatgctccttgtcgtttacttgaacagtttcattttctcatattctgttcccagaagaagttttgggaaattatcctctagtgcctaaagccactgtgacaccttccctgagtaaggtactgttgtcccgagtgacacacttggcactcactgaccacatgcctgtggcacatggggtgctgatgagatgcctcctagccttcctagttgctcccagaagcctggagttctgagcacagttgtggttttgcaatgcccccaccatttcaggcctcctctgtgtgccttggggcctgtgaaatgctcatctcactgggccagctggctgagccatttgcagctctcttgaggagggtaaatccatttctcccagaagcagcatcttatctcaaggtagccatttatgggagaccttcctctctttatggagctgtactgccgttagttgtggagtgcagacatttgttctcagccaagttatgggacagagtcaagaccaagggcctaaaaatgaagtcagaaacggtgtaaagatcaaggctgccagccgtgaaagcggacggcgcagggttcacccttgtgggcctgcacgtcttgccgcctgtgcagctgaccttgtgtgtgcaggtggagcgtcatggcatacgaggccaagctcccccggcaggcctcctcctctaccgtcaccgaagacttcagcgaggattccgaggtattgctggcctgttcttcacaccctgctcgcatgctgatgtgatcagaactgtcctgtcagcggtttgcatcacctcccttgcagagacgcctcccctttggtgttggggtgtcacagtcaggcctgcggaggcgcagggtgaacccatggctgagaggattctcactccccttggcaggggccttttgggctttgtgaccctctaggggcttcctggggttgtcataggccctgccgggtggtggggtggtcctcctaatggcctttccaccctgtccgtgcatctcctcagctgcgcagtgagccccaaacggtgcgcgcccgttccctcccccgccgcggtgcccacgtgcctggaatgctctagccggctctgccgcggctctcccctagccccccggctcctgccccgtcccacctctctgtggcgtctgcagctgcccttcgctcaggctcctctagtccagctggtggttcttttcatttggtgattgttactgttgtgtttaacgctcctacagtttccctcagagaacagactttgtctttagtttctattttgtgctggtgcagtgctgggtggggtagtacaaagaggtgagcttttgtcaggggctagggcaacggtcagcaaacaaggcctgcaggccagatgtgcctgggcccacggccttgcaagcgaagactggtttgtacattttttatttttcctttttttaaaaaaaaattttttttttgagaggaagagtgtgtgggggaagcccagaatattcgctgtctggccagtagtgaagtttgcgaccctggggctgggtcctaaggacagcagggatcccacagggatagggctgcccttctgacagccagaacagatggtgggggcaggagtgtgtgtccagatggggctcacagccaggtggaaacagcctctgctgcaaacggacccaaacctggagccgacccgccagcatgccgctgtcaggatgagtaggggtcaggacggaagctcctagcacaggccgtgctgggatcgcagactgaaggagattcatttgcagtttgcctgcagcttgacgaagcttttaaaatctctcacctagcactaggtgagtcccagattagcgttagaagtgagttgaggcttggctgggtcagacagtgtctgttaggagagactcatctttcccagcttgtgctggcaaggaagtggctgacagagtcactgggactgtcatggagcttgctgtcacagagaccaacagtcctggccatttggggtgattgcaggtacagcagattctcttctatgaagactcggttgcagcccacctttctaaaatcctcacctcggaccagcactcggtggtcatctcctcggccaagtgagtgcctggtggccctggggagggcatggtgccctggcccccagcctggagctgcctctctagaagggtctttctgtttttctccccacagagtgctctgtgagacggtgaaggacttcgtggcacgggtggggaaggcctatgagaagacgaccgagagctcggaggagtcagaggtcatggccaagaaggtctgttcccgtgccctgggtgggaggggcattgaggcagcgagaagcttgctctgtcaccagcagagggccgtgactgcaggttgtccaggttcttggtgatttgaacaaagaattagacaaaacgcacagtaaaggaagacaagaatgaagcaacaaagaacgaaggcagggatttattgaaaatgaaagtacactccacactgtgggagctgcccgagcagcggctcaagggtccagacacagaatcttcttgggtccaaataccccctagaagtatcccattggccacttcatgctcacctcatgtaaatgaagtggtagcttgcattcagtctgattggtggcagaaagcagccaaccagaggctgaagtggttacaaaggtcacactcctgtgcaaacatctgattggttgcaaaaagcaaccaatcagaggctaaggtgaagttacaaagttgcatttctatgcagactaagactcagctcgcaatcagtatggttggttgtggacagccaatttccccaatttcccacctgccagggcgggaaaggtggggatttgcaaagggagtagcctctggtctttttgttacttaggcgtggagagttaggattttccttttgatcgagttctaggaagtctgggtgaaatggcctgaggttccctgcctgcagaccctgttctcctgcctcagctctgcatgccatttcctttccttgttcagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaaggtaactggccttgtgatgaggaggggctttcctcaggccagcactgggcatgcccagcgtcccctgaacacggagatgacagaagggtgcatgttgagaaaacctccactgcggccctctccacccatgtccaggcaccagacccccaacgagttcgcttgccctccttccacccctcctctcacaccctcagaccccttcatgctgcctcccctcgacctctttcctggccctcattgacttcactataagcgtctcactcccgtgagagccttgaggtcacggcctcacacccgcacacctgcgtgtccatgcagccgctcctcccgcttgcagccctccagcctgcgccaggctcctctgcatcccttgccttcccctgcaagggttccagacctcccagcctgttagcagggacgccctgccccagtgccaggaccagggggaagatgggtgggggtggggtttcggagtccaagcctttagccagaggttgtttgaggaagatcaggccgtggggtgaggatgaggggccctccacccagcctgacagcgcccttggctttgcacccgcgtgctcagccgcacacactctccttgcacagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaaggtacttgtgcctccacctccctctgcgcaccgtcgtgtgcttggttttggtgagacgtagcgggcttgccaggggaggttttagggcactttctcatagttgctttggccacttggttacataaaaattgagcgcccaaggcctgtttctgtgcatctcctgtgcgcgcccttgaggtgggtgtgtgcggtctgtcttggtggacagcagtagaacccgcgagaccccctccatcagggcgaggactgcctccctgaggagcacttgcgtcctgccctcactgcttccttggaaccacactgggccccagaactgctcagaaggggctgtgtctggcagagggaaggcgggtgggtgagcgtgggccttctttgtccttgcccctcctggaacagcccacagcgcaggccctggtggagggcacccccagcctgtgcaggctgctgggaggcccatgctcagaactgacccatggccactgcatggccaccactgagagctctgctgtgtgtgtgctccgcctcccacagcccggactgactgggctcacccctccctccagcgctgccacctgtggcctgtgttaacctctccatgagcccagccccccaaacatgtgcacccactcggtcctccgcccccttctttgtcccacacacttcacgcaactgcctgtggtttgcagccctccctcctcagccctcccacctgctcgtgtcgctaaggaccccccaggatttcacagtctctattccacacagctgtaaggttttctgctgtgttgttacagtgtcgaaatctccgtgtgaaaagctgatcagcaaagggagtctgtccctaggcagttctgcttcccttccgccccagccgggaagccgggacggcctgcctgcgctcaacaccaagatcctgtacccaagtgagtggcggccagcaggagggactggtgggggccctagcacaacactggtcccgtcaaactgaaagagatgggctcgctgccctcggagagtttacaggcccctgagaaagataggtggaattgaaaaatttacacgactgtatgaaaagtgctttttttttttttttaaaaacaaaaaacaaaaaacaaaagccagatagtacccaaataaccacccaaggagcccaggaggcgccattgaggaggtgatgctcgagtcggggttggaagaattaaggaattatctgagtggaaaagggaggtggccggcctgatgagggaacccgagggaccatcccgtgcttctagcgtggtcgcaggaggcgcagggagggtgaggtcctggccgcctggagcattccttgatattcattccttaggaaggcagccttataaagccttaagcctcaactctcagagatcattttggtggagtggcttacatttaatgagaacatgaaaactgactctataagcctttttttttttttttaaaagagggtctctctctattgcccaggctggagtgcagtgatgtggtcatggcacactgcagcttgacctcctggactcaagtgatcctccccactcagcctcccaaatatctgggaccacaggcacacaccttagaagccatttttttgtgtgttttgtaggtgttggtttctgccacccagtatggtttctttgttccagtgatttttgacctaagactattggcaaaatttggacatggttatacataattttagaaacatttaattataataacgttctgcagaataccggtccaccagcttcagagacacgagcttctcctaaggctgtagctcctgaccagcaccacctctttcttgtatctcctttacagatgtccgggctggaatgtctggttccttacccggtggctcagtcatcagtcgcctgttaattaatgctgatcccttcaactctgaaccagaaaccctgtgagtatgagggataaaccgagtgggcatattgttacatggctgctagtgcatagaaaacagatctcaggattaactagagaaattagtgagcagttgcccagctggtggtagctgataaggaaggctgagaagtcgtggagattccacttaaggagtggagctggaaaccactactgcacatctgctgcagaggcaaagcgcacgcctcccatctccttcccaaggtcccacggtgcttgcttgacgtcccctgagcctgcatgcccttctgaggcttttcacaggctcagctactcctgccaggagctgcccttgtgctgctcttcgtggtcactctcccatgatcttggctggacctcactgacttctgcttacagcctgccatcttcctcttgccatcccttccctctgctttcctctaacacctgctctccttgttggtgatgcagaaccacagactctgagctggagggtcctctgtgtgtctcccttgtgtctccgagcaccttagggagacactagcctgtgctgaggcttataagggctgctgcgtgcctgcgtgctgatactgctactccttgggggacaaggccttcttcctctgctggcctgtaaggcagtgaggacatgtatatagcagtttaatgcagtcttcctaggtattggagtccattttggagacaagtggtgttttgaaaacctgtttttctgcactcatctttatgctggctgattgcaggttctgggcagctggtggcagttggttaaatgtggccagccatttttctggagtggtgacggacagtgacaggaagaaatgtgcggttcacagaggctctgggtttgggaaagtggacccctagattccaggtgctggcctggtacagcacttcagtgtccctgttcctggcctggtctactcctcccctggggctgcgtggggctccagttctcagccctcctgaggcttttttccttggggaggccagagctgtagtcctatagtgagcactgtccctagaggcccctgaactggatatctcctttgtctccttcatctgagactggaacttccacttctgttgctcagctgggtggtctcatctcttcttttcacctggggagacaaagctgtgctttgctgccttcctgctgtggtgtgtgcctgggccgtattgtgtgggccccattgtagctgggcctgagcagcccctggtaccctgtcctctcccactgccccagccactgccgcccctcctgctccaggcccctgagcccagtctctgctgccttccctcatctctttgtcctgtttctctccgttggatctctctcttttcccaggacctatacatgctggccaggcacttggtcttccccctggtaaacagttttgtcccagagctttgctctggctcagctgtcgggcacttgaattagatggatcataaatacactgacacatgctggttgttctcagatctggcggcactggctcagtaagctaaagtgtgtcagaattctggcccgagcaatgttcccaagcccatccacccattgagtttctttgggaacttccagaacatcctcttctcctggctgcagcctctgggtggaggaacaggggttcctcccttcatccacttgccctcggggggaaaccccagtgtgaccctggggttggggagggtgaaggccaggctgggctttcccagcagctgggggagctgcaggagcaggacttccagctgggtggggagaagaaacttgaatgagtctcttctcgtctgtcgcacacggggaaaaggaagccttgtgctgtggggctgggatggatgttttcaagtcattttcctttttaatttggcaacagctttgcttgtaactagggatgtttgagaaatgttttgagatccagagttgaaatgtgtgagtttctgtgccataaacatatcttcaggtttggtgctgctggtggagtgtaagatgggcagctgctgtggggaatagtccagcagctctgccggaggttcagcccagagctgctgtgtgaccagcaggcgcagaactgccgggccatgtgggattgaactgaaaacatgtccacgctagaagctgtatgcaaatgttcctaaatgataaccaaaacgtggaacatcccagtgtccgtctgctgatgagcaggtcaatagatgcaggttagccacgcagtggagtattatttggtaataaaaatgaagcgctaacacatgttataacatggatgaactttgaaaacatcgtcctgaggaagagaaaggagccagacacagagcccacgaccgcatgatcccattcctgtgaactgcctagaagaggcgcctccgtggaggtggaaagtagacgagaggcgccagggatggtgaggatggagagttagttgctgatggcaggagtacaggctttctctttagggggatgaaatgctctaaaatcgattatctagtgatggttaaatgactctgaatatactaaaaataattgaattgtacattttaaattggtaaattatctagtgtatatcttaataaatctcttagcagacaaaaaagaaaaagttaccagttttccccaaggaagagaaatgctgagaggttgggagtctgaaataagactgctcagcagggctgttgtaattgatttaaaactcacctttgcagagagtattacacggagaaatgtgtcatgaacaactattttggcattggcctggatgcgaagatatccctggactttaacaacaagcgcgatgagcacccagagaagtgcaggtaggtaacaggctcaggagcacgtctgtcttttgcgtctttgtggcttctccttccagacagtagcagatttctggagtcagcaggttaaagaacgtgcagaatgctaaggcggggggcagaaatggagcccagatcgccttgtcagaagcacgggtgctttcagagatggaagggaagcacctctcgggctggccaggtcaagggaaattcaacatcggaaaaccagtgatggtggtcattggaatggcggcatctcttaatgagagccccaagtccgtgatactacagaaaagcggcaggtgtgccaagaagctattgcacctattgcgtaagtgcccagcattgtttgtgggagggtctgtgtgttcatcaccaccctagctggccctcccccatcacacccgagcctgcccacaaggcccttgagtccaacctctgcaggaagacgggagcgtgggagccccaaggggcatcactgggggtttcagtttttttcctctaaaattactggatactcagtcctggcctgaagagaggatggagaaaaatgagaagggtccctcttctcaagcttttcttcctgggctgatgtagaattctctcttgtctgtgaaacacaagaagtgagggagaaatgtctccctccccaccccacagtaataatcagagaggccattcagctttgacatgattagaactacagagagggagaaatgagtgtgggggttgacggtgtttgtgcagagaacagcccttgacccagaagctgggagacccttgctggagtcttcgtccgctgagtcaggatgggcttgaatgaaccaagccacgtggccccctgtggcctcgccctcctcatggcgtcactgccaccttgcggggagccatgctgacacctgagggtccagctttagtcattgctcaggttacatgtagttgaaaatttctaggaaaacaaaagcatcagaactgaaagaacttttgactctgaggctcttccatgcaggagaaaatggctcaggggccccagggacatatccctgtacagcacaggatggtaacgtcagatcatttaaaaatccctgttagtccaaaaatcactgggaaaagtattaaaatacacatactttagcagggtaaaataagtagttgaggaacaggggcatgcataatacatttctagagctttggaaccctggtcaaacctctcttgagtttgtattgagagctttgaaaagttctcctgagaaaaattccacttgtacaaatgtcattggaaatttctgcagaagtcattggaaatgttggttgacgtaggtacgaagggactcctagcgtgtcatttccagagctcaggcatggggcggaggagtgtaatcaaggggattggttcgataagctgtggtagagcagtgcccggctgaggatggccacatctgcagagagcgtgtggccacagaaggaagcattgccggcgcagggtaaagtggaccaagtaggtcgtgaaactgtaaacaagttactgcaactggaaattaatatgcaaagaagactgaggaaatacatagcagcacttggcatttgtcattagcacgtgtggagggtgcctacaggtgctggattatgcatggaggattatgaggagtgtcttctccttggtgcttttctatattttccagtttttctatggtaagcataattttttagccagaaaaaatcaggatgtgtagaagtttttttatagggttctataatgttttaactttatgtatttacctttcagggtatgattactttcttggcaaaatgttactattgagcaaaatttcctattggtaaacgtatctttttatgcatatctgcaaaaacaaaaatgtgtccttcagatgttactgctgtaaataattgctaaatgtagctgatttgtgggtcagatgctgttcccagctttcacagaaatgactctggttaactatacgaagaaagcccagacctatggcaagtctttgcttctgtttctaggagccgaaccaagaacatgatgtggtatggagttcttggaaccaaagagttgctgcacagaacctacaagaacctggagcaaaaggtcttgctggaggtgagtgggagggtccttgtcacctgcaggctggcctccatccatcagcagactgccaggcctattgcttctcctgttgaccatttcctccatgcacagggacttgcctggggatgccctggccacggctgtgctcctgagcccctggcggtgggaagctggtagagaaggaggggctgactcatacctttctcttttcttttgttctgtgtctctgctgctcagtgtgacgggcgacccatcccactccccagtcttcagggaattgctgtccttaacattcccagctatgccggaggaaccaacttctgggggggtaccaaggaagatgatgtatgtatggggtgtgagcgggtgggcctgagctcagtggggaagagctgtctgagagcaggggggtgttctgctgtggctggggtggatccagctcttctgttgtgccagcagtggggttgccgtggagaacaagatagacagggtcccccacccagctcatcgtctagagggctgagcagagcagttgtgtcagtgaaggtggtcagtgagggtctgtggtcagcagatgtggtcagcgggtgtgacgtggaaggagggtcagggaaggtgtctgggaggccaagacctgaaggatgagttggagttggctaagttaggtgggcagaggagagggggaggctgttccaggcagagagaattgcacagatgaaggctcagagtcaagacagggcaggcacatggaggatgggagagaggtgccccgactgcagtgggcagcaggggcgtggagagacaggagagggctgcagggcctgggtcacactgggctgtgtgagctggggaagaagtttggaatttgtgttaagaactgtgggaaggtgttgataggtttaaacctggtttaaaccttcctttgtacgtaatagcgaatagaagtattcagcgcttcctgcacacgtggtgtgtgctggccccagtcctggcactctgcagcgttaactcacttggccctactgatggccctggaggagcgtgccgttagtttccccattttacgcatgaggaaatgggggagagagagattcagtaactttgccgagatgagagctgggatttggtcccaggcagctggtttcagggcctgcaacatgaagcccgtcaggagtgcagttacctggtaacttctcgccagctaggaggggctgacccccagagggagggagtgagggtaggggcggcctgtgctcggggatgtgtggagtggtggtcagctctaacgtgtcccttgcagactttcgcagctccatcattcgatgacaagattctggaggtggtcgccgtgttcggcagcatgcagatggccgtctctcgagtcatcaggctacagcatcatcggatcgcccaggtagtggccatggtcctggggtgtctggccgagtccccagcccggagtgtgctaaattctggggcagtgcatggagcctgggagggtgggcgctttccagggccatgtggctgcctcatgtcctgtcctggacagctcgtggccccacttcctgggccagagccctttccttgtgctatgcttgacagttaaattctcaagataactctttttaatttttttttttttttttgagacagagtcttgctctgttgcccaggctggagtgcagtggtgcaatctcggcttgctgcaacctccacctccctggttcaagtgattctcccgcctcagccttccgagtagctgggactacaagtgcccaccaccattcccagctaatttttgtacttcaccatgttggccaggctggtctcgaactcctgacctcaaatgatccacccaccttggcctcccaaagtgttgggattacaggtgtgagccactgcacccggccaagataactctttcaaaatgtgtatcctgcttgaaccacagccttgcctgtcccctctgaggtgggatgagatagagcagacccaggctggactctgcccgtgtctgcagctgtcaaagccgcagtggggacggagcccatggctctgatgtggggtgtgggaggatttccagctggggccctcgatcatggttctgaggccgagtggtgaagggctgggggtgcccccatggcttatttctgacagcagcgatgggctgagggcagtctttctgtgaggatggggcaggactctgtacccaggcacaggcactggggcgggggagggtgctgatgacacccactggctgaaccccaccctgcgactgtctggtgtcttccagcactctgtctacccttagctgtaggctgcttgaagttcacaattttcactctttggcaatgtttgttgttgaaaaggaggaacgggatgatgatggatggctcatcgtcatccactgtgccatctgctcttttctaggggtgttttcacgtggcaggggcccagtggcttctgggagctacaacacccctgcccctgggttctgacacctgttgtctcagcaccaaggtctcctgcactgactgctcagtgaggggatggggcgggatggggcgggacagtgggagaacagaccctcggttgagtgacacaacagcagaaggctagctgcaggcggagcgccatcccagaggcagaggtggggtgtcctgcaaggcagggacgggtgtgtggagcaggaaggtcatggtggtgctgatagcacttttaaacccctgggggttttggctcagcatgagtaatggctatgatgtctgctcagtgtcgcacggtgaagatctccatccttggggatgagggcgtgcctgtgcaggtggacggagaggcctgggtccagccgccagggtacattcggattgtccacaagaaccgggcacagacactgaccagagacagggtaagagcggctgcccgcggtacctgggtggggtacagggctcacctgtgggctcttgtgtgcactgttaagagctggagctttttgtgttttgttctaggattttttttttttttaagacacaatgattaagctaatagggcagtaatttctaggaccatctccttcccctaatgttaaaaaaaaaaaaaagtcctatttgtctctttctagttgtgatctcgttggcatccccatagtgtctgtcgcagtcagatgcatgcttcagagcagcaggtgtaattgggctttcgggtccataggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacaggtgggctcctacccctctgcgttgcgcatgagcctcccccagggtccctgggactgcactcttccaaggcccctggggcgtggagctgctgctcctgacttttgtggggtctgcattacccatgagggccgagcctgtttatgtgccctcagctctggctcatttccccagtggtctttcagaactcgcctggagtttacatggctggaacctaaagcccactgtgattttcaggaccactcgtttaaaacctgcccgggctcagccgggcgcggtggctcacgcctgtaatcccagcactttgggaggccaaggtgggcagatcacaaggtcaagagattgagaccattctggctaacatggtgaaaccccgtctctactaaaaatacaaaaaaatttagctgggtgtggtggcgggcgcctgtagtcccagctactctggaggctgaagcagcagaatcagtcgaaccccagaggcggaggttgcagtgagccgagatagcgccactgcactccaacctgggcgacagagcaagactctgcctcaaaaacaaacaaaacaaaacaaaaaaaccctgccctggctcccgagggcagcccgctgacagccgccttcactttgccctcgttttaccctgagaacaggcttgctctttgttctcaagtttactttaaaaaaaaaaaaaaaaaagacaactgctggggcatttcctctcacctgccttctagaaacacccctggagccactgtgtccctcgtggctggtggtcagcattgtctgccattcctgctcctcgcccgccaggtgcgggttccgcctgtgagtccctcccagccggcagctgtgctgctccgccggtgcggggcctgcctgcattctccccccgtggccgcacgctggctggtgccctggtgtccctttcttgtttcccctgggctccttcttctcctggctgtggacaggtgcacccgtcggttttgtgcccggcatgccgtgtgcccttccaggcagcctgcccagccctggcgtgcagatggatcgtctgtgccagccttcggctcttgtcgagcaggtggtcgctgtcccagtcatcaccggcgttcctcgctctgcacttccataccggctgcagtccttcctggcgctgcattctctgccccaggagttggtgccactgcggcccctgtcctcgtctctcccccaccccacccagatcagtgatggggctggaggacttcagttcagctaattccttgccgtgcagtgggcttctggtggcctcccctggaaagccattaccctgtcccctcaaagcccatggtggcccctctggcctgcctggaaggtgcacttgcacagcactgcaggaagctgctggcagcggcctgtttccacagggtcaggacaggctggccccgctgcctttgcttgcactgctcctatagtctctgtcccccgatctcacctgcctgagccacatctcagcctccctgggacctggtgtgacttgtgctctcaccgtcttccctatgagggctgctatctggggtctggctcagagcccatcactgcaccaggattgtcctgttcagatgagggtccttttgtccccagggacagaccggccagttacaggttccagcaaggctgtggggattgtgccttactgcagcagtctctgcagtgggcctgtgcacactgtcacttgcccactggccgttttacaggttgtaagcctcattttgtacatttctctccctggaaaatcttggattttgacgtcagatttctcgtggaagccctcccatttgctgtgggtcatcctgtgcccaagcttgtgactgaacggtcgctgggctgagccacgatccctgtcgtcctgctgggcctgccctccacatcagccctccaggtggtacctgggccgtgttcagatgcgtattgtgaaaggctgcccttccatttggcctgacatctgcccgtgcttctcttcctctctagtatccgagaaatagctcagtctcaccgggacatggagcaggaactggcccacgccgtcaatgccagctccaagtccatggaccgtgtgtatggcaagcccagaaccacagaggtagctattctggccttttcagtcctggcttcttctcagtgtctgccgccctcggccctccccgtgcgtgttcattcccccgcctccccggtgcatgttcggccctcccagtgcttgttccctgcccctaaccgtgcatgttcggccccccgcccccatgcatatttgcctggtttcttctaggggctcaactgcagcttcgtcctggaaatggtgaataacttcagagctctgcgcagtgagacggagctgctgctgtctgggaagatggccctggtaagctggtgccccagggacagcagggctcgggctgtgtgtgaaacgactgctgtcgccaggttgctgggcacacagggcagcacactttagtccagagttcccggtcttaaggaatgggccgcagaggtcatttggtttgttgtgcggctggtgcccacccctgctggcaacccctcagtcaggttgtctcaagcatgcgagaagcgcttgcagcggaaacacccttgtcgtcgtggacagaagatgcttttctgccttagaagcctgtagtgcagagtcctgctcctgccgagagctggccacactctcaggcaccttccatgctcagccctgcaaaaccggctgatatggcagctgtggggctgttactgaatcacaggggctagaacagggagaggcctgagagactgactggccagccttctggttttaaagatgaggaggaaggggcttgataaagattgggcaactggagaaccgccccaggtgtggtttcccagccctccactccgcacgccactcacctcctcactgcacgcgtctcctcactgcacgcatcacctcactccacacatcacctcactccacacatctcctcactgcacgcatctcactccacacatcacctcactccacacatctcctcactccacacatctcctcactccacgcatctcctcactccacgcatctcctcactccacgcatctcctcactccacgcatgtcctcactgcacgcatgtcctcactgcacgcatgtcctcactgcacgcatgtcctcactccacgcatctcctcactccacgcatctcctcactccacgcatctcctcactccacgcatctcctcactccacgcatctcctcactccacgcatctcctcactccacgcatctcctcactccacgcatgtcctcactgcacgcatctcctcactccacgcatcacctcactccacgcatcacctcactccacagaaatcctcactctacgcatctccttatcccatgcctcccctcgtcccacgtcccgtggtcacacgcgtgtcctcactgcacacctcctgctgcctcctgcaaggttcgactgctgactttgcttcccacagcatttccactgcttgacacaggtgaatggctccgaccccatttctgacagagggacacaagcaggtcagttgtcagccttgctctatgtgaattcatcgttgactgatggacagttttattctctcaccagcactacttagaaagtgaggttctgggtttggttccttttctggtgctctgggacttcgtttctggaaagtgagctccctgatcagagcagagcagagccctggagcggacctcacccccctgggcctcgcgctgatcagcagtgcacactctccatttctctctccctccctccgcctggagcagcagctggatccgcctcagaaggagcagctggggagtgctcttgccgagatggaccgacagctcaggaggctggcagacaccccgtggctctgccagtccgcagagcccggcgacgaagaggtatgtggctcatagggctgtgcctgggtctcccggacatggtggctctcgcctgaagtgcctgtgttccttgtgacccgtgtggctctgggatcaagatcgtgtcgctccggcagcccctgaggggccttctccagacttcgctattaaaatgctctttaaggcagggagggacagcaggtaggaaggagttctgggctgggattaagagtgccccttgaggaccagggacctgttgtcctctgaaacagaactgcagggcttcctggacagtgggtagaaggaaggctgagcccagccccacagcctcccccgagggtggagatgtatcatgggataaatggcagccttttgggatcccgctgtggacagggcgcagttggtgtgcgccactccccactcacactctcttcctgtgtgaacagaaagactccagctcgtcgcaggtctgggagggacccgaggacgcagggcatagcggaccctggggtggagtcacattcttctgcagggagtgctggctgaaggagccctggagagggccgtgtctggacaaggacaaaccccagcctgtctcttggcttccctgcttcagagatagaacacagaggggccctgaggaaagctcatcttgggcagtacagttgcagaaggcaaataactgcaagacgccaaacctgggcacccctgcccagtggggtttgtgagacctgtgggcagcagtaaggcgaggggacagaggtgggcagctgcacaacagcaccctctttccggggccctggggcgttttttgacgcatgcaatcctttcatgggaaactgactcaggcactccagccgatggatgaaactcagcagcttctcagtgagggcacttgggtataaaaggacagggcaagctcctcaaaatccattaaataattcattgtaaaggtgattaagaaattttacccaaaattacaaaaataataatatacaatgattcaacagatgtcacagtgacatagccctataataccagattaaattaaggccagtaaagtgggcagtgaggtgagaggctgggaagaggacatggacggggggaggaaagcatgttaaattcctcctcttacagtggaagaacgttacaaacaacattcttgactttcatacttggagaaatacagagtcaataatgtttttagggtcaagagtggtggctcgcacctgtaatcccagcactttggaaggccaaggtgggaggatcacgttagccgaggagttcaagaccaggctcggcaacatagtgagaccctgtctctattaaaaaaaaatttttttttaaacttaaaggtaatttctaatagagctgaaaagatttatatcttccaaattgccaccaaggacaaaaataaaatacaatttatattgtaaaagaaagtaaaggaccagcaagggtatcgctaacagcatgaaaataagataacagaaaaatgacatggctttctcttaaaagtaaattcttaggttgtgttttaaaagaaacctaaccatatattgctcacaagagccctgtttttttttctcatactcctaataaaaatttatgatacagaaagattaataataattaaaacaccataaaaaatccaaagtaacaatataaaaataaaattgcatatgtaagacaataaatgataaaaagaggatcactttacattggtaaaatacaataattgttatgtatagtcatcaacttatgacagttataatagtcacgaaactgtgccaaataataagcatctaaattagctgttcaagactatgttttttattccctaacttcattttactgtgctccaagcaatggtctgtatgttactagtcctttgaaatgtactgaggtgagacttgcccaataggtggtttttgtaaatgtatcttgtatgcagttgtgtttacatcattaagttcctactgaaattttttttgtcttcttgatagatcagttaactctaataccataattgtagatgtctcagtttatctttgtggttatgtgtatttttgcttcatgtattttgaggctatgttattgggtacccataggttttatcattatataatgatccttttatctttagtaattctttttatcttcaagtctacttgcttgctatattttttcatagttttactttcaagctttatttggagtgtctcttataaagagtgcatcacagagtgaggcagtgttacctccgtgcatctcagggagtgctgtgtggagaggctgccgccgccgatggctgtcaagagcagaggccgagcctctgtgtggctccgctcttcacccttcctctgctcttctgcctcagggagtggatcgcaaggaaagaatgcaaagtgcaggagagttttcattagacagatactcgtaatactaagaatcaaagcccagcaatccaacactagaagattggctaaagaggttattttaataatttttgtttagatactgatatttatgatattttcaaaaagtttttaaatctcatgagaaacgcacatgtaaagtgaaggaagtagaatatgataaaaatagacactatgatcactttgaaaccactttaacactcactaaaatcaacactaaatacaagaatcaataagggagagaagccctttcaggcacaagaggtctttcccagctcccgctcatctcagccctgcctgccctcccagcctctctggtggagatgggcatgaggccgtgatcagttgcagcctgattctcagtattcctcattctccccaacagagtgtgatgctggatcttgccaagcgcagtcgcagtggtaaattccgcctcgtgaccaagtttaaaaaggagaaaaacaacaagaacaaagaagctcacagtagcctgggagccccgggtacctgcctctctcccgcgtgtgtttctggccgtccacgcctgctggatcggccccgttcccctggtctctgctttctcccttggccttgcagctcctccctcttggtccctgtgctgtaacccccggtcctgcgaccacacttgtctgttggtagctgcagccctccaccctgcctgcttcccctctgaccgttgtcacacccggccctgacgtgctctctggctttctgcctgccctgagttgggggattcgaggtggggaggaagacagcagtagagtggtgacaagacaaacttggagacacaaagctctggactcaggccgtgctggggcatgccctgcctgctccctcctgggctgctggttcctgataaattgatgcattggtcgaggttcctgtgctgggaagcccaggccaccagagattgtgggtgatgaaatcaatcgaatatggtcctgaaggacattgttcctttgggtcagtaaattggagctaaactctctgtctgaaggatcagccctgaatacccaggccatatccagtgctgtcaggggctggagaggcctccaagcctggatattgggactggtgtttgccgccagtcagggcagctcctgtgggtttttcttctttgcatgtttgtccagaaatggggtttctgttaataatggtggctctgactatgtgaattgaaatctctgctcgtttcctttcctgctatggtccagaagtgaaatttaacccttctagaagctggaggaaaagctggctttggccacaatcatgaggacatttccctcatatttggtggtggtaaatccctcctgggacacggggaaatgaccagaggctggcggcccacctggcaggaacagatgccagctctgctgcagccatcgccccttgagcgggtggctctgtgcctctttctgcactgctggtgggtggtgctgttggctgggtgatggataccggctgccagagatggctcaggtgccagctgctgggctatctcaggcactggctgctgggctatctcgggtgccggctgctgggctatctcaggcgctggctgctgctgggctgtctcgggtgctggctgttgggacgtctcctgtcctggcactgggctctcgggtgctgggtgccagctgctgcctaccttgcactgggctctgggcactcactgcactcgtgcttttccatctccgacagttcacctctgggggacagaggaggttgctgcctggctggagcacctcagtctctgtgagtataaggacatcttcacacggcacgacatccggggctctgagctcctgcacctggagcggagggacctcaaggtacttccataggcgtctccctggaacctgcacttgggcttgcacgcagctcccttctcttccatcctctcccccgacctggccatgtcccagcatcacgattcttctcaggctttcgtgtatacctcaggtgggggcggctgtggccctcatctaggcagtgatggctccacccaccacaaccagaggaagccaggagcagacataatggggggcagagccttggttatcttaggctactcagacaaggactgtcttcgtgttaaaaacactatgaggggacacagaccctgaagcacagtcacacacgactgtccccatgctgctcctgggcgggtgctgccactcgtctgcagggagcattgggaggggtggttgggtgccaggcctcggtctatgccaggcctcacgccacatcttgcaggcccatgcccctgcccaggttggcctcaacgggccaacccctgggtgttgaatcactggctgagtcccgagagggcaaaaggccactgtgggtgtcctggacagtggctctcatgaggtcacttgtcatccacttgcttttaggcctgtgttttgtctttgtcttggatttgtccttgctgatggtagtgactagaatgcaggaacaatgggccaggcatctgtatggttgttacttttaagctgtttccatcttgttttaccgtttttgtcattttggctctcatttgtgttcacaagccgaatgggaagggccgttgtggcaggcctgctgtggagccctctggccctggctgtcttctcggcatccatggcggtgtcttctctgttgcaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagcttgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttcc

SEQ ID NO: 671 - DNA, 83944 bp, Homo sapiens
agagacacgaatatgtttcagccgcaacaggctgcgtttcagccggaagagtgaaagggcaccttgaaaacgcaagtttatgaatatgtttctgtactttcagaccatcatcaaagaggggatgctgaccaaacagaacaattcattccagcgatcaaaaaggagatactttaagcttcgagggcgaacgctttactatgccaaaacggcaaaggtgaggccccatgcaggaaagcacacgcgaggacatcacaggagccgtcccaggggaggaactgggggtgctgagtccttgtgtgggaaaagcttcaattctcagatctgttattgccagtgagttttgtaacactccacgctgtcaggttttacttgtctcaaggcatgttttatttcttatcaaaattaatttctgttcattttccttttctttaatgtcatcggtaatggggaaaaggaaaaaagggtcacagagacagccgcgttacagctggatatctctctctcagaaaggcggagggaatcacggggctatgaatttcatcttcttattattaaataatttttattctttaagtatattgaagttctttttttttttttttttttttttgagagggagtcttgctttgtcgtccaggctggagtgcagtggcgagatctcggctcattacaacctccgcctcctgggttcaagcaattctcctgcctcagcctcccaagtagctgggattacaggtgcctgcaaccacgcctggctaaaatttttatatttgagtagagatggggtttcactatgtaggtcaagctggtctcgaactcctgacctcaaatgatctgcctgcctctgcctcccaaagtgctgggattacaggcatgagccaccgtgcccggcctagagatggggtttcaccacattgcccaggctggtcttgaactcctgacctcaagtaatctgcccgccttggcctcccaaggtgctgggattacaggcatgagccactgtgcccagccaaagtagaaggagctgagcttcttgatgtgtgaacagaaatgggaaattctttatttttaggctttctagcaattaaccttgtttctgtgtgccctattgtaggtagatttaaagctagaagcaccaggtgggtgctgctggaggaggagcagccagtgaaagtcacagattactgccatgtttaagcggatgtggtgttagacattcagacaccagtgtgttggctgggattctgaatacctgtgttttttatcaggattggtgtcagtactaatattttggtatttaagaaatctggagtctgaataatttacattttgagacatatccctagaaagttactgcattaaaatttgaaatggaacaaagcagcttgtttagaaagggttctgaccacttccctcaattaaaaaaaaaaaaaaacacgacaaaataaccttttacagttagttctggtggtgcggggaggggaaaggttacttaaaagattgagtttcttttctgagttattagtttgattttctccagggttcctcatagagccatcgtagaatagaggggatggtataagggaaacaggaggcaggggctgtgccgggggaccctgtagggagtggagagggagacgggggaggtccccaggcctgactcccagccctgccctggagcatctttctctccaggaccaggatccttctgctctactcccttgtttcctttcacggccagaccctttccatttggacctgtctctcttctccagaagaatttgttttagccaggaccttccccctccatgtgctcgctggaggaacaagccaggaggacacggaatcctcagtccagaccccggccttccctcagctaaaacactgtgtgagaacatacttcacatgtaaaagtgaatactggtattgacagtagtaaatacagaaataccagcattgggttgtttgctttggttctctctctttcttccttcactaatgcaatgacaatgtttgtagatttttttaaaaaaatcatggcactatacctgtgagcccgagcttttggttagaagcaggtgggtgggttaatttggattggcttattgattggatgctacagtttcaaggtactggggcttctgtgggtgcttgttagggatcattggggtgtggtgggcagcgctggctagtgcttagggatgtacctgtctttatgtgccttagtccctgtgtttgtctctttctagtcaatcatatttgatgaggtggatctgacagatgccagcgtagctgaatccagtaccaaaaacgtcaacaacagttttacggtaagattcctcagtcatgcctttcttgattcttcactgaagttggctttcctttttgatctgaacatgtgtccaagcagttcaaacgttttcattcttttcttactgattggaatgattgctggtaaaatttgaatttaatgctgaaagtaatactgtggttggagaataaccaagaatttggcatgcataagcacaaaaggacaatagggaccaaatgaaaaatttttatatgtgttttggttcacgtctgttttgttttttttgagacggagtttggctcttgttgcccaggctggagtgcaatggcgtgatctccagctcacagcaacttccgcctcccgagttcaagcgattctcctgcctcagcctcccgagtagctgggattacaggcatgtgccaccacacctggctaattttgtatttttagtagagacagggtttctccgtgttggtcagggtggtctcgaactcccaacctcaggtgatccaccctccttggcctcccaaaatcctgggattacaggtgtgagccaccacgctttgctggttcacatcttactacctctgtacagagttttgttttttgtgattaatgtagaaaatttggaaaatgcagacaagtatgttaaagcaattaaaaagcagccataacagccacctcaaaaaacattgaatgttaatattttggtgtatttcttttttttttccttttttatgtttaaactttcttccttccaaatttataaaagttatgtaggactttctgcaaaagttctaaatgcacagaatcatgtgatctcaccacttggaagtggccagctgcttactctacagtgtttatctttatttctgtatatttatgtctttacctacatgtacccatgagatcatgctgaaccttttggtttacacctgtgtttttttccccccccaggacaatttatagtagagagttgctcatgtcagctgatctaaatgttcatgatattatttaatggctatagtagcattttcttgtaggattttataatttaggctttacgggctgactttagcgcctgcctgtgtaaggtttgactctaataacagcactagaacttttaaagctgtttttctttatgttattaggccatcccatgtagacaaaaagtgtgtaccctaattaaaaaaattattcttttataattcagtcaaggtgagtaattttcctcaagtttaggatctgatattttgggttagtgctagtttcaggtgctttcaagttttgttttattttatttattgatggattcattgttgatgttgccaatacaaatgggattttcctttctctgtctaaacctctgcttattttgtgttgattaactgctcttattttacttggagtatttgtagttttctctattaatttatttttaccagctgggaagagacatttttaaccacataaatagatttttctttgattcgtggtttttagagtctttaataggagtaggtgttgaatttctttggagtgttctgagcatcagttgattaattaatgaatttttttgagatgttgtctccctttgtcacccaggctgaagtgcggtggtgtgatctcggctcactgcaacctccgtctcccaggttcaagggatcctcatgcctcagcctccctagtagctgggattatagtcgtgcaccgttatgcccagataatcttcgtaattttagtagagatggggtttcaccatattggccaggctggtctcaaactcctggcctggagtgatctacccgcctgaaccttccaaagtactgggattacaggcatgagccactgtgcctggccctgggcattaatttagatgttcattttggtttcagttatttgcatatttcctaataaaaaaattattcttggtaatgttgaattttactcctttatcttgcaatttagaattttcccactggtatgtatgcatttgttttgggtgagaatgtagccttattgcagttttaaacaattgttttttctgtttttaattttaatggatacataatagttggacatactgtgttttgatttcagagttaaaccaaccccataaaattcatttagtaactttctatgagtttatgttttctgcaacattttatgtagctttgggattggttgtttcttaagttcgagagaatttattttaaattatttgtcaagaagactttttagggagataaggctgtaatagaaataaatcctaaaatatttatttcttgcattttgatcattttttgaaccttttcactttttgagtccacatctgtaatttactttcccacaaatttcacaccttcaaagttagtagcgtgtactgttgtgtagtttaaacacctgtgtctctggttgaatctcctttgcatttctaattttattagtttagtttgcttttcttgtcagatttcgtaaactctagcatttttgttttctttgtttttaaagagaactagttcttagattattgaacaattctccttttctgtttccttttttatttttttgagacggaatcttgctctgttgcccaggctggaaggctggagtgcaatgacgtgatcttggctcactgcaacctccacctcctgtgttcaagcgattcttctgcctcagcctcctgagtagctgggattgcaggcacctgccaccacgcccagctaatgtttttatattttcagttagagacggggtttcgccatgttggccaggctgttctcaaactcctgaccttgagtgatctgcctgcctcagcttcccaaagtgctgggattacaggtgtgagccaccacgcctggcctgtttccttttttttttttttttttttgagacagggtcttgctctgttgcccaggctgcagtatagtgctgtgatctcggctcatggcaacctcttcttcctgggttaaagtgattctcctgcttcagcctcctgagtagctgggattacaggtgtgtcccaccacgcctggctgatttttgtatttttagttagagatgggttttcgccatgttgtctaggctggtcttgacctcctgacctcaagtgatcctcctgcctcagccttccaaagtgctgggattacaggtgtaaggcaccatgctgggccctactttcctgttttctaattcagtgtctgtatttatgtgtattggtttttttttttttttttttagatggagtcttgctccgttgcccaggggggagtgtagtggtgtggtctcggctctctgcagcctccgcctcctgggttccagtgattctcctgcctcagccttgggtagctgggattacagacacatgccaccatgcccagctaatttttttatttttagtggagacagggtttcaccgtgttggctaggctggtctcgaactcctgacctcagtgcccaccttggccacccaaaatgctgggattacaggtgtgagccaccttgcccggctgtgtattagtttttatctgttgtaacttacgaaatatgttgttcaagtcctcttatgatcttgttttttatcgcttgagcttccataggctgttaatgaggagttagaatctctttcaggccagttacgtttaacactttgttcatgtatttctaacagttttcaccttctccattttgaagctttgttaagcgtgtaaatatttaaaaagataataccttcaatattgagtaatcatttgttaataaagattaataaagtagtagctttttttttcttctttcctagacaaggtcttgctctatcacctgggttggagtgaagtggcacaattatgactcactgcagccttaaactcctgggctccagtgatcctcctgcctcagcctcccagttagctgggactacaggtgcttgataccatgcctggctaatttttacatttttttgtagaagcaaggtctcgctatgttgctcaggctggtctcaaactcctggcatcaagtgatcctcctgccttggcctcccaaagtgctgggattaaagaagatctttttcgcaatgagtagtttgtgtcattaactgttctctcatgtatattagtatttctaagtcttcttttctttgttcagaatttacttgatatacataccccccacccttttccatcctaacttttatctttagttttccttattattttgaatttaattccctttttttttttttttttttttttttttttttttagagataggctcttgctgtgttgctcaggctggaatgcggtggtacagtgttagctcactgcagcctcaaactcctggtctcaagagatcttcctgcctcaccctccccagtagctggaaccacaggcattgtcaccacacccagctaattttttattttttgtagagatggggtctaactatgttgccttggctggtctctaacttctggccccaagtgatctgtcttggtgtcctaaagtgttggtattacaggcatgagccgatgtgccttgcctagatttaattcttgtaaacagtatgttgttagaatctgtcttattttagtcagaaaccctttgccttgtaaatattgtgcttcagccattttctgctgtcaggattcttgcatatctgatgcctgtgttttgtggctgaatgtattgtgctttcttgtttgtttgtttgtttatttatttatttttgagacaaggtcttgctctgtcacccaggctggagtacagtggtgcagtcatggctcactgcagcttcgacctcctaggctcaagtaatcttcccacttcagccttctgggtagctgggactccaggcacatgtgaccatacccagataatttttgtttttttgtagagaaggagtttcaccatgtcacctaggctattcttgaactttggggtgcaagtagtccacccaccttggccttctgaagtgctgaggttacaggcatgagccaccacacccagccatgctttcttattttaatggtctcttggtacctctcttctacttcccttctgtgttgtctcttaaacatttatagttcacagattttctttttcctttcttttcttttcttttttctcctcccctcccctcctctcctttcccctcccctccccgcttctctctttttctatcttcctttctttcctttttccttttttttttttaatttaaatttaagagacaggtcttactctgtcgcccgggctggagtgcagtggcatgatcaccatttaccgcagccttgaaatatcaggctcaagcgatccaccggcctcagcctcccaaaatgttcagattacaggcatgagccaccatgcctggccaagttcacaaattttattatgctagacctgtttgtagccagcccatatggtgacatcctttttttggtcaagctttgtgtattactgagggtttagtcacagagaacatgctactcaatgctttgtttcactagctcttattcgattcataccaaaccatgaaaatgaaaaaggactgaagaacatggaagaaaaataatgcaaaatggtctgttttccagaaaggaatcaaatacgatattttattagtgagctccgagaacatagtatttcccaatgttggtgttgcagggggttgtcgagagcaggctcgatgctgttgctgtctttgaaggcatttctgctcggagactcagagttgccttctctcttgtgcaatgcgggtttgctaactggttggtctgggatagagcaagcctgatttcttcctcactccagtttgggctttccagctttgaaaaactgttttttccttcttttctcttacacttgaaaaaacgaattctggttcatgtgctttgtcttgttctttgggaatttggctcgtttatttagtcattgttttggcaagcattttttttggggtctaccgtgggccacacaccatgctgagtgcggtgggtagaaatggagaggagccactctgcatcaagcttatattctcgtgggagatcagataagcacatacatagaaccttagttacaggctgagacaagctccgatggaagagcagtacatggtgcctgatatgtggaagaccccacctggccttggggaggggctgggcagtcttctcagaggaagtgaggtctcatagctgagacatgaagaatgatagtggtaaatccactgagggaagcatgagcctgagagggtatgtgtgtctgtgtgttggtgtgtgtctgtgtgtttctttgtgtgtgtctgtgtgtttcttgtgcaaataggcacctcggggatggggcaggtggagggaccagcagtgcgaagaccttgggatggggacaccacgtggagtgtgcaaagtggtggaagggccagggtggctgatggaggccagagcaagaggacaccagaggggaccagcgtggctggggggggccagagcgagaggacaccagaggggaccagggtggctggggggggcagagcgagaggactccagaggggaccagggtggctgggggggggggcgccagagtgagaggactccagaggggaccagggtggctggcagaggccagagtgagaggacaccagaggggagcagggtggctggcagaggccagagtgagaggacaccagaggggaccagggtggctgcggggggggccagagtgagaggactccagaggggaccagggtggctgggggggggggggtgccagagtgagaggactccagaggggaccagggtggctggcagaggccagagtgagaggactccagaggggaccagggtggctggggggggggccagagcgagaggacaccagaggggaccagggtggctgaggggggcagcagagtgagaggactccagaggggaccagggtggctggcagaggccagagtgagaggactccagaggggaccagggtggctggcagaggccagagtgagaggacaccagaggggagcagggtggctggcggggggccagagcgaggcgagaggacaccagaggggaccagggtggctggggggggggggcagagtgagaggacaccagaggggaccagagtggctggcagaggccagagtgagaggactccagaggggaccagggcagagcttgggacttactcctcaggacttgggctgctgttgaatagttttatttggtgaaattctcagatttgcaggtgtcagaaagttctactctggctgtagggtggagggtgaactggaaggggagggaggtttgtaggattgttaggagagagtggagtggagagtgcggaggtgtctagggggcagtgggcaggctagtgatcaggtcagaagggggtggagtagatgaaggtgtcagggcttctgctgagtacagcagcaggctggttaagtgagctcaggagtccagaagaggggctgtggggtggtgggggaggcttctttatcttccatgtctgtcacattctttagccttattttatttaatttgttggtttttttcctagttctagttatcaaagtttttatattgtttgttactacatttacttgcaacctcccctcccagctcccaccccccacccccgattttggcatactttgtatttatcctggcttattcttgtttgaaaggtaaaatttttttttttttgagatggagtctcgctctgttgcccaggctggagtgcagtggtgcgatcttggcttactgcaagctccgcctcccgggttcacgccattctcctgcctcagcctcctgagtggctgggagtacaggtgccgccaccacgcccgactaattttttttttgtatttttagtagagacggggtttcacagcgttagccaggatggtctcgatctcctgacctcgtgatccgccggcctcagcctcccaaagtgctgggattaaaggtgtgagccaccgcgcccggccaataggtaaaatattttttaaaagttttctgtttaacaaagtcattccctccagggaaagattttcctttgatcttctccattttctcttgggttttcacatgttttcattgacttaggatttctcccctgatttattaaactttgtgttatagtaattttagttgttgtcttcaagtcctacgcttgtttgctttttttgagacagtctcactgtgtcgcccaggctggagtgcagtgatgcgatctcagctcactgcaacttccaccttctgggttcaagtgattcttgtgcctcagccttccgagtagctgggattacaggctcccgccaccacacccggctaatttttgtatttttagtagagatgggtttcaccatgttggccaggctggtcttgaactcctgagctcaagtgatctgcccgcttcagcctcccaaagtgctaggattacaggtgtgagccaccatgcccagttttatcatcttcccttagcagcctagagctgtggaacactacaagactgtagggtccattcgagttttatgcttttatttacttatttctccaagtcagtgtttttcatcatttttaaacccatgttctcttttgatgaaggattaatttttattgcctcatttagtttttgaaatttcaaaatgcagcaaaaaggaatgaaagcagtgggctttattctcaccctccctgaccctcctggagagtcattcctacctgtattccatttggtcttatttatttataatatatgctacatgagagcaaggatttttgtctgttttgttcatggctttacaccaagttcccagcacacagtaggtgcacataactctttgttgaagagtggcttggtcacctccagttccagaatgatttgggccctgcccctcattgttcggctctgcaggaagcttcctgggaccagatgctgggcctggctgcaagatcaggtcttccttcctgcagggcacagtccatgtgcatcccagcagccacggcagggctggggaggaactgatgtgggttgcttctctgggcagggcatgggggttccctgcctgtggtgggggaagggggtacgtggctgtggggtggaagggatgtttcttgccagagggagtgggcgtgggaggtgcgctgggtgagcagcctctgaggcaggaagtgctttccaggctggggtgggtttgggcttttttgtcagagctgtgggaagccattaagattttaaagcagggtggtaaagttgggtttttgttagaagagtctgtctgctgctggaggcgagatctgcagggaagagttggctaggtggatgagaaggggtgcagaggggcctttcccccaacatgaggatgtggacagcctggatgtgcttatggaggtgagagatggggcctgaggagagccatgcactgcaggcgggcagggtccatgcttctgctgttgttggtacttttatttgttttgggtgactctgagaattaaatattaataacagtgttgaaggaacatactgtatcattggccatgatgcatgcctcctagaaagcagcgctgtacacagtgacatgatcacagcacccctgcaggactccagatgcacagtttcttctcctcactgagagtgttttggtattgctggcctttccagttctagaaatgtcccctttgagactgacttcatggtggctggtgtcagagtctgtgtcccttgtgaaggaggcagaatcagagctaaattcaatttagcaaagattttctagactaagtaggaagagggctcatcacccgaagtgggcgtgggtgctccccatagccaggctttgtctacaggacagcgggaggcagtcaaggcctgagccctggccaggtccctcggagggcagggagcctggagctaggagagagtggtgatgcagggtggccatttccactcccacagggccctttgcccttcacacccagtgcccactgccctgtctgagacgcctcatgctgtcctggcctgggcctccctggccacctgctggcatggcctctcccatttgtgggggtgccacttcctaactgcctctcctctcacggctctccttccgtgccccctaccttgggcaggatgtgggtgggatatagtttgagtccatctcgggtgctggttttatgaagcacacatttgactccctcagtgggtggtggagtgtgcagacctgagctccctgagctctctcgggtagccctggtcacctctcatgggcagggctgcttgcacagctggagggcaaggcctgagctgctgttcccggagagctagagctcgacaggcctggactgcccaggaggcccgtggaaaggctgatccttcctcagttgttgcagctgagtgtgtgtggcctcctgatgctacatgttcagttgccttttacttcctttatgagggaagttttatgctacgcggtatttccaaagtgtgagctccccagaggaatcagggactctgtctttgaatgtccagggtctgtgtatcctctaccagatagaagacccaaggcagcaggactgggctccttctcttcttttgatctctgaaagtacgggactctgcaaggtaacttcattctttaaggcaagccagagtgtgaatcctagctcagcttcttccaagcagatgactgggggcgagtcacaggacagctcgaagcctccattttctcatctgagaaatggggctagtaacctgccttgtggggtggtttggttgtaaggactaaatgagttaatgaatgtaggcatgatatatgtgtttgtgcctattaacactgtgattataggcacttactgattattcagtgaatgaactgaaagcaataaaccaaattcatttattatatcatttggtatgtggaaaattttcttctagtttggtgtacttaacgtttcatactttctctgtttactgaataataactttaattgaacaaaatcactactaattagtccagatttcactgggcttcagttagtctggctgtattattactactccctgggtcatggcaactgtagctgaggtgaaccttagagaggaaagacaagttttactggaatatgcctgaaatacagagccatttagaagggtcatattctgcccattgttaaaagcgctgtgaactaaggctgggcatggtggctaacacctgtaatcccagtgctttgggaagctgaggcggtggttcaactgaggacaggaattcaagaccagcctgaccaacatgatgaaaccccgtctctactaaaaatataaaaattagacagacatggtggcgggcgcctgtaatcccagctactcaggaggctgaggcacaagaatcacttgaacccgggaggcagaggttgcagtgagctgagatcgcatcatttcattccagcctgggcgacagagtgagactctgtctcaaaaaaaaaaaaaaaaaaaaaaaaaaaagcaagcactataaaccatcgaggggcccctcgtttcttacctaatgaagttcagggtctggtcctcatgtgccctcccagcctggcctctccccagccaagcccagtgcttcttagggagctccctgtgtgtacgggtcacctgctggccctggtctctgggggtctgtttccccaaattctccccaccgaccctgtccgtttcctcctcagggaagccttcctgtttacatggtgctcaggaaactgccatatgcttctgtgggactgtggttctcaaacttggccatgcccgagcaccttttggaactttccccagaagtttgcaagtgggtgctttttcaaagctttccaaaatcttagggtacaaccactttgggacccccttcttgagggtactttgtgtcactcatgtgatgctacattagcacaagctccctagtaatgtgtacttggccacaccttgagctcaaggccatggagtgtcttggcagcttagggtccccagtgctctgccctttggggtgactatgtgtatgaatatgagctggaagaagcaggttctgttgcttctttttgttagcacaacagagagaatgttgactcaccccttccttggcaagccccgctgaagaggtgctcactattgtggacccctctgtgggccaggctcccccttttacaatttcccagctcatgtccggccggcagcttggggacaaggttagcccctgtgctctgtgtgtgcgcttttagcgagtttgccagctggaaaacttgtttatcccagagaatggaggagtcatttgacaagtaaggcattaccctggccacctaatttcaaatcagttggaaaagatgcaagttttagaacttgttattccttatttgaactatcctgtatcacggcaaactgtctactgagtgcctgagggtgtacggggtaggtaagtgtgttccctactctgggagacttctaacagtatataaagaagtagttctagtgccctgtcataagtagagtggaagaaggtacaaagtacagttagagtggtggtggttagccttgggaggggaggtaagcttctctgaggagcggcatgagagctggatgtggggacgggtcccttttgcagagaggactggggaagagtcagggagtcggggacatccaggaaataggtggtaggagtgtctgttcatgtgacacactagcagtgcctgctttccaggtacaagtcctcctgtatggattcatttgttaacttagttcttaaagtgtttgaatcttagtaatgattttaaaggaaatttaaaatagggagaaaatgggctgggtgtgatggctcacacccgtaatcccagcactttgggaggccgaggcaggcggatcacctgaggtcaggagttcaagaccagcctagccaacatggtgaaaccctgtctctactaaaaatacaaaaattagctggatgtggtggtgggcgcctgtaatcccagctactcaggaggctgaggcagggagaattgcttcaacccaggaggtggaggttgcagtgagccaagatcgcaccgttgcactccagcctgggcgacagaacaagactccatctcaaaaataaaaataaaagtaaaatagggagaaaatgttcccacagtagctctgcagttgttttcttttttcatgtttctcttcagacttttttttttttagatggagtctcgctctgttgcccaggccggagtgtagtggcgcgatttaggctcattgcaacctctgcctcccgggttcaagcaattctcctgcctcagcctcctgagtagctgggattataggcgtgtgccaccacacccagctaatttttttgtatttttagtagagacggggtttcaccatgctggccaggccggtctcgaactcctgacctcgtgatccgcccaccttggattcccaaagtgctgggattacaggcgtgagccactgcgcccttcctcccttcagactttttaataggcacacattaaattttacatgtgttatatacatgtataattttgtgttttgtgttacaaagttaaattttgtgttttgtgttacaaaattacattttacatgtgttatatacatgtataattttgtgtttacatgtgttatatacatgtataatttacatgtgttatatacatgtataattttgtattttggctttatttgctgttttatcataagattccccatatcatgagtctctgtaatgatcgttttttatggtggcagatatttcattgtgtagatgtgtcatcactgatcagttaaactttatttgctcactcttgcagcattaggaactgagaatgtttcagtttttcctgttggagataatgctagaatgtgcatttcagatcacaggagggacatttagggaggtgagtttgttctcccctgcagagcagcttccatgctgagccctgtttgcccaggagagggtgcagtttgcccttcaggagctgctttggtttggtcttgggttcctttttgttacctgccctgagagttgagaagacaaaacttcctcctgctttgggtgattctagtttggttctggtttacagctttatttttgagtatttctgtatttcagcttctatttactttacaccattttagatagatcatcatttgaactttcagatatcctaagcctccagaatctctagaggattggcatgtcacataactttaaaaaagcaatatcaagaagaagttgggtttgttgaagggaagtggacagatcaggggactctggcttatatggctaagctggtggaggaagacatgtgagcagacattgggtgaacgtctgctgttccagtggcacatcctggaatgaggttgggtggagggtaggtagagagctgccccaggtatggaaggtggtagaagaagagttgagtacacacttgcatgagggatggggctggtttacaggaatggaaccagcttggaaagaagacagaaggtgagaagtgaatacttgttggtatcatgtaagaacagagtgaagaaaaaggacaggccggcccttggtttatttttaaatttcaggaaaatggattggccaaataatggggatcaaaaataaagggtgtttttattatgagccaagtgaaaattaaatttaagatatgtatgttgttatggtttgattgtgtcctccaaagttcatgtgttggaaactgaagcgccagtgcaacagtattgagaggtagaaactttaagaggtgatcagtgctgggtgcagtggctcacgcctgtaatcccagcactttgggaggccaaggcgggcagatcacctgaggtcgggagtttgagatcagcctgatcaacatggagaaaccctgtctctactaaaaatacaaaattagctgggtgtgttggcacatgcctgtaatcccagctactcaggaggctgaggcaggagaatcacttgaacccaggaggcggaggttgcagtgagccgagattgtgccattgcactccagcctgggcaacaagagtgaaactctgtctaaaaaaaaaaaaaagaaagaaaaaaaaagaggtgatcaggccaggagggctctgctctggggatggattaatgctgttattgtaggggtcagttcctaataaagggatgagttcatctcctcccccttgttctcactgtcacctttgacgcagcatgaagcccctcaccagatgccgcaccatgctcttagactttcgaactatgaggcaaataaacttctgttcatttaaaattatctagtctgtggtattctgttacagcagcgcaaaacagactaagacacatgtctagagggctgcttatgtgtaatagctatataatactgcatatataaagggcagtttatatttaatgctggtagaatatcatgaaggtagtgtatgttagagttaggtttagctactgtattagtttctcatggcttccatagcaaattatcagataacatgaaacagaagaaatgtaattctatcacattcctggaggccagacatctgaaatcatggtgttggcagggctggggtcctaggagagactctgtgacttgcttttcccagctcctggtaattccaggcattccctggcttgtggctgcatcgcttcaagatctgcctctgtctccacatggccttttcttccttcttctgtgtcttctcctctgttttcttaaacagacacctgtccttggatttagggcccactcagataatccaggatgatctcatctcaagatccttaacttgattacatctgcaaagactgtttttctaaataaggtcacattcacaggttccagagattagaacatggacataccttttggaggccatcattcgatgccctatagctacaaataagaatggtgtgaacaggcaaggttttattctttcacaccaaagaaagtagtccttggtgagtatggtcattctgcaaggtcgaccgagcccttccagaatgtgagtcttctagtctaagaggctatgaggtgctagtcaccactgtgtctcctgttgttggacggggagacgaggagaggagaaagtgtgttgcctggtaggagttcataaccaggattcatggccccctcaaagcggtctgtggatatgactatattgtattaaaattggtttccactgtaatcataagtattttatttttggcacttagagaaattctgagaaggagttcataggcctcaccagactgccagaaggggtccatggcacagaacagacgaggagctcttgtatgacttctccaaagtgtgacatggcacttctgcggacatcctcccggttgatctttagttatgtgctcataccgtatagctctcaggatgcttgccctgaaataatcatatcagaataaccatgttatgcagagagaagggtgatttttcatgtctgtatttatgacttccttttccccaagtaatatttttgaatagtttatggtatcaagaagtttgatgaagtatatcataaagaaggtcttccttgttagctgtgtgacctagggcagatacttcatctttctgagactcaattttctcatctgtgaaatgggataatactggactgtatctcaaaggtcattggattggcacagaagtgcgttctgaatgtttcctagtttctaatctccaccaccagtcatctctactagtaggaaagtaatagggtttaacttgctaacatgtaacagttattctgatttataggagtttcaaaggatttcaaacgaggccaactttacagatatattaaaaatagcttttgtagcagaagagtagatatccggaaaaagttatccttaaaagttttcaaggtataatcaatacaaacaggaaaaataaaagttaagggaaaaccaagtataatttaacatataagatgcctttaattggtagctaaataaaaaggaagctatgtaatggatcagagtattgcgtttaaatcttgtcatggcagagcacggtggctcatgcctgtaatcccagcattttgggagaccaaggcaggagaatcacttgaggctaggagtttaagaccagcctgggcagcataacaagatcctgtctctacaaaaaataaaaaaaattatccaggtacggaggcatgcacctgtagtcccagctacttgggaggctgaggcgggaggatcacttgagcccaggagttctaggttgcagtgagctgtgattgcaccactgcactccagcctgggcaacagagagagatcgtgtctcaaaacataaaataaatcttgtccatgtggcattcatatttgttgggtgaatgaaagttccctagtaggcctacctagcgtgaaactgtggctgagtttctcagctgtttctaacagacatcagcccagaggatggttaggactgcttcttgggtgaggaaccgtgatctttatccagatttcatcatcagttttcctttttagcatgtttggatttcagatattttctgggcaaaattcctaagccagttaactttggctcggagagaggaaaaactgtttttttttttttttttcagatgagtctcactctgttgcccaggctggagtgccgtgctgcgctctcagctcactgcaacctccgcctcccgggttcacgcagttctcctgcctcagcctcccaagtagctgggactacaggcatgtaccactacacctggcaaactttgtatttttagtagagacagggtttcaccatgttggccaggctggtctcgaactcctgacctcaggtgatccacccatctcggcctcatgggattacaggcgtgagccactgcgcccatccagagaaactgtatataattggcaaatgtctctgcataaaagactcttcctaattgctgcaactgctggcccaggtctgggacagggagaattgtatttgtgggtcccaaaagtcctcttgagtgtgaagtgtctttgctcttcctgttgggaagccccacgttcgttagcagctcctgccccctgggctcacttctgcaaagcaagcctgcctctatttctgctcaagtgcagtgttccaggagaacctgactgcatgtcccagctctgccagctctcagtggtgggttcttggccacctgtagcttcattctcccatctgccaatgagggtggtcctacctagcacagcaatggtggggcagtcgagcaccgggcagagtaggtgctcagtgaatgaaatactgtaattattaacacatgccatggacagcagtgcaggcctgcgggatcaggtgcagaaggaagttaacccagtgaattccacacctggtaatccacactgtgttctcaggttaaagaagcaggaggaagcaggcattgagtcaaattggtggctgtttgctaagtgtggggttttactgaaggcagcacctgcttctgcagcacagctggtctgaaaagccaggttgctccttgtgagggcttaggggtcggttttaacagtcactccaagcaggcacagggagaagatgctgtcctcttctggcagcctggctggtgagcagtggaaccaattgtggtgtctcttctttagagtttggggtgggagaagacgcagttactcgtctgggctgtttgtttagattatcagtggggtttgcatttgtgaaatctaagccattttcaccttatgattgtatgtgtttgaaaaagtatttgtgttgttaacacttgttatacttgttaatttttatgaacaagtgtagcgtacttgttaattgtctttatttacaaatggcagagaaaacaaagtggatagttgagagactgtcattggattatagtaatttagtaagggaaagagttctttgagaaaagacctggggggaagatacatggatttgattgaattttttcctagggtgcctaggcagtgaatactttttagccatctttactcagtatgcttttaaatgtgtcacggtgtgattgagccaagttccgtctgtctggtttttttttttccttgaaagttacaaaaatggtatcattctctaggaaatcatgttaaaaaaaaatcccacgttcccgtcccagaataacctggtgtttcacagtacatagtggtaggatctttttatttccttgaaacaacttgttatcaaattaagataatttcctgctctgtggtagggagactgctgtttattgacccagtccttcctcctcaccacacaattgaagaacctggtttgaagtgtaaacctaaaaaacatgtgatccccccataccgtttttttttttttttttttttttttttttaagacaggaggaggactgtgggagtggttatcagtagatctgtgcagaagggttggccctgcagactgggtctggtgtagaatgtgccctgtgggagctgcctccaggcctgtggctgggtgtgttaatcagtgctggacttcatacagaaaagtcgatgctgttttcttttctttttcttttttttaaatttggtagagatatgatctcaccatgttgtccaggctggtcaacatgatccaatcctcctgccttggcctcccaaagtgctgggattacaggtgtgagccactgtgcctggccaatgctgttttctttgtagctgaattgttcattggctgcaaagctatagagggtgggtcaagataattagatgtttggaaaatagttaagagggggattggcttccaccccattctttgattttttttctctttgaagaaagagggggggctcaagggacactgaccttggaggcaggagccttggggtttgtcctgtgcccgtcattgaccgggatcgcttccttttctgtaaatcaaggtcatgggcgcagctgacttgccaaggctgttgccagctctgcgctgccttctgaggaacttgatggtttgcttcctgtgaaaacttgatggtttgctttaaggtatcactagataccttggggtgatatctaatcacaccaatgaagagattgggtatttgtttttcccaaatccctaagtgctgatttctccagggcagtacacaacctcttatctttagcactcactttgacttgcataagtttcctggcttggatgataagctatatggtcaccctgcttattcagagaaaggttcatagtgttctttaatgactattctaatacatgaaaaccattttttgtgacttgagacataattgatgtacaataaactgcagtatttaaggtgtacagtttgatagtttttatacacacacactttctctctctctctctcataattacactgaagctgtcaccatagtcaggataacatttccatcaccctgagaatttccttgtaatccttccttctctgcctcttcacaggcaaacatggatggatttgttttctgtcattgtagattactctgcattttaaaaagaatgctatataaattgagtaatgcagcatgtactacttttttttttaatgtctggcttctttcactcagcataatggttttgagatttttcatgttacgaatatcagtagtccattgtatgcatattccagcatttgtctattctattggtgggcatttaggtagtttctagttttgggttattactaataaaactatgaacatttgtatacaagtcttttgtgtggacatattttcatttctcttgggtaaacaccttgaagtggaatcgctggatcatatagtaggtatatgtttaacttcttaagaggctgctaaactgttttctgaagtggtgatccaattttatattcccaccagcagtgtatagagagttccagttgctccacatcctcaccaacacttggtgtgatcagtctttttaattttatgtgtcctaatagttatgtagtgttaccccattgtggctttaatttccatttccctgatgactaatgatgtcaacatcttttcatgtgtttgttggtcatttgtatgtcttttgtgaaatgtgtgctaggacatttatccatttttttaattgggttcttattgagttgtaagacttctttatgtattttggatgtaagtcctttgtctgatacatgtgttgtgaatgtttttctcagtctgtggcttgtgttttctttaatgacacttttagaacagaagtctttctttttggtgaaattcaacttatcagttttttaaatggctcattcttctagtattctatccagaaaacccttgtctacctcggcttgcaaagattttcttctataagttttgtagttttaggttttacagttgggattattattgatgttcttcccccgacccccatatggatattcagtttttgaggcagcgtttattgaagatacattccattcctcatttaattacctttgctgccttttttcaaaagtcaattaaccttttatttttgagtctctttccagattttctattttgttttattgaactatattatgtctgcctttactgaaataattctacactttgttgattactgtagttttataggaagtgttgaaattagagtcatctttgttcttttctaacatagctttattctaagtacttagcattttcatataaattttaatattagtttgtcaatttctataagtgaggcctgctagaattttgtttgagattgtgttaaatctgtagatcaatttggggagaattgctatcttaataacattgaatctttaatgatgttgagttttccagtacattaacacgatctctctctctttatttaggtgctttaaatttatctcagcagtgctttgtagttttcagtgtagatgtctttaacgtcttttgttagattcatttcaatgtaatttatgtttttatttttattaactaaatggaatttataaacattttatatctgtttgctgctaatatataagaatacagtggattttgtgaccttgcaaaatactgcttgtttaattctagtagtcattgtgtagattccctagaaagttctatataaagttgtatcatttgcaaatagggacagctttacttcttcctttctgactcacatgccttttatttatttttcttgcttcattgcaaaggctaagattccagtacagtgttgaataggagtagcgaaggcaggaatccttccaccttttccagtcttaacatgaaacagttcggttttcatcattaaatgtgatgttagctgtaggctttttgtaggtatcctttatcagtttgaggatgttctttacttgatcgctgacagttttaattattaatgggtgttgaattttgtcaaatgcttttctgcatttattgaagtgaacacatggtttttttctcctttatattattaaaagggcaaattaaattggttgattttcaaatttaagacaacttttcattcttgggttaaaccctatttgctcataatatgttttttatttattgttggattcaatttgccattattttgttaaggattgttgcaccaatattcatgaaggtattgatctgtaatttatttctctccctttcttccctcatttcttcctttctgcctttgtcaggttttggtactttaaaaaatagagagtcaggccagatgtggtggctcacgtccgtaatccctgcattttgggaggccgaagcaggtggatcacttgaggctaggagttcaagactggcctggccaacatggtgaaacctcatccctactaaaaatacatatatatgtagtgagtcagtgttaccccgcctctgttttctgataaagtttgtgtaagcttggtgttctttctgaaatatttgctagagtttaccagtgaaatgatgtaggtatgcagtttttttggggtaaagtttttgataataccctgtgattttttttttttaatgttcagattttttgtttcttgtgtctgcagtgacattttctgcattctcttccttttccctctgatttatgtctgttggatggagaagtagaaactttatgagagaagggatatcatggggcttgttgatctgttttcatcccagcgcccccgaaccatgcctggcaccaaatagccacactgtaaatgcctgtggggttaattgatttgttgttgctgtatctctattccttggcacctctgggaagcatttttgtctccccccgtccacatgggaccgtgtcgtcactgtgctgtgacgggagctggctgagtcaggctggcaggctgtggctgccctgcatgccgtgccctcccacggtggctcttcaaattcttggctatgtgcccagcactggtacacagaccctctgagtcagggcttgccaatggaaaaaatattttcaaccttttttggtcttttaaaatattaaaacctatagttggaattacttcttttcatttttacaatgtacttgaagtatcagaggaataaggaaagccattgtaagcttggttagtggaaagggataaaccacctctgagcatccaaataaaattaggaagcgggggttctagatgagggaggacaattccaggaggctcttgaccttgtatatgattccctgactgggaatgtggtctgagatgccctttcctggacagattacaaatgacagcccctggagcaaacacatgaatcagccagggagttaaaaaagaacagggtagtttggactgggcctctctctttcaggacatgactgctgtggctacagactgcattcaggtccccagcatctggaaggagtctgtgcccacttatcctttgcatcctaaggggactgggtctttgtgcaccagcagcagccgtagaggttgggcttgggaatcaggggctcccttatcaaagctgggaaacttagaacaacagctgtgccgctcatggacctgtagtctctcctgttaagcagagtgctgagttcatgtgatagcaaacacagctctgccagaccacagggtcaccaggcaggcactccatccctccctccagggggagaccacggcatgccttggatgaggtgacttggccaactgtcttgtggccccagctcctgacattacaatgtgatgactgtgacacttggaagagaaatgtctcaggtatcgtggtcctgggtcctgtggtacaggaccttgtctctgcggtcctgtacttttgcttcacaattagaagaattgaaagcttcaggttgtttcaggtatgttttttcaagaagtgcaatagtagtgtgtttatagatgttttccttagagttagttttgggggagagaagatgactgcccttccatcctgcaggtggattggctggggaatgaggccatctcttttcagagtgagcagtgaaccatttttgtctgtacactgacctggggctgatttggcatcctgaccttccagtctgagggagttggtaaggggctggaagggcccattctttgtgtgtgtgggtattttttagagacggggtcttgctgtgttgcctgggccggtctggagatcctgagttcaagcaatcctcttgccttggccttccgagtagctgagactacaggtacatgctggacccacactttggactctgtccctgctggcctagttctttgccaagagcaaaacttgagagcaccctcacacaggtaacagttagaccttgtcaggagacatggctgttttcccagacagctgagctttcagactaaagcacagaaaagttggaggacatgggactccttagcccacaaaagaaactctattttaattttccatgtgaaataggagtagggtacgttagggtagggcatcttggttatgagatgcctgcagcaagtgccatcagggtggctgccagctgagtcatctccctcaaagagctttcctggaaccactctccccggtgatgtcagctccttcacctccattgctgtctctagctgcaggggtggttggagacccagtattttagctaggccctgccagaggccattgggatagcaggtcaatggatgaaggaggttgtataggcaaatgggagtaattatctctgatcttgatttttgtaggaaataggcgtagattaaggcatagataaatttgaaaaggcatagatacattaattaattaattagagatgaggtttcactctgtcgccctgtctgaagtgcaatggcgtgatcaaggttcattgcagctttgacctcctgggctcaagtgattcccgcaccttagcctactgagtagctgggaccacaggcaggcaccaccattcccagctaatttataaattttttttgtagaaacagggtctcactgtgttgcccaggctggtcttgaacacctgggctcaagggatcctcctgctttggcctcccaaagcactgattggcaggcatgagctgctgcgcccaaccaggcatagataaatttaaagacaccttttactgtagacaatttggaaaatagagaaaaccagagggaaaagaaaaaaaagaatctctcagtcctaccacttgatgtgtgaacctccagttttcccggctgcttgtgtcctgccttttttaaacacaatacgatgacatcagtatgtccccctttccctcatttatgttttattgtggtagaatactgttttattgtggtagaatacacataacataaaatttagcatcttaaccatttttaagagtacagtataaatatgcccttttataaattacttgtttttccctcctcgtgtggctttgttttctgtgtggtagccattctgtggtttacttaaccactctaagtattgaacacacaaacaggcttgaatcaattcatttgaaaaggtgtggacaagactttgtcctaagggtgacacctggcccagccagcagatgtgattgttctgccttggccaccttgctctgggaaattgtattgcttagtcaggttgaccttcagtgaccaaaaaagtggatggtagtgtcaagggcttcgggtagcttatgaaactctttttccttctcatcttgttactttcctcttgatacttacttgttaactacagtgttactatagacgcctttgggtatatgcagatttaccattagttaatcccagagaaaaatggataaattatgacagcgtggtggctgtcagacttaagaatgccaaagcattcccgtttctctccctccaccccatcccttccagacttactaccagggacctttggtttgcctttccttgtcaccaggactccgaggtctttcagctccttgtttcttctgttcagtagctgaaggatgcaggtactctgccctcctgctgtggtttgtttctctagcgagaagtccagcagcccagctactgaaagccaaggtcactaacgcaggatgcagtcagcccaggaggagcacagccctggacatgaagcttctggtcttacttctcccaccttcctgctacggtgtgcattgcagccgcaagctctgccttggaattgcttactgtgtcttagttcctgtgtgcatttttttattttttatttttttgagacagtcttgctctgtcatccaggctggagtgcagttgtgcgatcacagctcattgcaacctctgcctcctgggttcaactgattctccctcctcagcctcctgagtagctgggactagaggcacccgccaccacgcctggctaatttttgtatttttagtagagatgggatttcaccatgttggccagactggtcttgaactcctgatctcaggtgatttgcccacctcagcctcccagagggctgggattacagtcatgagcccctgcgcctagccccccttgtgcattttttaaaaggtgcagttctgtatttactgtagtgtttatgtggtaaaatttgttcatttaaaaacatttaatattgctgttgttcccttgatgcttggttacaaatttgcataagttctcagtggcctgccccagcttacctattcccatgggacttctttttacttttattgtgcccttttgtagagtatgagggtttttaggaactcaaaaattgcattatggcaaaaatacctggaaggttttcctgatgctaagattctttttaattccccttttaatacaaataacatgtatcattatagataattaagtgcagataacccaaacaaacaaaaaccactcaaaagtcttatcactgagattctagattaaacactattatatagacctgcgattctcaaacatgggtagggataaggcagtgggggaggtgagattggcctgaagaggacatttggggactccacactggtttgtcacagttgtgggtatggagagcaggggtacgtgctgctgacacctagttggtaaagtccagggaagctgctcagtgtccccagaggcacaacagtgttgtgcgacagcctcacaacaaagaattatttggctcaaaatgtcaatagtgctgaggttgagaaaccctgatatggacagatagttatggggcctttttctgtgaatattattaaatacactttagttttacaaaaatttggattatttatacagactagtttatgacctgcttttaaaacttattacttcatgaacatctttctgtgtccatgactatgggcctgtgacataccattgtgtgagcatgttggagcttacttcaccagccccctgtctggagactgaggtgctgccagcgttttgctattgaaaccacatttgtttgtattttgccttctgcatgctggttgactatggccagcccatgttggggcaccagctctacatctggggtgcctttcatgggtaataatattcccttcctgccagaggcccccccgccaaccatggcagtccccaatctctagttttctcacagttgaacataactcaagcttaatgaagtactgttgaaatagtgaataggtaagtaacacaatatttctgtcacgtttcatttttaagtagaactttcactttttgcttcattttactttatgggtttctaaaaaaataaataaattaaaacaacctatcttctggtaggttacatgtgactttaacttcttgccaagttggctttgctccatacctgggcttcctgagttcctggggaggcaggagtgggtcagatggaggatgccttgctctgactgtgctgtgggtggcacctgtcagttgtcatgctggggaccccctccttccccccaaagctgctctgaggctgcaggtgagatgcagcccaggagaggaagtgcatgacagctgtttgggcccacgttcccttttaggttgcagacagggcagcgtgcagagctggtgggctgggcggggtctgacacagtgctgtgcggagctcacccggacctgggcactcaggctctttctatatggggaactccaagagcttgtttgtgtggtggtgtctatttttgtgttttgtgtggtgctctgtgaggaagtctgttgtctacgcacatcccagctgctttgaatggtctgtctctgggggcttccaggtagggaattgtgtacggggaatccaggattcgggcagcatcggaacagcaggatgtgagtaacaggaagtgacagaaatgacccagggcgccagatgcttattctcggccacctttccaagcgctgcagcccaggagctatatttagcagagtgtttccgagtgcctcatcctgcccccagcaccgtccctttgcccctcttttggttggtggctgattgcacggtactgatttgctgctccagcgttcctgctctacttcgtaatctgtaggctcttgcccattgactttaacacccagtttttgtttgtgctgggtcacttcaattttgatacacgtggagcagctggaaactgttctgagcaggaagggcagcaggtaagagccccaggggacagtgtgccatcatactgggaggctgttgggtggtgagttcaaggtcagggtttggaattaagcggaaggaattgagcttccttgtaagatgctccagagggttgcttcttggcttgtatgtcttagaaatggaaggctggaatttttaaggtataggctttgtggtgtgactttactcatgtgctagaaacattctgtggttctcacctggccagacagaaagctgcaggtggaagaggcttgtgtgtggtgaattcctacagtctgagctttgtcacgggaaaatttccctccagtcccccaaagcaagcactacagagcccagatttgttctgctttgggtgtgggtggattttcaccttgtctgtcgacggtgcaggacctgtccctgtgtgctttgaggtttctagggtgtgatgttggtttgtggtttgtggaggggtgtgtgttgggagggaaggtgtttttgctgttctcctctaaaagctcccttctgagtggtcccgccaggacctccctttcctcccttcatgaagcatccaccttgttttcagacactcgagctatttgggattcaggaattgactctgggatgagaaatttgagagacaaattaggaacagttgtgtctgccatgagacgcgtggcagtcggcaggggcctggtggggtgtataaaagccctgggaaccctgcataaaggggttgggatggtaaaggagtgaattccaggctcaggcgctcaggagattcccctcccccagttccctcagcagagtctggctactggcatggtttcaggctgacctgttaaccttccgtatggctaaactacaaatatagggcatggctatattgtgtgtgtctctagttctggcttgggcatgttagcatatttttgtgccaaaacatttaaaacattcaaaaagtaacacatgaacccagctatgactgcttccagcctgagaaataaacataatagatataacagaggcacttggaattctctttcctatcctcgtttcttcctgctcccccttccctgggggcatcctaactttggtgtttgtcatttgttttcatgtttatatacttttttgataagtgtgtgtaggcataaacagtatatagcattgttgaactggttctgaaatgtcgaataaatgttatcagactggacagccacagcattacgcttcctggatttatccctgtggctacatctagctttagttaaatggttcaaggtttaatacaactgattcctgattcctggagttaaatcagaatttctggggaacgaggcatgaaccgcagagctcctgacaggcgcggcctgagttgaggcccacgatgctggttttcgtggcctctgtagtgttccagtacctaagacgtcctgttgtggacgtacactttcccagattccctgtgatcagtagtgctgctgtgaatatgcttatcttcgtcttcttggcacatgggcaagagtttctctagaatgtgtttctaaggatagaattgccaggtgtgtgcatcttcagcttgactggtgatcgtcaaattacctccagaactatcagcagcagtggtcacgtatgagtgatctcatttctatagtgtctttaagtttttcttttttaacataccaaactgagggcaagatgaagacctcatgagtgagataagacattggacattgctgagactttaatcgacaccgtgccctcagcatgtccacacggacctgctggccctgccgccaccccagctgtaaagcttgcttccacccacagtgtccccttcctgggatgggagcagcacccagccagctgctcggaggtcactgtggactcctctctgtctcaccctgtcccgtctgctgtcctcagagcacatccagagcctgcccactctcctcaccatcatctcgtgatggggttactgaggagcctcccaaaaggtttcctgccttctttcctgcatcttactgtcagctttcaataaagcaaccagaatgatgctttcaaaacttgagcttgcatggcttcttattttacgtggagtaaaagccaaagttcttacacctgcatggccctctgtggtcctgatgcttgcaggttggcccctggcccccttcctgatgccagccccagccacgcaccacgcgcctgcttctgctcagcccttcccacctccttccttgcttccttccagtctctggctccttcctcgcctcctccccgtttttgctgtggagtcccctggcccccagacctctcttttctggtctcccgtttttccatagggcttgtcaccagctactactctccatgctgtgtaattcacttctttaataagtctttaatttactgcctgcattcaaatgtaacttccgcaggagcaggaatcttttctgtttgctcaagtgaaagactgcctgaatttatttctgaggaagaaagaaagaatttggagcccaatgatgaagatagcacaggagagaggaggtgaagttgagggagcagtttctgacttgggaggttggggggatgggacaattactggtctctgggaggcagtggcagaaggaccttgaggccccctaagtgtgtagtaggacccccgaggggcatggccagtgggctgtggggctgcagaggcagcttcttttggggccttgtcttggcaccatctcggccactcccagagcatacattggtattgccgtagtgggtgctgggctggcccgccccacccaggaagtgcactactgtttgagggcaggagcctgcgattctgacatcctctcttcatggctgagctcctcaggttacatagctccactgattcctcaagcactgttgtgtttagaaatgaaaccttccatttccagggccctgccttgtgcaggctcaagtacccaggccacgtgtcagagcccatagcaaaatgagcagctcaaccggagggcgtggtccatgacactcctgcgtgtgcttggactcaggcgcagggacaggcggggcagctggcatttctacccacccctcctgacatagaggacctggtccttttctttgagaatgtgtaccaaaggtgtgtcggctgtgtccacataatattttcttggcgtcagatgtttcatgggttgcactaactacaaatacaggactttagataagattacacttttaacttgcgctgcccacatacgcccttgtccttaagaaacacagcattgttctggagttactccttggttttcccagtttaaacttaaatattgttgatggtggttacttatttttaattaaagcttttattttgagattctttgtaccctttacccagttgcatgcagtggtaacctcttgcacaactccagtacaatgtcacacccaggatactaacctcgttacagtggagatgggtagcctccaagccgcagagattttccttgtgcccttttacagcctcacacatgtccctctgtaacccctggcaaacactcatctggtctccatttctataatttggtcttttcaagatgtgatataaatggaatcttatagtatgtaacctttggggttggatttttcactcagcgtaattccctggagcctcattgaggttgatgagtcttatcagtggttgttcctttttattactgagtagtattccacgggtgtaccacagtttgttaatcatttaccccctgaagggcatccgaatagtttccagcttttggtgatcatgaataaagctgctgtaaacattcctgggtaggtttcggtgcaaacatgaatctccatttctctgggataaatgctgaagagtgtaattgctgggtcatatgctagtcacatgcttggttttttaagaaactgccaaaccgttttgcagagtggccgtaatgttttacatcccacccaacagtaagatccactttctccatattctctccagcaggtggtgttggcactagtttctgttgtagccatcgtgataggtgcgtagggctctctggttgtggtttcagtgtgtttctctgatggctaaggatgttgagtatcttctgtgtgcttatttgccgcttgcatatcctcttgtgctgtcgggggtgaggactcatttccaggtggtataggagacatcccggctctcagcttggcctcctctggatactctgttaggtgagtgctggagtgcctagctgcggcctgggagtggggtgggcatggttttttcttgtggcgctggctggagtaaggtgggtgttactgccgttgtcagtttctgtcttgtctgactgcccccttcctggatccttggcctggaagagcaggcttttgttggggctttccacccacccccccagtatccatcactgttttcggctgctgcttctttagctccaagtctagggtataccaggtaaaaagaaaacccagagggccaccacagtgtcatccctttggacaagacccttgtcaggctgccatcttctctctacctttcagggtctttttgtgttgattttctgatgcccatggttttcagttctcagtgagaggagtggggaaaagtacctccctgtcatctgaatttggacccgtgaaaagtgaagagggggtccattcagaatgttgtgcctctacccatccctgctcgctcgtcatgaccgttggaccgttgtggtccccgggcctcacattaattactcttaggcccttttggtttggcctgtggtttcagcgtgacacagtttgctggactttgatcttttttgtcatttaaagtgtcatttatgaatgagatccacgtccagatccctgcatgtccaaattcatggttagaaatggttggacaggacatagccatttgggtgctgtgattcagcctgatgtcaatcagtgaactgcctttgtcattatcctccagatcttatttctccaccttctattttgaactcttgggaaacctggtcagagtgggagggacaactagtcagatgacttaatgagatgttggtatcgtccttgtgctgatcctccaagccagtcaccctgccaaaacggaaatgaaatgtgccagacaccgcttgtactgagtgagcttgggagagctcgtggtgagtgccagttgcttccctgcctccggcccactggccctggtgtgaggcaccacccagatgaggagaggctgcgggatggaggtccagggctccgcctggagcccccctgcctggtgtcctggccacatcagctcatttgctgtgggactgtgagcaggcccctcagccgggttcgtcaggttgtggagaagctgaatggagcagataacctggaaaacacgcggtggattgccgagaccttctttgtgcctcgcccatattagccaaactgtcccttgttctatcagctgccatgtgtgtgtaagccagagtccaccctcttttccatttgagaaatcacgtctgcatgtctccagtatgtctcctttttcaccatgatttctcagagatcactccctgcggtttaataaccccctgggctaattcttcccaggacatgggaggacattttgtctggcttggcaactcatttagagtagcaaggtattttctcatttctcttggaaaatcatgtacttgaatcaagaatagaagccaaaattgttctttcaaatagaattttaaagcttttttttttaatccttaacatataaacgtaagactttatttttatttatttatttatttttaagatggagtcacaccctgtcgcccaggctggagtgcagtggcgtaatcttggctcactgcaaattccacctgccgggttcacgccattctcctgcctcagcctcctgagtagctgggaccacaggcgcccgccaccacgcctggctaatttttttgtatttttaatagagacagggtttcactgtgttagccaggatggtctcgatctcctgacctcgtgatttgcccgcctcagcctcccaaagtgctgggattacaggtgtgagccactgtgcccggccgactttattcttttttaatagctcatttttggattggcaacacatgcaagtggtacagaaatcttaaggctaaaaagatataaagtgtttcccagccactcagaggtcctctcagttagaggtgactaatattagtgttttctctgtacccatactcttcctgcaattggcttttatctattaacagtgtgtcttagaggttgttccatataagaacatgtagagtagcttcaggggttttagtggctgcatagttttctgttatatgaatgtactgtcattactgtagccagtctctaccagccttatattgatcactatttgtttggtttcaaatattttgtctttatagtgaatgccgccacaaataaccttgtatatacagtatgtgatttctcatgaagatacaggagaggataaatttatagaagcatggttgttgagacacaggtgtatattttcaagtctgacagattttaccaaatggtttccatagaggttgtattaatttttgccccagtgtatgagaatcagtagaccatattataaaacatttgatctctgtgaatctggtaggttaaaaaatgggatctcctaattttaacttgcatttgccttataagacagcgttttttcataaacgttgaaaatccatttctaacactgttttaacatagtgctgccagactctcatattcatgcttcatatttcatattcatattcatgtttccacctttctctccctgtctcttgtacagttattttctaaccagattttatgcaggagtctgggcagctctgcacacttttcttttgagttatgtggttatgtgtttttgagaaatcccaagttctgtatcctttttgactgaggtgcagcattcacatggaggagtgtactcattacagacgcacagcttgatgcatgttcccgaccacggagaacactgcagcccccggaatccctcctgtgtgcccctcctgtcaaagcagctgctaggagaagctagcatctaataccatagattagttatgtctgtttttttaactttatgtaatgcataaggaaattacacagagtatatgtcgtcttgtgtcaggcttatttctttcgctgttgtaagattcattacattattgcttgtctcccaatgtatgagtatactacagtgtattcactgtaggcctgtttagagtagtgatgctatgaacattctcgtatgctttgatgaggaaggtatgcgtttgcatttctgtgggatgcgtgggtggaattgctgagtcacagggtatatacaagttcagctgttttctgaagtagttgcaccaaattgcactgtcaccagcacttgatactgtctgttacagctcagccattgtgagagatgcatcaccctgtagctttaatttgtacttccctgatgactaatcaaattgagcaccgggtcatgtgctttattggccatttgtgaaatagctattcaagtctttcgtccattttactattagtttgtctgctcttactgatttttaagttctgttaccctcaagagaattccagcaggtgtgtaaaaattcacatctgtctatggctgttctagcctgcctcaggattctgtgagaaatgcatccaccattttatccactcctcctctgtgacatcacgtttctttctccagtcatcaagcatcaagatctgaggatattttctctctccagtgtgtaggtttccatgcagtcacctctgatgcagttctgctccttctcttggtgggacgtcctgcagcctggccttttgaatccctgggatgtcattcatttgtcctgttgagttcagtttattgccctgctttttttttttttttttttttgagacagggtctcactctgtcacccaggctggagtgcagtggtgcaatcttggctcactgcaacctccgcctcccaggttcaagtgatcctcccaactcagcctcccaagtagctgggattacaggtacatgccaccacgtccagctattttttgtatttttagttagagatggagttttaccatgttggccaggctggtctcgaactcctaacctcaagtgatctacctgcctcggcctcccaaagtgctgagattataggcgtaagccactgcgcccagccttattgccctgcttctgatttgcaattatcttttaagttgattcaggggtgtgaactgtttcttatttaatacatttgcttgaaaaatatgagccatcttttagtctccaaagacttttctttgtgaaggctggattttggagatagtttcagcttttttacaccattccttggttgccagtagttatgatactggctgcagtccagacatagggatgctcttagtattccttagagcatctccctgcaccctgccacctgccctggtgggcagggtgagcagccaggaaggcatagcctgagggcctgtatctagcccctgctttctcgcctgggtccttcctacccatgctgtctcccaaatcaagggattgaataggaagtgctgctcagaacatcccccagaatcagcctcccgaagagactcaccctcccctaccagaggttgggctgtggctggtgttaggggaacaggagtaggaggggagccagaggaggaggaggtgggcccttgcctaaggggtgcctgctggttggtgtgggggctggagctcgccaggaggggtgtgctgagaagatggaggcatggcatggaagtgtgagtcatggcaaatctcctgtgtgcagctggggaccgacatagagaaggcaggcccagttgtgtcccctctgtgggcagctaagaaggatggattctgacttatttggtgggactctcctgtgacatttcttgtggtttgggagagtggaccactgataccagagcagtcttaagaaagatgctcacatgggaaaggggtctcagcagtgtcaaatgatgacatcaaagctgagggcttcgaccccaaggtagcaccgatagtgacagtgcccagaacattatcaggttgcaccaactggcacctcacaacaacaaggctaggatgcgacactgctcttaatagctccggttttcagatggggcagtggaggcacagggcggagaagcacctgctctaagttacacagctagcaagggcttcagactcagggaatgtgccaggccctgtgcacatttggtcctgttcagtcccaccacagccctgcaggttgcttctagcatcacttttcttgacgagaagcaaagagggtctgcccccatttcgcaaatttatcagtggccaggtaggattcagatctgggtctctctcaggcttcttcacaacagaacaggcacaaataagaggtttttttttgttgttgttgttgttgttctgttttttccttagaagccaaaacccaggttctctgacatttatctgttgctcagtgtttattgtctgcaaacaacagcacaggtgaaggcaatgatgccattggtcacttgtatcttaactcactgtctttaaacctaatgcttttgtctataatttgctgtctagtagtgcccaatacccacaaagcaattctagtacaccctctccttcagtgtgtgggtcaggtgggcccaaagatccatcttctcaaacgctgaggctgagttctggagcaaagttggcacttcagctcgtaaaggctgccgtgggagtagtagactcaggacctaaaacatctccttgttgtcttctataaatatcctgttgcatgactcctaatataatccccgagttatgcacagtaaggtatattatctttctcttactatatttactatgctgacaaaagtgttcaaatattaaaactcacccagggtgaacagttcgggacgtgtgctcagacttgataggtagacagggacggtgccgatgacatgcacccactcggccttggcagctcccagtctcccatgaccgtccctcagtggctgtccagagactccctgagtcccactctcagggcccactttgtcgtcttcatggctgagtcagtgtgggaaatagttatctgcctgcctctccacgctgtgagttctgtgaggggaggaactttgctcaccatgttgttagaatccccagtctagaggagacacctagccagcatctgctgagccggggggtgtcctctggagggagaggggctgtttgtggtgctctcaagcttgaacagcagcagggcagaaggcagacggcccctccgggcctgcctttgccgtctctccttcgccctcactctctcccagctctgctgcttcccacgcccagcccggccccaggtgttcttctcccaccaacccaggatatgtggaagaagaagcgaaccatgcagtggcgacccagttccatttatcccctctgcggtgaaacttagtcactggagaatctccctgtaaagcactttctatggtttctgagccagaaacatggtcatttaataatttaaattgggtattcctaaattgggtcttcttaatgtaaattaaagctatgagatgtgccgaaatctaaaagttaaataacatattttgtttttgaatccatggggaagcaagcattttcctaacactgttggtgagaatgcaaaatggtacaacccctgtgggaataatttggcaatagctagcaaaattacatgtgcatttactctttgtcagggcaattctacttctaggaatttaccccagagatacactggtaaaaacaggaaaagatgcttgtaaagataattcacggcaacactatgagaaatcgcagaagaattttaaacagcacaaaattcccatccatagggcgctggctgagtcctatacagtggagtactgtgccactgttgaaagaatgaggaagccctggatattgctaaggagtgatggccgggatatgtaattaaatggaaaggcaaaggtggagaaaagtgtccatgctactgttgacaaaagggacaatgtgatatacatgtttgcatgtatcttaaaaatggaaggagaaaccttactttctctctctcttttttggtaaagcagcctatgggaaccaagataggggagagatataaaagctagatttctaaatctaccttgtttgtagatttgactttggaactccatcgctatattataatcattataaaacaaaattaagtaaaaggttatgacccttgaaaattttgatatacactatcaattttttctctaaaaagtttataccctgtttacctcctgtcagtacttgaggagaactctttttcccccacatgtttgtcagtactggatagtcatcttttaaaactttgccaatcccatgggcaaaaaatagattgctattttcatttgcattctctgatgactagagtgattaagcagctttttacttgcttattatccattttgtatttcttctgtgaggaagtccaagctagagcaatcaaacaacaacaaaaaaagaaataaagggtatccaaattggaaaggaagaagtcagattatccttgtttgcagatgatgtgatcttatatttggaaaagcctaaagaccccaccaaaaaaactattaaaactgataaattcagtagagttgcaggatccaaaatcaacatgcaaaactcagtagcatttctgtatgtaccaacagtgcacaatctgcaaaagaaatcaagaaagtaatcccatttacagtagttgcaaataaaataaaatacctaagaattaactgaagaagtgagagatttctacaatgaatactacaaaacattgatgcaagaaatggaagagaacacacaaaaaatggaaagatactccacgttcatggactggaagaatcaacattgtgaaaatgttcgtattacccaaagcagtctacagattcaatgcaattcctattaaaataccaatgacattcttcacagaaatggaaaaaataattctaaaatttatatggatccagaatagccaaaagacccagaatagccaaaattctcctgatgaaaaattggaggaatcacattttctgacttcacattatactacagagctatactaacccaaacggcgtggtactggcataaaaacagacacagaacaatggaacagaatagagagcccagaaataaattcatacatccacagtgaacacatttttgacaaacgtaccaagaacatatactgaggaaaggacagtctcttcaataaatggtgctgggaaaactggttatccatatgcagaagaatgaaactagactcccatttattgccatatgcaaatatcaaatcaaaatggattaaagactttaagacctcaaactatgaaactgtgaaaacactggggaaactttctaggacgttggactgggcaaaggtttcttgagtaattcccacaagcacaggcaaccaaagcaaaaagtggacaaatggttaaagctcctgcattagcaatgcaggaaaaaagcagtgaaaaaaagctcctgtttttaacaagttaaaaagttcctgcacagcaaaggaaacagtcaacaaagtgaggagacagcctacagaatgggagaaaatatttgcaaactgccaggcgtggtggctcatgcctgtaatcccagcactttgggaggccaaggtgggcggatcacgaggtcaggagatcgtgaccatcctggctaacacggtgaaacctcgtctctattaaaaatacaaaaaattagccaggcgtggttgctcacgcctgtaatcccagcactttgggaggccaaggtgggcggatcatgaggtcaggagattgtgaccctcctggctaacatggtgaaacctcgtctctactaaaaatacaaaaaattagccgggcgtggttgctcacgcctgtaatcccagcactttggaaggccaaggtgggcagatcatgaggtcaggagatcgtgaccatcctggctaacacagtgaaacctcgtctctactaaaaatacaaaaaattagctgggtgtggtggcgggcgcctgtagtcccagctactcgggaggctgaggcaggagaatggcatgaacccaagaggcggagtttgcagtgagcggagattgcgccactgcacaccagcctgggggacagagtgaggctccgtctcaaaaaaacaaaacaaaacaaaacaaaaattgaaaactattcctctgacaagggattataaccagaataaatcgagagctcaaataattcaaaaggggaaaaatctaatcatccagttaaaaaataggaaaagtagacatttctcaaaagaagacatacatatggcaagtaggtatatgaaaaagtgctcaatatcattgatcatcagagaaatgcaaataaaaattacaatgagataatgtcttaccccagttacaatgacttttatccaaaagacaggcaataacaaatgctggcgaggatgtggagaaaagggaaccgtacactgctggtaggattgtaaattagcacagccaccatggagaacagtttggaggttcctcaaaaaagtcaaaatacaattaccgtgtgatccagcaatcccactgctaggtatataccaaagagaaaggaaatcagtgtatcgaagagatgtctgcactcatgtgattatagcagcactattcacaatagccaagatttggaagcaacctaagtgttcatcaacagacacatggataaagaaaatgtacatatacacatggagtactatttagccatgaaaaagaatgagatcctgtcatttgccacaacatggatggaacaggaggacccttaatgttaagtgaagtaagccaagcacagaaagacaaacttcacatgttcttatttgtgggagctaataaaaaaaaaaagaaaacagttgaactaatggagataggcagtagattgatggttaccagaggctgggaagggtagtggggctggggggatggttaataggtacaaaaatgtagttagaataaacgagatctagtatttgatagcacaacggggtgacaacagttaataatttgctgtacatttaaaaataactcagagtatacttggattgtttataacacagagaaaggataaatccttgaggcaatggataccccatttactctgtgattattctgtgcctgtattagagtgtctcatatgccccataaatacatatacctaccatgtacccacaaaaaaaattaaaaagaacgttgatgtatttcttttgtgaaatgcaagttcatagccttttttatatcaggaagattttttttctactgattgataagaaccctttatatattatggatatcattttcatttgttgattattaccaggtcacagctttatttccagtcaagttgttcaggtcctgcatagtctgatattgaggttttctacaagaacatttatatgtgatacatgctcatggtattccagacttacagctgagcagacttccctcaactgttcaaatgctggccatcactgtgggctccctgaagcagtagcaactgtgtcttccactgttcggaaaacaacagttgttacttctttttttatttccttagggtttactactgtgtctaagtagcaagcaattataaatgtccacttaaattgattgctgatgaatatataaaaactaaatttcactgtctttttggtttgagatcattcttatttttaatttttagtgatccttgataaccatttttgttttcggttcagtgtgaatacctgaatgaaatagtaatttttatgtctgtgtgaggtcggttttaagaaagcgttcatagctatcagcacttgccttttgttcatggatctgttgaacctgtttctttctctaggtcataactccatgcaggaagctcatcttgtgtgctgataacagaaaagaaatggaagattggattgcagcattaaagactgtgcagaacagggagcactttgaggttaaaaaagaaaatacccttctccaaatgcctcctgttgcctccctcaccccagtgtctgctgtctgagtgtctcccacgtgcggacccacagtctggagctcacgttcttagcatgttctttatacaattaaagcttattgcttgtcctctcagcagacctgtcctttataaaccttcctcctctcctctcttggatactttgtttaatcttgtccaagttactgcatttaacaatttaaaagagaagtcttatctttgccctcttggtttcgttcttccagcccacccagtacagcatggaccacttctcagggatgcacaattggtacgcctgttcccacgcgaggccgacctactgcaatgtgtgccgtgaggctctgtctggggtcacgtcgcacgggctgtcctgcgagggtacggatgtgcgtttgttattctgtcaggaaaggtggcctggcattttacttgataaagccttggaaatccaaacccagtcaccataaataagccgttgtcacccatgtggtcagtcaagggcacagcgatttctgtgatgccattcttgtttattttacctgccgaagagtccttgataaatcattttttatagtgctcagagtgaaaagggaagtggtgggtggcaaaaggagaaatgggaaatctagagcacacagagggaaaggcactgaaggaacagtggtcggcccctgtgtctcacactctgcagccggggaaacggggctgtgcatatatggactgaaagtgtgttacagacttagaggtcagggctgcagggtttgggcaagggcattcagtctggtggcaaagcagtgggctagagcagggcttgttagctatagcctggaccacaccctgcctctgcctgtttttgtacagctcccacgcttcagactggcttttaaatttttaaatgattggaaaaaatcaaaagaagaatcatattttgtgacacatgaaaattacatgaaattcaaatttgtgcccgtaaaaaaacattgtctctggctgcttttgtgctacatgacagagttgattagtggtgacggaagctggttgcgacctgcagagtctccactgctcactctctggcctgttacagaaagcttactgatccccagctttccctgccgctgccggtcccaccgccatcagcctctaagcgtatcacagtagttcacttataaaatgggagtgccattggttccttccttgacttttctggagctggacggttctcacaacactgctcagcatgggaagctcttggcacagacacagcttgtaggctcatgtgccccttctctcacagtgtgcaaatttaaggcccacaagcgctgtgctgtgcgtgcaaccaataactgcaagtggaccacactggcctcgatcgggaaggacatcattgaagatgcagatggggtatgttaagaaataccacctgtggggccctgagccagggtcccccacctgcacggccccatgcaagcctcctccctgccctccctgccactgtttcatttgagatggtcacactggcattgggtggcacagtggaaattatatgcggtctccgtgtggttgtcgcacccccgagctccatcctgtccctgtgagtcttgtttgcacctccgacaggtgctatgggtagatggtacttcacaggccctgccatcccttccctcactggccatcagggaaggagcttgttctgggaagaatgccttggctgagttcacaacgagcatttcctggctgccctggacgtggaaccttgggagcgtccctagtgcgtgcctctgtttggttgcagattgcaatgccccaccagtggttggaaggaaacctacctgtgagcgccaagtgcactgtgtgcgacaagacctgtggcagtgtgctgcgcctgcaggactggcgctgcctctggtgcaaggccatggtgagtgtgggccctgcgcccgggctggaggggagggcttgctccctaccgtgcccatgcgggccttgcggctccgcatgatctgctggatcctggtaaattaatcccagaggcccctccggctgagagtgggtttttgaactgttgggtcattctccttcttagctatgttttggggtatttcttccttttgcatttattcctgtctttagacatatgcagatgtgtattgttatgacagatgtcaccctgcatcatgcggcactgtagccgggttgtgaggggtcacctgggacaattgagctggccgcctctgtggtgtggaagcaggaaagctgtagaggccatttggagcggcgttggctctgggcagtgttgacagtgagcacagccatgtggaaggggtgcagcccagtggcctcctgccaggtcctgggtctcatcgttgctctgggtggtgagatgtgcttccagggagagactcagggagcctccatgtacttgcttctgggttggtcattgtgaagtggctgctgcagtcacttgcctagcacatctggctgccaggaggaagccaagacacaggggacacatagaggcacatggccccaggagccctcaccctcgtcctgaaagtttgaggtagctgtggtcgaagggccagaaggttgggtacaggactgtagctcacacggtgtgaagcatgactggctcctgccgggtatttccgtgttatgccttctcaagtgcaaagccagggcccagggcccccgatgatagcaggccggcccagggcccctgatggtagcaggccagcccagctctgaaatcacctgcctcccccgaggccagctcatcagctacagggcaggaggatttctggtgtgtgtgaaggatgccagtgacccttggtgacgcggggactcttgtttcaggttcacacatcgtgtaaagaatccttgctgaccaagtgcccacttggcctgtgcaaagtgtcagtcatcccacccacggctctcaacagcatcgactccgatggtgggtaccacacatgcttatccttctcatgcacgcccacacgcttccttctccacgcactttctcttctccagctctggagttggttatcttggtgagatgtcagcaagaggtcaggcacagctgttgggggtgctggaggagttgcacagagcggcacacggcgccctgatgctgcggcattgcccttagatgggccagagacccaagcctggcacttgacgtggaggtgatgctgttgagtggcacccaggcttagacaggcctgagacccgagcctggcacttgacgtggaggtgatgctgttgagtgcaacccaggtctggggccttctccgtcatgagccattgaagctgtgccccatctctgcctagcacatgctggcacactggcttgcagctgctctcatgtctggctgggacatggtggcacctgttgacaagtactggtggaaagggggatgtggggtacatggctcagaggagatcaagaagagaagacagcagaaaggtggcatttggacagcttgtgaatgtggaggtcagatggatggggctcccggcctcacacatggagaccggctgtggggaactgttcactgacctcctcctgacttacaggtgtgcatgtgtcaggtgtgtgtcctttgggggggtctgctgctgctgattccatcagtggtgccctcagcgtcttccgtggcctatatattttcttctgttcgttcttgcgtccagggttctggaaggccagctgtcctccttcttgcacaagcccactgttggtcttcgtcaattcaaaaagtggggacaaccagggtgtgaagttcctcagaagattcaaacagctactaaaccccgcccaggtcttcgacctcatgaacggaggcccacacctcgggtaggaagcttgtaaaatatatctttcttggagttttaaaaattgtgtagatagtgtgtgcttgttaaaaaaaaaaagttcaaagacacaaagctttaaataggaaagaaaagttgaactgcttccttcccaaattgcacttgcagaggtgcccactcttaatagaggtgcatggccttccaactttgaacacagtgcgcgtgtgcacacacgtacatacatccatgtacacacacccatgcacgtgcatcttttgagccaatcaggattcttctttacctgccgttgcacaaatgccttctgtatgtgtctgcatacaacgttgtgggtgtattttctttcattttataattttttatttatctgtctatctatcatctatctatctatctatctatctatctatctatctatctatctatctatctatctatctgtgggtgtattttcctggcgtgcctcgttctttgtaacagctgcctaacattgaggaagaagctgtcctgcagcgaggccaggaggagtgtttgctgagaggcacaggaggccgctcggtgtgcaggtgctgcaaggcaggaacacgtaagggcggcgttgggccagagcgatttccactgtgcatcagcagcacagagattagactgttcctctgcttgctggagagccatgtgtgttctttgtagttttttacttttcataagtttgtagaaaacatttgcctttgtgaattttgccatttgaatgaatttcttcctctggaagcatcagttccaggtcggagctctaagaggacttgctggcactgccggagatgtccaggatacccgtagtgggaagtgcctgcagagcctgtggtctggcctgtatttctctgggaggagtcagtggggtctgtgtattaggagccaggggctactctgatgtgaacctcggccagctccctgcgtgtccttggcgtacatgccagggtaagaggaacatgctgctcgtcgttggtcctgtgggtgtcttctgtgttgctcatccccactcacagccaggcgcagtcggagagcagtcacagatggcagcattccagcctgcttccgcaaaggcagtactcccacattttctgtagaaagacttcttatctgaatggtggaggattgcattcactagtaggctgatcaagatattttaattttaattttactgttttttgagacaagagtcttgctaggttacccaggctgagtacactggtgcaatcctggctcacagcagcctcaacctcctgggctcaaaccaccctcctgccttagcctcctgagtagctgggactacaggtgtgtaccactatgcccagctaattttttttttttatgttttgttgagcctcacaaaacttttaaaatgttttgtagagtggtctcactgtgttgtccaggttggtttcaaactcctggagccaaatgatcctcttgcctcagcctctcaagagtgttggattacactgcctggcaaagaaataattttagttaaaaagtggggaaagtggagatataatacgtctgttatcacaatgcaccaagcaggctgaggttgttattaaacatggtaccaggggtgttggaggaatgctgtgaaatggctgtgggcagggcaggttacacagctgaactcgagaataacgaaatattcattttggtgtgcaagcaaaaccccatgtttcgtagtgggagttaagtatgagatgggatgatttaggaagcccccacagcggcgtaaggggagttgagtcgtcatttaccatttctggaagcagctcatctcacacagctcacagcagaatctggagctactgcttcatgttccagttcctggccttgacctgtcacctcttctcccgagagcagggggccttacaggtgtcagtgttctgtgtggagcctgggcttggtgccgcatcacctatgcctgtctgtcttctgagcactcattctgggtcagacactgagctcgaggcagggtgcgcaggtgagccaggcggggagtgcagatgcagggaatgggtaggagcacacgcagggtcccccggcacttcagtgggggtgacacagcttctctgggaacccggtgggggcagggtcgcaagtcaaactgggcgtccttccacgtctccccgagctggcatccgaggagctctagtgttctgaaggctgcagggaggcgggaggcttctgggctgagggcaccgcttgtgcagaggcgaggcaagagggaatgcagtggggccaggccaggcagcagcagaaaggtggcacctgccgtcagggagggctgcgggtgctggccaagaggttcgactccttcctgcaaatgaggggcagcctcataaagcaaggcccgtggccaggctcgtgttttagaaaggtcttcctggaactcatggggagctttcaggaagggtgtcaaggtgactgaggctcctgtgggactctgcgagagcacggtggtgacctgagcgggtggctgggttgggtgtggaggagaggctgccaggaggggctgggtcggctgcaggctgagaggaggtgggtctggcctctggactgggttggtggtcgagctaccattctccgagtagggatgtgtcctgttggatgtgccctgggataccagagtggtgtgttctggaggacaggtgcaagtgttggctttcaggagtggcctgggggctgttgatccagagtcacctgtgtggtccttgaaactggatgtggtcacacaggaagaggatgaggagtgagcagaagcggcactggtctcctgagtggggacgctgctgggcaggggcagggggagcccaggaaggaaggaaaccgaggagttaggagggtaggaggcgtgggtcacatcaccggaggactgagtgggcccaggcatatgtgctgcagtggggacacgcagcccgcagcaggtcaggcagcctggggctccagggtgaccagaacaagggccagggcggaagccagactgtggcccagggccggggagtgccaagactgagggtgcagggtgatgcaggcagcccagagggcatgctgggaaggctggcaggggccacatgtggatggggcagggacagtgacgcagggtgggctcacatggttaggggccacggcaggctgtgcccgtgagcctggcaggggatgcagttttggcccaccactttgcctgtgatgtctgcagagcgtgcagtggctcaccaagctgagtggtcttgtcgctgggtggggcgtggctggtgggagcagttggctggaccccagtgctgctgtcgtccctttgacaaagtggaccctgagtggaggcggctggtgtcacgtggcagggcctgtgcgtgctctgcctctggtgcaggtcagccatgaggagcacaggtggcccctcagccccgtactgacaagcctgtcatttgtcctgtggaatggatgtcatttcacggcctttctcttttctctgcagcttacggttattccagaagtttgacacattccggattctggtttgtggcggggatggaagtgttggctgggtcctctccgaaatcgacagcctcaaccttcataaacaggtaccaggacaggagggagcccagccaggagcagagagggtgcggaggttagagggaaatcatgcagtctcagctcctgttcatctcggagcacctgttctcaggccagaaaccattggtggttttggggagtgtgcagtttggtggccagggcagagaggggagagcctgggccaccccctggcattgtggaggcccgggggctctggccatgatgtatgagggggacctgaagggagctacgaaaagaattgcccacaaaggacccacatggggagcagggctgggtggggctgttgctttactgggtaatttttgtcttgaggcctcttgcttgtgagaaggggacggcagtatacttgagtttctcaagtcagagtcatggttcattggacttagttttttgtattaaaataaaaatagattttcctgattgtgtataaaaatgttcatatagtcatttaatttccacaccaagccacggcctccccaggtgatcagccagtgccaacattttgctgtctctgacctctcttgatcacagtacatacaatgcacagtgcacttgtaatttaaacgggctattctgttactgcttttgttgttgttgtttttgtttttgtttttttgaggtggagtcttgctctgttgctgggctggagtgcagtggtgcgatctcggctcactacaacctctgcctccccggttcaagtgattctcctgcctcagcctcctaaatagctgggattacaggcgcacgctaccacgcccagctaatttttgtatttttagtagagacagggtttctccatgttggccaggatggtctcgatctcttgacctcatgatccgcccaccttggcctcccaaagtgctgggattacaggcatgagccaccgcgcccggcctgttactgcttttaaaaaaccactaattaagatgttgcagacaccttgtgcctgtgtctgtaagtaggcatctgtgtgtcgttttccactggacacacccgggagcccagggccagctcacctccatgtgtgagcacggagatcacttcccagtggtctcctctctgagcgcacccaagcttaagtattgaaatgtgctgacaaactgcctttcctcagggctgtgccagcttccatgcctgatgcctttaaagctgtctttccccgtgcaccatccaagctgttcatctctttagtttttgtccagctaagtagaccaaaaaatgtctgacctttacttctttaattcctggtgaagttgaacgcctcctcagttggttatgaagttttaaataaatcacctgttcatatttttttttgcctcattttctctttgagtattcacctttttttcctttaaaaatgggtgtgtgaggattattgttacattaacttcttatctgtcactgcagatatttttttcccggtttgtcgtttgtcagttcaacatcctttttggggggtggtcttttctttcatgatttttgtcaacgtctgtcatatttgcagctgcctacaccccaagattaagatttgcatctgtattttcttatgtttattatggccccatttttaaaaaattcagtcttctgtgtgacgtggatgtatttttcagtgattctgtggtgcctacccagctctgctcacttggtagtatttccaggtgggtggatttgacagctcgggccgtgaggccagtggctcaggaggagaagtggtgccgcctgctggtggattagcatagactactctaatttttgattttgtgtattacttgcaagttcactgtcactagttaggaagacagtggaaccttgtggctgattttcatacgttcagccaaggtcagcacacatttctctcccctgcgtctctttgacacctgatgtggtggccatgccttcgctgggcccctgccgcctcggggtttcttgtcttcctggctgctactgctccatggtggcctctccctccttacccttcccttaacgctgtgtcctcagagccttgctggggcctctcctccttcgcttttgaacgctcagcgacttgcagggcttctgctgtcgtctctctcctgggggcgcctcaattgatagctgagccttgggcctctctggatgtctcctagtgcctcgagtttccaacactacaccacgttcagcccccaccctgcgttcctttccttcgagtctgaaaacatcatccatctagatgtctgagccaggaaatcggacagttgttcttggttcgtccgtctcttcctcctgcctgtttctcactaattgtgtcctcagtcctgccacccacagtaccctggcctctgtccatctgcagctcacccaggcgacctttcccggggcatttctgcctgtgcaccccccaagcacgatgcttctgggaaaagtccagacctttaagagtcccagctttgcctcctgcttgcttctctgcctgtctgcctcctgtttcctcgctgtcctcctcttcactgagctctgccttgccccctcccagtggtgtctccctgcctggagcaccatccatgcctgctgtgcgctgctctccttttcctttaaggctccaggaagccctcgcggagtcctcagaccctctgggcacccttcagcactgggttctctccatctagtgtgtcggctccggtgtcctggcctgctcgctcctgcctcccctactgccaaatgtccccttggtgaggcaggaccttccctggtgtttgctgtccccacaggcggcagggcctcaagcatggtcacctccacctggtgggcagagggctgtacggtgctgtaggctggaccacggcaggtttcctgcctcaaggacagtaacgcctccccacacactccaccgcagccttcatggccctggtcactctgttgtcagagtcaaaggctggtgagctctgggcagtgggcattttaagaggcctcctaagcaatggaatggtgtagtgggatctcattggagctctgaaatgggaatccaggtggagggtgaggcctgagtaatgcatgaggtctcttcctggaacagcaggcaggcgggcagaggctgagctctggcaaggctccagggtagcctccagactgaggatggtcctggcaccttttttggataggatttagaggagagaagtgatactagtgatgtttttggaagaagaatttggcattagtgagtgagatgctgtagtggatggagggacgggtggcgaggcatcagagtgattccttggggctgtggtcacggtggtgaaaatgggaagcagagggatttgggagacagatcagagagggtgtgaggggctgaccatcaagatgtgatgacagctgagagatggacctgtggctcatccatttctcccagaagcagcatcttatctcaagggcagtcatgtttctgtctcattgccaaggaaaatgccatctgtcccctccagtgggctctgcctgtaatgtgtaagctgcgtggttttaggtcacgtccccacattgctaacgtaaccctcacggtgggggacaaggagggctgcgggctgggaagtggcccctgcccccaggtgtttgcctgcgcatcgtcccccatgtttccttagtgtcagctgggagtgctgccgctcggcacagggaacgacttggcccgagtactgggctggggctcagcctgcgatgacgacacccagctcccccagatcttggagaagttggagagagccagcaccaagatgctggacaggtgagtggggatgtgctccggtgccgtatgaggagactttgagagacaggtccctttgaccaggtgttcttaacctggggtctgtggaaaacatgggccctctgaaattatttgtaaagatttgacctgagtatatattcggatagtctttgatatttggtcagattatgacaaggataaaaacaaaacaggttaagaaccagccatgccctaggatgatccagtcttcccagaaggccaagcctgagtgtgtcagggccgtggagaaggcagctgtgccatctttggctgcttcagcccgagatctaatacccatcggaagaatgctccttgtcgtttacttgaacagtttcattttctcatattctgttcccagaagaagttttgggaaattatcctctagtgcctaaagccactgtgacaccttccctgagtaaggtactgttgtcccgagtgacacacttggcactcactgaccacatgcctgtggcacatggggtgctgatgagatgcctcctagccttcctagttgctcccagaagcctggagttctgagcacagttgtggttttgcaatgcccccaccatttcaggcctcctctgtgtgccttggggcctgtgaaatgctcatctcactgggccagctggctgagccatttgcagctctcttgaggagggtaaatccatttctcccagaagcagcatcttatctcaaggtagccatttatgggagaccttcctctctttatggagctgtactgccgttagttgtggagtgcagacatttgttctcagccaagttatgggacagagtcaagaccaagggcctaaaaatgaagtcagaaacggtgtaaagatcaaggctgccagccgtgaaagcggacggcgcagggttcacccttgtgggcctgcacgtcttgccgcctgtgcagctgaccttgtgtgtgcaggtggagcgtcatggcatacgaggccaagctcccccggcaggcctcctcctctaccgtcaccgaagacttcagcgaggattccgaggtattgctggcctgttcttcacaccctgctcgcatgctgatgtgatcagaactgtcctgtcagcggtttgcatcacctcccttgcagagacgcctcccctttggtgttggggtgtcacagtcaggcctgcggaggcgcagggtgaacccatggctgagaggattctcactccccttggcaggggccttttgggctttgtgaccctctaggggcttcctggggttgtcataggccctgccgggtggtggggtggtcctcctaatggcctttccaccctgtccgtgcatctcctcagctgcgcagtgagccccaaacggtgcgcgcccgttccctcccccgccgcggtgcccacgtgcctggaatgctctagccggctctgccgcggctctcccctagccccccggctcctgccccgtcccacctctctgtggcgtctgcagctgcccttcgctcaggctcctctagtccagctggtggttcttttcatttggtgattgttactgttgtgtttaacgctcctacagtttccctcagagaacagactttgtctttagtttctattttgtgctggtgcagtgctgggtggggtagtacaaagaggtgagcttttgtcaggggctagggcaacggtcagcaaacaaggcctgcaggccagatgtgcctgggcccacggccttgcaagcgaagactggtttgtacattttttatttttcctttttttaaaaaaaaattttttttttgagaggaagagtgtgtgggggaagcccagaatattcgctgtctggccagtagtgaagtttgcgaccctggggctgggtcctaaggacagcagggatcccacagggatagggctgcccttctgacagccagaacagatggtgggggcaggagtgtgtgtccagatggggctcacagccaggtggaaacagcctctgctgcaaacggacccaaacctggagccgacccgccagcatgccgctgtcaggatgagtaggggtcaggacggaagctcctagcacaggccgtgctgggatcgcagactgaaggagattcatttgcagtttgcctgcagcttgacgaagcttttaaaatctctcacctagcactaggtgagtcccagattagcgttagaagtgagttgaggcttggctgggtcagacagtgtctgttaggagagactcatctttcccagcttgtgctggcaaggaagtggctgacagagtcactgggactgtcatggagcttgctgtcacagagaccaacagtcctggccatttggggtgattgcaggtacagcagattctcttctatgaagactcggttgcagcccacctttctaaaatcctcacctcggaccagcactcggtggtcatctcctcggccaagtgagtgcctggtggccctggggagggcatggtgccctggcccccagcctggagctgcctctctagaagggtctttctgtttttctccccacagagtgctctgtgagacggtgaaggacttcgtggcacgggtggggaaggcctatgagaagacgaccgagagctcggaggagtcagaggtcatggccaagaaggtctgttcccgtgccctgggtgggaggggcattgaggcagcgagaagcttgctctgtcaccagcagagggccgtgactgcaggttgtccaggttcttggtgatttgaacaaagaattagacaaaacgcacagtaaaggaagacaagaatgaagcaacaaagaacgaaggcagggatttattgaaaatgaaagtacactccacactgtgggagctgcccgagcagcggctcaagggtccagacacagaatcttcttgggtccaaataccccctagaagtatcccattggccacttcatgctcacctcatgtaaatgaagtggtagcttgcattcagtctgattggtggcagaaagcagccaaccagaggctgaagtggttacaaaggtcacactcctgtgcaaacatctgattggttgcaaaaagcaaccaatcagaggctaaggtgaagttacaaagttgcatttctatgcagactaagactcagctcgcaatcagtatggttggttgtggacagccaatttccccaatttcccacctgccagggcgggaaaggtggggatttgcaaagggagtagcctctggtctttttgttacttaggcgtggagagttaggattttccttttgatcgagttctaggaagtctgggtgaaatggcctgaggttccctgcctgcagaccctgttctcctgcctcagctctgcatgccatttcctttccttgttcagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaaggtaactggccttgtgatgaggaggggctttcctcaggccagcactgggcatgcccagcgtcccctgaacacggagatgacagaagggtgcatgttgagaaaacctccactgcggccctctccacccatgtccaggcaccagacccccaacgagttcgcttgccctccttccacccctcctctcacaccctcagaccccttcatgctgcctcccctcgacctctttcctggccctcattgacttcactataagcgtctcactcccgtgagagccttgaggtcacggcctcacacccgcacacctgcgtgtccatgcagccgctcctcccgcttgcagccctccagcctgcgccaggctcctctgcatcccttgccttcccctgcaagggttccagacctcccagcctgttagcagggacgccctgccccagtgccaggaccagggggaagatgggtgggggtggggtttcggagtccaagcctttagccagaggttgtttgaggaagatcaggccgtggggtgaggatgaggggccctccacccagcctgacagcgcccttggctttgcacccgcgtgctcagccgcacacactctccttgcacagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaaggtacttgtgcctccacctccctctgcgcaccgtcgtgtgcttggttttggtgagacgtagcgggcttgccaggggaggttttagggcactttctcatagttgctttggccacttggttacataaaaattgagcgcccaaggcctgtttctgtgcatctcctgtgcgcgcccttgaggtgggtgtgtgcggtctgtcttggtggacagcagtagaacccgcgagaccccctccatcagggcgaggactgcctccctgaggagcacttgcgtcctgccctcactgcttccttggaaccacactgggccccagaactgctcagaaggggctgtgtctggcagagggaaggcgggtgggtgagcgtgggccttctttgtccttgcccctcctggaacagcccacagcgcaggccctggtggagggcacccccagcctgtgcaggctgctgggaggcccatgctcagaactgacccatggccactgcatggccaccactgagagctctgctgtgtgtgtgctccgcctcccacagcccggactgactgggctcacccctccctccagcgctgccacctgtggcctgtgttaacctctccatgagcccagccccccaaacatgtgcacccactcggtcctccgcccccttctttgtcccacacacttcacgcaactgcctgtggtttgcagccctccctcctcagccctcccacctgctcgtgtcgctaaggaccccccaggatttcacagtctctattccacacagctgtaaggttttctgctgtgttgttacagtgtcgaaatctccgtgtgaaaagctgatcagcaaagggagtctgtccctaggcagttctgcttcccttccgccccagccgggaagccgggacggcctgcctgcgctcaacaccaagatcctgtacccaagtgagtggcggccagcaggagggactggtgggggccctagcacaacactggtcccgtcaaactgaaagagatgggctcgctgccctcggagagtttacaggcccctgagaaagataggtggaattgaaaaatttacacgactgtatgaaaagtgctttttttttttttttaaaaacaaaaaacaaaaaacaaaagccagatagtacccaaataaccacccaaggagcccaggaggcgccattgaggaggtgatgctcgagtcggggttggaagaattaaggaattatctgagtggaaaagggaggtggccggcctgatgagggaacccgagggaccatcccgtgcttctagcgtggtcgcaggaggcgcagggagggtgaggtcctggccgcctggagcattccttgatattcattccttaggaaggcagccttataaagccttaagcctcaactctcagagatcattttggtggagtggcttacatttaatgagaacatgaaaactgactctataagcctttttttttttttttaaaagagggtctctctctattgcccaggctggagtgcagtgatgtggtcatggcacactgcagcttgacctcctggactcaagtgatcctccccactcagcctcccaaatatctgggaccacaggcacacaccttagaagccatttttttgtgtgttttgtaggtgttggtttctgccacccagtatggtttctttgttccagtgatttttgacctaagactattggcaaaatttggacatggttatacataattttagaaacatttaattataataacgttctgcagaataccggtccaccagcttcagagacacgagcttctcctaaggctgtagctcctgaccagcaccacctctttcttgtatctcctttacagatgtccgggctggaatgtctggttccttacccggtggctcagtcatcagtcgcctgttaattaatgctgatcccttcaactctgaaccagaaaccctgtgagtatgagggataaaccgagtgggcatattgttacatggctgctagtgcatagaaaacagatctcaggattaactagagaaattagtgagcagttgcccagctggtggtagctgataaggaaggctgagaagtcgtggagattccacttaaggagtggagctggaaaccactactgcacatctgctgcagaggcaaagcgcacgcctcccatctccttcccaaggtcccacggtgcttgcttgacgtcccctgagcctgcatgcccttctgaggcttttcacaggctcagctactcctgccaggagctgcccttgtgctgctcttcgtggtcactctcccatgatcttggctggacctcactgacttctgcttacagcctgccatcttcctcttgccatcccttccctctgctttcctctaacacctgctctccttgttggtgatgcagaaccacagactctgagctggagggtcctctgtgtgtctcccttgtgtctccgagcaccttagggagacactagcctgtgctgaggcttataagggctgctgcgtgcctgcgtgctgatactgctactccttgggggacaaggccttcttcctctgctggcctgtaaggcagtgaggacatgtatatagcagtttaatgcagtcttcctaggtattggagtccattttggagacaagtggtgttttgaaaacctgtttttctgcactcatctttatgctggctgattgcaggttctgggcagctggtggcagttggttaaatgtggccagccatttttctggagtggtgacggacagtgacaggaagaaatgtgcggttcacagaggctctgggtttgggaaagtggacccctagattccaggtgctggcctggtacagcacttcagtgtccctgttcctggcctggtctactcctcccctggggctgcgtggggctccagttctcagccctcctgaggcttttttccttggggaggccagagctgtagtcctatagtgagcactgtccctagaggcccctgaactggatatctcctttgtctccttcatctgagactggaacttccacttctgttgctcagctgggtggtctcatctcttcttttcacctggggagacaaagctgtgctttgctgccttcctgctgtggtgtgtgcctgggccgtattgtgtgggccccattgtagctgggcctgagcagcccctggtaccctgtcctctcccactgccccagccactgccgcccctcctgctccaggcccctgagcccagtctctgctgccttccctcatctctttgtcctgtttctctccgttggatctctctcttttcccaggacctatacatgctggccaggcacttggtcttccccctggtaaacagttttgtcccagagctttgctctggctcagctgtcgggcacttgaattagatggatcataaatacactgacacatgctggttgttctcagatctggcggcactggctcagtaagctaaagtgtgtcagaattctggcccgagcaatgttcccaagcccatccacccattgagtttctttgggaacttccagaacatcctcttctcctggctgcagcctctgggtggaggaacaggggttcctcccttcatccacttgccctcggggggaaaccccagtgtgaccctggggttggggagggtgaaggccaggctgggctttcccagcagctgggggagctgcaggagcaggacttccagctgggtggggagaagaaacttgaatgagtctcttctcgtctgtcgcacacggggaaaaggaagccttgtgctgtggggctgggatggatgttttcaagtcattttcctttttaatttggcaacagctttgcttgtaactagggatgtttgagaaatgttttgagatccagagttgaaatgtgtgagtttctgtgccataaacatatcttcaggtttggtgctgctggtggagtgtaagatgggcagctgctgtggggaatagtccagcagctctgccggaggttcagcccagagctgctgtgtgaccagcaggcgcagaactgccgggccatgtgggattgaactgaaaacatgtccacgctagaagctgtatgcaaatgttcctaaatgataaccaaaacgtggaacatcccagtgtccgtctgctgatgagcaggtcaatagatgcaggttagccacgcagtggagtattatttggtaataaaaatgaagcgctaacacatgttataacatggatgaactttgaaaacatcgtcctgaggaagagaaaggagccagacacagagcccacgaccgcatgatcccattcctgtgaactgcctagaagaggcgcctccgtggaggtggaaagtagacgagaggcgccagggatggtgaggatggagagttagttgctgatggcaggagtacaggctttctctttagggggatgaaatgctctaaaatcgattatctagtgatggttaaatgactctgaatatactaaaaataattgaattgtacattttaaattggtaaattatctagtgtatatcttaataaatctcttagcagacaaaaaagaaaaagttaccagttttccccaaggaagagaaatgctgagaggttgggagtctgaaataagactgctcagcagggctgttgtaattgatttaaaactcacctttgcagagagtattacacggagaaatgtgtcatgaacaactattttggcattggcctggatgcgaagatatccctggactttaacaacaagcgcgatgagcacccagagaagtgcaggtaggtaacaggctcaggagcacgtctgtcttttgcgtctttgtggcttctccttccagacagtagcagatttctggagtcagcaggttaaagaacgtgcagaatgctaaggcggggggcagaaatggagcccagatcgccttgtcagaagcacgggtgctttcagagatggaagggaagcacctctcgggctggccaggtcaagggaaattcaacatcggaaaaccagtgatggtggtcattggaatggcggcatctcttaatgagagccccaagtccgtgatactacagaaaagcggcaggtgtgccaagaagctattgcacctattgcgtaagtgcccagcattgtttgtgggagggtctgtgtgttcatcaccaccctagctggccctcccccatcacacccgagcctgcccacaaggcccttgagtccaacctctgcaggaagacgggagcgtgggagccccaaggggcatcactgggggtttcagtttttttcctctaaaattactggatactcagtcctggcctgaagagaggatggagaaaaatgagaagggtccctcttctcaagcttttcttcctgggctgatgtagaattctctcttgtctgtgaaacacaagaagtgagggagaaatgtctccctccccaccccacagtaataatcagagaggccattcagctttgacatgattagaactacagagagggagaaatgagtgtgggggttgacggtgtttgtgcagagaacagcccttgacccagaagctgggagacccttgctggagtcttcgtccgctgagtcaggatgggcttgaatgaaccaagccacgtggccccctgtggcctcgccctcctcatggcgtcactgccaccttgcggggagccatgctgacacctgagggtccagctttagtcattgctcaggttacatgtagttgaaaatttctaggaaaacaaaagcatcagaactgaaagaacttttgactctgaggctcttccatgcaggagaaaatggctcaggggccccagggacatatccctgtacagcacaggatggtaacgtcagatcatttaaaaatccctgttagtccaaaaatcactgggaaaagtattaaaatacacatactttagcagggtaaaataagtagttgaggaacaggggcatgcataatacatttctagagctttggaaccctggtcaaacctctcttgagtttgtattgagagctttgaaaagttctcctgagaaaaattccacttgtacaaatgtcattggaaatttctgcagaagtcattggaaatgttggttgacgtaggtacgaagggactcctagcgtgtcatttccagagctcaggcatggggcggaggagtgtaatcaaggggattggttcgataagctgtggtagagcagtgcccggctgaggatggccacatctgcagagagcgtgtggccacagaaggaagcattgccggcgcagggtaaagtggaccaagtaggtcgtgaaactgtaaacaagttactgcaactggaaattaatatgcaaagaagactgaggaaatacatagcagcacttggcatttgtcattagcacgtgtggagggtgcctacaggtgctggattatgcatggaggattatgaggagtgtcttctccttggtgcttttctatattttccagtttttctatggtaagcataattttttagccagaaaaaatcaggatgtgtagaagtttttttatagggttctataatgttttaactttatgtatttacctttcagggtatgattactttcttggcaaaatgttactattgagcaaaatttcctattggtaaacgtatctttttatgcatatctgcaaaaacaaaaatgtgtccttcagatgttactgctgtaaataattgctaaatgtagctgatttgtgggtcagatgctgttcccagctttcacagaaatgactctggttaactatacgaagaaagcccagacctatggcaagtctttgcttctgtttctaggagccgaaccaagaacatgatgtggtatggagttcttggaaccaaagagttgctgcacagaacctacaagaacctggagcaaaaggtcttgctggaggtgagtgggagggtccttgtcacctgcaggctggcctccatccatcagcagactgccaggcctattgcttctcctgttgaccatttcctccatgcacagggacttgcctggggatgccctggccacggctgtgctcctgagcccctggcggtgggaagctggtagagaaggaggggctgactcatacctttctcttttcttttgttctgtgtctctgctgctcagtgtgacgggcgacccatcccactccccagtcttcagggaattgctgtccttaacattcccagctatgccggaggaaccaacttctgggggggtaccaaggaagatgatgtatgtatggggtgtgagcgggtgggcctgagctcagtggggaagagctgtctgagagcaggggggtgttctgctgtggctggggtggatccagctcttctgttgtgccagcagtggggttgccgtggagaacaagatagacagggtcccccacccagctcatcgtctagagggctgagcagagcagttgtgtcagtgaaggtggtcagtgagggtctgtggtcagcagatgtggtcagcgggtgtgacgtggaaggagggtcagggaaggtgtctgggaggccaagacctgaaggatgagttggagttggctaagttaggtgggcagaggagagggggaggctgttccaggcagagagaattgcacagatgaaggctcagagtcaagacagggcaggcacatggaggatgggagagaggtgccccgactgcagtgggcagcaggggcgtggagagacaggagagggctgcagggcctgggtcacactgggctgtgtgagctggggaagaagtttggaatttgtgttaagaactgtgggaaggtgttgataggtttaaacctggtttaaaccttcctttgtacgtaatagcgaatagaagtattcagcgcttcctgcacacgtggtgtgtgctggccccagtcctggcactctgcagcgttaactcacttggccctactgatggccctggaggagcgtgccgttagtttccccattttacgcatgaggaaatgggggagagagagattcagtaactttgccgagatgagagctgggatttggtcccaggcagctggtttcagggcctgcaacatgaagcccgtcaggagtgcagttacctggtaacttctcgccagctaggaggggctgacccccagagggagggagtgagggtaggggcggcctgtgctcggggatgtgtggagtggtggtcagctctaacgtgtcccttgcagactttcgcagctccatcattcgatgacaagattctggaggtggtcgccgtgttcggcagcatgcagatggccgtctctcgagtcatcaggctacagcatcatcggatcgcccaggtagtggccatggtcctggggtgtctggccgagtccccagcccggagtgtgctaaattctggggcagtgcatggagcctgggagggtgggcgctttccagggccatgtggctgcctcatgtcctgtcctggacagctcgtggccccacttcctgggccagagccctttccttgtgctatgcttgacagttaaattctcaagataactctttttaatttttttttttttttttgagacagagtcttgctctgttgcccaggctggagtgcagtggtgcaatctcggcttgctgcaacctccacctccctggttcaagtgattctcccgcctcagccttccgagtagctgggactacaagtgcccaccaccattcccagctaatttttgtacttcaccatgttggccaggctggtctcgaactcctgacctcaaatgatccacccaccttggcctcccaaagtgttgggattacaggtgtgagccactgcacccggccaagataactctttcaaaatgtgtatcctgcttgaaccacagccttgcctgtcccctctgaggtgggatgagatagagcagacccaggctggactctgcccgtgtctgcagctgtcaaagccgcagtggggacggagcccatggctctgatgtggggtgtgggaggatttccagctggggccctcgatcatggttctgaggccgagtggtgaagggctgggggtgcccccatggcttatttctgacagcagcgatgggctgagggcagtctttctgtgaggatggggcaggactctgtacccaggcacaggcactggggcgggggagggtgctgatgacacccactggctgaaccccaccctgcgactgtctggtgtcttccagcactctgtctacccttagctgtaggctgcttgaagttcacaattttcactctttggcaatgtttgttgttgaaaaggaggaacgggatgatgatggatggctcatcgtcatccactgtgccatctgctcttttctaggggtgttttcacgtggcaggggcccagtggcttctgggagctacaacacccctgcccctgggttctgacacctgttgtctcagcaccaaggtctcctgcactgactgctcagtgaggggatggggcgggatggggcgggacagtgggagaacagaccctcggttgagtgacacaacagcagaaggctagctgcaggcggagcgccatcccagaggcagaggtggggtgtcctgcaaggcagggacgggtgtgtggagcaggaaggtcatggtggtgctgatagcacttttaaacccctgggggttttggctcagcatgagtaatggctatgatgtctgctcagtgtcgcacggtgaagatctccatccttggggatgagggcgtgcctgtgcaggtggacggagaggcctgggtccagccgccagggtacattcggattgtccacaagaaccgggcacagacactgaccagagacagggtaagagcggctgcccgcggtacctgggtggggtacagggctcacctgtgggctcttgtgtgcactgttaagagctggagctttttgtgttttgttctaggattttttttttttttaagacacaatgattaagctaatagggcagtaatttctaggaccatctccttcccctaatgttaaaaaaaaaaaaaagtcctatttgtctctttctagttgtgatctcgttggcatccccatagtgtctgtcgcagtcagatgcatgcttcagagcagcaggtgtaattgggctttcgggtccataggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacaggtgggctcctacccctctgcgttgcgcatgagcctcccccagggtccctgggactgcactcttccaaggcccctggggcgtggagctgctgctcctgacttttgtggggtctgcattacccatgagggccgagcctgtttatgtgccctcagctctggctcatttccccagtggtctttcagaactcgcctggagtttacatggctggaacctaaagcccactgtgattttcaggaccactcgtttaaaacctgcccgggctcagccgggcgcggtggctcacgcctgtaatcccagcactttgggaggccaaggtgggcagatcacaaggtcaagagattgagaccattctggctaacatggtgaaaccccgtctctactaaaaatacaaaaaaatttagctgggtgtggtggcgggcgcctgtagtcccagctactctggaggctgaagcagcagaatcagtcgaaccccagaggcggaggttgcagtgagccgagatagcgccactgcactccaacctgggcgacagagcaagactctgcctcaaaaacaaacaaaacaaaacaaaaaaaccctgccctggctcccgagggcagcccgctgacagccgccttcactttgccctcgttttaccctgagaacaggcttgctctttgttctcaagtttactttaaaaaaaaaaaaaaaaaagacaactgctggggcatttcctctcacctgccttctagaaacacccctggagccactgtgtccctcgtggctggtggtcagcattgtctgccattcctgctcctcgcccgccaggtgcgggttccgcctgtgagtccctcccagccggcagctgtgctgctccgccggtgcggggcctgcctgcattctccccccgtggccgcacgctggctggtgccctggtgtccctttcttgtttcccctgggctccttcttctcctggctgtggacaggtgcacccgtcggttttgtgcccggcatgccgtgtgcccttccaggcagcctgcccagccctggcgtgcagatggatcgtctgtgccagccttcggctcttgtcgagcaggtggtcgctgtcccagtcatcaccggcgttcctcgctctgcacttccataccggctgcagtccttcctggcgctgcattctctgccccaggagttggtgccactgcggcccctgtcctcgtctctcccccaccccacccagatcagtgatggggctggaggacttcagttcagctaattccttgccgtgcagtgggcttctggtggcctcccctggaaagccattaccctgtcccctcaaagcccatggtggcccctctggcctgcctggaaggtgcacttgcacagcactgcaggaagctgctggcagcggcctgtttccacagggtcaggacaggctggccccgctgcctttgcttgcactgctcctatagtctctgtcccccgatctcacctgcctgagccacatctcagcctccctgggacctggtgtgacttgtgctctcaccgtcttccctatgagggctgctatctggggtctggctcagagcccatcactgcaccaggattgtcctgttcagatgagggtccttttgtccccagggacagaccggccagttacaggttccagcaaggctgtggggattgtgccttactgcagcagtctctgcagtgggcctgtgcacactgtcacttgcccactggccgttttacaggttgtaagcctcattttgtacatttctctccctggaaaatcttggattttgacgtcagatttctcgtggaagccctcccatttgctgtgggtcatcctgtgcccaagcttgtgactgaacggtcgctgggctgagccacgatccctgtcgtcctgctgggcctgccctccacatcagccctccaggtggtacctgggccgtgttcagatgcgtattgtgaaaggctgcccttccatttggcctgacatctgcccgtgcttctcttcctctctagtatccgagaaatagctcagtctcaccgggacatggagcaggaactggcccacgccgtcaatgccagctccaagtccatggaccgtgtgtatggcaagcccagaaccacagaggtagctattctggccttttcagtcctggcttcttctcagtgtctgccgccctcggccctccccgtgcgtgttcattcccccgcctccccggtgcatgttcggccctcccagtgcttgttccctgcccctaaccgtgcatgttcggccccccgcccccatgcatatttgcctggtttcttctaggggctcaactgcagcttcgtcctggaaatggtgaataacttcagagctctgcgcagtgagacggagctgctgctgtctgggaagatggccctggtaagctggtgccccagggacagcagggctcgggctgtgtgtgaaacgactgctgtcgccaggttgctgggcacacagggcagcacactttagtccagagttcccggtcttaaggaatgggccgcagaggtcatttggtttgttgtgcggctggtgcccacccctgctggcaacccctcagtcaggttgtctcaagcatgcgagaagcgcttgcagcggaaacacccttgtcgtcgtggacagaagatgcttttctgccttagaagcctgtagtgcagagtcctgctcctgccgagagctggccacactctcaggcaccttccatgctcagccctgcaaaaccggctgatatggcagctgtggggctgttactgaatcacaggggctagaacagggagaggcctgagagactgactggccagccttctggttttaaagatgaggaggaaggggcttgataaagattgggcaactggagaaccgccccaggtgtggtttcccagccctccactccgcacgccactcacctcctcactgcacgcgtctcctcactgcacgcatcacctcactccacacatcacctcactccacacatctcctcactgcacgcatctcactccacacatcacctcactccacacatctcctcactccacacatctcctcactccacgcatctcctcactccacgcatctcctcactccacgcatctcctcactccacgcatgtcctcactgcacgcatgtcctcactgcacgcatgtcctcactgcacgcatgtcctcactccacgcatctcctcactccacgcatctcctcactccacgcatctcctcactccacgcatctcctcactccacgcatctcctcactccacgcatctcctcactccacgcatctcctcactccacgcatgtcctcactgcacgcatctcctcactccacgcatcacctcactccacgcatcacctcactccacagaaatcctcactctacgcatctccttatcccatgcctcccctcgtcccacgtcccgtggtcacacgcgtgtcctcactgcacacctcctgctgcctcctgcaaggttcgactgctgactttgcttcccacagcatttccactgcttgacacaggtgaatggctccgaccccatttctgacagagggacacaagcaggtcagttgtcagccttgctctatgtgaattcatcgttgactgatggacagttttattctctcaccagcactacttagaaagtgaggttctgggtttggttccttttctggtgctctgggacttcgtttctggaaagtgagctccctgatcagagcagagcagagccctggagcggacctcacccccctgggcctcgcgctgatcagcagtgcacactctccatttctctctccctccctccgcctggagcagcagctggatccgcctcagaaggagcagctggggagtgctcttgccgagatggaccgacagctcaggaggctggcagacaccccgtggctctgccagtccgcagagcccggcgacgaagaggtatgtggctcatagggctgtgcctgggtctcccggacatggtggctctcgcctgaagtgcctgtgttccttgtgacccgtgtggctctgggatcaagatcgtgtcgctccggcagcccctgaggggccttctccagacttcgctattaaaatgctctttaaggcagggagggacagcaggtaggaaggagttctgggctgggattaagagtgccccttgaggaccagggacctgttgtcctctgaaacagaactgcagggcttcctggacagtgggtagaaggaaggctgagcccagccccacagcctcccccgagggtggagatgtatcatgggataaatggcagccttttgggatcccgctgtggacagggcgcagttggtgtgcgccactccccactcacactctcttcctgtgtgaacagaaagactccagctcgtcgcaggtctgggagggacccgaggacgcagggcatagcggaccctggggtggagtcacattcttctgcagggagtgctggctgaaggagccctggagagggccgtgtctggacaaggacaaaccccagcctgtctcttggcttccctgcttcagagatagaacacagaggggccctgaggaaagctcatcttgggcagtacagttgcagaaggcaaataactgcaagacgccaaacctgggcacccctgcccagtggggtttgtgagacctgtgggcagcagtaaggcgaggggacagaggtgggcagctgcacaacagcaccctctttccggggccctggggcgttttttgacgcatgcaatcctttcatgggaaactgactcaggcactccagccgatggatgaaactcagcagcttctcagtgagggcacttgggtataaaaggacagggcaagctcctcaaaatccattaaataattcattgtaaaggtgattaagaaattttacccaaaattacaaaaataataatatacaatgattcaacagatgtcacagtgacatagccctataataccagattaaattaaggccagtaaagtgggcagtgaggtgagaggctgggaagaggacatggacggggggaggaaagcatgttaaattcctcctcttacagtggaagaacgttacaaacaacattcttgactttcatacttggagaaatacagagtcaataatgtttttagggtcaagagtggtggctcgcacctgtaatcccagcactttggaaggccaaggtgggaggatcacgttagccgaggagttcaagaccaggctcggcaacatagtgagaccctgtctctattaaaaaaaaatttttttttaaacttaaaggtaatttctaatagagctgaaaagatttatatcttccaaattgccaccaaggacaaaaataaaatacaatttatattgtaaaagaaagtaaaggaccagcaagggtatcgctaacagcatgaaaataagataacagaaaaatgacatggctttctcttaaaagtaaattcttaggttgtgttttaaaagaaacctaaccatatattgctcacaagagccctgtttttttttctcatactcctaataaaaatttatgatacagaaagattaataataattaaaacaccataaaaaatccaaagtaacaatataaaaataaaattgcatatgtaagacaataaatgataaaaagaggatcactttacattggtaaaatacaataattgttatgtatagtcatcaacttatgacagttataatagtcacgaaactgtgccaaataataagcatctaaattagctgttcaagactatgttttttattccctaacttcattttactgtgctccaagcaatggtctgtatgttactagtcctttgaaatgtactgaggtgagacttgcccaataggtggtttttgtaaatgtatcttgtatgcagttgtgtttacatcattaagttcctactgaaattttttttgtcttcttgatagatcagttaactctaataccataattgtagatgtctcagtttatctttgtggttatgtgtatttttgcttcatgtattttgaggctatgttattgggtacccataggttttatcattatataatgatccttttatctttagtaattctttttatcttcaagtctacttgcttgctatattttttcatagttttactttcaagctttatttggagtgtctcttataaagagtgcatcacagagtgaggcagtgttacctccgtgcatctcagggagtgctgtgtggagaggctgccgccgccgatggctgtcaagagcagaggccgagcctctgtgtggctccgctcttcacccttcctctgctcttctgcctcagggagtggatcgcaaggaaagaatgcaaagtgcaggagagttttcattagacagatactcgtaatactaagaatcaaagcccagcaatccaacactagaagattggctaaagaggttattttaataatttttgtttagatactgatatttatgatattttcaaaaagtttttaaatctcatgagaaacgcacatgtaaagtgaaggaagtagaatatgataaaaatagacactatgatcactttgaaaccactttaacactcactaaaatcaacactaaatacaagaatcaataagggagagaagccctttcaggcacaagaggtctttcccagctcccgctcatctcagccctgcctgccctcccagcctctctggtggagatgggcatgaggccgtgatcagttgcagcctgattctcagtattcctcattctccccaacagagtgtgatgctggatcttgccaagcgcagtcgcagtggtaaattccgcctcgtgaccaagtttaaaaaggagaaaaacaacaagaacaaagaagctcacagtagcctgggagccccgggtacctgcctctctcccgcgtgtgtttctggccgtccacgcctgctggatcggccccgttcccctggtctctgctttctcccttggccttgcagctcctccctcttggtccctgtgctgtaacccccggtcctgcgaccacacttgtctgttggtagctgcagccctccaccctgcctgcttcccctctgaccgttgtcacacccggccctgacgtgctctctggctttctgcctgccctgagttgggggattcgaggtggggaggaagacagcagtagagtggtgacaagacaaacttggagacacaaagctctggactcaggccgtgctggggcatgccctgcctgctccctcctgggctgctggttcctgataaattgatgcattggtcgaggttcctgtgctgggaagcccaggccaccagagattgtgggtgatgaaatcaatcgaatatggtcctgaaggacattgttcctttgggtcagtaaattggagctaaactctctgtctgaaggatcagccctgaatacccaggccatatccagtgctgtcaggggctggagaggcctccaagcctggatattgggactggtgtttgccgccagtcagggcagctcctgtgggtttttcttctttgcatgtttgtccagaaatggggtttctgttaataatggtggctctgactatgtgaattgaaatctctgctcgtttcctttcctgctatggtccagaagtgaaatttaacccttctagaagctggaggaaaagctggctttggccacaatcatgaggacatttccctcatatttggtggtggtaaatccctcctgggacacggggaaatgaccagaggctggcggcccacctggcaggaacagatgccagctctgctgcagccatcgccccttgagcgggtggctctgtgcctctttctgcactgctggtgggtggtgctgttggctgggtgatggataccggctgccagagatggctcaggtgccagctgctgggctatctcaggcactggctgctgggctatctcgggtgccggctgctgggctatctcaggcgctggctgctgctgggctgtctcgggtgctggctgttgggacgtctcctgtcctggcactgggctctcgggtgctgggtgccagctgctgcctaccttgcactgggctctgggcactcactgcactcgtgcttttccatctccgacagttcacctctgggggacagaggaggttgctgcctggctggagcacctcagtctctgtgagtataaggacatcttcacacggcacgacatccggggctctgagctcctgcacctggagcggagggacctcaaggtacttccataggcgtctccctggaacctgcacttgggcttgcacgcagctcccttctcttccatcctctcccccgacctggccatgtcccagcatcacgattcttctcaggctttcgtgtatacctcaggtgggggcggctgtggccctcatctaggcagtgatggctccacccaccacaaccagaggaagccaggagcagacataatggggggcagagccttggttatcttaggctactcagacaaggactgtcttcgtgttaaaaacactatgaggggacacagaccctgaagcacagtcacacacgactgtccccatgctgctcctgggcgggtgctgccactcgtctgcagggagcattgggaggggtggttgggtgccaggcctcggtctatgccaggcctcacgccacatcttgcaggcccatgcccctgcccaggttggcctcaacgggccaacccctgggtgttgaatcactggctgagtcccgagagggcaaaaggccactgtgggtgtcctggacagtggctctcatgaggtcacttgtcatccacttgcttttaggcctgtgttttgtctttgtcttggatttgtccttgctgatggtagtgactagaatgcaggaacaatgggccaggcatctgtatggttgttacttttaagctgtttccatcttgttttaccgtttttgtcattttggctctcatttgtgttcacaagccgaatgggaagggccgttgtggcaggcctgctgtggagccctctggccctggctgtcttctcggcatccatggcggtgtcttctctgttgcaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagcttgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttcc

SEQ ID NO: 672 - DNA, 44104 bp, Homo sapiens
actagcgagcgccctgcgtaggcaccggctcctgagcccgtgcttcgggtgagggggcgggtcttccggccctctcgaaaatcatttccggcatgagccggaagaccgtcccggatggcctcggggactgccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtgtgagcggcgccggtgcgggctgggagtggggcgggcgggccccgcggaggcatgcggggcgtcagcgggaacctgaggccgagtccctggcgccgcccgcacgcatggcggccgccccgggtaacccgcgcttgggacgccgcacgccttttaaatgttttttctaacctgcgttttatctttggaggattttccctattaaattgtacgatctttgtggggaggcacagttcgtgtttgtatttgtaaatcccagtagctcatacaatgcttatgcacttaaataggtcccagaaacatcccatctatggggtcatgttaatgaaacggtcgttgactttcagtcgcagaattaacattgccttctcaatgcactggaacgggtggcctttgattcctcaaacttacttcccttactccaccttggtggttttttttgcggggaaacgggataggggatcagggtcttgctgtgtcgccgagcctggagtgcagtggcggagatcacggctcactgcagtctcaaactcccaggatcaagtgatcctcccacctaagcctcccgagtagctgggattacagacgcgcttcaccacggtcggctaatttttttaaaaaaaaattttttggaacgaggtctcactgtgtttcccaggctggtctccaactcctgcgctcaaacgatcttcccacctcggcctcccaaagtgctgggattataggcgtgagccaccgagcccggccccaccttggtgttaatatcgtaatatcttttaggcgggacagaacctttactgttactgaaatcttcagtatgaaagaggtggttttctttccccttactgcttgcagcttaagggtacaaaaatgtttgtacctttacctaaattataatggtcctaaggtggttccatctgcgtctgaaagtaaacctgacgactttctcaagttatgctgttgatgatattcagaataataattgctaccttatattgcattctgattgtgcaaaatcagtagttctcaaacttagctccacattagaatcacctatggatctttaaaaaattacaaatcccaagccacaccccagaccaactaaatcacaagtatcacagtacacaagtatcagtgtgtgtgtgtttgtgtttgtgtgagattaagcctagaactgcatgccaagttatcagtgttttttgatgcttcccaaatgactactgtgcagacaaattttagtactgtggtaagtatttgcatgtgttattttatctttcccaaaattctgtgtatgaagcaggaactgttattgccattttcacacatggaactgaggccaagagagattaggtaacttctgaggttgcacagcaggttaatggtgagactgggtttttttgtttttttttttttttttttttggagacagagtcttgctctgtcacctaggctggagtgcaagtggcgtgatctcagctcactgcaacctccacctcccaggttcaagagatcctcctgcctcagcctccctagtagctggaactataggcaagcaccgccacgcccagctaatttttgtatttttagtagagacagggtttcaccatgttggccaggcggatcttgaacttctgacctcaggtgatgtacctgcctcagccacccaaagtgctaggattacaggcatgagccacagtgaccagccgggactggaatttgaacttaggcttgatgactaacttttgcatttgcttttctcactggctcccccagcaaatggttctttgctttcactgcacccattgttttaacaaaactaagaagaaagaggatgctttgctgttctaggaggccctgaagaacagtgctgtttcagaaagccagaagcacaagaagtccctcttcctcaaaacatgattccctgacagatgacataaatcagttcattaggtgcttattaggtgcttatgctttaaaagctaatatcctttgaaagtcaaattgggtgggaggcttgactcacccctcactgaacattttcacttactttctgagtctgttttgcctcatctataaaatggggatgaagcttgccctgcccacttcataaaaacagtgctgtgcatataagtgctttcaaagccatctgtataatagcttgtaattgtaaagcgttatctctttgacacaaatggaatgttttcctgcactttgaaaatggcatcttgatggggcaggagcatgtagaacagtcagaataagaggtcacttgtggagagcagatagctttaaagggtgctagagtagcgagtaatacctgcctgagggaccaggacaggagaccgggatgagaagctaacaagaggcaggagagtgagacaggctttgcatgttaagatcttctgtttaggcagagggattgacatttagggagatcatttctattatagtttgtgaaacaccttcattccactcattccagccttcccaggccagtcaagctctgaccctccatcagcctggagtctattctctgttcagtccgtgcctttgagtctgaagagaaaggtggaaagaagccgtagggggagggaaaggcttccctccatctccagccttctcttcagggaggaacctttgggaaggactccttttgaacgcctgtgttttttgaaagaacctaaaattatcacagggcactaagctttggtttaacatctgaaggtcttactagagccctttgacactggtggattttaaaccataatttcccaggttgaaaccaatgtccagtttggctaattcgtttgaccaatagatgagagtgtttctacccaggagttctcttttcaggtatcaaaaagtgggactcaaaactctttaaaaggagaaacaagctcttttaacaggaatagtcactagcataaaccctgtcttgttctgcttggtacctgcagaacaggtacccacatctgatcttactggtgcctgtgtacctattactcttattttttatttcatttcatttgtttatttatttatttatttatttagagacagtctcactctgtcgcccaggctggagtgcagtggcgcgatctcagctcactgcaacctctgcctcccgagttcaagcgattcttgtgcctcagtctccctagtagctgggactgtgggcaagtgccaccgtgcctggctaatttttgtatttttagtagtttcgccgtgttggccaggctgttctcgaactcctgacctcaggtagtttgccttccttggccttccaaagtgctgcgattacaggcgtgagccacagtaataggcctgtgtgcctattacacttaactacgtgttctttctaatcttgtgttttgaatttctgtactctgtctcctgtcaaatttattatgtttggaaagagaactcatttcctctctaagctctcccctcttgtgttctctcacacgttagcatcctccgcccagttgcttgagcgaggagcctcagaataatccttgactttttaccaatacagatctgttagcgtaacggcctgcttttataatcttttatttaatcattgccagtaagaagtctaaatttctgatcctgctttttcctgtgttggctccaacctttatttccagccacttaccaaaagactctgttattccttctgcatggcccatcatcttcttttaagacttaactcatatatcacctcctgtgacaccattcataaaaatgagtacagagtgtattctctgtacctttttatacttgactgaattaaatgttaactccatgttggagactgtcatttgtatttctagttccctgacctaaaaagtaattagatatgtcaacttatggtaaagttctcctgtcttacttaaaggtacatagcatttcactttgccattgtgtttagtgtgtttttcttttttcctcccaaggtagaaacaaataacttctggggtagaaagcattttcagctccctttaatagggaagacattcttgcaggtgattctgtaggttactgtggctgaggaatgtatgttcctgtattgcatccttcaatacatgacaaggtaggtacctagcaagtgtacatacgttgtaataaataacttagtttctgacttttttattttaatagataacaaattgctggaaaagtcagatcttcattcagtgttggcccagaaactacaggctgaaaagcatgacgtaccaaacaggcacgagataaggtattttgaaactaacttgtattatttatgtctcctctaaggaaatttatctcagttcagttgtcacttctctaatttaaaagcaaatcaagtactatttctgtgttccagtttttgtcagctcctttcaaataagaactaaaaccatgtaattacaattgttttttagaaggtatgtcatacctagaaaggttattatcagtacagtgctctgagcttgagaaatttcttaaggcaggttcacgtggtaaccctaggtcagtttctcatctaacctgccaggattcatgtttttttgtttctttgtttttaaataatcacagacaagtatttctgagcgggtttgtgtagatcctgttaatgtaggattgattggcacatacgtaaaaattgctttcctgcagtatgggtctatttgatcctttttaggttggtgtttttttcaacatacaaatggtccccaacttgcagtggttcgacttataatttttctttttcttttttttttttttcttttttgagacagtctcactctgtcacccaggccggagtacagtggcacgatctcagctcactgcaacctgcaacctctacctcctgggttcaagcaattctcctgcctcagcctcccaaatagctgggtctacaggaacccaccaccacacctggctagtttttgtatttttagtagaggcagggtttcaccatgttggccaggctggtctcgaactcttgacctcaaatgatccacctacctcagcttccgaaagtgttgggattacaggcgtgagccaccgcactggccagcttacaattttttttgttttgttttgttttgttttgttttgttttgagatggggtctcgctctgtcgcccaggctagagtgcagtggcgcgttctgggctcagtgcaagctccgcctcctgggttcaagccattctcctgcctcagcctcccgagtagctgggaccacaggcacccgccaccacgcttggctaattttttgtatttctggtagagacggggtttcaccgtgttagccaggatggtcttgatatcctgacctcgtgatccgcccgcctcggcctcccagagaggtgggattacaggcttgagccaccgcgcccagcccagcttacaatttttaacctttataatggtgcagaagcgatacactttcagtaggactgtgctttgagtatccatccaaccagtctgtttttccccttcagtttagtattcaataaattgcatgagatattcaacaacttattataaaataggctttgtgttagatgattttgcccaactgtaggctaatgtaagtgtaacctatgatactcagtaggtgagatgtattgaatgtattttcaacctactatatattttcaacttctgatgggtttaaagagacatagcctcagtaagtagaggaacatcagtattagtagattgtgaaatcaaattagcagattgcagtaagctcttatttttctttaagaactagattagaaaaatatcagtgtgtgctgggcttggtggctcacacctgtaatcccagcactttgggaggccaaggcgggtggatcacagggtcaggagttcaagaccagcctggccctgatggtgaaaccccatctctactaaaaatacaaaaattagccgggcatggtggcgggcgcctgtaatcccagctacccgggaggttgagacagaattgcttgaacctgggaggcggaagttgcagtgagccaagattacaccactgcactccagcctgggtgacagagcgagactccgtctcaaaaaaaaaaaaaaaatatctatatatctatatatctatatatctatatctatctcttggtgtgtattgatagaatatttcatgaaatacatatttgttcatggcggggtatttgtgtttactgggtcactggtgtgcatttatgtatatttgaagtcttattatcctcttctgtaatattcattgtgtttgcatgttaaatttggtatggggacagtagccattattgctctgaaatctccacacatttagcaattgtaaaaacaaggttggtgatttatggtgtctagaaatggtagctgtagcctgatgtatttactcctagagctgtagctgctctcatgtctcctcatctggcacgatggtctcctgatagaggacagagtgggaaagataccagagaacagatggcttggcagggcctagcttccatccttgctttgtaacagttcaggagatcctgcctggctgtggccctgggaggccttctgtagtacttaagatattagttttagtattttggttaattttaggtgtagataatgctgtttcaccattttcgtctaaattcatccaattgaaaactaaaaacatttctatctgattaaacccttgatgactatattcttgtattctttatctgttagccaaactcatgtgcttggaatatgcagccgttcttttggctaaatttcactgggatagacttttttgaggcagggtctctctctgttgcccaggctggagtgcagtggcatgatcatggcttactgcggcctcaacttccagggctcaagcaatcctcctgccttagccttctgagtagctgggagactataggtgtgcaccaccatgccagtctaattttttaattttttgtagagataggggtctcactgtgttacccaggctggtctttactcctgggcttaagtgatcctccctcctcaaccttccattagtgttgggtttacaggcatgagccaccacacccagggggatggtcatttagttggaggtcttgttataaaccaggttcattcagcccacacacagcaagttaatcactgagatgatgggttttgtgagagtttattcataacgtggccaagcaaggaggcaggagaacaggtctcaaatccacctccttgaaaacagggattgggggtacttaggcagtagaaagcagggtggtctaaagtgtgggaagaggtgattggtgggtaggaaagatgaggtaattggggcttccacgcaagcataatctagctttgtggttcctcataggacacatgcagaaaatggtggcgtcagcaccatctgagggaggagtgttttggccctctgatgtcaaaagatcacctcttgggcattcacacaggcccagttgaagggttgggggtctcaaccagctttaatgagcaagagctgcctcctagttcctggagaaaaactttaagcaccagttattgtagtgagccacagtcagttattatttataaggaagctattgggagtttagttatgtgttgtttggcaactcgacttgctagtgggagtttggaactagaaaaaagtgatgaaaagcaggcaaggcaggttgaacggtgggcttcatcaggttaccccttgttcagtctttccatttccacaaacattatccataataagcctgccctcctgacttctttgtttccattcacagtatcgttgttttccactagtcatctatggttccttcttccctctagatcttcccatctccatattcctttattcctcatattccccatattcaccaagcccattggttctccaccccctagcctcttgcatcctttggtttgcatttattttgccacctcctttgtttatttatcttcttattcccagactgtggtgagagcctcattcactcaaaagactcctgtgaccgtagtgtgggctgggcattagggctgtagagatgagtaagccagagtccctgctctgaggaggaatagagtctagtgggggagaccaactcaaagggacatttgctagagaatgtaagggtgttcacagaagctgggcactttgttggtttcctttcccctccttcctgtctctccaaagttcctgcctgtctcatcctaattaaccgtaaaacactgcacactgtgcttaaatagtgatctgcatcagttatcagactttctcttaagtattttcatcactttgcctacagtttaaaatcaaactcttcagcctcgaaattgtttattctaagcacggttcctggactagtgacatcttctgggaaactgttagaaacgaagattcttgggccccacctcagacctactctattagaaactctgggggtggggcctggtaatctgtgttttcagaaatgctttagctgattgtagtgacctctgaagtttgagcactaccacctttactgctactcagacttcctggaaccagcaacattcccatcaccagagcgcagaaagtcagaaatgcagatggctgggccttgccaggaaagcaggtcacctgttagtgggctccaggaatctgtgcttgaaacatgccctcggagtgattgttttttctacttgccgaagcactttagggggctgatattcattgtaagtaaaataagaagtccttggaggctttgggtcatggaaagagctgtatcctgcttgccttagtctctcctagcatttctgttgtgttctgtgtcttggtagactttgaagtttaagcatctaatcctgaggctcctctgcctgatgatcttgcctccattttgcccttcctaggagattcctactttagttcctctttggaaacccctcccaaaatgaaaccatccttgtctggggaaatctttgcctctgaacatgattaacactttccatcgtcactctttgatacacttttgtttttctttgtgttgttagtttttgttttgttttgctttgtttttttgttgctctgtcgcccaggctggagggcagtggcgcagtctcagctcactgcaacctccgccttccgggttcatgccattctcctgcctcagcctcccgaatagctgggactacaggtgcccgccaccacgcccagctaattttttgtatttttagtagagacgggatttcaccgtgttagccaggatgatctcgatctcctgacctcgtgatccgcccgcctcggcctcccaaagtgctggggttacaggcttgagccaccgctcccggcctgttgttagtttttatttcatgaatctgttctatagctagccagctccttggaaggtgggtccacatcttacatgcttgagtccaggagttcgaggccagccagggcaacatagtgagataccatctcaataattttttaaaaggtgggggagatttgataattattctgcctgatttaggatggtttcatgtaaagtgtgttccactgtctaatctcttggcattacttcttgggttaagattggggaagtgccaggttgcctcaagataaggtattagtttgtgcttagctatgtaataacaatacatatagagatggaaggactgctatactaccacctttatccccctctttttattttattctgggtcatatggagggggcagttctttccgctctcatcggatgttggatgagaggaacaagtgtccagccttgttccttttctccatctacaagctttccctagacagtggtttcagctgctcactatagtctgataattctcacctgtgacaccagctttctctcgaactataaatccacagttctagttgtcttctgctgtatctgagatattatgcaaacacttggcaaagattccaaaactgcattgactctggaggtgatctgaactcactcctgtggctttaggcacatctgtttgctgacagtgtctacatgttagcctccagcttggacttcttcttgaggttcagactcttaatactcagtttccatttgacagtactcagttttcacttgaatggccacaaacgaactctttaggtctcctccaaaacctgctcctcccacagtcttgcccatttcagtgggtgacacctaccttctaccagttgctcaggccaaaagccttgattcatccttgactcctatctgtcttcatgccccatagccaattcaaagtcaagtcctgttagcgctgtctttggaatggatctagaatcagaccgtatctcacctcactgctcccaccctggtctgagccgcactgtcccatgtttgcacttcacagtagcctgctggctggtcttcctgtttcggcccttaccccactgcaatctgctctccttttaaaacctaagtcattcagctgctcagagccctccagcagcttcccttcacgcctagtaaacctcacagccctcggaggtgcccacaaggctctgcatcatttccccacctcgtccttgaccgcacctcctctgtccccctgtgcctgggcttcagtcacccttcctccaaatacaccacctgctgtacacctctccaggctctgctgctgctgctccttctgcccagagggcccttccctcaagggtccacatggcttattcctcacttccttacagtctctagtcatgtgtcacgtaggagaaaccctcctcaattacgttaaaataggaccccctccctctgttccccttcttgtgcttgagttttctgcaagcacatgtgactgctgacctcacacgtgctctcagttgactgtcagctgtgtggaagcagagccctgcactcactgctgcgtcatcggcactcaggtccttgctgagccagtgggccctgttggtgcctgttactgggacttcattcaggaactttccaccctttattcctgatgtgcctgatggtcacagttgctttgcttttttccatgtgtttcatgtctcctcctttccactcatagtgcctgtaaccgcagctgctggagacacccgaatggtttattggctttgtgaacatgtttctggagttatggtttcattgcctaattggaaaggtttggagtctcatttttccccctccgttttttgcacattctcttcatctgcctggtttgccaatttagtcccggacatgatggcacatggaatgacaatcagctacaagaaatggcccaactgaggattaagcaccaagaggaactgactgaattacacaagaaacgtggggaggtaaagctagcccttttcctcatctgtcttctgccctctatgagagtcctgtggggagcgggggagctcagtcacttctcaccagaattggcagcagccttagccatatgtggcatcaaaagtcccctccataggaataaaagggtgaggaaaacagaatgaaaagaccaggcagattgaggcccatcaccagaagggcaatcctgtgagagcgctgccagttaccatgctccaaaatcagcatgagaggcaagagtggagaggctttaaagaacaaaaaagcctgctacctggtgcgctgaaggcctcactgatggtttcataaagcttttcagtacaaaccctgaaatttcagagacattcgtgagaaagaatcaagtcctaggctgtgttcgcctggatggtggtcttacggcaaagctccagttgggaaaatacagttcaccatcagtacagctgaattgattatcttttcagcagaaatgagtctccaaaaaggtagctgaagttgaggagtagacagctgtcctcagcaagcccctggcagtcacctggaacacttctcattccagccaagctgtccttcaacagggagtggcagggatagttcccctttgtgtccccataggcgcctcggctccttgctgtcacccagctcatttattctttcttaaaaataaatcgccacccactgtgtagtttccaaatgaggtcctaaaatttttatttatgaaagtattcttctttatctcccagttagctcaactggtgattgacctgaataaccaaatgcagcggaaggacagggagatgcagatgaatgaagcaaagtgagtagagaccccgcctccttggagcctggtcattgggtcccatgtcctttgttctgctgacctcttgtgagcagggccagtggcagtgagtggccacagtgcacttagcgagagtttgattttcagtgcatacacactctgggatccttttctaccagctctgagaaggaaaaagcaaggacagtgcccacaggcttctagcatcctcctagggatgtcaccttggctcttgcaagtggcccagagacactagcagctctcctgtggccgctgtgtgtgggagctggtatgttcctgtggtggaggtggtagggccaggatagctgagcgcatggcccttgggaaaagggaaatgagtttgtgagcaaaactgttgctgaccagggagaagcctggcagacaagataaatggggactctgaatcctgagaccttggagctggggtagcgtgtgcttgggtttccttaatatgtggaaaggggtctagaggcttggaaaggcagggcgcttgctcaggcttttgctcaggaaatgtcagagctggtgaaatatatacggtttccagcctccttttaaatcccctttaccaatctaagcatcgaaagtttctcttccttcacatcgtgtttttcctagtcattaataggatgaatttcaccttaggtgtttcctctcctaatggattatcctgtaaaccatggggatgggcctggctaaaagatgttgtaacagacacaaagtgttaagcactcagccaggtccgtctggctctggcacagggctctggcgaggtactattcgtcctctgatgtcatgcttccagaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccaggtgggctatcaatccacagttagtggtttccatccttagtagagtagaacctaggtctttgaaaagaaagagataaacctggcagttactacaggaggtttaccagggaattctttcagtgtttcaaggagaaaagctaattctgaacaatataaattaaaccagagttagaaaaaggaaatacaccacaattagaattcttccccataattttgtgaagctttttgtatccatataaaaattctgatcttgctaatgcacaagaagactataatccaaccttatatgaatatagatgtgaaattcctaaatcagactcattgatagatttttatttattttttgagacagagtctcgctctgttgcccaggctggagtgcagtggcatgatgttggctcactgcaacctccacctcccggggtcaagtgattctcctgcctcagcctcctaagtagctgggattacaggcatacaccaccacgcctggctaatttttgtatttttagtagaggtggagtttcaccatgttggccaggctgatctcaaactcctgacctcaggatccacccgcctcggcctcccaaagtgctgggattagaggtgtgagccccaccgcctggccattgatagattttttaagaattccctgcaatcctgctaagtctatttatttaagataaatctgaaacctactgagacatgggaattaaaagatggattatcaagaaatcaattacgttaggaatttgaatctctgttgtggaaaatgtgcgtgtttaaaagctgccccagagagcccagtcatcccctggtcaaggtccactgatcaaccgtctatatacactcttactaaaacctgcaagagaacaaggagaggttcactctcacaactcacagagaacaccgatctggatgttctggccaaccaaccattgaaaagaaggagtgatcacccacctagaaacctaagaaaatgagctgaaaagctgttaacacaagttcagcagatgccaggtgcagtaagtagctcatgcctgtaatcccagcactttgggaggcggaggcggaggcggaggcggaggcgggaggatcgcttgaaaccaggagtttcaagagcagcctgagcaacatagtgagactccatctgtacaaaaaacaaaaacaaaagctgagcatggtggtatgtgcttgtggcctcagctactcaggaggctgctgcgggagagttgcttgagcccagtaggttaaagcaacagtgagccaaagttgtgccactgcattccagcctgagtgacagagcgagaccccatccagaaacaaacaaaaaagctctacagattagaacatacatatttttaaatccccatatcagtagtttcgagtttgaagagattattccagttaatttaaaagtgaataaatgacaataggaaagagtcttttaaagggaataaatgacgataggaaagagtcttttaaagggtgatgatggaaaaacaagttagcatatcaaagagataatctgcactaccatcatgtttgtggcagcaccattcacaatagccaagatacggatcaatctacatattcatcattggcttaatggataaagaaaatgtgctgtacacacacacaatggaatattattcgctataaaaatgaattaaatcatgttatttacaaccacttggatggaactggaggacagtatattaagtgaaataagccaggcacaggaaggcagatactgcgtgcttctacatgtggggctaaaagaaaaatgttctcctagagatacagagtataactgtggttactagagcatgggaagagtagtggggaaggaggttaaagagagattacttaatggatacaaaaatactgtaaatggatataaaaatactgttagaaggtgtaagattggcctggtgtggtggcgcacactgtaatcctagcactttgggaggccaaggaaggtgaatcacttgaggttaggaattcgagaccagcctggccaacatggtgaaaccccgtctctaataaaaatacgaaaattagccgggtgtggtagcggatgcctgtaatcccagctactcaggaggctgaggcaggagaatcgcttgaacccgggaggtggaagttgcagtgagccaatatcatgccactaggctctagcctgggcagcagagcaagactctgcctcaaaagcaaaacgaaaagaatacttagtgctgtggaaaatgcctaaaattaatataaccgaaaataggacacaaaatgttttcatacagatgatcccaattttgtatacttttttaaaaaaatgactggaaggaattatatgtactgttactggtgtttatttttgggggtggtgagattatggtttttgatttctcattttatacttacctgtattttctaattttccggtttctattaagaaaaaataagctgtcctttttgtattgtttctgtctcacatttactttaagcagaattgtttggcttatgccatggagcttgacagcagtgtgagggtgttgggggccccaggtgagctggatgctgctaggttgcatgttcacgtcagctgagaggctgctggagggagaagttggggagatgtgtggtgatgccaaggaagagcccctgagcagtgcagtggacggggggtaatgcacatttcctagtgaaaatgctgtcctcattccctagcccaccctttgaagcatcttcctagggctgtgcacttggaggtatcatgtgattgcagatgtgggacctgaggagtcttcattactttgcttaggtagcctctcctcctagaagccttcctgcgtcattacccacttcctgcctccccagcttagatgtccctcatcttcctgcttcaggcagctgtggtttacctgggccatatgtagcacactgttttgagatagctcttcacactctgcctccttcccttatgctgccacgtgtccctgtggtcaggcacagtggctgcttcataagatgcactcagggctgggcacggtggctgctgcctgtaatcccagcactttgggaggccaaggcaggtggatcacctgaggtcaggagttcaagatcagcctggccaacatggcaaaaccctgtctctactactaaaaacacaaaaattagctggatgtagtggcaggtggctgtaatcccggctactcaggaggctgagacaggagaatcgcttgaacacaggaagcggagattgcagtgagccgagatgatgtcactgccctccagcctgggtgacagagagagactctgtttgagctattaaagacctttcctttcagctatagtgatgaatccctgataacaggtggtgttttcctctccctgtgaccctaagtcaagtttttatctccaccttgcagaactgggacctgaagttatagaaagtagatttcagacagtcaacaagtgctttaatcatagagtagtggtactcacacaccttataccgagattctggtttttcctcaaagagagttagttcacagttgtctctaccagctaagacaatttggataaattgtatttttggtaatttgccctgtaaaacttatttttcatcttccaggtataaaatcaagagtgtaatgcactttttaagctatacccacatcccttcccaagattctgctatactgcctagaggactttccttcattttgagaattaccaccgtggtaaaaacttacgagaaatttcagcagaattcttgattgcagctcagtagcattgctagagttctacattaggggtcctccacctagcaggcatagccatagttagaagtgaaatttatcaaagaagagagagtaaggtcagggttaggagttagggagtttctgaatttaggacttgaatgagagacaaaaatgattctgagaaggggagttagtggatgagactttgaccatgttaaaaatttgtcacagccaagacttctatgtcaagctttagtaaattaaagttactaatgttatgtaaactttgacatttcaagaatctcactatacctcagtttcctcatttataaatggcaataatgatatttacctcaaaaggttgttataaggcttaaatgagttaaagtctgtaaagtaattaacaatgtcaggtaaggggaagtcctaagtaaatcttcactgttagtaatcaggctgtgggtgtgttaatgcaggttgagcatcccatatcccaaactccacaatgctccagaatctgaaacttcttgagtgccaacatgacactcaaaggaagtactcattggagcacttcagatttccgatttaccattaatttcaactgaatttcatatttagacctggatcctgtcctcaagatttatatcatgtttatgcaaaacttcaaaatctgagaaaattcgaaatctgaaacactggtagtcccaaacatttcgagtaatggatgctcaacccgtgtaagactatttgctgcagaaaacttaagtcacaaccatgactaaccctcagtgagcctgaggcatgtgtctatcctaagatacccttggtcccagaaggcaggcctcctcctttgccagttcactgctttctctaataatgtggcctatctctcttctaggctttactctgaaaccctttaaaaggggagccttactgatgttatgagtttgggcttgtgacttttgagtattttgctcagggtagttgttattttacatgcactgaatgtgttattagaactggtggcttctagagagcccaaaccccgtgctttcttaagcagacataaatggtgggctttttttttttttttcccaacaggaggcggcaagcccggctgcagaaagagcttgcagaagcagcaaaggaacctctaccagtcgaacagtaagtaaagataaatgaatcaaaactgtgtttctgaaaatttggctctcttaaaagttttgtttttatttttttttttgtttggttttttttgagacagggtcttgctctgttgcccaggctggagtgcagtggtgtgatcatagcttctaatgtttttatttctgtaaaatcatcttacagattttagaaagaaaaatgttaaaggaagaaaatgaaaacatacagttcttccaccactcagaactaacatccatatatcattttaattgtattttgctggcttctaatttctcacaaatcatgtactgatacggcctttgaccctatttctgattacttacttgagatagattattgaaaataaaatttgatgggtcaaagcttttggaacatcaccaaataaccttccaaaaagtttgtgttcatcagctgtgaatgtgaattctaacttcctgcactcagtacccgttactgcctcactgtttcctgttgacactttgaacgatcagttttctgcctcttaattgtgcctgccatgtaatgcggtggggtttttgttgttgttgttttgtttgttttttccctccttgctccctttggtttgtaacttaaagtggaaacttaagcgaaaactaagatctcttggaacaaaaggaatcaaactagttctggagcttttcctaatctgcctacaagttaaggtggggtatcttctctgagatttgaagctttcatagtggtagaaaagagtttccttcgctctaggatgtttcttttctattgaaatgtgttttggaatatagttttagagttttgatccactattttttaaaatgttggttgcttccctgtaagtggaggggtttaaattcaactaggagtcattcaccaactaacgtcttaatttacaaagaaacaaaggttcccatatcatgcctttgctttagatatgtagggtacgtgtgtgtctgcactctcagatgtggaagattaatctcagttgtattttcccaagccacaaagtaaataaatagttgacctggaaatgagatttggtttcttcagaataacagcttataaaagtgtcatttgcataaccgggttgactgggataatttagacaggttgagcatcctgcccaagatcatacaggaaggggccgaggtaggatgcaaacacagggctgtaaaagcctgttattttattttgtattttattttattttgagatggagtttcactcttgtggcccaggctggagtgcaatggtgcaatctcagctcactgcaacctccgcctcccaggtttaagcgactctcctgcctcagcctcccaagtagctgggattacaggcatgcgccaccacgcccagctaattttgtatttttagtagagatggggtttctccatgttggtcaggctggtctcgaactcctgacttcaggtgatctgcccgccttggcctcccaaagtgctgaaattacaggcatgagccaccgagcccggcctaaggcctctccttaatctctatgcttccctaaggagtttctgggtcagaggacatacatctttgaaaggttttgataacttagcaaatgctagtgttttcttgtggtcccgggcctaagcacagttgcaagtacttaaaaccataaaattctattttcaacaggacattgtcaaaggctcagctcatatttgcagttcctgtctttgcagttctcctctcttccttgtatgggcacaggtgactctcgcaaacctagatccctgggaaagccaatcaagaaaataaagcacagccttgtcctttttctttcgacctgccttttattcccttctacatcctggccaagaatgtggtgcaataattacacatagtcctggaataaatagctaaggaaaataaatttactttgaccaggtttaacttgcttagtaacaggttcttaagtatatatttacctaatccagataattatttattgaaaaggaaaaatctttctgtcaagttcttatgaatccaaacagtaggtgatgaaatcttgggttattacatttaattatcttctccatgaaggttgcatctcagtaggaggtcattaagaccaaaataattacttgccctcctccaagtaggaaagacgtggcccagaaaaatgaggaagggggattccagaggtactttgcatccgctgggataaacagcaacaaagggagcatgtcctatgacttgattatgtcatttgaagtgtgatgggctctcctaatgtcagagacactatgtatttaagcataaaatgcgcagagtcaaaaatgcatagtgtttaaattttgcttttctattttttaaagtaatatttgaaactgggttaagttggctgttgatttcatggcccatttagccatcccttctttccctgaattctccctacactgttgttttatattccatagctgctgcccctaactaccctaggtacccctcagcccttgtgtcatgggaactgtgcttggtgagtactgcagcccttcaacagtgatgctgactgttgatggaatgccctactttggcactggttatgtggttatagactcaacagatcatattttattgcttcaagtgggaactgtgtttatacctaaaaggatcaaaagctcacttttaaatttattctcagttgaaattctggatttgatttgaacaggttaaatgtttattgtagtgttgttcagaacatggcagctcttcctttttctccaaagaatctttaacgcattgctgtcatagccaagtggtttaggatctaactagaaaatgacattagcatttgcggaaccgattaatcacagaactgttcaggagaatcaaagaatgtcttgcctttctttccagggatgatgacattgaggtcattgtggatgaaacttctgatcacacagaagagacctctcctgtgcgagccatcagcagagcagccacgtaagtaggcaggtttgggccagggaaaagacagcttgaggagcaatatgaaggcacatctgtggacatgacaaagaatgcagtcagatgcacccaaccccttaccccttttctgggacacccagcgtcgaacacaccacagaggtgtccagtctttctcagttcacctctgcttaatgggagggaagcagaacacgggtggcttcaaatgcttctaaatacaaaaaaatgtagtggcttactcaaatatggacagtgaaaccttattaagcagaatgattgtttaggtttgatcatcctgtttcattcttactagggcttccccccgcccgcaccgcccttcaagagtggggattggttactaacagtcagaaattgtgaagttagttagccaggaattgtgaggttagttgtctaatgctttatttccagggaaattaatttaatactagggaaccttgtttcttttgaaacttctaggctgggttttccctttcccttcccactgttttctggcagtttggtactgtgttgggtttctcttggctggggtttgggaactaagtgggaaacatattcccagttacctgtttttgtgggctgtttattgattgattatttgggcaaaatgtttctaaggtttaaacctatcctcccctcctctttagtaagcgactctcgcagcctgctggaggccttctggattctatcactaatatctttgggtaggttagaagacctttcctttttaaatgtgtataagtatacctaagtatatgtacatgacttatttttattctttaaatgtacaccaggtgtcagtgatgcagagtatacatatgccttaatatcagcttttcatttagcttcttccttttttcctcaacttcctttcctcttaatctcgctgcgtgctgatctctggcctttccctttagtctgtccgagtctccccttttgggacatcattcttcttctgatgctgccaggtgaaactattatcctctcttagtccagcatgtgagtgtgggtccttaacaattatgccaatcaccgcttcactgccctcagtcatcagatgttcacgtgctaacgaggatgctttgcatgttcctaggaatgccgggagccctcagagcagggctgccaggttgaacactttgtacagtactcatgctcttgttgctttcttttggcatgcgttagactccacattgatcacaagtgatgaggttgattctaactaggcatagaaataaaatagttttgcaaaaaagaccaaagagctacctctgagctagctgttacattaagttgagaaagtttcccagcagcttattgactgggtaagcagttgttcaggattgcttttcattgttgggttttggagtccacaggttagtgtgcaggagagtaaggcatgtgctggctctctttctcatttgagtgagggtgcttttgatttttttgtgaattgttctgtagtttgaagaatctagaaggacaggctatcaacagaggcagtctgcttaagcaaggtcgtcttggagtcctttctaacaatttgatgagcagtaaacctctgcaatcctgtctaatatttgtctttatgttatttcttaggagacgctctgtctcttccttcccagtcccccaggacaatgtggatactcatcctggttctggtaaagaagtgagggtaccagctactgccttgtgtgtcttcgtaagtatgcttcagccccgaaccctaccacgcttgatatggtgacagagcctggcaattaaagggtcctttctaggcctgcagctaagcattccattgttttacttatatcaagcctttccaccttttggctctgtcagctgtgagaaattgatatattttgcttagtttcagaggacaaaatttgttacaaccatcctctgtaatggcagagctgactgagaaaggattgctagcatgagggatggggcaaaggaaaagtaattagggattgtgaaaaatgggagagggatttatataattattgtcaccaattggctccagtttagagtgagttgccagtcagtggtgtattatggaagttcagtaggacagctgttggtttcatgaattatatccctatctgtatgactcccagccattaggggtctatgactggaagcagtcctgggcagaagccacggtgatggataccagggctgtcacccggagttcagagctgggtcctagtactagcaggtagtttgcatcccagctggggtagttgagcagaaattgaaccagcctggggaaacattcagtacctggctcagaactgtcaaagcatgaggagggtaggaaacagagcacaaagaacagaacctggagagttggactgactccagtactggcctaataactggcagcgggtaagtgaaaggagccagctttcaaagcagggaagattttgccgtaaaaatgggatggaatttatatggtgggagctttgggttccaggtataaggagggacttagctagttacacagtggactggctgagtgatgaactgccttgactgttgtaaagagagttccgctttggaggaggagttgggatggggcgcatcaacgccccttcccagtcccactccactcctgtgattccatgatgcaccgggcacctgcagaggtcgatgatgattggtaaaaggtctgattgcactgaatgtcacggtccctttgttgccctcaactcccagcagcccattttttccctcccgtcacatttaagtcatgtgtatgggatcatggagcagctgataatttgggattctgtcagtgtgtgtttctgagagtgatcggctcacagctgacgagtatccaacaaaaccagttacacaggagactgacgagtggcagtcatgggtgtgatggtgcatgatctcaagttttcaatctgagacctcctaaggagaaagaaaccataaaaaagaaaaggaaatttcatgggggtaaaaggtttggtcacctgtcatacttttcagcagtgggtcacaagagggaggcaaagtggaaaatgaagttaccaaagtgatgcctgttgcccagcctgttaatagtcactccctccgtgatacttcaagcattttatttttttttagtcccaagcaaatgtaaatatcacatattctcttccccaagtgaccttttagacaagtgattatctacttaacaatctcatattgatagtctatgttttctagtctttcttttccttctctattatagaaatttccaaacatacgcagtatctcttcccccccacacttatgctggagcaatttgaagccaattctaggcattatatttcatccaaaaatattttactgcccataatcttcttaagagagtatagtgaatttttcgattattcccttttcccattctagaatgggatgctgagtctcactctgttatccaggcgggagtacagtagcacaatctcagctcagtgcagtctcaaccttgggctgaagcaatcctcccacctcagcctcttgagtagctggaacaataggtatgcgctaccacacctggctaatttttgttttttagtttttaagagacgaggtttcgccacgttgcccaggctggtcttgaactcctgagctcatgcgatctgcccacctcggtctcccgaagtgctgggatcacagatgtgtgccactgcacccagccaggatgcttttttacttggttttctttcttatcctgaacataagtaccatcttttgccagtgtttatgccagtattagaaatttccctgtgaagaatataaattctcttaaaataacgactgtcatttttatctaaggcttatgcattaacaggcaccattctgggttgcaaaaacctttctggagctgagcaaactgagatttcagaaacttggcagaggtcacactgccagtacacactagtcccataatgtttccagaaagaactacatagaattccattataacacagattgatgtttttgccatctacttatattaggactcattgcgaaagctgtattatgagaggccatgtgctatacattatttaaatatgtagtatttaatattattagtaaattagtaattactagtagatcaataagtagtattaactcagtctggaccaaaattaattctaggtttacttttaaactattaagataaatataggccattattgttagaacagatgaaattaatgcaaggaccaactttaagcagtctacacagattttgagtactttttgagaaggttgcactgcactctaatgcaactgtaactagaagaataaaatgataatagaatcttagttgacctgggctaggagtccagtttagtttatgattggctccacctgtctttaaggatgagtgtttccccatgaattaggcatttggagtgttcgcgcatcttgagctcttgggatgagaatgactgggtttgacacagggtgcttgtcttgcaggatgcacatgatggggaagtcaacgctgtgcagttcagtccaggttcccggttactggccactggaggcatggaccgcagggttaagctttgggaagtatttggaggtgagagcctgctgcatgttctcagactgaaaacttgagatgatgcacccttgcactgcagaaagaagctgtgttgctggcatctggttgaccttgctttcaggcactgtgaattgttcattttctcaaaacatacattttatgtaagggatcgtttgaccaaagcatcatacatctcagttattctttacttccgagtggatgtttgctctcattttctaagtagtgatcagaaaatactgttaagttatggatatgtttatgttagtaaggtttctgtagtttttctcaagtatataccaatcagagcatcttgcaaaatagtaccgtttttatgaggaaaataagtcttatgatcatggattctacaattaaactatacattaagctgtggttgatgcatttaatgacaattgcaatagcctagggaaaaaatgactggagtcatgtctaagcttgaggaaacagaggcgtactacctagaaaagatgtatttaacagtgtatcagacgagggcccttagatcaagactcagtctctttggacttttaggatgctcagagatggatggcattaaaacagaaaatggaagttaatgaaaccatctcttagaagtctgaagccgggcatttcccagttttgacgttttcgagattcagttaaatatgcgtgtatttttactaaagtaaggccgaagaataaggcttaaggtttttaacgggaaccactttgccaagtgtctgtagctgcgacacacacattatccctgtcgagcaataaatagctccaaagtgattttgtctgttaattcccctgatcatcacaacagccctgtgtggttagaatggtagagattgcgccatttcacagataaagggaataaaactcagatactacgtgatttacatggctagtgaatgatttctgtggtgagggagtggtggaactaggactaatgcaggccagaagacctgaaattccatgctcttactgtagccttctctagcaactgaaaaatcttaggggtactgcttttaaggtttatcagagcaggagcaacttattagaataggttattagtaaagcacccctcctatctgccccggcctttgattttcaggaaagggactcagcagttagagcccattgaagcatactaaaatttactattttgcccagaaacatttagcttatgaatgataatggctgaagcaattagaaaacaataataaaaacaaatcataagaaattttcactttgtgaggctggggcaagaggattgcttgaggccaggagttcaagaccagcctgggcaacaaaatgagaccctgcctctacaaaaaaaatattaaaaagtagctgggtgtgttggcatgcacttgcagtcccagcttcctgggaagctgaagtgggaagatcaattgagcccaggagtgagaggctgctgtgagctctgatcgcatcactgcactccagcatgggcagcagagcaagaccctgtgtcttttaaaaaaggaaattttagggaatttgatttgcaaaatcaaagtaaacagtctgttttgagtatgccattgagatttaaataaaaataacactagaaatattttcgttttactccttggtcagtaaaaacacctataagaaaattagaggtaccaacctttaattctagtaacctttttgcggctgaaaagaaacgaacatcagttgaagttaatactgacataatctgtgccagcacataatttgtgttaataaaatcaagtttctacctaatctacagaaatagcagaatgtgtggcggcatttcttacagttttgtgtagggcctttcttctacaaacagctgtttcagtctacaagatttttcgtcttggcaaatatttatttactgaatcttggaagaggccaagttcaagagaccttttctgaaatagtttgggggtcctgttttttcatccttttagattatcagaagaatcacactttctacccagtgggaacatctgtttttgctcattttctccaaagcagaagttccactgggaattatacaaatgctgttgacatagcaccccccgcccccaaccccgtatcttgtagataattaagagttttaatacggtctttgttcttttgagatcaatctctcatattgaatagcattaattttttggtcacttcctacatttcggcactgtgttaagtgccaagcaaatagaccagtattttaagcataagccaaagagatatttcttagaatttgcagtaatatttttatctgtgaagatttcatctaaaggaaaatcttagcgaatattagcctttttcaacccttttgaaaatcttaagaaagctaggatccagaaaaagccattaaatatgctgtattttgcaagtgagttcagaggagaggttcatcaaccaggttaacagtctgtggcctgaatgtacatgacagcttcaaaccagtattcgtgtcaccttgatatctggctccaatcattatttttactacttagaagtactgaataagataaaaatgtgttgaaatgttttctgttctgtgttcctcttttacaaatatgattacaatggttccttaatttctagcttatctgtgtggatcatccttaagttacccttttaaaaggaatttaatcaaatcattgagatttttgctcttctcagtttgggattgcccgttactgaaatttccgtgtgggtggccaggctgtctggaagcagagtagataaagtggacagtggctctgttggtgagggagagctgtgtagagggatgggaggtgctggcacttagttcgcttgccaggatcttagattcatggagataaagtatgagggcaaattccagaaactccaaactagcttgactggtattctatatgagtagtcatttaaatgtaactaacacaatttcttttcacaccttaatgaaaattaccacaccatgggtccagaaattgactgccagtttctacaaaagtggtagttaagttggcacaaatgctgatcaacccaaatatttatgtatgtaagtttttaaaatgtactgagaaatagtggaactgaataaacccagtctctagtttgattgacatggtttataaattcctacactttgtttttctaaagagaatgaataactacatttcttaaagaacagaacacacatccaagatgctggggtcagtgtccacttagacttgcattcctcttagaaactagcagtatcttttatctctcatgttctctttgtcctgctattttgtttgattctgtaaaggtacaggatagctattgttttagcagtgtaattggcttccattgtatttcagtgccctgttttaatgtatttattggctttatttaacttcccatcatcctaattttttctttttatacagaaaaatgtgagttcaagggttccctatctggcagtaatgcaggaattacaagcattgaatttgatagtgctgtaagtattgaatagctatgattttaaaggtttttagaaataatttaagacattaggttcttgaaattataacataacttacccgatttctctgccattctctgtatcttaagccaaatccatgttaaagaaagatggaaatagattatagggttaattgctgtatcaactctgataaacccttgggttctgcttcatgcattaggcttgtgatgttactcagtactttgtataatttcacttaatagttgtattttgagtgtatagatgctgtactccaggggccagcgtggtctctaccctccgagattcgccatctaaatgagagtgatgggaaagcattaaactgcaaagcgttgtgctgagttatggctgagatgtgtgtggagtagaaaggaaatactgatgagagagtagctcattctggggcaagggttaggggccatagtaaggcatttaaagcagatctaaagataatcaaaggtcagaggcaaaaagccagggacggacaccacaggcagagggagcagaggaggttgggctgggcgagtgcaggagcttgggtggaggtgatgactgggtgaggccaaggtagcgtcctcatctaccaagagtccttatcttgattgtcatctctggggagccttgttcacattcctgggtgggctgagtgtctatgttcccagcatcttgtgcaaacctattctatggcacggtggtggtctatatctgtttcttttactaagctgagagctgactacctgaggacaagtgtctgggcgttaatcatctttgtacccccagcacctggcacagtgcctattaggttctaaataaccactccttgaatttaattggggaatgataaggaaataaggttggaaaatgagggtatgttgtattgaaaggtttagacttttgtaaagccatgtggagacttgagagatttttagaaatgggtatggtgttaagttgtggtggaactgtgacagtgctgaagactggcttggaggaagcaggtctgcagtggcccgtgcgttcagtgcttctgcagagatgcagaaggcccaggtgggggctgaggaaataggggagaaaggagaggaccaggctcgacacattgaagatgaacagttctcagagtgagagttgggagattaggcaaggagagagtcaagggtgcctctgaggtttctgacttgttaatatttgctgctagtgaaggttgccaagggaaaagtgagtagggaaggctgggttccatttggagcttgaggtgtctgcaatattctgatgaaattgagcaagctcagaaaaaaaaaggtctgaactcgaaggagactggcgagttgaagcacactcacgacagtagctggtattcaggctggttgtatagggtgaagcatctaaaccttcttgtacttgattattggggaatttatatcgtgtgaactgaattcctctgatttggctaaaaattggttttcctcttctttattcccacagggatcttacctcttagcagcttcaaatgattttgcaagccgaatctggactgtggatgattatcgattacgggtaagacccagttaagaaagttagtgcaatctccaaacttcatgtggtgttatcaaggcacaaactggcaggtgcttaattaggggactttgttttcccaaaaatcatgcttgattcaccctgcccttcctttcctccttggggaaatctgtgtttccactttatactctttgtccaaaactcagtttcaaaatatttgcaatgggaccctcacatttgcatgaaaaccttggaatactcttcataaggactaaatactttggtagatagcaattttggcttaatggcacagaacttagcaacagcatgtgaattgtgattcctgtgggctctaaaacctaattacctaaagtgggatatagaagtacaaatggatgtatcatagggataagacaattctgaaacaaaaactccaagctgagaaagaggggacaggtgtcagagcagggagaaatgattggatgttgaggaaagctgcatttgaaccaaaacttgccaagaattctcttggcatctgacagagagaccaaaacttggttgtatcatttttgattggggcagggggcggagggcgaagcatgtaacttaatttgcagacattttttttccccataagcctgaaggaatcatcacataagcttattaaatacaagctattgaaagatataatggaggatgaatttggcattagtaggcattttactaaaaaaaaaaaaaatttttttttaaaaagttaacacaagccgtttgtgtgtgtcaacccacaccaaaaacagaggaagtaatgttaagatgaattttttttctttttttttttcttttgagatggagttttgctcttgtgtggggtacagtagtgtgatctcagctcactgcaacctccgccttctgggttcaagcaattctcctgcctcagcctcctgagtagctaggattacaggcatggctaatttttatatttttagtagagatggggtttcaccatgttggccaggctggtcttgaacttctgacctcaagggatctgcccaccttggcctcccaaagtgctgggattacaggcgtgagccactgtgcccagcaagatacatttctttttttgttttttgaaggcagagtcttgctctgtcatccaggctagagtgcaatggcgcaatcttggctcactgcaaactctgcctcctgggttcaagcaattctcctgcctcagcctcccgagtagctgggattacaggcgcccgccaccacgcccagctaatttttgtatttttttttagtagagatggggtttcaccatcttggacaggctggtcttgaactgacctcatgatccacccacctcggcctcccaaagtgctgggattacaggcgtgagccaccgtgcccagcctaaatttcttttttcttttttttttttctgagatggagcctgttgcccaggctggagtgcaatgacgtgatctcggctcactgcaacctctgcctcccaggttcaagtgatctccttcctcagcctcccaagcagctgggattacatgcatcctccaccacgcccggctaatttttgtttcgttttttaaatttatttattattttgagatggagtcttgctctgtcgcccaggctagagtgcagtggcatgatctcggttcactgcaagctccacctgccaggttcacgccagtctcctgcctcagcctcctgagtaggtgggactacaggcacgtgccaccacacctggctaatttttttgtatttttaatggagatggggtttcaccatgttaaccaggacgttctcgatctcctgacctcgtgatccacctgcctcagcctcccaaagtgttgggattacaggcctgagccactgcgcctagcccaatttttgtatttttttagtagagacggggtttccccatgttggctaggctggtctcgaactcctgacctcaagtgatccgtctgcctcggcctcccaaagtgctgggattacaggcatgcaccaccacgcctggcccagatgaatttcttaaatctacaagggaggtggaggagctgtagtagaatggtatattaggtgggtttctggtgattttcttgagagggttgtatagattattagtattagatgctagccaatacctcaggggtggtcattcttaattcacaatttaaagaagatccaggtccgaacatgcaaaataacgagccctgacgatgacaaggacatgttgtgagagctgaggagcctatgttcttgtcttaatgacggactagggaagtgcactgctagagagcctgccatggggcacaccaattcagatgcttgaatagggtcatttgaagccctgtagttctgtactgtacacatggaaaagatggcctagccggtactcatggctacgttctaatccatcctgtggtatactgtgatttatctatccattgatcttttattctagactgagatacagtaaaactgaccaattattgaagaggggcctacagccttttttttatgatagtcccttagaggagaagaggaagaagttgagtcaaccagtagtgcaggatattttttaattggtaatagaggagtcctatacaggtgggcatcagcctttgggtcagaaataacaagaaggggacctagagcagggagctagactgacagatgaaggtcataacattgagctggcacacaggtctcactggggaaatgttctcagtatgctggagcagggcgcaggctgctgggctgctgcttctgatgatgccgtgctggggcaggagcctcctgtgctggactagttggcttttgagtttctggcctgctcataaccttgtcctgttacttggtaaatgtgtgaagattgggaggcctgtttcagcagattccctgcacccagagaagtctcccgaaaaccttaccaggttccagaaagtaaaataggctccttattctagggagtgctggcttttttttagaccccagttaacagatggtactggaggacaggaatccattcatctatgttgtgaaactcacagacatccatgccctgttcggtgtctcctttgctcttacgacaagggaatggtgttgggagagactggcaaacaagaagcagctggttgagtgcttgctttaacatcctttttgtaaatgcaccctagaaacaacctggcattgaaaggagtcctctgtgatgcctccgttaaaaatctaaagtcagtacaaaactgcctggctgcttggtaagatttgacttgagaaacttgcttgagaacccccctgcccacttctctcgtggtgtggtgaagtggccacagtgaggattggctatggctgctaggtgatggtttctgtttggaatgttcctctttgagttctgcattcttctggaatcggctgtctttggttggtgttatgttagctgcatgattaagttgttacctgaatgagcaattttgtgtttagaaataggggtcggcactcgttatctgccatgaggcacagagatagtctgtgcagagcccagtggagcagagaaatcttgaagcctccccactttgaggccccggccttgatgacatctaaacccgctgccccgctattgttaatccctgtttaaaagtagaagatgaaacctaaaagtgttgttaatcataaaaatgaatttcagaaacacctaacagatagaagaattttaaatctgatccatttcaaaggactctataaatgatagaggtgaatgaatgcctgtaggaggcccagctctataccattggaagcaccgagacagtgagtcagcctcaggcagctccagcttattctcactgagaataaggtgagcagaagcccaaacttttttttttttttttttttttgagacagtgtctcgctcagtcacccaggctggagtgcagtggcgtgatctctgctcgctgcaagctctgcctcctgggttcacaccattctcctgcctcagcctcccgagtagctgggactacaggcgcccgccaccacgtccagctaagtttttgtatttttagtagagacgagatttcaccgtgttagccaggatggtctcgatctcctgaccttgtgatccgctcacctcggcctcccaaagtgctgggattacaggcatgagccaccgcgcctggccaagcccaaacattgtaaagagcaaggtgacaatacgtacgaggagccaagaaacaaaacgtccctttcccttattccattagttcagcagtttcattcctggaaataagtcaagagaagaaagctgtgtgctcatagatgttcactgcaacagcatctgtgacagactcttaaagaaagggaggtgcaacaaggaagagatttgatcccattcatcttgctgagtccgtactaagatagcacaaggatgtttcctgttcacagatgttacagagacccagggtgttcaaatcagtggaaccccaaagcccatgaattttcagctatcacatgaaaaaatgcttacgctataagcttaaaagagtaatggataaatttttaggaagagtataattgtgtaaagattaacatgttcctgtgaagtatgtaaaaatgaatatacagatggtccccaatgtagggtattttcatcttacaatgtgtttgtcaagactggccccatcataagttgaggatcatctgtacttgccatatcccacttatgaacaatgtctttttctaccctgtgtttgtgaaatgtgattttactcttaacattaagaaagaaacagatagtgaatataaatacaaatttgaaattttgataaaatagttattcagaatttaatgtaaggccgggcacagtggttcatgcctgtaatcttagcactttgggaagccgaggcaggcggatcacttgaagtcaggaattcaagactagcctggccaacatggtaaaaccccgtctctactaaaaatacaaaaattagctggatgtggtggcacacgcctatagtcccagctactcaggaggctgaggcaggagaatcacttaaacctgggaggcggaggttgcagtgagctgagatcacgccactgcactccagcttgggtgacaagagtgaaactctgtctcaaaaaagaaaaaaagatagaatttaagaagtagcctacccaagttttgtctctgcccatgatttgtgcagagtggatgttttatattgaatggaatcattattcatggactgtatctagtgtaggctttgttactggagctttcttgatcttacggaaggatcagtgggaggttttcacacaaccgcagcacagccggcacccgactggcagcagttgtaagatgctgtcccagtttcagaggtttgaatgtgggataaggcagtctgagaactcatacaagcttccctcattgaagctgagaggggagtatatgtggtccgaagttttcgcttctgtgctaaagtggagttaaccccactgaaaatagaggaaggattggtttcaaaaatgttaacacaaaaaaaatctaaccctgaaccatgaggtctcatctttgggaactaaggtttggagtgcagtggcatgatctgggctccttgcagcctcgaccttctgggctcaagcagtcctctcacctcagcctcccctgtaacagctgagactataagtacccaccacacccagctaattcgaatttttttgtagagatgagggtctcactaatttccccaggctggtctcaaactcctgggctcaagcaatcctcccaccttggcttcccaaagtgctaggattaccagtgtgagccactttgccaacccttgcattttctaattagaaagaaaacatcagtgaataccttctgaacctctggtgttttacacatagaaaaatgttgatcatgcactgcatagaggtcaatgatgaatggtaaaaggtctgagtcctcagatcccctcccggcatcccagttatccccagctgcctctcctccatcgcacttcagaagtgctgcgatgggcagaagggcagctgacactccgtgatgtccctcattctgtgttcctccgtgagctcagggaagacactggttggcatccaacagcttagtcacaaagggatttgattgttgggagtgctggtatctgtggctatgatctgccttgttcaagctgagacctctgattgaaaatcccccaggggttttaattgtttacataaggagtcctgatgtttccttttgtaaattatgcctgtggtgaccttgtctagtctgactttaaatatggaactgactttcagcagcatggcgcaacatcgaggctttaaaaattctttaatttgatataattcagacatagaaaaattacaaaaacagtacagcaggtatctgtggtagagctgatttcaaattcaagattgaggatggggagcacgtgaagcttggtgctagtgatgttgaatttttgtttttaatgttatttttagtgggagttttatccttttggtcttgatacctcacctttggccaacactcaaagataggcttcctatgagatacatggcccctggataagactcagtgaatgaaattgttgcttcttgtcctgtttgggatgtgtgtgtgtgtgtgtgtgtgtgtgtgtgtgacaggatcttgctatcactcaggtggagtacaatggcactatcatagttcactgcaacctcaacctcccaggctcaagcaatcctcttgcctcagcttcccaagtagctgggaccccaggcgcatgccaccactccctgcaaatttttaaaaaaatttttttgtagagatgggggtttcactgtgttgcccaagctgttcttgaactcctgggctcaagcagtcctcacaccttggcctcccagtgtgctgggattgcaggcgtgagtcactgtgcctgacctgtttctttttcctttgctgtcttatcgctttgagtgttcctggccggatctcagggtggtctgacactctgactctggaggtaaggatgctgtggatactttgccagcataggcagggcctggcgccctgaggctcaccctggctgtgttctctctcctagcacacactcacgggacacagtgggaaagtgctgtctgctaagttcctgctggacaatgcgcggattgtctcaggaagtcacgaccggactctcaaactctgggatctacgcagcaaagtctgtgaggaaattcagtctctctgtctgtgtatatgcttagatgttagcgtggaggtgtgtgtttgcacgtcagagcctgcatttatgtaatatagtttgaatttcagatctggcttcatgtttagaggggcactgaggatagtgatagtttttcttgtttaaagcttcatttaagtgagtaactctgacaagtcagtggttagagggtggcagcattatgtaaacagccacgttggtgcctctgcttgattaatgatgtttgcatttctttcaggcataaagacagtgtttgcaggatccagttgcaatgatattgtctgcacagagcaatgtgtaatgagtggacattttgacaagaaaattcgtttctgggacattcggtatgatacccaagctcctgactggaggcacataagagtctccacagtaatggttctgtacatgggttgtgcttttaagatctcaggacatggcagaaatgagtttcggtacacgtatagtgttagcttattaacacttggctgttctttcccatgaagtagactgtggagcttagcaatcatttattgagcatgcagtgagtgctaggcccttcaccagctggcaggtaagaaaaggcaaacaggatactctttctacctttaggtaatttaaactgtagtagggaaggcagaacgcaaaagtcagtgactagtgtgttgaagtggaggcagctacgtttgttccagtgtgttaaagaatgcctctccagatttctccggagacgtgagtaggattcacacggcaggaaagccactcaaacttttgagtgtgtgtctggtggctgatacatggcaagtgagcaggaaacagggcagaagccagtgagggggctatgaggggttgaaatcaggttgccacaggcttgataagccattgtcaaatcactcgatcttgtaagtcgttgggtgtttagcaaggaaatggttgctttgcaggagtctagtagacgactttggtggcattttgagagggcatattagggaataggaaaccaatagagttgataaggacctaagttcaagtcagtagaggaacatgtggaggagagaatctatttgaaggagaatttggacagggcttattgacaggttggaggaaggggaagacaggatggagagtaaatgaggacagcctcccagcagggttgtagagagggtgggggtacagggcctgtggtgatagatgatgctttgaaacacagcatggcaccagaaagtcctgacaatgctcatggttcctggacaccacttcacattttattcataatctttagtttgcttttaaaacctgaaattggaacttgaaagatggaatttgagagttaagttggatgttcgaagtctcttagtccatcccataatttgacaggtgaagaccctgagtcccaaggaagtggagtagcttgcttcaagctgcatatttagcaacaataagataaattcttgcttagttaaggtgggaggtaggaaaaggtttcattgaaagcctacaacaaaatcatcacagaacaggtcagcaccccctttggctatgaatgtcaccaacagggccctgcccagggtggctgttagccaccctggacatgggccacagcacagagaagaagagggaggtgcgtagggccgtggctctgccctggctttcctggccccatatctggaggtggagggccacagagccacagtgaatagggcagaaaacctgcaagaggctagagttacacttacaaggcagcccaggcccactaatgcaggtttctttgccaactttatccaaaagttgaaatcacatcactgaaaataatacgaattgggtagtagccctagttagctcatgctgatcagaaaccgatgggcgattgttgtcattccaaaaatggatgaggaaattcttaccaacttcagagttctagtctgggaatgactgtcttagggtctgttgatgggaaagtaagaaaagcagtcacaggttattagaagactgggaacacattgactgcgctggcagagcgttgcatgctagttgaattgcagtgccttttttttcctccacggcatgatgtgaagtagttctggcctacgttacatttctcagatctgttctccctcttagatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcaggtaactgaagatgtgctggttgcatgaagaccagaggcccagccctgctctcttaacgtgctgcgtggcctgagctccctcagtgacagtgccctgttgtttgtttcagtgcacctgggttcaagtgcggctctgactggaccagagttgtcttcaggttagtagtgacccaccccccgccaatttggttcatcacaaagagtcctgcatgggcattttcccactggggatatagagctaaattttgttcagtgcccaacctatgtttccaggagtgtgcctgtaagttcataattgcaggccaccattattgtctcttcctttccagtgttccttttgtgattacatgaacctaacgtgttgtaccaaaaaataacagttggctggttgctttgttgtgggtgagcccattaggttcacttctcatcactcattcacgcaagagctgttggagagcctttagaaaagggcaggagtggccgtgggcctggggcgggactgaaaaggctttttggagaagggtgtgcaggtggtctgcagttttctgctccttgttcccttcttccatgtatcctgcttcttccaaatacctttccaggctcagttgctaagatgtttcttttcttccctcctctctttgaggcatgtaacaaggcagtccatgggctgaaacccttagctatgtggaggttggctttgatctccctatatgttgttttgttgaagtctgtagatggttaaggacttggagccccaagaagcaatgtgatgccactgttcattagccggacggggctgaaatactggggaaaagcagatttggctggaagggccatgactagcacacattctgaggtctgggtacacaggagtggtcatcagtgaagaacaaacattccttcttgggaaaaaggccacagagatgctgaattgggggtggggaattgacaacctttcttttcttactgtcttctgtagccctgatggcagttacgtggcggcaggctctgctgagggctctctgtatatctggagtgtgctcacagggaaagtggaaaaggttctttcaaagcagcacaggtaagatgaaccctgtctcagccccccgttgcgttgtgagcaaggcctttgacttcatctcaggggtcatccggtttagacctcagtcggcgctgtgagggcactgtccgcccacctgctcggctggctgagctaggtcagtggagagaagctggggccactcacacagcacagcaggccacagtctacagagtacgccaggtagagcggttagagtggcagccgctggagaaagggttatagaaacacatccctgactctttggttatgtccacgtcctctgtgtctccttccccttccctactctccttcctttccgcctccctgtctcccttggaagtccctgttgtcagtgcatttcagtgcattgacgtgtcctaaacactgatctccacacaccttcttttatcttccacctgataggcaggccccagacccccttttttcctagctttgttctgcccacacaagcccacctgctagttggaacccagataccattttccttcagaacctctctccctgtccttgggcagcagcaactgctcccagacctaaccagtgctgaccaccactgcccggctcttcagaggcatgtgtactgtctttccagctcactcagagctcctctcttagggagagtgtgataaggcctgactgccagaggggccaaactcccttcatcccagcatgacttaattaagtacaccactggattttttctgaggtcttttgcatgttagtgagctcctgccttgtcgcgggcacagtgccagagagtaaaatggaagttggaaaaattaggactccctgaatgcacaagcttctggtgtttggtttaccaagatctcatcccaaatgttctgaaacttggtgcttttctgatctctcctttgaagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 673 - DNA, 44104 bp, Homo sapiens; identical to SEQ ID NO: 672

SEQ ID NO: 674 - DNA, 44104 bp, Homo sapiens; identical to SEQ ID NO: 672

SEQ ID NO: 675 - DNA, 44104 bp, Homo sapiens; identical to SEQ ID NO: 672

SEQ ID NO: 676 - DNA, 44104 bp, Homo sapiens; identical to SEQ ID NO: 672

SEQ ID NO: 677 - DNA, 39393 bp, Homo sapiens
gtcagctgggtgactcatacatctgtgagaccctccgtatggagaccggggcggggggtgttgcttaatgcttagaactgctgaaactaccagttcactgtctcagcactaatccaactctgctccttaagtgggatttggcttttagacattgagacctggatgctgggcatcctcgctagatcccctacaaattccccacatacgtaggccaggagcctcagcggtgccccttcaggctcatctggcaagacggtaccagcttgctcagaacaggggctggctattcatcatctcagagcatagagaccctctccttgccacccggcccttcccacctggttggtgacaaatcacaaggtatgtgaccaccacaggccaaaaccttatcagaaacctggggcaggtgtggggaagagcaaggatgggcgttttcctgcagacagtatgtcccgccttcaccttttctgtgtggtttccataagacttggttgctatttaaggagacttggagtgagcgggtgcaatggctcatgcctatagtcccagtgactcaggaggctgaggctggaggatcacttgaagccaggaattcgagaccaacttgagcaatacagtcagacccagtctctacaaaaaaacaaaaataaaaataaattagctaggcatggtgtcacacacctgtagtcctggctactcagctggctgaggcaggaggatcacgagcccaggagttcgaggctgcggtgagctatgattgtggcactgccctccagcctgggcaacagaacgagctcctatatcttaaaaaaaaaaaaaacctcagagtatgcttaattctagaccgctaagatggcctcttaattgtaaaacagagtggctatctcttagtaggaattgccaaatagaacttttgggattttaatatattctttttttttaaaaaaagtgataggatcttgctatgttgcccaggccagtctccaactcctggtttcaaatgatcctctcgcttcagcctcccagaatgttgagatgacaggtgtgagccacagtgcccggccattaatatcttcttgaaaacagtctttgcgaagtggttatgttgtggttttcaggaacttttctgatttattcgccattagacacagtcacgatagaactttaaattcaacctggctaagtgtgataacaccaaaggttagtcagaaagtaaaacctcattggaatctagctagactccctggcaaggtgtactgagaaatgtttgaagcttaccaagaaaaataaaatattgaaaacaccccaaagcatgctgcagtaaaatacaaactaagcaaagactcaccgatgaaactcggatgttgaagccggtacaagggcatggtgaggacgcacaggatctcgtgagtaggtttcataactaggatgttcttgacttgatatttaggattgtcttacctttctccaaccctctaacacctgaccaacaccccaaggtggtagaagttgccagggacagataacatggcagccagcgggaagaccagcaagtccgaaccgaaccatgttatcttcaagaagatctcccgggacaaatcggtgagtggtgcacaagtgagtgatttgatagaaattattgtttaaaaaaaatggagctttttcaagtacagtgtagtcatgatcaacatcaaaactctttgagggccagggcgcggtggctcatgcctgtaatcccagcactttgggaggcggaggcgggataacttgaggccaggagttcgagaccagcctggccaacatggcaaaacccatctctactaaaaatacaaaaattagctgggtatggtggcaggcacctgtaatcccagacttgggaggctgaggcacaagaatcacttgaacccaggaggtacaggttgcagtgagcccagatggtgccactgcactctagcctgggtagcagagggagactctgtctcaaataaaaaacaaacaaacactgtgagggccagggaagctttgtgtctatttttgtctctgtctaagatggatgatcactgagctataaatgagtgaatgaactgcagaaatagagcttctcttcagtctcatcaagactttagtcctgtgtccctcagttttctccgaatccctcaatccccacactgtcacccccacctctgcatcttttcctagccagccttgaacccttgacttactatttaaacacagttttgtcagtacctgtgatgcccttggccttttgtctatctattgtgtcacctgcctgggtaaaacccagacagtgatcaatgtgactccttcttctccgtgcacctaccccacccggggggtctcaagcctcagctgggcccgcagggccattggataagggaaaatgccccagtctgccccctttccaccactctccaggggcacgttagatgctccaggtgtgcccatgaacttcctcgcatgggagagggtccaccgtccagcctctgtggatagctccactcgaaagcttcttgtgggccaaaaatctagctcagcaacatctagtgcaagccacatatgtaattttaaattttctagtagccacatttaaaaagtaagaagaaacaggtgaaattcattttgatgttatattttatttcagcccactatatccaaaaaactatcagttcaacttgtaaataataatataagaattattgaaatctgatgtgtattttatgtttacagaacatgtcaatttggaatggccatatttcaggtgtccgggagccaccttaagcagtggctaccctactggacagggtagctcgccatcattctggctttttttttttttttttttttgagacagagtctcactctgtcaccgaggctggagtgcagtggcgtgatctcagctcactgcaacctctgcctcccaggttcaagcaattctgcctcggcctccctagtagctgggactacaggcatgtgccaccgcgcccagctaatttttgtatttttagtagagacagggtttcaccatgttggccaagctggtctcgaactcctgacctcaggtgatccgcccatcttggcctccccaagtgctgagattacaggtgtgagccaccgcacctggcccattgtggctgacttctgaacccggtatggggtccaaagaacctccccatccttaccgtgccacccaggagatccggctttgcctgtgtgctttctgccttctcctctcctagttaaggaactcggtcattttaatcaagtactctgattctttcgttctccaagccctttcccaagttgtatctttccagtccattttatctcaacttctggctgaagaggaaaccactcgtgttggtttcccacgttgttttccccttgctcctagattttccaccaagaaatgtagatggtttttgtagataagtcctcacaggtgggaaaagagaattcaattcctgtctcatgtattcagatcattttgccagcgatgtctgtgtggccccaggcatggtgtgccagggctctgagcccatttctctgtgattctcccgacgctgccctcttctttgaccttcatcctccagcaggtggctaaatgactgcccctgctcctggcgtctcacccacacttgacaacatccagaaggaagaggctgtggtttcctggggtctcttgtaagggtcaggaaatctttcccaagactcttctctcatatctcattggccaaaactgggtcacatgtccactgtaaaccaatcccaagccagaagaattagatgatcgtagtgaatcaggccaatcaagaatcgtaccctggagccggcctcctctgagcataccgcctggtggaagatggtggtccctgaacaatagttggcggcttttatccaggaagaaggggtgtgtggctgttggatgggcccccgaaggctggctacagtctcacatcacccacttctctacctgcccccatcctgcccctgtccttcctgttgcagtggaaggggtagtttgctcccatctgaggttcaccacctcttacaccctgggtttcatggttggccaccttctcaggggcctcagtcattggtctggctgtgtgtgcagcctctcctctctgctagtactttgtctgagcataaaaataagtaccagccaggcgcggtggtttatgcctgtaatcccagcactttgggaggccaaggcaggtggatcacctgaggtcaggagttcgagaccagcctggccaacatggagaaaccctgtctctactaaaaatacaaaaattagccgggcgtggtggtgcatgcctgtaatcccagctactcgggaggctgaggcaggagaatcgcttgaacctgggaggtggagtttgcagtgagccgagatcgcgccattgcactccagcctgggcaacaagagcgaaactctgtctcaaataaataaacaaataagtaccgacctcatgcaccttaagaacaaccaccaactaccctcgaccctatatcctttctagttcttcttcccttgcagccaaaccttttgaaagagaagaaacatgccctctcttcacctgcccttgtctctcccgtccactctgcagtccccctcatcagctccacagtcaggctgcctaactggttctccccttgccgatccattctccagtttgctgctggcatgagctaaatctcagtgctcccttctataaaatgggctgcattcctgtctcattgagttgctgtgaggattaagtgaaaccatgtggtcaaagtgcttagcttggcccctgatacatgataagcactcgaaatgctatttaattcttccaaaagctatttctctatttagctttcctaaatactgtttaattcaagtctttcatcctgcttaaaacgcttcaacgtcttctgaggttctttagggccacgtcctatgagaccatttcagcagcagcagcctgcatccccattcagtggcatggtgaagccattggcagttccagaagcattctcggggccccgggcttcgtatacattttgctcagagagcatgccctcaaccgtcccctgtcctctggctatgccatttgtccaccaggtagagcctcctctgaaagcaagagccttccctctctccttccctcctcagtgccctcccctcaggcttcctccccaccagcctttgccctggcatttattccaggggcacaattgccagttcacttgctgggctcccaaccaaagagcagggaccttggggaccaaggggatgtcttcttcggtttttattttcagtagccagcagctgctggggcctctgtaaccgtgtgtgggatagatgaaagcagtatttgcctaattgacaggcgaagtctagcaaaggagacaggctcctgcaagagcacccagaacacagtgtgctgcacactgaggtgtggtcgcaggccacatgctcccggggcaccaaaagccagggggtgctgggcaaagggagagatggggaccgtgaggtgtcccctgaagcgtgggtaggatttcccccaggtgaaagtgcagcagaagggccttccttaccgtggaaacaataggaacagaggcacaaatctgtggtgtttgggggagctgtggcagagccgctgtggccagagcccagggaagagtggagctgttagagaggatgctctcagggtggccacgcacaaggcgctggggtttattccacagagaaggagtgagcagccagtagacactgagcagcagaatagcgaggtcatagttaccattcctgcaaggcagcctccaaattggttgatttggggagaatttttttttttttgagacagggtcttactctggagaccagtgaagatctctttaccccctttgtgggagagcagggttggagtacaatggtacgatcgtagctcactgcagcctcaacctcctaggctcaagtgatcctccttcctcagcttcccaagtagttgagactacaagcaggcaccaccttgcccgggctaatctttttttttttttttttttttttgagagatggcaggggacagaggagggggtatcactttgttgccctggcttgaactcctgacttcaggtgatccttcccaccttggtctctcagtgttgggattacaggcatgagccactgtacctggccagaggagagtttttaaaaggggctgtttgctagggtgtaggcaggtgtgaaagaaatcacaagaaatagccaggtacagtggtggctcatgcctgtaatcccagcactctggaaggccgaggtgggtggattgcttgagcccaggagtttgagaccagcctgggcaacatggcgagaccctgtctctacaaaaaaatataaaaaattagctgggcatggtggcgtgcatctgtagtcccagctacctgggaggctgaggtgagaggatcacttgatcctgggaagcaggggttgcagtgagctgagatagtgccactgcactccagcctgggcgacagaatgagaccttgtctcaaaaaaaaaaaaaaattacaagaaagagctccatgcgccacacggcagtgacgagcagctgggtgctggcacctccctggggttaagggatgagggatcgcacaattctcagaaccccgaggccctcagggctacctcccaggaactgtgatccccactagagggctgtgccagccgcaggcccagccaccatgcaggcaaggtggggacaaacatctggcccaccttgcccagaagccagaagaccagggaatctactagggcaacacgccctggtcagccccgcagggtggatcttgagggcaaggccaagacacccacagtgtttaggaagctgggactcgctgcagcaaccagcaggtagcagtgtgtgtcccggtcagcccgctgctcacaggtgccaggcttccacaccacccaggctagtgaggcctcccaaacatgcttagcgctgggagtataaggtttcctacggaatcttctctgtaaaccagggttctagtggtatttgctggaagtcacttcagcatcattcatgcgagtaacctagagggcacagggctacgcttcgggacatctgatatgggtgaaaggggagcgtataggagaggacttaatgccaacaaaaatgatttaggccgttcctggaattcaaaatattcattcgaagaagggggccagccaagggggccacactcaatgaaagagtgtactctcattcattggtgcacttggcaaacactgaatccctgtgtgtcctagactctgcagtagatgcttaaagatgtgcagagactccagattactaccaccaagccacagtcctatggattaaagtgctgagggctgggaaacccaaccctgctctcccataagtgggtagagaccttcgttgccaggggcaggacagggccagggcctgtgggcccagatgatggccatccccttcccacccagctccctcagtgcgtggctttaggtctacctgtgcagtagttcacctggtgggatttcaggggcttctccagaactcacacctctttgcgttgtccagaagttctttttttttttttttttttttttttttttgagacagagtcttgctctgtcacccaggctggagtgcagtggaacgatctctgctcactgcaacctccacctcctaggctcaagcaactctcctgcctcaatctctcgagtagctggaattacaggcgtataccatcatgcccagctaatttttgtgtttttagtagagacagggtttcgtcatgttggccaggctggtctcaaactcccgacctcaggtgatccgcccgcctcagcctcccaaagtgctgggattacaggggtgagccaccacacccagcctgtccagaagttcttgtgacaaagaggggctacctttcattccacagctggaaataaaagatttaacatgcaaatggatggcaaaagtctcatttacataattttctttctttcttttttttttttttgagacggagtctcactctgttgcccaggctggagtgcagtggcgtgctcttggctcactgcaacctccgcctcccaggtttaactgattctcctgcctcagcctcttgagtagctgggactacaggcgcgtgccaccacgcccagctaatttttatatttttttttagtagagacagggtttcaccatattggccaggctcaaactcctgacctcgtgatccgcccgccttggcctcccaaagtgctaagattacaggtgtgagccaccgcgcccgggctgctgctggtttttatcatggatgccttagcttagcattctttggcccttagacccacacctgttcttcttgcaggtgaccatctacctggggaacagagactacatagaccatgtcagccaagtccagcctgtgggtaagttgcttggagaaaactgtaatgctggttttcctttaagtcacagataaccgctcactttgtgtttttaaaaactggccttgctaataatctaaataaagacatgcaaattaaaacatcagtgaggcgccactggctgattggaaacaattttatttatttttatttttatttttatttttatttttttgagatggagtttcattcttgttggccgggctggagtgcagtggcatgatcttggctcactgcaacctctgcctcctgggttcaagtgattcttctgcctcagcctcccaaatagctgggattacaggaatgcatcaccacgcccagctaattttgtatttttagtagagatggggtttcaccatgttggccaggctggtctcaaactcctgacctcaggtgatccgcccgcctcggcctcccaaagtgctgggattacaggcatgagccactgtgtccggctggaaagaattttaaagagtgtgaagagacaaaggactcatgtctggaatgtatgaagaacgctcagaactcagcagtacaaaaagcaagatcctatgagaaaatgggggaaagacaggaagatacatttcatcaaagaagatacatgaagacaagcaagcacatgaaaacatctttggtatcattagccactagggaaatacagattaaagctacagtgagagcatattatacacctaccaaaatggctaaaatattttaggttggtgcaaaagtaattgcagttttttgccattactttcaatgtagtggcgagatcttggctcactgcaacctccacctcctgggcccaagcgatcctccgacctcagcctcccaagtagctgagactacaggcatgtgccaccacgcctggctaatttttgtattttttgcagagatggagttttgccatgttacccaggctggtcttgaactcctgagctcaagtgatctgcctgccttagcctcccaaagtgctgagattacaggcgtgagccactgcacccagcagcagcttcttaaaacatgaaacacatacttaccatatgacccaacagttgcatcccgggcacttatctcagagaaatgaaaacttgtgtcctcacaaaaacctatacatgattgttcacagcagctttatttgtggtagctccaaaccggaaagaaccaaaatgtttctcagaatgtcccacgtcagcttcctagttttgatattgtactgtaattatggcagatggaaccattgggagaaactggatgaaggatactagggacgtctctgtactatctttgcaacttcctgtgaatctataatcatttcaacacaaaacgtcttttaaagagtgtagaaaaactggcagtttcagacactggatatgcaaatgtgccttggcaaaacactttctggaaggttatttggcagcatgttatcaaaagccaaatccaattctataatttatttttaaaaagtcatggagagatataaagacatatgtataaggatgttcatcacaatattaattacaatgggaaaaattggaaacaacctagatgccctaacaataggaagtgattaaataatttatggtacatccattcaatggagtaatacatagctattaaaatgattagcacgttttctctatatgtgtgtgtgtgtatatatatacgtgtgtgtatagatgtatgtatgtgagtatgaatagatgtttgcaatgtataattgagtgaggaaagcagttagctgaacagtatgtacaataggatctttttctttacttagtaaaagcattcgtataattaagttatatatgtctggaaaaaaattttttttgtcgggggtgtgggacagtgtctctatcacccaggctggagtgcagtggcacagtcacagctcactgcagcctcaacctcccaggtttaggaattccccctacctcagcctctcacatagctgggaccacaggcatgcaccaccgcacctggcccatgccctgctaactttttttcttttttcttttttgtatgttttgagaaaaggtctggctctattacccaggctggagtgcagtggcatgatcatggctcactgcagccttgacttcccgggctcaagggatcctcctgcctcagcctcctgagtagttgggactacaggcatgtaccaccacacccagctaattttttttttttgtttttttatagagacaggctctcattttgttacccaggctgctggctaattttttttaaaaactttttgtagagacaaggatctcactatgttgctcaggctgctctcgaactcctaggctcgagcagtcctcctgccttggcctcccaaagtactgggattacaggcatgggccaccacacctgacctggaaaaataaaataaaaatctgcaccaagatcttcacaataggtattttcaggcagtaggaatttggatgacttttttccctttgcctgacttttctttctttcttataatgaacatggattacatgtgtaattaaaaacatgcgcagtttttaaagtaggtgtctggtttctttcatcttctccaccctcactgctctctccctcttttgccttagatggtgtcgtgttggttgatcctgatcttgtgaagggaaagaaaggtgagatgaagccccttgtctcaggctggtttctgggcggagtggactgctctctgggcggctctgggaaggggcatttacatggaaggagagacaggaaggcagaggcagcgctcttgcacatggaaccagtgccaggcccactgacccacactcctgtacctaattcacgtgacataggtcctgttgacaccagagctcactcgctcagcaaagtcattgtccagggtggcagataagtagatggtagacggagcccaggtctgtggcccccattcctgtttgctcgcccctgtttcatgtacttctgtgctaggggcaaactcaggagggtgcctggggtgcctaggactcaggaggacacaagaccttgaatgaatgaggggcgagtgagtgggcagtgtttcttctgagtcagtggcgaggggcagttaccgttggggctgacaggcaaaattctcaaccaacaccaaaaagggggaaatgatgcctgctgggggcagggggagtaagacccagaatttattatggtgcttacttcgatggttctgaaccagtgtcacggcgcccttgaagatttctggcagttttgatgtgtgtggtaagtaatttgttactaataacagttgcataaaccaaattagaacagattccagctatccttgtgataatgtcactgactcagttccattctaaatatgcctttttgagtgttgctactggcaacatcaaggaattgttcagaaccctggatgtgccactggaatacgtcagctatggggccatcagcattgagggggcatggctgaaatggggccccaaacggccccctctgtcctctccaccttcctcctgggtgccctgctcctctctggaccaggaggcatctggtttgagccccgaaagcccaagtccttgaccagagaagggcgcctgttctcagggaaagccactgcacaggacagctgtcaaaccacgtggtctctgggcaccttcttagtcctgagcttgaatgaggggcgagtgagtggccactgtttcttctgagtcagcagcgaagggcagttacctttggggcttgcaggcaaaattctcaaccaacagctaccacgcacttggcggggccgcctctcgtgctttatatttgagaaatatgtgcttcgtgtcttttttagaaggtgtagtgaacttcatacaattcttctggtctactgggcgcacacttcaggtctgttcaacaagtagaattttcagaagtgggggtttagagaatgctcagtatgtttcagagcagcgtgaaaaggaggctggaacttgagccttctcaagttggatttcacctccccatgtggcctgtgagccttcaggctcctcactcagcccacgattgaccctggcccacatctgctttgctgcccagcgctgtttccctctgcatcttaccttcttccttcattcgtccagacatcctgccctctagaacctgagcagccagcactgtctcaaagcctctgaggccacagagctagggaatgaagggggcgggcaggatggaggggactgggtcctctgtcttcagatttctaccattctggcaacatgatacaattgggaggaagatgccaggatctccctttagagcggtgaaccctcatgaaggggctgattctccagagtggtgtggagtagctgggtggcagggttctctccaatcccagcccctatcccctccagatgctaaaggttgaaaacccgtgttcgctgcccattccgtcagtggtggtgggtgccaggccgagggccaagtccgaccctgccttcatctcccttgcagtgtatgtcactctgacctgcgccttccgctatggccaagaggacattgacgtgatcggcttgaccttccgcagggacctgtacttctcccgggtccaggtgtatcctcctgtgggggccgcgagcacccccacaaaactgcaagagagcctgcttaaaaagctggggagcaacacgtacccctttctcctgacggtgggtgactcctccggccagccctgcttccttcacccgcagcaccttatcatgtggatgggggcaaaggaaaggggatagaggaagaacttcacatctgcaggcctggaaattgcacccttgaaagaaattctagattgcatggtctgtgattgtctttttttaagtccttgaaaatagcctcttagcctttgaagacaccctttcaacctaccgtttacatatttcccttgacccgaccccctaattacatgagcacgtgttattcctttgcttgctaagctcgaaaaagaaagctcacagaaatgcccctcggccctggggagttctaagtaggaaagggttccctacaggacaggagagcttagcgaagtaagatgtcatctttttccttgcccacagcttgggggatcacaggagatattttcatctctctgggggcccgtctgtcatccattgagacctggctaccaacggtgccagcgtgcaaactctctgaagtcttgggcgtgagctcaattgggggaagctaccatctgctttacgagcatgtttatttgtcttaagagaatatacacttccaaagttacatggttcagccttaaaaaggaatgaaattctgttctgtgctacaccatggatgaatcctgaatacattatactaaatgaaaggacccagacacaaaaagacaaatactctatggtttcacttacaggagatacctggagtaatcagattcatacagacagagacagaatagagcttcccacaggctggggggttggaggatggggagttggggtttaatgggaacagagcttcagattgggaagatgaaaaatgttctggtgatagatagtggtgattactgcagaatggtgtgaatgtacttcatgccaatgaaccgtacagttaaaagagcttaaatggtaaatttgatgttattctatgtttatcacaactgttttacaaaatcacatttacaaaaaagttataaggtcctgggtgctcccatgtacctgtgctgggagtttgaagtgacataaccttttagagacaatatgtcaacacgtattgaaagccttaaaacgtgtgcttctccgaggtcaggagattgagaccatcttggctaacatggtgaaaccccgtctctactaaaaatacacacacacacacacacacacacacacacacacacacacacacacacacattagtcaggcgtggtggcgggtgcctatagttccagctacttgagaggctgaggcaggagaatggtgtgaacccggaaggcagagcttgcagtgagctagatcgcgccactgcactccagcctgggtgacagagcgagactctgtctcaaaaaaaaaaaaaaaaaaaaaaaagtgcttctctttctagcagttcagcttatggaattaattgtctaaaactgatttattacagcattgtttgtaatggcaaaaaagtaaagaccacttcagtagccagcaaaggggactggctacgttaagtgtacattatagagccctaaaaaggatgattcagaactgtattttatgatgtgggaaaatggtcacaatgctttctgaaaagggctagaattaatgaagtgagtaaacagactacagaacgtgatcatcactttgtcccatttctgtaaaacgtcttctcacatatacatatttgggcgtggccagttgcagtggctcacacctataatcccagcactttgagaggccaaggtgggtggattacttaagatcagaagtttgacaccagcctgggcaacatggtgaaaccccatctctagcaaaaatacaaaaattagctgggcatggtggtgtgtgcctgtaatcccagctactccactgcactccagcctgggcgacagagcaagactccatctcaaaacaaaacatacatatttatgtgtacaggcaggaaattttgggaaggttatgttagcaatatgtatttgggtgtcaggagtataggtgaatgtgatttttcttttttcttgcttatcatctttattttctaatttttacatgattatatattacttaatggaacagccccttctgaaataaatgattttttatttgtttctttccacagtttcctgactacttgccctgttcagtgatgttgcagccagctccacaagattcagggaaggttagttcaagaagaaatgccatggttttatggatttgttcattccttcaatagacttttttattgtttttgaaacagggttttactctgtcaccaatgctggggtgcagtggcgtgatcttggctcactgcaacctgtggtttctgggctcaagtgattctctagcctcagcatcctgagtagctgggactacaggtgtgtgccaccatgcccagctaatttttgtattttgtgtggaggcggggtttcaccacactgaccaggctggtctcaaactcctgaccacaggtgatctgcctgccttggcctcccaaagtgctgggattacaggtgtgagccactgcactggctccttcaatagacttttttttttttagatggagtttcactcttgttgcccaggctggagtgcaatggcatgatctcggctcaccacaacctctgcctgacaggttcaagcgattcttctgcctcagcctcccgagtagctgggattacaggcgtgggtcaccatgcctggctaattttgtaattttaatagagatgggttttctccacattggtcaggctggtctcgaactcccgacctcaggtgatctgcctgctttggcctcccaaagtcctgggattacaggcgtgagccaccgcgctcggcccattagacttttaaagatagctttttttcatggaaaatttcaaacgtacccaaaagtagagagaccagtataaagatcctctatgaacccatcactcatcttcagcagttattaaccatgaacatccttgtgaacaaaatcacagagtcccaacccccatgagtctcacacattaaccgagagcaccaggtaaacccaaataacaaggaactacacggcatgccaggtggccacagatgctgtggagaacaagaggcttgtgagagacaaggggagtatctggtgggatgtgtgttgaggatgtttaaagccagtctctaatgaggcaaaggagaaagccacactctcccaggggagagccttccaggtagagggcgcacctcgcctggtgtgttccgggggcagtgaggaggttgcctgctgagtgagaggagcaagggatgaaagggggaggccaagtgcagtggctcaggcctgtcatcccagcactttgggaggctgaggtgggcggatcaacccaggagttcaagactagcccgggcaacgtggcgagaccccatctctacaaaaaatacaaatattagccaggattggtggcacatgcctgtagtaccagctacttgggaggctgaggtaggaggatcacttaagccctggaagcagaggctgcagtgagctgtgatcatgccactgcactgcgctctagcctgagcgatagagtgagaccctgtctcaaaaacaaacaacaaacaaaaaaagtgggaagctgaggttagagtggaaggggaggtgtggccagatcatgaagggccttgtcgatgttgtagagacttgagtttttgcctgaatgagatgggagccattggcaggctgtgaatgacaggcgctgactttccaaatggtcactatggccacagagttgagaacagagttgagatggccaagcatgtgctgtggggactgagggtgtgtgagagaggagtgagtcaggtggacggggctccagcatggaaggaggcggtggggacaggaggagaaggaggtgccaggacccgtgggttcaggccctctaagccactgggtctgggattcatgaggaagggagctacacagagaggcagtttctgtaactggattatgggatgggcagtgataggtgatgacaagggcagtgtttttgtcgcagggcatctgcgacatctgacccgttagtggttcgtgaaatcaatgtagtggatccaaaatggaagggaacagaatggaatggaatagaatagaacagacagggtgcggtggctcatgcctgtaatcccagcactttgggaggccgaggcgggcagatcacctgtggtcacgagtttgagaccagcctggccaacatggcaaaaccccgtctctactaaaaatagaaaaattagccaggcatggtggcgcgtgcctgtaatcccagccaattgcttgaacctgggaggcggagattgcagtgagccgagattgtgccactgcattccagcctgggcattagagcaaggctccatctcaaaaaaaaaaaaaaaaaattagctgggcatggtagtgtgctacttgggaggctgaggtaggagaatcactcaaacttgggaggcggaggttgcagtgaactgaaattgtgccactacactccagcctgagcaacagagcaagactccatctaaaaaaaaaaaaaaatagaacagaacaaaatggaatggattggaaaatctcagagtatgtcacacatggtgaagctgaatatggtgtcaggagagttgttgcacgtttgtgtctgtttactgggctgtgttacaaatccaactttcagaacatctcgaagctagtggtccaggacaatggggtggggtgtgcgcagccaagatgggggaagatgaggtgattacagaagaagggggcacagaacaatggggaatggaattggttgtgttagatcttatagtgctctataagagagaccccaaattcagatttttaggtgacctttcttgatttttacaacactgtataggcccaacaaagcaccacctattttctgttctaggagaggagcaggtcttagcacagctgcagggcttcaggaaagtgggtgcgccctgagcccagggagcttgagagaagtgcctgaatgcctgggggcctgggggcttgacagctgagaagcccaggtgggcgagcagaacaggcgttggtgtggctcaacaacggccggctgatggcagggaaggatgcatatttattttccacttagagtttaggactgctatgattccctggttgcagaaccaataaatccgtgcctcatatgtcaccatggacagagctggcttcctgtaatttttgccagctctactttcccctccaggcagtggtggagggcaggccggtgccctcctctggctccccaacgcatgtgaacgtgcagagatgagggaggttacaaagggcttgcactgggggccaggggcttcacacactgggaatcgggggaaggtcactggcagatccgttcattcagcccacacaatgcttaaaagtctttttatttaatttaaaaactaggagatttcactccaaattccacgtgaagtttcttttttaaaaatcaagctggctgggcgcgatggctcacacctataatcccagcactttgggaggccaaggcaggcggatcatgaggtcaagagtttaagaccagcctggccaacctagtgaaaccccaactctactaaaaatacaaaaatcagccgggcatggtggtgcacacctgtaatcccagctactcaggaggctgaggcaagagaattgcttgaactcgggaggcggaggttgtggtgagccgagatcatgccacttgcactccagcctgggcaacagagcaagactccatctccaaaaaaaaaaaaaaaaaatcgtgctgcccgcactgggtgccttgctgcctggccacatgaggctgccgctgaacagcaggtgaccatgggggtcagggtttccataccctatcagggcattcctggaccccagcgctggccctgtgagtgcctgtacctctggcccctgctgtaggcagtggaagtcagtaagatgcatgggatcacagttggggacacctaagtgtgcaaggtggcaggaggcaaggatagccaggatgtgaatgactctccacggcagcaggagggctcatggggcaggtggatcccctccctctgggggctttgggcccatggcacactccttgcgctactgtaattgtttcactgtcagtatgcttccaaatccctaaatggtgcaaccccgaataggacatggccaagacaaaaagagatagtgccacatcatgtgccctgtgtgaggtgtggccctctggcccggcacccagggagggagtcgctgatcgctgcctgtctgctctctctccccaacagtcctgtggggttgactttgaggtcaaagcattcgccacagacagcaccgatgccgaagaggacaaaatccccaagaagtaagagtatggttgcggaataggtgaggggtctgcggtgggggtggagagaagagacgacctccaccttgtctctgtgggacagacctcttcccatagggctggcacggctggggtaccatctgcatgtgggatggaggtcaaaggttgatcatttttggggaaaaaaaagaaaacaagaaaatgacagggaagttagcaacctccagggctcacgtaagccccgaaaagctcccgggtttcccctttgttgaagttttgttgttgttgtttgtttgtttgtttgtttgttttttgtggtaaaatgtacacaacatgaagtttgccattttaaccacttttttttctttttttcttttattttttgaaatggagcctcgctctgtcccccaggctggagtgcaatgtgacctcggctcactgcaacctccgcctcccaggttcaagcgattctcctgcctcaatctcccgagtagctgggattacaggcgtgcgccaccacgcctggctaatttttttttttttgtatttttagtagagatgggtttcaccatgttggccaggctggtcttgaactcctgacctcaagtgatccgcccgccttggcctcccaaagtgctgggattacaggcgtgagccactgtgcccggcccattttaaccacttttaaatgtaccattcagtggcttaagtacattccgaatgttgtgtagccttcaccgctgtctatacccaaaactttcccattgcctgagcaggaactctacaaccattgagcctaccgctccatccttcccattctcccaccccctgtgctgttttttttttacctaaacaagatttccgcctggcccttcgcactgtctccttgtgccccatgtacacatctctggaggcgcaggatagtgagctgcagtaatggagctcgcatgtatatggcagctattccatgaggcccttgacgccctcacaccttagccttgctgacaggaggcagagctgggaatccacggagcctaaggggctaagcttggccctcgggatgttgcctggccccacagcttcccccacagggaagggaccaggacccagacccccaggctcttccaccgtcagggctgcctcaggctctgaccagtgtcgttgccctcttcccgtccaccctgtctccatggggagcattcctggagaatctccatgtgacagtggggagagaacagaagcctccctaaagcggcctgggtgccaatccctggcttgtctgtggctgtttcccacaggagctccgtgcgattactgatccgcaaagtacagcatgccccacttgagatgggtccccagccccgagctgaggcggcctggcagttcttcatgtctgacaagcccctgcaccttgcggtctctctcaacaaagaggtaaccacctaccatcgctactacccgcagggcagcaggcctaggggcaggccccacacccctctcttcaccagccccagcccttaactacatgggtgccttgcaaggaagcttgtttctaggataaagcaccaacatgcgtaagtgactggcctgttttcacagcctggagctggtcagcatggtccttagaggaggacggaactggcttgcgttccacccactggctgtcccgagggactggggaaggaaggggcgctgcttttcacatacctgccccccagctgtccttgtcctgtccacctccatgggccttgttcactcatggagcatcaatagctgtggtatcccaaattcttcacttcctgggaaatttaagttttgcagaaaccatgtgggatggcagtgtcacctgtgatgtcatctcttaggggtgtcatggtgggaaaaggtgagagctgctggccaaggctggctctggttcctctggtcagcagtcagccatttgtgcactgtgtgtatacacgtgtgtgggtgtgccaggggctgtgttacacgggctctgctgggtgggatgccagcacttggctttcccagtggtttcctttcacttcactcatcctgcccccataacctcctgacccctggcctcctccgatgtgatgatcggaactctgttcccctccccagcttcccacagatgggtggaatgtgtttcaggcccttccttagaagaaatgtattgctatcacttcatcttccttaaattctgccgcttttattccagtgaaagggattgagatgaatctagaaagcagtaagattaaagacaccgccacatctgttctcttcttctgacctatctgctgacttttctagatctatttccatggggagcccatccctgtgaccgtgactgtcaccaataacacagagaagaccgtgaagaagattaaagcattcggtaggaccttcttctcagaagtagagggcatagtcttctagaatttctgatcctgtttcctgagaggtcacttctctggtctgataaggcccttctgggtccttggaactggctacttgtctctgctgtcataggcagcaggactgcggagggagaaaggccttacaagttatctcattcaacttcctgcccacttacggctggtttttgtcttggaacaaaattcctggcaagtgatctctttccatggttatgccttcctggagggccccacagtgctcattgtggttgacagatgcagcacattgttgtgggtgaggcctaatttgtggactcatgctgtgggctctgtgatcccagctggcatccacagcaggggctccttgtctaccttcccaggctttgtgtggcttgaaggaggtcccacatggaagcgctttgtaaatggtgaagtgtgactgtctcggctcaaatggccatcatgtcatggctgaccttcccatatcctacaggggaggtgccttctgcctgttgttcccacacattaactaagctcaaaaagcatcaaagcacagggggtcttatataatggtcttatttggctctttcatgaggaagacatgatggaatgacctgtgagggtaacctctaagttcactttttaactcaaacattcaatgaccaagacaaagttagacttatgcatcttggggtgactgtcccagggcccaggactgaggatgtggaacttccagtcctaaaatgggctctcccgggcaagccagggtgagcagtggccctaggtgtcatataccacttttccctgtgagtcatcacagatgagggtcagaaatcctgatgcgtgcagactaaggaattctagacttttccctccctcccttccttccttccttccttccttccttccttccttccttccttccttccttccttccttccttcctccctttctttcacagtctccctctgtcacccaggctggagtgcagtggtgtgatctcggctcactgcaacctccagctcctgggttcaagccattctcctgcctcagcctcccaagtagctgggattacaggcgtgcaccaattttgcctggctaattttgtattttcagtagagatggggatttcgccatgttggccaggctggtttcaaacccctgacctcaggtgatccatccgcctcagcctcccaaagtgctgggattaccggtgtgagccactgcacccggatagctgttaactttttaaaaacaaaatattaattgctttctataggctgggcactgtactgcatgccttgcacaaattgtttctttatcctcaaactttggctgagtgcagtggttcacgcctgtaatcccagtactttgggaggccaaggtgggaggatcccttgagcccaggagttcaagaccagcctgggcaatatagggagaccctgcctttattttttaaaaaaatcctcaagcttaattttaaaggtgattaaaagtcatctttttaatcatcacaacgtccctatgagttagatgcaattattacccccattttactgatggggaaactgaggcttagaatagataaataattcaccccacagttagtggctaagccaagattggcacccaaacagcctggctccaggcccaccttcctatccaccacgttccacccaccaaccagtcctgtactgcctctagctagtctcttggaggacaggaaggacaatgttcatgaagtaagatggaggatgttagaaagggctgagcaggggaaaggaggggtctcccaggagctgcagccttaggggacatgggtgggagttgatacagagcaggttatgggtgaccagaaatggcctggagacaggacttcaaaaccccagccttgaagctgagggctgagaaagcctagccttggaagtggagggaaaccatcatcagagaggagagaccagcgtgtaccctgggaggccgcagggaaagtgcacgtgttgggggaccagtgctgaccaccggactcccgtcttccccttgcagtggaacaggtggccaatgtggttctctactcgagtgattattacgtcaagcccgtggctatggaggaagcgcagtgagtagctgttggggtttccgtttcctgggcgtctcagccttctgtgtcaagtttctcgccgtttattgctgaagaaggaactagaatgttcagctagctcgccagccttccacttccttcctctttctcccttcgagggctgcacagaaagttagcatcttagctctgcatctaccacacccctctgtgcccatcttacaggagttctgaggattaatgcaagccaaagaatgacgcagaggagagaaataaagacagaaatgtcaccatgggatcagctggctttttctatttatccttggaatgaattgttaggaatttggtactatttccacctcccagaagatggtcaaatgaactgtcagcccaggctaggattccctatcttttgatctcaaattgaaatcttataccagtgacaactggattagaatatatctgttcttagcctgttgttgtgaatgacttttcccctttgttagaatcaaaaacaaatgagaatcctgccatggttcctttatgctggcctgagagacctgcccagctttgctgtgtgccacaaagtcaaatagattcatttaatacatggcttggagtggggggcgatgatctcccacctccagccccccgagaggatagctcgaccaggtcttaactctttgccttgctggcatgttctaagcaccgttgtatgtaaaaaatattatcagggttagaggaaggttagggtaggggaatgatgaaagacaactgattccttaagataatataaggtaatagatagatttttttgagatggagtctcactctgttgcccaggctggagtgcagtggtgagatctcagctcactgcaacctccaccacccaggttcgagccattctcctgactcagtctcccaagtagctggaattacaggagcccgccaccaagcccagctaattttgtatttttttttttttttgagacggagttttgctcttgttgcccaagcaggagtgcaatggcgcgatcttgactcactgcaacctttgcctcctgggttcaagtgattctcctgcctcagcctcctgagtagctgggattacaggcacacgccaccacccctggctaattttttgtatttttattagaaatggggtttcaccatgttagccaggctggtctcgaactcctgacctcaggtgatctgcccacctcggcctcccaaagtgctgggattacaggagtgagccaccgtgcctggctgattttgtatttttagtagagacagggtttcacctgttggccaggctggtctcaaactcctgacctcaggtgatctgcttgcctcagcctcccaaagtgctgaaattacaggcgtgagccaccgcacctggcctatatgggaatatttaaaaggcaactttaggagaaactattactgttattcaaaacagattcaaactgtaggtctacaagggagggagacaggaaagaaccaccactcactgcctcctttctgccaagattgggctctgttctgcctttaggggatcctcgcacatccctgtgccctggaggggtcttggccctggttcacctttcctcatgtgctcagcaacatgggagcaaaggatcctggctgagttttcccctaatatgtattccatcacctggtcctctttcaaagtgttgggtgcattttgggtcaaagattcccaggaaactggaaagcattccaaagtcccccaaaggctggaggagcctgggagctggactggaccatgctgacaagtctgaagctagaggccactcagaaagctgcagagcaggagccatcgtcccagagccctgtggcttctggggctttagtgggcaggcttccacggaaccaggacagacctgactcccaagctgctccccaccatccaaacccacatcctgaagctctggggagtggccccagagccttggcatagtcctttggcaagctctgcacaaacacaaaaagtccatcctctgagcccaaccccaagggccctcttcctattccagccatctttacaatgctgtttctgcttttttcaatgctcaaattacgctcattaagagaggttccaccaggacccagatggtaggatgtgggccaccttgggctctggcagatttctgtaaagagcttcctgtagacactggaggcaggataggggacagctgcttttacctatccagggaaacttgattagggaaaggaagtcctttcccagagaggcagttcagacttccagctgtctcaggacagccttagaatggtcctgatgctggccacaccccaccttgttctggctaggcacaggatggagggtgtgcttccggcacgaatgggctctgctgtcagagagtgtgcagccacgtgactgtgggcacacttcccgtctggaaaatggggatcttggagcacctgcttggtatggggttgatgagggtaaggtgagagttttgaggacaggccttagcacttggcctggcacacagcatgcacgtgagtggaggagccaactctccagccgcagaggctgcttcatgatcctggccatgctgccgtgtgtctgcctggagaaacacacattgctgtgtccccagctggatcccagacccgcctgttggcacagggtctccgccatctgtcagatgttgagaaatctataccccgactgatgatgaagaagatccagtagagaaagagcatgtgctgctttggacccaagctattcggtctgtgtgatccacaaattgtgggtccctgcgttgcccctctagacaacttaccacacagtcacactgtgacccccttatagtgacagtttttggtgacaagaggctttctggcctggactcgttgctgacaccaaccagaaggttctgcaggccaccgtgtggttcacaaagtctcaggaggaggctgtggtctctgactcttgagccagtttgtctcattaactccatagaacattctagaaattcagcaattcagaataggctgagttgcttgaagaaatatcctcctgttgctgccagcccaccctgagatttcacaagcactgttctgcttctcgtaagtcaagttcccaggctcttgaacccaccttcccaggaggtccatcaggggatgtggatcctggaaaatgcctaatgtcaaataggggctcatggggtccatggcagctttgatggttataaatctcctctgttcttcttcctctagagaaaaagtgccaccaaacagcactttgaccaagacgctgacgctgctgcccttgctggctaacaatcgagaaaggagaggcattgccctggatgggaaaatcaagcacgaggacacaaaccttgcctccagcaccatgtgagtcctcgaggctcagggaataagccctggcagggcgggctggtgctggtctgcttcccttcacatcaccctgctgggctcgcaggcacgcacgtgcagcatggtggtctggcgtgtgtagtgtggagtgcatatctacgggcccacacaaggatcccactctcacccctggtgtgatgtgggggttacacccatgggccttggagacagctgtgcgctaaccccagctctgctgctgaccctgggaaaacaccttgagttctctgagaacctcagttttcctgtttgtaaagtgggggcggtaatagttcaagtctcatagagtgattataaggattcagtgagacaatccatgtgaagcgtggggcctgacacacagagagtgctccaggaatgtcagctactgtttttagaagtatcactagctagtgtggtgccctaagcatgtaaactgagtaatgctcttggctgtgttcattcattcattcattcattcgtccatttccatcaggaattgtaaagaacaggaggtcctaatgactttagatgtccattaaatttaaatgaaactaagtactgatctgctgaccctgactcaaaggacgactggctgaatttgggcagcagatctagcgaagactatacagtgaagttcccaagtcagcgtccactgtccttccaagccacgcttttgcgcttcccttcccgggagcatgtctgtgggctcaaggcccactcactgccacctccccatgtgatatgctgggggttccctctgtggccccagtagaccacctccgaggtgatgccaatggctgggagactggattgtttgaccccatgactccgatgctcagtagctcacactctctgagaccaagagtggggaacagtgaacaattggcagaaagcaggtggaagtcaaaggattttctgaggataattggccaagttactgtgttagattctaaagcacattcgtgaagctccgggagagagaatatcagggaaactgagagcctagatcaatgtattcaagggcgtagggatcgtaagatgaacaatgatggctcaccacactgtgggaatgtttcatggtgtgtggactagtttctaaacatgtacgactcggccggccatgatggctcacacctgtaatcccagtactttaggaggctgaggcgggtggatcacctaaggtcaggagttggaggccatcctggccaacatggtgaaaccctgtctctactgaaaatacaaaaattagccaggtgtggtggtgggtgcctgtaatctcagctactcgagaggctgagacaggagaatcgcttgaacccgggaggcggaggttgtggtgagtcgagatcgtgccattgcactccagcctggtgacagagcaagactccatctcagaaaaaaaaaaaaaccaaccaacaaaacaaaaaaatcatttatgactctccacacctccatgaggaaggtatatttatatgcattttatgggtaaggaaattgaggttgagccagaatgaaagacttatccaaggtcactgaatcagttaatagcagagcaaagtccactccacagcaaatctcccagcccaggaagatgccaggggttctgacttgcagggtgttctcaggcacgtggcagagcatgttcagttcagcagctgcttggccccattcagcgcaaggtagagttaatctcagctgggaggagtagctcacacctgtaatcccagcactttagaaggccagagtgggcgaatcgcttgagcccaggagtttgagaccagcctgggcaacatggcgaaaacccatatccacaaaaaattaaaacattagctgggcatggtggcacgtgcctgtagtcccagctatttgagaggctgagatgacaggatagcttgagcccaggaggtcgaggctacagtgacctatgatcatgccattgcattccagcctaggtgataaaatgagaccctgtctcaaaaaaaaaaaaaagtcaatcccagcaaagagggggatctcaagcttgtaccccttttttccctttggaggtatcctctcttcaccaggtacttggccatactccgcaagtccagataaagatattctgtcctcttttaaaaattatttttatttttttttgagataaggtctcagtctgtcacccaggctggagtgcagtagcgcgttcttggctcactgcaacctccacctcccaagttcaagggattctcctggctcagcctcctgagtagctgggattagaggctcccaccaccacgcctggctaattttgtactttcaatagagatggggtttcgccatgttgtccaggctggtcttgaatttcctgaactcaagcgatctgcccgcctccgtctcccaaagtgctgggattaaaggtgtgagccacgacgtctggctattctgtcctcttttaaatgagctccagacgccagtgagctgaaggagctctctggggagcactgtggtcctggaaacacgtgcttgagacacctcccctcagaggttcccgagctgacgtcttcttccaggcccagcacctgctggccgccgccccaactctttttccagagctgttccatccttccctgccttctgcctgtagccttcaggtttcttgggctttttttctatcattatttacatgatttttgttagcatttcatgatttttttcatatcttaattcctgttattggacatcctggagtactcatgtcctccgcgttggatcccacgcgataagcatctgtgatgaaatgcccggcacagtgcctgccagatagtagaacttcagtacgtattagtgggatctggaatgacatttctgtcaaggaacgtcacattgcactgtctttggggcacatctgagggtctcgcacatcctgctcattcacttaaacattgacagctctcacttggtgccaggtctgatgctgggtgctggggacacacagctggatatcttggaaggcaggagagaaggagggggcattctggtgcagggttgtgttggcaagactggcgcggggggcgctgggacacagctgggggtgaagtagcaaaggcaggccagggcagctcacaggctgcttctgaggctgaacctgcagatggccacagagctcagagaaggggcctggcacgtgggagatgagttactgagataatccaggcaggcaaagcctgctggaggacttggggacttgcagttttggcaagtggtaggagggagttgctgaggaggatgaccgggggatgtgcatctatagaggtcaagcacagagaagggggttgcatgctctgccctctgggaacttctagaggagaagacacaggaattcctccagtgcgtgcaaggagtccccatacccactccccaagtacatgaacttctaggactttggaagctcagtgagttcaccagtccctggagaacctccatgacggcatgcctgcctcgaatggaaaggctgcccatctgctcttcaccctcctctgctctccatcattctccttttcccttctgtttgggcagcattaaggagggcatagaccggaccgtcctgggaatcctggtgtcttaccagatcaaggtgaagctcacagtgtcagggtaagtgtcccggcaccaaccctcgggctgctctgtcctggtcttagatggtctgaacttttcctttcctgaatgactgggagacagaaagcaaggaaaggcccatagcttctaccaaggattaccaagtagagcttgggagagattctgtttgtctagtaccatgcttctgtctgataaaatgtcaggtgggaaagggtggagaagcagactctgaaatgtgtgcattcttagcgccactttgcaaaaatacgtgtgcatatgtgcatgtggtagaagctgatgtgcaagaatgaggattagtcaaatgttatccttcagaaaagaataactgctgtgaaagaactctcagtaaatcttcatgtttttgcatcttagaaggtatccatccataaagtggggactttcccctcccctctcacacatgtaatcacagggcacaggagtcttcttttcatacaagagtgccaatatctcagagttttaagggaacaggtttccactttcattttcatgtgaagccagtttcttccatttgtttaatcttaccaaaagggaaaaacttgaattctcattttcgtttcaaattccattgccaaaggctctggccttttacctggatgagccttgggtagttctgccatcaaaggcaagtctgtgcctaggtttcatacttctaagtagtaaagaattcccttgaggaaaataagcgtttaaaaagagtttcccaaatttctaacaaagtagaacatgggtctattttgcatttttcgttagcatagtgtttttttttttttttttttcactgtggatagtgcataaaaggatctaaaaacagggtggagtttcttttagcagtcaaggaaagcaaccagcaggtatttcacaatgacctcttgtgacttatcttgaatgttagggcttgactttttttttttgagatgtaatctctcactctggagtgcagtggcatgacctcggctcactgtaacctccacctcccaggttcaagtgattctcctgcctcagcttctgagtagctgggattacaggtgcccaccaccatgcctggctaatttttgtatttttagtagagacggggtttcaccatgttagccaggctggtctcgaacttctgacctcaagtgatctgcccacctcagcctcccaaagtgctggattacaggtgtgagccaccgtgcccagccaacttttttttttgagacggagtcttattctgtcacccaggctggagtacagtggcatgatctcagctcactgcaacctccacctcccaggttcaagcaattcccctgcctcagcctcccgagtagctaagattacaggcgcctgccaccatgcccggctaatttttgtatttttagtagagatggggttttaccacgttggtcaggctggtctggaactcatgacctcaagtgatccgcccacctcggcctcccaaagtgctgggattacaggcatgatcccccatgcccggcctttttaaactaatcatcttgagaaagagatgaagtcacaggtaatgaagttgaacattaagggatgggaagaccctggatgttgtgagttcgggtgcaagggccatgagagctgggctgtgtcctgcctctgaatcatgggaaagggtcgtgttaccactgtgacagttaacgacaggcgtttgtttgtgttttctagctttctgggagagctcacctccaggtaagcctgttcaccttccttgtttgattgtttctcaagatatcaaaggcagcaaacttggggctccaaaacggtttctgatgaaagctgctttctggacagttgtgctcagaggtgttaggaatgatgctttgccttcggatgcatcacagaaccgtggctcataggcgtttctttgggaccagatttctttgggaccacagctagacctatgcctgggtaaggacacacacatacacacccagaaaactggcacactccatgcagccagcttgtgtgtgtgtgtgtgtgtttgtgtgcggtaaaatacacataacataaattttaccattatattatttattttattttttgagatgtagtctcactctgtggcccagcctggagtgcagtgacgtgatctcggctcaccgtgacctccacttcctgggttcaggcaatcctcccgcctcagcctcctgagtagctgagattacaagcgtgtgccacaacacctggctaatttttgtatttttagtagagacggggtttccccatgttggccaggctggtctcgaactcctgacctccagtgatgatcctgccttggcctcccaaagtgctgggattatagatatgagccaccacacctggcaaattttaccattttaaccgttttgttttattttattttattttattttgagacagagtcttgctctgttgcccaggctcgagtgcagtggcatgatcttggctcagtgcaacctctgcctccttggttcaagcaattctcctgcctcagcatcctgagtagctgggattacaggtgcacgccactatgcccgactaagagctgagatgatgcagtacataacctcaatgcctgtctcaaatgtttcttaacttgctgctgcttcgtgcataatttaaaaggcagctgtcactatttgcaataccaaaaggtagaaacaacccaaatgtccaccaacagatgaatgggataaacaaaatgtggtatatccatgcaatggaatattactgagccataaaaaggaatggagtactagtacatgctacaacatggataaaccttatactaataacactacgctaagtgaaagaaaccaataacaaaaggccacatattgtatgaatccatttacacacaatatccagaacaggcaaatctatagagatagagaacagattagtggttatgccagggactatagggagggaaaatgagagtgactggttaagggggatgagattttctttttgggtaataaagatgttctagaactagatagtggtgatggttgcataacagcgtaaatgtatttaatgccaccgaattgtgcactttaaaatgatgaagctgggcagggtggctcatgcctataatcctagcactttgagaggctgaggcaggtggatcacttgagatcaggagttcaagaccagcctgggcaacatggtgaaaccccatctctactttttaaaaatacaaaaattagccaggccatggtggcatgcatttgtagtcccagctactcgggaggctgagataggagaattgcatgaacccaggaggtggaggttgcagtgagccgagattgcgccactgcactccagcctgggcgacagagcgagactccatctcaaaaaaaaaaaaaaaaagttcccactgcattgtctttcagcttgggcctggggatcttttgtgactctccgcagccataggtctttgctgtgttacttacaattgtgtgtatgggtgttcacaccaatcttcattctttttttctagtgaagtcgccactgaggtcccattccgcctcatgcaccctcagcctgaggacccaggtcagttatgtccttttttagctttctttaattatttgctacttgcagatttattgttgatgtatttctagtctttcttgaccgcatctcagagcatgggagtggccaggtgtaagagattccatgtgatctacaaggtgaatagtctggggggaagggagggcccatctgttcagcgctgagccgggtagattatccaccttcagctggagtctgcaagatgtagcatccttgctcttggacagggacaatctcgtgaggttttatcatgaatgatttaagagcagaagctctgctgtcaacagacctggatttagaattaaagatgatttaggtaaaaacttaattttagagcacgaggattttgcatttcatttggaaacaaaaggcctcatgtttcatttgaaagcattaacagacatttaaaagaagataatttttttttttttttgagacggagtctcactctgtcacccagtctggagtgcagtggtgtgatcaagcttactacagcctcaacctcctgggctcaacccaccctcctacctcagcttctgaagtagctggaactacaggcataccaccacccttagctaatgtttttgatttttagtagagatgaggtcttgccatgttgctcaggctagtcttgaactcctgagctcaagtgatctttctgcctcatcctcccaaagtgctggggttacaggcatgagccactgcacctggctgaagataactgtttttttttggggttttttttttttttttttttttctgagatggagtctctgtcacccagctggagtgcagtggcacaacctcggctcactgcaacctctgcctcccgggttcaagtgattctcgtgcctcagcctcctgaatagctgggattacaggcgcctgccaccccacctggctaatttttgtatttgtagtagagacggggtttcgccatgtcggccaggctagttttgaactcctgacctcaggtgatccacccgcctcagcgtcccaaagtgctgggattacaggcgtgagtcacggcgcccggcctgaagataactatttttgacagtggcagttatggtaagaatacagaaaatactagaaaagagggtcaggctgggttcctgacacctcagctcatttgaattataaatctactggctcttgtatggatgcgaaatgatgcaatagttgtatgactctgaaaacatataaaaaccactagactgtcgactgtgaaaaggtaaattgtatgatatatgaatttgatctcaatcattctctttctaaaaaggtaaatgaagcagcaaaaataatataggtgaaatctcagaaattctgaagaaacattctctgcatcgaggcagcttagttgacgggaaagaaaaacagatctgtctaaatgagaactctccgtaggtataggaataagggatattttaagtaaaagtggtataaacaagcagggtttatttttctcatactttacaaatagcttttctatattggtagtgaaatgccgtttaaacattagaatgagcccccactattcattttaggttttgtctcaacagtactttgtttcaaaatagctcttccaaatactttggattcagatcctcaatgaacttttccaaaactgtcccttggagaaaaatgtagtccagctatatgttttcagttcatttatgcttgtgtcattaaaatgttactttttcatggtgtgggattaagatgctttctggttcctttcaaggacattaaaaagatagtcacttgaggagatgtcatagtttatgttgggttgttttctggaactttgagtagactttatgccttaattttttttttttgagacatagtcttattctgtcacccaggctggagtgcagtggcatgatctcggttcactgcaacctccgcctcccgagttcaagtgattctcctgtctcaacctcccaagtagctgggattactggcacgcgccagcacgcctggctaatttttgtatttttagtagagatgggttttcaccatgttggccaggctggtctcaaactcctggcctcaggtgatctgcccgcctcagccctccaaagtgctgggattacaggcgtgagccaccgtgcccggcctgacttaatttttttaaattcttttccatatacaactttcacgttccagtcattatggccttaacagtgaacatatcacaatgtcaggatgaaacaatgatcttttgtactgtgagatttctgggagcaaaggttaagacaaatcaccccatggttacaaaattctgatttctagagatatgagatagatatgagatagatgagatttctagagataaatgtcatctctcctgtcttctctgcctagttctcggctccctgagtctaggctggtaggattctaagcagagaaagcataagctatatgtagttaagccctgctggagcctggggaccaagtaatttgtgtgtaataagtgctgtgacatgctaccaagtttttattgtcccctgtcaagggcatctttactgaatccgaagatgctgatttgattcttccttgttgtctacctctgcaaggctgatggtcccgcttagtgtaatttcttcgctgagcactgtgggccgcagggtatttcttgctcaggggatgttttgacaagctagcctctctagggcccctgtacgtagcgaccctcatagacactccctcccagtgctggcttccaggtgggcaccagaggcgagagtaggggctcaccatcaaatcgccgctgtgctccccaaaactaggtgggcagaaagctaaaaaagtacaaaaaccattcaaattaatagcagttagtctggggatacaacacatgtgaaaacataactcaacaacaacaaaatcaatatgttaacagaaattgaaaactttgcggctgggggttggtcctcaagctttaatgcacactctaaccctggggtgctggtgaacgtcaagtcccaggtctcaggcctctgaagcctgacagatggaggtgccagggtgcacatgctcacggcaccctggcgaccctgacctcaatggggtcccgaggacatggaaggagaaatactttgaaaggcgaagcaactggctgggcagggaggccaaggcgggcggaacacttgaggtcaggagttcgagaccagcctggccaacacggtgacaccccgtctctactaaaaatacaaaaattagccaggcatggtggtgggtgcctgtaatcccagctacttgggaggttaagccaggagaatcacttgaacctgggagacggaggttgcagtgagccgagattgtgccacttcactccagcctgggcaacagagcaagatgccatctcaaataaataaataagaaaggagaagcgacatcagagggggcaaggctgatcagggaaagcatcctagagttgagactgggggggtttcatgtgaggaggtgaaggctgtggcacattgtaaaggaagcagtgatttaaaatgcaaggagaggccgggcgcagtggctcacgcctgtaatcccagcacttgggaggctgaggctggcagatcacttgaggtcaggagtttgagaccagcctggccaacatagttgaaaccccttctctactacagatacaaaaattagccaggcataatggcgcatgcctgtaatcccagctacttgggagcctgagacacgagaaactcttgaaaccaggaggcaaaggttgcagtgagcagagattgtggcactgcattccagcctgggtgacagagagagacagtctcaaataaaataaaataataaaataaaatataaaataaataaaatgcaaggagaaaagctgttccagtgggaaaggcagggaggcaggaattacacgcagtgatcatgaactgcatgtatctaggccttatctctcaaattgtaaagtcacctaaaaggtagacattttctaggtacagctatgatatagaatttagactaacaaatgtctctctctccctcttccctgcctcccttttattccatgcttacagctaaggaaaggtgagtgagcctcttgaatgtggccctgatttgtcctatgctctgggaccttctcctccagcacaaaaccctctttgagtctttgcacatatcccaagctctcctgccggctcaggaggcacatccgctacttcccgtctgctccctagtgcttacggcacgcacgcaccattacactgggtgtgcttgctcactctgcgcgtgcctttgttttctcccattggtgctagttaaaggaattttaaacgaagccttgaggaaaatggcgtgcccccatgttctatcatggggaaaaccttgatcagttccttcgttgcaaaaagatcaaggatcttgtttcagtttcagcttcaaagggcgtgcaatgatcaaaatgttgtttgttttattttagttatcaggatgcaaatttagtttttgaggagtttgctcgccataatctgaaagatgcaggagaagctgaggaggggaagagagacaagaatgacgttgatgagtgaagatgtcggctcaggatgccggaaaatgacctgtagttaccagtgcaacgagcaaagccccacagtttagtcctttggagttatgctgcgtatgaaaggatgagtcttcttccgagaaataaagcttgtttgttctcccctgg

SEQ ID NO: 678 - DNA, 215768 bp, Homo sapiens
tgttgttacattaaatttatttctcacctccattaaaagggtttttgctttggagttttgttaactttcgttctttggagtaataatatttctcttgtgtatggcgctgaatacatttgtcaataatacgtcaaaaaaaaaaacacttggcttcttaatacttggaaatacgtacatattccttactatgtaaaacactttatttattttgtaaaaatgtttaaatatgaataaaaatactgtaacccaaagtagttgcctacttttaaaaatgaaacttgtaaaaataagagggagcccaaaccacatagaaagtcttagtttattttggtagacttgctttttataggcattggtttaaagtgattcttttcagagacatcctttgagaagttaaaattgcagaggcttacgctttcttttatttcaaatatgcatagtgattaaccaggaataaggattctcccatgttctgcctgttaagagcaaacagatctggagaacggaagcccaccctgcctcccttttccatctgaagcagtgcggggaggctggctcctctctttgttcccagactccagggcaaggggcgaccatgctgtatatgctgtgccttgggggacccccagaggctgcgctctgtggcctgtgctcccccgacctgtgcacccgcaccccagtcggccacttgctctcacatcaggcaacgtcagcctgctgcagtgaaactcaaccacgattttcctttgcacacaaatccttcctacttccaccactccctagcagagttcccagtgccagagagcactgctggggtgggggtggggacaggaagcccagttattgctgtgttctattttagggggcacttcctcaagagtccccttgaaacccgttaccagcctggaagggaggatatcttgccttttacaaaatacggtcgatactcaatgcacagcctctaaaacaagggctactccagtgttctaaaagcacacgccaatcctgagtttagtgaccacattttaaagatcatcaggaaaatgccaagttcccattaagactttaaagctccttgagatcccaggttgcggggtgcataaatggcccaaatcggagagtgtgctatagcaggtagacaggtttcgctaacacgaacagctatcagtaaaatgcctttattcagctaattctatagaagcggagttttgagagtctttggttcatgtgaggcaaaatcaggtttatggaaaacgcagcatctgcttcaaggctgcttcatctctctcaggacaactgagtctcctgcgtgagggaggagcgcctgctggaaagcacagagcacagcagtatgcccggaacatctccatagcctttgacaaggccacacttcattagttttaatttgcagaaaggaaattaaatgataacattttttcccaaagcagagtgtccagaataggacttcagcttaaaacaaaacatagcatgtttttcattaaataacccccaaagaaattcaaaaagtgatgatggcagctctgagagagggcttgccttatattacaaagtctgagaaatgaaacctacatcgttagcctcgagatctttgtccctgatgatattctgcagatgccctctcaagggtaagtccattttgtaatttggggatggtgtggacttgtattttacttaagtttctaactaattttgaaagaaggcttgggcatttggagaagagtggttttttttgtgttttttgtttgtttgttttttgagaaaaataattctaattgaagcctcatttccaaaaattactttttaagttcttttaatgtttcatttccaaaaaatatatattgggtattttttcatagggctgtcctgtgcctggctaaaggtagacagactatactaaaaaccacaagtttctggaattagcctgactgggtaagacctggataaagatggtgctagtttacaatgaagggattttgttcaaagctgaaagctccatcaaactttctttccactaatttcagctgggactggaagagagaaaactggacaaaaattggccttttaaaaagctgaaaagtaatgagtatgattcataagttcaacagagataggagggacatggaaaaggcatggcgtacatctgggaatagcgaatgcatatcaaaaggcttcatttcttttgttctttcatgaggcttgtagcacatcaaattttgaatgtcttcttttaaagctatgtgcgcacacacgcacgcacacacatatgcgggcacacacacacatcctccctctgaactgatggtgtttagtatcgataacattttctttcttggtaatacgaggtaaatgaggggggcaaaaacttatgacttctgagtaaaatgccatgtcttctatattccgtgagctgcacagtcttgcaggaatgctccacatttcagagtaaatctgaaactggcttaaaagctccaaatcctcccttgtatgtggtatgagtgtgccttcatctccagctgtcagagccaaatcgcccacctcctcatccaagtgatgcctaatcagacatttaaggattctgaacttgatcctgtctcttcacaatatgtagtaaatttaaacttacttaagaaagtcagtccctaactaaggacatttaaacttccttaggaaaggagagctcactgaatgatgtcaaagtaatgaactgatttcctctacaaggtcactgcaaccacaccagctagctctatctctacaggcatttagacttcgctatggggccacaccaccgggtggacagtaactcttggaagtctgtcttcccttttcttcattaataaaaacacagaacaatgactaagtgtccaagcatgttcttacagttcagtacctccccagatgcttacaaacagtgatagcatacctctaactcaccactggcctgggcgcaagagcatattttggtttgttttttcatagactaggggtaaaggtctgcactactaagaaaatatctgaattttcccattgtcatttccatgtaaaaactccccttgacaataaacgtaagtccaagccacagaggggagagcaatttcccacctgtgggagggctttccctaaactaaattttctacttcttaaccatctatcccagagcctcttcaaacaccaaagaaaacgacaacaaaacaaacctaaaaacaaacagaaacacagaaaaagaacaaagacttaacaaatgaattggaggaaaagaaaattcacctacaactctaaattagatttccagatgcatgggcacggacaggcagccgcgtctcggggacgcccggcattaccgccgtttggggaggatgaggtttctcagcatgtcgaaggagttgccgtccgggtgcacagtcacaacctcgccgccctcctggtgaacctggaggaagccagaatcgtccaggccaacgatggacacctttggtccctctgcgctgcccagatggacttgctgaccactgaaaaggaagaacagcgtgcggtcactgggaggtgtcacaggacgacttaagacaatgagctgaagaataatccatgatgagagagctgggcgtgctggggagagggctgaggctcgctgcagggaaaaggcagcctgggctgagctctgactttcttccaccctggtgaatggttttaagaactgctcaaataaccagcaggatgcaagttcaacaaggagtcgaaatttcttcacacaacgtcactcctcctaattctggtcatctgcggtgatggctggaaccacttcctcacctcccagcgcttttaagaaacactgtgcaactctaggttttttggctgagattggaggaaaataggccgagttggcaaacaatgttttatcttataaaacaaagttggctcatatcagccacaagtgaaactcatcctgatcctacttcttttgaatattttccaaatgtactcaagtcacgtccttcttaacagctttcgaagtatagaattttctcaagtttttattttgaagaattttaaatctaaagaaaagctgaaagaatagtgcaacaaacctcatattctcttccattctcacaccaaatgaaaatattttctgtatttgctttctttcttcacacataaacacacacaagcacacatttttttttcctgcaacatataaagataagttgcagctgggtgtggtagctcatgtttgtaaccttagcactttgggaggccaaggtgggaggattgcttgaggccaggagttcaagaccagcctgggcaatatagtgagaccctgcctctacaaaaaaatttttttttaaattagcgggccgtgtggcacactcctattgtctcagctacttgggaggctgaggcaggaggatcatttgagcccgggagttcaaggtttcagtagtgagctatgatggcaccactgcactccagtgacagagcaagaccctctctaaaaaaaaaaaaagtgaaaataaaaaaagttttttaaaagctgcaggcattgtgacactttctgcttaaatactttatctcctgagaacaagaacctcccataaaattataatagcattaactatgaccactcaagaaagtctggatacaaacggtccatgttcacgtcattcccactgtccttttaatatcctttgtggctatttccctccatccaggatcacacacattacatttagatgtcatgcctctttcgtcttctctaatcccaaacaattctgccaccttcttttggtctaattgtttgtgcgcagacctgacatttttgcagggcacaggcctgttgttgtggaatcagtgagcggtcctcggacttcagctgcatgagaatccctggagtatctgttatgacacagggtgctgggcccagcccaggggtttctgatgcagtagcccctggttgaggctgaggctgcttcctgggatctcactttgagaaccactgttacctggaaggtttgacaatttagatgcgtctattgtttcctcacaattagaatcagattaaaccaatgttaaactctctcactatttcggttcttcccatcgcatcccaccaggaggcataagatgcccgtttgctccattacttgtgatgctaacttggtcaaggtggtgtccctgcagtttctctaacagagacacagaaaataatcattcagaccagtgctcggtccctcattttaagatactgaactacggccgggcgcggtggctcacacctgtaatcccagcactttgggaggccaaggcgggcagatcacaaggtcaggagatcgagaccatcctggctaacacggtgaaaccccacctccactaaaaatacaaaaaattagccgggtgtggcggcgggcacctgtagtcccagctactcaggtgactgagacgagagactgaggcaggagaatggcgtgaacccgggaggcggagcttgcagtgagccaagatcgtgccactgcactccagcctgggcgacagagtgagactccgtctcaaaaaaaaaaaaaaaaaaaaaaaaaaaagatacagaactactaagatactaataaaggagttgaaaagaatgaagatgagccagcactgacctgtggacccagtatcggtaataaaggggaaggacgctgttgggccctttgtcctgaaactctttgatcagtttctccagcacagtcacgactctggcgatgagataatcggctcttaagggcttcagttctgccttgtgttgtttattgtattctgtgatgaggtcgttgatgcagatggtagggttactgttagtcacattaaatccacagcctggacaaaaacaaacaattgagcagctcagcctgttgatggcatcacacattcctctctgccacatggaaaaagttacagtcttgactgtcaacttcctccttccttgtcctcatttcagatttcgtgtctctaaccacttgaagagtgacatgtatttctgtccatcttcctttttgtccttcttttattattcttgttcaagctaaaaccatctcaaccttactgcaaataaaaaggtgggaaaaaagaaagccacatttgattcaatttaattcaatagaagctattaaatatgggacaaaacgtatcagtgttgcctctgaaataagtggtctaccaagcattgtagctctgcactgagtccaggagagaataaaatctctggtttcttctcctgcttgaataacagatcccacgcttgaaaatagagttttattcaggacttgggaagtaaactctggactcagagatttcaaaccttggtcatggcataaccctagaaatgcatcttttaatactttattcttggaagtctttggtgctaaggttacgctgttggcaagacgccgactcatgttcagtggctttttgcagggtcctaaaccaaggcttcatgagagttaccagggatggtgtctgaataggcttatctgtgcagttacttaacaccactatcctctccaggcagagggcggtgtcttcagaaaagctggacttcagtgttcagcagggccctgaatcggcctgcgagaggtcttcagtaagaaatgaaatactgcaaaaactaagcagtaagaaaactaccatgttttcagtgactttaagaaaaaaaatccccaaaacattcgccacaggcagaacaatgccatttgtaacaacagccttcccggcaagtgtcctgccgtttccagtgtgaagggaaggattgactggtctcagattttaaaacaatatactggctattaaaatacaaagcaattgtcaattacctctggaaaaaaaacaagtaactacagcaacaggggcaggacttgcagttgctcacgtattcattcattcaatacatacaggatctgaagcacctactgaacgttcgtaaggcattaaatcaagtgctgtacagcactgaaaattctcccgtgttcagaaaactggaattcctaggaggagtagcaacactcactactggccacttaggctatgtccttctaaggaccggtgagcaccctgctggctgctctgaatccccaaagtcagagaccccatcctatggccttcagaattcaataaaagctatgggttctcaccataggaaaatgtttcattcccctactttattttttatttttatttatttattttttggagacggggtctcactccagttgcccagactggagtgcagtggagccctcatagcgcactgcagcctcaacctcctgagctcaggtgattttcccatctcagcctcctgagtagctaggactacaggcaggcaccaccacgcccagctaattttttgtatttttagtggagacagggtttcgccatgtcactcaggctggtctcgatctcctggactcaagcaatccacccacctcaggctcctgaagtgctgggattacaggcattgagccaccacacctggcctattttttatgttttatttttgaaacagggtctcactctgtcatccagaatggagtggagtggctcgatcaaagctcactgtagccttgaactcctgggctcaagtgatctacctgcctcagtctcgcaagtagctgggattatgagctcaagccactacgcctggccttcgcttaccccacgctgataacatttgttagctccctgaagccatccatgagcctgcttgtggcccctacctaggaatctctgcatcaactgcaattactcacttaaagataggaaatgggggagactgggcaagtggctcacgtctgtaatgccagcactctgggaggccgaggcgggcggatcatgagttcaggagtttgataccagcctggccaacatagtgaaaccctgtgtctactaaaaatacaaaaaaattagctgggtgtggtggcgggcacctgttctcccagctacttgggaggctgaggcaaggagaatcacttgaacctgggaggcggaggctgcagtgagccgagattgcaccactgcattccagcccgggcaacagtgctggactccatttcaaaaaaaaaaaaagataggaaatggagctttaagggtatgaagtagcttgcctagaataatattgccccttggtggcagagctggtaacacaggccttgtattccctggctggcacttgaaacacatggttacatgttttttgaccattgctggtttctgaacacagattaggttctactgccacagagtgaggctgatgactggacggccaggaacctaaggacttctgagattgcctctgaatccatcttcttgcctgatttggatgtgctaaggtgaaacagggattctttaccccgccttgaccagcatggagcttcttctgaaggttaaaatgatgccagctctttcatggcccaggaaggtcacgataagaatgcaagacaccaggagaactatttaggaaattaacttttctttttcttattacagaatagaacgttaaatgtttattttcaccatttcaaattcaatgagtagcaggagtgtggaaggatgtaggaacatacctgtttgatgtgataccactttggtggttcccgtggtcacacacagaaaatgctaaaccctgtgaagtgctttcgaccaatctctctgcatctataccctgctccaaaactacaagactcaaagtaacctcatatgataatctgctcctgccaatgtaggcatgcataaaccgtctttatttttattgttttattaatctaaaaatgctgggggaaaggtttttgaaacttaccaataagtatataaaatgtttctcccatgagtgttgagttaaccagaactccgccgatcttcatgaggtcactgtaataaatatcgttgggccacttcactcgtaagttgatatcctaaagggaaatctgcacattaattaagccgtcacaggacacaaggggcccaggcaagtcactgagctaagggaagataagcagaaaccaaggtaacatgggcctcgtcctctcctctttttcaggcagctaatcacttctttgggacaatccgatattgaagtgcctcttggggccaggaggtaaaagccctgaagaacacagttgacataaaccccagcattcttccccatcccccagcactgtttctcatcatccaaaaccctttctgaagatgcttaccttgtaaatgaagttcattatgtcagtatccaccaccaccaccaccatggagtagctaactaacgtgctagggccagagggtggggagagaatagtaatctcagggggcgtctcccttcaggaacccatgcttgagagacaaagatggccctgaattaaccaaggtcacaaaaggcaggtagaaatgtcttgagtagcaggcagtggccaggcgcgctggctcacacctgtaatcccagcactttgggaggctgaggcgggcggatcacaaggtcaggagttcgagaccagtctggccaacatagtgaaaccccatctctgctaaaaatacaaaaaattagctgggtgtggtggtgtgcatctgtaatcccagctacttgagaggctgaggcaggagaattgtgcgaacccgggaggcggaggttgcagcgagccgagatcgtgccactgcactccagcccaggtgacagggcgagactctgtctcaaaaaaaaaaaaaaaagaatgctgtgaagatgcagaggagaaattcaccttagcgaaagcctcgcagaactgctaatggtcatcttgggtaatggaactggacttgtcatgtggcctattgcctctgcgtcttgaatggtgtggcctgggggtgggggggctctccctgtcatcagcttacagaatggaccaacactggacagtgtctcgaacaaggccacccaggcctctgcctatccactgtgactctgaagttgggacacagagacggggctagccgagtgggtgtcagaaccaccaggtcttttagacctcgggctggcagccaggctgtgccatgtgtgggtaaaggaagcctgtctggagatgcaaggctggaagagaacattcagcaaaataaagctaagggagcagagagtagctgatggcctccaagggccacggggctggtcttcccacgttgcaggccgggcatggcaccaagcaccttctcagcattagtctacgtgttactcacacccagcctatgtgttggtgctagcgcatccccagggaacagagggagaaacggaagcttagagaaattatgtggcttgcctgaggttatagcacttgaaagccacggagctaaaattcaaacctttctgccaccaggcctgggtgaggaatcctatgctacgcggcctgttgcttccatgaaatcccttcctccttccaacaggccttcttttgacttcggcccgttagagcatattggaagctcatctgccctaaaacagtagtttaggctgagagaaaaaatacaggaataggagcacaggagaacaaaaagtctaagtaaaccaagcatggggggtgcgcaatgacccagaactgatcaacagcttcacgtttcttttctctctagaacgggggttctcagtgggagaggggtggatttggcgatactgggagacttccctggttgtcacagcctgagggagtgctaccggcgtctagagagtagaggccgcaatgctgacacacatcctttaaggcacaggacatccccacgacaaacatgccagggcccacatatcaatagcactgggctgagaaagtctcctctaggaaacctgtgtctaggaggctctgctcttcatcactgcccccagttccctttccttcccctctctcgccttcccacatccccctgtgcccaccacatggccaggggaatgagcccctgcctcgccggcgggaggacacctgcagagttcccagagctgtcaagctcctccgccacgtgcgtggcagctggtgcctgggcgggccctgcacttgggctccagctcgccttcatggcttcagatctcctcggctcatgaagcagctcatgaaactctgggttctcacgcaggtaaacaggaccagcatttccacatgaagaggaggactgtgtgctcatttttcattttctcaatcatttattccaacagctgctgtgatcctcccacataaaaaaagaccaaaatgaaacaaatcctgcttttgaagagctgctaacatcatgggagacggaacaggtgcacacatcactcctcttcaaagccacacgtggtggataccctaaaagaggcttcaacatggcaagtgctggacagtgctggaggaaagagctggaagtagctggagggtctgagaatggcactggagctgggccttaaggatgaacagaattttaagaagcagagaagagagcaggggtaggggtgtgtgggtggagggagggtgcggggcccggggggacttcatggacagaagaaagagcaggagtgagaatgggcggcccaaggcgagttccggaaggaatgcctgcatcccagcgaggccgccttgggtctggggagggtggtcatgatttgtgtgctgacggtgacatctggttagggaccagttggggtcctagtgaaggccacacaaaaagtgaaatccaaacaacaggggcctatttcaatcaaagtagctgcactgtgtcagctaacttgactatgttaaaaaagaaacccaattcaaaatcaaatgtcccatcacacaggtgaggctgggtagctgactgcagaagagggaaagaacattggtacaagcttcttaaggagaacgggaacacaaattcccccgaccccgttcaccgctgaaggcaagcttcccacttccatcctggcctccagcgcctggcgcacgcagcctctgagcacagcaggccctcaaagaatgctcgctaagggaactagtggggctccaaggtcaaagtcagagccatgaaaaagctaaacagaccaaacagactcatttaatgttctcggcttagtgtttgttttagttattttcctaagactaacttgttgctagagttaatttctcccatgacaggactttctttcttcctttttttgatacgagtctcactctgtcgtccaggctggagtgcaatggcacaatctcggctcaccgcaacctctgcctcccgagttcaagcgattcttgtgcctcagcctcccgagtagctgagattacaggcacccatcaccatgtctggctactttttgtgtttttagtagagatggggtttcaccatgttggccaggctggtctcaaactcctgccctcctcaacctcccaaagtgctgggattacaggcatgagccaccgcgcctggccaggactttctattttgattgcttcctgctagacagaatgcacagctcaggtgctcaaggccgggcacctgaagccctgtaatggtgtgatgcccccaaaccatcagatatgcaaggatgctgggtgcctggtagtaagcgtccgtttcagcgatgtgatgtaatacaggaaacagagacgtcagcattaactacatctgtggaataccaaaaattcatacacagcaaatacatcacagagggatttaaggggcagtgagaaggaccttttcttcaatgaaatgatgacaggacctccaagtctcctttgagagtcacgctcttaacatcttgcttcaggaatcaatccaatcatttctctttagcctgacataggagctgctgggggagggaggcaggaatctcctatttatacccatatgaaattcttccaggaacatttgggagggggctatgggaagtgaagcccaagtagggaagaaaatgcttcggtcactgagctaattgttccctgttgcttgtctttttaataactgacaacaaaacatccaacagtaataaggaagcaggcacacgggtcctaatagctgggggaagatggccccaagtggatctgcacattgtatgtggtcaacagtggataaaggatagttctgttagagcacagagtctggtaaacagaagtaggaaatgagaaaggtttttaggtccccaaataacccttttcaacagaaaatgcagatgaacaacttcaatccagtccaacaatcaaatctcatccagtgcttcaaacaaaaaacaaacatgcagctgggcgtggtggctcacgcctgtaatcccaacactttgggaggctgaggcgggcggatcacaaggtcaagagattgagaccatcctggccaacatggtgaaactccatctctactaacaacacaaaaactagctgtgtgtgatggtgcacacctgtagtcccagctactcaggaggctgaggcaggggaattgcttgaaccctggaggcggagattgcagtgagccgagatggcgccactgcactccagcttggtgacaaagtgagactctgtctcaaaaaaataaatacataagtaaacatgaccaggtgcagtggctcatgcctataatcccagaactttgggaagctgaagcaggcagactgcttgagctcaggacttcaagaccagcctgggccacatggtgaaaccccatctctactaaaaatacaacaaaagagccaggggtggtggtgtgtacctatggtcccagctactcgggaggctgaggtgtgaggattgcttaagactggaaggtggaggttgcagtgagccgagatagtgccactgcactccagcgtgggtgacagagtgagaccctgtctcaattaaaataaataaataaacaacaacaaaaaccaaaaactaaagcgttgccctcatcaggctgtttgagaaatctgaaaaactgggtagaaagggagttctggggaatgaatgcattcaggcaagcctgaagcagcattagcacctggtggtgctctgaaaactccgagagcactttgctgccagctgtgcaaagggtaggctgaggttctacagccaccaattatgcaagcacatgctataaacaagaataagccagattctgcatgcatcccagggacatagaaggagactgaactgtacctacctgatactcgggaatggacctcactgcttccacgacagccacggacatcagatgctggacaaacgggatcctctgtcccagctgggatctcagtggaatggagatgagcagagtagaaagagcacatcccacagggctcagccacacattccctccccgtcctggaacacaggccacagtgggaaacatgctaccttgccacgtggacagacgcagacacacgtcatgccagggccacacactcaaataaatctgaacttattacaatgcttattgtattacaacgcttattatattctgggcttaataaaagaaaagctttttaaaatctgaagctctgttgctgaaaaagtttccaataattagcataatgttctgcttctgtgagcatatcatttgtgccttgatgactcagagtcttacagcgtctgaacatgactatatgactataggtttaattcccagcatatggtcatgaaggcaaacacagacattgggaaactgaactgaatctatactgatccatgagaggtcctggaagccactgtttagaagcaattcctattgtggcgatggttgctcagcccagcaaatatgccattaaataagagccacagaactgtgtactttatttatttttattattattttttaagatggagtctcactatgccacccaggttggagtgcagtgcgtgtgatctcagctcactgcaacctctgcctcctgggttcaagtgattctcctgcctcagcctcccaagtaactgggattaaggtgcccgccaccattcccaggtaagttttgtatttttagtagagacagggtttcaccatgttggtcaggctggtcttgaactcctgacttcaagttatctgcccgcctcggcctcccaaagtgttgggattacaggcatgagccaccacgcccagccacactttaaatggaggaattatatttcaataaagctgtttaaaaagggattcctgatattaactgagttgttatttttctttacttcctttctttcttcctttttatttttgagacagggtcttgctctgttgcctaggctggaatgcagtggcgtgattacagctcactgggctcaagtgatgctcccacctcaggctcccaagtagttgggactacaggtgagtaccaccatgcccggctgatttttgtattttttttaagagatgggtcttgctaagttgtcccagctggtcttgaactcctgggctcaagtgatcttctgccttggcctctcaaagtggtgggattataggcatgagccactatgcctggcctacttttcttaaaattgaagttagaaaaatagaagaatccaaatgagaggtagagttcatcaaagttcttcttgaatgtctttttcaaaaaacaaaaaaaaaatccacatattgagatccatagcttttgacaaaaacattttttttttccatttgaattatatttgaaagacatggttcaggagaaagaagtggagaacagcagatttcttatttctttggttcttatgaaaaagtcataagaggctgtgagagtgagaagcacatgtgggtgagcctggcactggctggagcagggaggggccaagccccgtggagcagcccctgtacagggtcagaccccagatgggtctgggaggatgtgggctctcgtctccgggatctgcaggtggtggagccctgggcagcgctctgcttctctgtggtcactgtgtgaatgggcactgatgcagagcccaccatgtacatgcaagcccagcccagggccagctggggtgagaactggcatgcaaaaggcctcccacatgacgctcagtacagacacagaaggctccttatggagaaccttcaggaaaataaacgtctctagagcacagtgacgatccccaaattggaaagcccggaattcatgtaggtcacatttgccatcacaggcaaatgtccagtgattcataagcattatgatttgacagaatgctttagttctactaagggtgaaccttctgatcactgcttccctcttcctcttcctccattccaggcggttatgaaaacagaatctactaacttgagtcccccagatgatcagcacacacattcaatgggctcctgggccacaagagttgcagagtttagaaaacagaagtaacagcaatgatcacaaaagatgactgacctttgccctcggtctgccgggccgcgatcactattaagcccatttcctgcggtgtctgaaacatcagcctgccgaagagggggaaagaccggttaggccagacatggacacgcccgcggcaccaatggctcacacaggagggacagggtttgcatgcatctgggggtgtgtggccatggaagggccaactttggttccactggccttcaggaatgtggagccatgagggatatcaccctcctttctaacctgggtcgtgagaatgaaagagatgaagaaagcaccttttaacatcaaaaaaagagcatgcgagggggcgtgtgtacctgcctgagccgttactccatttattaaagacttggttagattctatttcatcagaatatcctgccaagttctttctccccccacccccaatgtatgtaccttcttcaagtgacaactagcaattcctgacatttgttcctacttagggtgcacttctgtttgaacactagaacacaatcataacagaagtttctgattattcagaaaaccaatatggtggcaataaagccgtttaaaagacacactatcccctgagaactaattatgatttaactatggtaaataaatccacaccttctgaggacgcaggagaactctgcatcgttttcggcttcagtcctgcttttaaaatggtttcattgaaaagaatacaaactttcctttgggggataggtagaaaagggcattacatccccaccaaatgagtcgatattaactttttttcaaaaaaaggaaagaaaaaaaaatcacacaaaaactcccactctgagaatttcctgcaagctgcgctctccctattttaaccccgtggtaggacagttcctctctacgtgcccaggaattgccgatcaggtgctgcgcaggcgcggttcgaggtaggattcatcaacagagcaaagatcaggtttggccactttgtcagtgcagatgagggggcctctttgatttttttcttttcttttctttcttggaaggaggggagcagccaggacagggatgcggaagggatggcattttgtaataacataaagtttctaataataagtctccaggcttccacagtggtcctgctgaggacaaaggagcgctagagaaagaccacgctgagaagcttatcatcctcccctcccagctacagaaactgggtggaactttacaaatggctggaactcggtaagagaagaaaaatacttaaaagcagagagaaacaacactgtgtccactgtgcacccatggctcacagagctccgtctgacggcgcatgcaggcctcagttgggacagaaggagcccagaagacccttcacgtgttaaaaagacctcaggacacacagggcaggggctcagctgctgagatagctgtcttcccacacggctgctggaacaggcacaggacgctttcggcgagcaggctggcctcgccgcccatgtgccaggcccactccatctcacatgaaatacagctcagaagtatttctcttggacgccatgaataactcattgagatcgagtgtgctgtatgccactgggtccaagaagaaagcgtccttttcttgtgttggaccagcagaaaatctaagaaggagtctttgtctgtgcagggagttaacattgtctttcaggcacctctgttttctagagggtccagcaaccctccacctggcttcctaaggcccagggctctcgaggtgatggggcaggggccgaggggatgatttagcgtgttgtgagcagatcgcaaaagcaatctaggatgttctgtaaataaacatgtagacggtagacagtcatgggctatagccagggacagtgatgggaggggcaggaaaaaggttggttcagaaaccaaacacagacttctagaacaaagagaaatgattaagggaacatatgcactaaactgctagaggtttggcagcagttaacagggcatattaatgagaagagggagtctgtgctgaaggccaagaggaaattctgcaaggagggagacaaccggggaaggagctaatgctcagtttgagacaactggaggccgccagatttatttgtgctatctgagataactctggggccaaaccgcatggctcacagtcaacaaagcagcatttataaaccttgtcaattctgcatttctgaaaatgaagctgcttgagtttgctttagcagaaaggagaaaccataaatgcatttccatccttagcggatgatgtccttacaaaaagaaaaaggaaaaacaaaaaggaggggggttccataatgattacctccctgcttctgtatattttccttccttgctggcaaaggttgtggaataaaagctttctgtgagtggcagccgagtgcattcactgtggaaccaaagcggcactcaggaaaagcgctctgttttgtactcttgtgttgagtctgaaacatttggagcctcctaagggtcactctgcaaatgagacagcctcctgaccactttggttactaaggacagcccagtagccacggaggctctgccaatggaactgtcctgattgtcacatggtcctttaagattaagctttaatgattgggaataacctaagacaggccagcatgaattaatgaaaaatccgaatgaacaaaaacgtaaattcagaccaagtccatccacttcggggatctgaacctaagaaaatagtccacattcacaacagtgttataaaggtaaaaatatggaaacaacctcactgttaataaacaaatggttaaataaattctgataaattaagtcaatggaataatttgtaatcaaatcattatagttctgaagactatatagcaacgtggaagaaaggcttgcattggtatgtcaaattaaaaagcagcatacaaaactatagatgcttttttttttttttttttttttgagatgcagtctcactctgtcgcccaggctagagtgcagtggcatgaatctcgggtcactgcaacctccatctccaaggtttaagcaattctcctgcctcagcctcccgaatagctgggattacaggtgtgcaccaccatgcccaacaaatttttgtatttttagtagagacgaggtttcatcatgttggccaggctggtcttgaactcctggcctcaagcgatcctcctgcttcagcctcccaaagtgctgggattacaggtgtaagccaccacgcctggccaaaaactacatatacttttattccaagtatgtaaaattcaaaaagggcaggaaggagattagacaaaatgttaatgatggctatattaagattttttttcttttattttaaaactttaatatgatgggtaacctttctttttttttttcgtttgagatggggtcttattctgtcatctcagctagagtgcagtgactcactatagcctggacctccagggctcaagggatcctcccacctcaacttcctgaatagctgggaccactatgggttcataccaccacacctggctaatttttgtattttttggtagagacagggtttggtagagcccaggctgggtaaccttttgatttaaaatttattttgaattttttttggaaaaaagcatatttttacatttagatataatattgtaattgactattcataaatacagaacttctaagtataagaccaaaaggtccgttttaaaaagaaataagacaattggccgggcgtggtggttcccgcctgtaatcccagcactttgcgaggccgaggcaggcggatcacgaggtcaggagatcaagaccatcctggctaacacggtgaaaccccgtctctactaaaaatacaaaaaaattagctgggcatggtggcgggtgcctgtaatcccagctactcgggaggctgaggcaggagaatggcgtgaacccgggaggcagagattgcagtgagccaaggttgcaccactgcactccagcctgggcgacagagcgagactccgtctcaaataaataaataaataaataaataaatataaaataaaataaaaagaaacaagacaatcaacaatagttatttgcagtacccatttcattataactagtgagcagcttatctgatactaacaagtgagcagaaattcttgaaaccagtctgttcagacccagtgatagccttaaacatggtttacttcctgacccggggactgtatttctacagaattgaagcctgaggaggactcagacagggacacaaaataattcaggggctcaactgttcaccacagcattactgatgcagtgtgaaaaatcagaaataatccaaacagcccactgttgaagaattaaaaaacccacagcagtcccacatgaaagcccatcatgtggtcatcagtaatgtgggcagatgaccaccggacacttttaggtgatttaatcaggatgcaaaatcctacagacagcgtgagtccaatcatgttttgaagtatgcttttaaaaattatggccgggcgcggtggctcacgcctataatcccagcactttgggaggccgagacgggcagatcacttgaggtcaggagttcgggaccagctggccaacatggtgaaaccccatctctattaaaaatacaaaaaattagccgggtgtggtggcgggtgcctgtaatcccagctatgtgggagattgaggcaggagaatcacttgaacccagggggcggaggctgcagtcagctgagatcacaccactgcactccagcctaggcaacatagagactccaactcaaaaaaaaaaaacaaaaattattaggaaatataccaaaataatagctgcagttaccttggggagtgaacatatttgaaaaatatagaaaaatattaagtagaacataagtcatctaggtaagtcccacttctcattaaaagtgtatattcttttagaatttctctctttttagaaaacacagatatattttacaaagtatttttctgataattaaaaattttttattttggagctcttacaatgatgtagatatataattatagacattatattgttaaaaagtgaaaaagaaggttaaaaacagtatcgtagaatgattctctttatatacgatatgtatttatagaaaaatacaggggccaggctcagtggctcatgcttgtaatcccagcactttgggaggctgaggtgggtggatcacttgagcccaggagttcaagagcagcttaggccacatggcaaaaccccatgtctatcaaaaaatacaaaaatttagccaggcatggaggtacatgcctgtggttccagctacttgggaggctgagatgggaggatcacttgaggcagggagttcaaggctgcagtgagcaaagatcatgccactgcactccagcctgggcaacagagcaagacactgtctcaaaaaaaaaaaaaaaaaaaaagaaggacacatattaacagtggttatctcaagaaggtggaagaggccgggcgtgttggttcacgcctgtaatcccaacactttgggaggccaaggcgggcagatcacgaggtcaagagatcgagaccatcctggccaacagagtgaaacctgtctcactaaaaatacagaaattagctgggcatggtggcgcgcacctgtagtcccagctactcgagaggctgaggcaggaaaatggcttgaacctgggaggcagaggttgcagtgagccaagattgtcccactgcactccagccaggtgacagaacaagactccatctcaaaaaaaaaaaaaaaaaggtggaagtgtggaagtagaattatatgatgatttaaatgtctcctttatgttgttctatataatctctgggtggtaagatttcaagtgatttttatttctctcttatactttactgaattttccaatatttttataattgtagtgcattcattttataaatcctattaaaaaaagatttatttaagcccaacctatcagtggattaagcttgcagctgccagttcactagttggtggagcaatctcctttccagcacagattggcaaagaaagggcggccaagtgcaggcagctttcccaggctgccatacctgtcccgtggctcattccctgccgcacaggccaaggccacggagggctggcagtctgccactgggagcagctggcctctggaagctgggctgtacctcagactggcctccctttctaaaagatgttgtaaagtctttctctggaaaacacaccccaaaccctcctaagtctgaggcatcgtgccctgcagcagtctggcatggggtgggtgtgaggcgacctcgaagtctccctcgggcctggagggcttcctcagctcatggtcctggcctgacaccagtctgtgcttctctttgctatcttctttaccccccagttttctcagctctgaccctgttcttagcttacagagagacacacactctcatgagtgaaaaagaaagccaatgggaggtggcgaggaagagggagaagggggccccaggcagtcacacattgaaggttcataagttatttttcattttaaaaaagctgactggaagatgaattcccactgttcataaccctgctgccctctgcttagttcaaaggaagcagtgccgaacttcatttcagaactacttttaacacatattacattgtaaaaaccaaccattacatctgagtagcactttctaaaaagttaaaacgctaaaatatcaagatatttcatttttgttaaagtcacactttaacaatacgattgattttttttaagctactttctaggcaggaatgcacaagattgttttttgaaaggaaatgaacagtggtttctgctaaaaaacgcctccaccgtaaaatggagtgaggcccatgagacagctgtgcaacgcatggggacacagtcaggggcagaagaggcccgacttctgacaggtgacttctgaactggcggcagggtccacggcacaaagctgaggtggctgccccaggacactgcagggtcctagccagggaccctggggatattattcctggcagctacaggaaggttcccaaggaactttagaaacatcacagcagagtggagactcagacagggaacgggacagatctggactcgaatcccagtgttgatatgaacatggagtaagggaatccatctctctcagtctctccagtcacctataaaatggaacattttgtgcagtgtcagtaaaaatgaaatatgatggaatttgcaaagtggtccctgtcatgtcgatcctagaacttcttgctgccagaagacaagcagcgcctccccttacctcctcctcttggggataaggagggaagtcagggagacagagggaaggaatggaatggtggggacaaatgtgtgtgttttacgactcctcaaaaattctatacgtgatgcctctcctctctgtacccatccctcatcacttctacctacacacactaaggtgatctctatctgggctaaaaaccttgtaagtgacactagcaatgggggatgcagaatcttcacttccagttctagggtctctgaacctactcagcaaagctacacatagttggttgaactggctcttcggctgactttgtttaggtgactgcttagaaacactgttggtcagaggtgtgcccaggcagataatagaacagttttattgatatattcttccattctattctggatttgacactacggcctgccctttcctcaatgcactctgttggtatgctttaaatcatatcccctttccgctcttggtgtagaacaggatgaatgtttcagtaggaggcaacacgggaatcgggactgttcaaagagcagagccatcacaatcctcccactggagctccccagaagcagagagatgcctgtgggtcaggccctctgttagagacacccgcttcatttccgtagctcctggcatacctgcccttcttacgtttttggctaatcttccccacgtccagcataagagcgtccacattgctgctaaataaatcatttcatggctcccaaggagcccagtggattcagctttcagaatgaggctcctttttggtaagtcaagcatttactaatgttggtctgtattatccaatcaaagtgaatacaagccactgtttcttaccctgacacttcaccataaatactagatgcctgcgcatccactgccttctatcttaaactggtgctattacagaatttacagatgagcaaagaagcttgcatagagagaaatattcatggtgcccacagccacctctgtggctgtacctcagcggtagccctgatggcagatccctgcctctgacggcgagccttcactgcgccactgcacaccagtactcagactatctgtccccactcctccgccaggagtctccggatcctccacaagatcttctcaccccccttttcaggctgttcagatctcataaatatgtccatttttctacaactgggtgtggagcggctcttggtggagagtgtccacagccttgaccataagtcacctgcccctaaagagggtctgctactgggaagtgctgccgctatttcagaggatggacaccgactcacgtggacgacacagcaagcagatgtctgcgaacagtgtttctgcaggcaccaggtagatgtttcaactggtcacctggaattcacaccaattttttgtgctatgagtggcattttaggttcgtgatctcatccaagccttccaaagctgagaagaagtccttcctcacagacaagaggacacagtctcagaaaggcaaaaccactgctataaagccacatagcaagcaaaccagaaattcaaatcatgttctggttggttgtaaggtctataatacttttttctttttaaccttttacttcgaaataatatcagacttaaagaaaagttacaggaagagtacaaagcattcctacatgcccttcacacagcacccagatttcctaaaggttcactttttaccatatatgttttgtccatctgtctatccatcattattttctgaaccagttgagagtgagctgcagccctaatgtctctgtattcctatatgcgtctgtgtagcttcctaaaacccagggtttatcttacctgattatagtacaatcacggaaatcaacagccttgttacaacactattttatgcttttttttttcttttgagatggagtttcactctgtcacccaggttagagtgcagtggcacaatctaagctcactgcaacctccgcctcccaggtttaagcgattctcctgcctcagcctcctgagtagctgggattacaggcgtgcaccaccatgcccggctaatttttgtatttttagtagagatggggtttcaccacgttggttgggctggtctcgaactcctgaccttgtgatccacccatctcagccccccaaagtgctgggattacaggcgtgagccaccgcacccggctgatatggcactattatctaatccagaggtcagcagaattctctataaaaggtcagagagtaaatactgtaggctctgcagccgtatggtttctgtgctcaattgctcaaacctgccgtccgagggcaaaggcagccatgcctgtgtctcaacatttacggacataaaaatttgaattttacataatgtttgtgtatcacaatatattccttttaactaataggcttttttattttttttagagcaactttaggtttacagaaaaattgtgcagaaagagttcccatatgtccccttccccaacagtttccttatcattcacatcttgctgtggtgtggtcatttgttacgatttctgaagcagtcttggtataggactattaaccacagctcactgcttctgttagggttcgtgctttgtgctgtacattctgtgggttttgataaatgcatcgcatcttgtggccaccatgtcagcattacacagaacagtttccctgccctaaaaattcccctgtgcttcacttattcatccctcatcccttcccctccccgaaccctttggcaaccaccggtatttttactctctctatagttttgcctttcccaaagtgtcatataaattttattctttaaaattttttctgaccctttaaaatgtaaaaaaacatgcttagctctcatgcggcacgaaaactggcagcaggccagactcggcccaagggccaaactttgccaaccccagatctcatctatagagtgtattcaaattgtgtccattgtcctagtaataatgctctttttttctggtctaagatcaaatccaggatcatctgatgcattgagctgtcacggcttcttcgtctcctttaatctggttcagtttcttagtctttttgtttttcatgatccagacatttttggaagagcaggggcagttattttgtcctatgtccctcaatttagataatcagatacccccgttataagactcaggggtgcatttctagcaggaatacatggaagcgatattgtgacctcagggcctgacatcgggaggcaggcagtgctgtctcctgacatcagggatgttaactttgacccacagggttatgtggtttgtgctgggttttcccactaaattgcctttgtaattaataagcacttatggggagataaatctatttctcatgaaatttaatctattagttttagtatccatgaatgattcttgcttgaatcaattattatttttatttattttttatttttttggagacacagtctcgctctgtcgcccaggctggagtgcagtggcacgatctcagctcactgcaagctccacctcccgggttcacaccattctcctgcctcagcctcccaagtagctgggactacaggcgcccgccaccacgcccggctaatttttttgtatttttagtagagatggggtttcaccatgttagccaggatggtcttgatctcctgcccttgtgatccgcccacctctgcctcccaaagtgctgggattacaggcgtgagccactgtgcctggctgcttgaatcaattattattattattttttgagacagagtctcactctatcacccaggctggaatgcagtggtgcagcctccactcactgcaacccctgcctcctgggttcaggcgattctcctgccacagcctcccgagtagctgggattacaggtgtgcaccaccatacccagctaatttttgtattttagtacagacagggtttctccatgttgaccaggctggtctctaactcccgacctcaggcgattcacccgcctcggcctcccaaagtgctgagattacaggtgtgagccaccgtgcctggccttgaatcaattatttacttgatggttgccaaacagatttttctgaaccatcatttcttccatattcacttgtgaggttctactgtaaggagtaactttttcttctcccctccacttattatttatcttttaatttatttatatcagagtagacttatagattcttattatttcagtagattgtatgccttcctatcattttttattttgatactcaaatagccacatatctggcaagtgaatgctccttcagtctggctcctgggtcttactggtgtgtcccagtcatctttcagcataagaggtctctactttcaggcataagaggttctaggctcatcttgaactttctcagcccctgccctggaatcagcgatttctccaaggagctctggttccttttggtgaaaaacggtcttttaaaaaaactggggctaagaaagagatagaaaatgtgtgcatgtgtgtctagggtgtatatatgcattacaattgtcccttggtattcatggaggatttgttccagactgcctcccaagtcccacagtgagctctgtggaacctgagtacacaaaaaattggcctccatatacatgggtttcacatcccatgaataatctgctttggttgaaaaaattccatgtgtagtagacccctgcagttcatacccctgatgaatcaaaggtcaactgtatttccttccgtccatccatccctccctccttccttccttccctccttccttctttctttcttccttcctctagattctcatcttctttctctatctaatctatccatctaccacccatccatccatccagtttgaaaaccataagttcatcataaactccaatccaatccaataccacaaggttcattctagcccctccttttctatattcataaattctttctccaatagtgggaaatctggcttgcattatctacactatttattcatttgctcaatgccataatacacagggggaagtggtctcagcagtgctgatccatattactgcgaaatcacacttactaactagagttcaatatttgtttacagttttttttgcccttagcctgagggtatagattcaaatattgtattgaacatttccttggatttgttcttttttttttcccctttactttagtgtggttattttatttgtctgaaatcaggttaggtttaactgtacttctatattacattttacccccacacccaaaccccaccaatccttctttctttttcattgtttaacctggttcagagtcggaactgtacacagacaagtatactccgagaagtgtcacactcccctacccattccttctacctaggtctcccactccacctcctttctgtaaaccacaaatcaaaatctcattcatttctggtttattcttcctgtgttcctttttgcacaaatgaatggatacatgcatattttcttatttccttgtcttccttacagaaagttaccattttgtagatgctcttttgtctcccccatccacctaccccacacaattaatatacccgggaaccactaggttgcatactccttatgagaatctaaggcctgatgatctgaggtggagctgaggcggtgttgctagtgctggggagcagctgcaaataagttcatagagcttttcctcattttttctttttttcagacggagtctcactctgttgcccaggctggagtgcagtggcgcgatcccaggttcacaccattctcctgcctcagcctcccaagtagctggaactacaggtgcccaccaccacgcctggctttttttttgtatttttagtagagatggggtttcaccatgttagccaggatggtctcgatctcctgacctcgtgatccgcctgcctcagcctcccaaagtgctgggattacaggcataagccaccgcacccggctcctcatttcttcttaaagctgagcagactccattctgtggatgtagcacagcctcttcaaccactcttttatgtataggcatttaggtagttcctaaaaggacagtataatgaacactcttattcgcatggatttttatattgctggaggtatatcttcagggtaaattgctggaagtgggatgctgagccagaaggtaaacacactggtagctttatcagattctgccagaacccccactactgcacacagccgcgcagagatacctgtttccctacagcctaaccaatggacagtggcgtgtgtctgtgcatgtgcgtgtgtatacacagtcaatgaccagttaatgtcttttgagttaactcaaaagttaagagtttcttatatattagggcagagtccccagctctgccccacccccccaccccccaggctgcacagcaggaggtgagaagcaggcaggcaggtgagtaagaaagctagaaaagcttcctctgtatttacagccgctccccacagctcacgttaccacctgagctccacttcctgtcagatcagcggcagcattagattctcataggagccctactgtgaactgcgcatgcaagggatctaggttgcatactccttatgagaatctaaggcctgatgatctgaggtggagctgaggcggaggttgcagtgagctgagatcatgccattgcactccagcctagacaacaggagcgtgaaactctgtctcaaaaaaaaaaaaaaaaaagccttgatggtatttttagtctaagtgcattaaatgtataaattaacttggggagaactgaccatctttgtgattttgagttgtcctacctatgagcaaaggatgacttacatttgttcaaatatacttttgtgtctttcagattgttttaaagtgatcttgtgttgattgtgcatatttcttatgcactatcttacgtattttatcttatttgttgctattatgaatatatcccataatttcctttaactagttattgcttgttgtatataaaaactattgatttctgtataataattttatatcctgctctattactgaattctcttattgtttgagttagagaatcactgattctttaaggtttctcatttcctctgcaaacagatagttttacttctttttcaatgatacctttaattgacttctcttgtctgtttggattggctaatacctttagtacaatgccaaacagaggtggagacagtgggcctccttgccatgtttcttagtgtttccctgctatataagatgctatctaggactcacagacacttacaagtcagtaaattatccactaagtcctatttttggaatttttaaaaatcaggacagggtgttgaattttataaagtgttttctcagtatctatggaaataatcatacatttttcttttttgatctattaacatattaatgagttaagagatctattaatttttttaatattaaaccaatcttgcattcctagaaaaaaaaatcacatttgtcttaatgttagattctgttagttaatatttatttagaatttctgcattgatgctcattagtgatactggcctgtaatttttatactgtctttaacagatttaagtatcaatattatttacttcattgaaatgaatttgaaaattttccttcatttttgatgagcccatcctttttccactgaagtactccttctgaggaagactaaaaaaaaatttctgccaatgatcctgtaggaaaattccaaaagaaacctttttgatttcttcttgaaatagctttcagaactcctgttctcaatcaaatatctttgcacctacaggtctatgtgaggtacttgcagcacatgggtagtaagacaatgagtttatattaatgtggactacatttaagaatctacatataagaaccttaactgaggctttaccttaatactccagacaaacaggctggagacctgacctccttaagaggtctggaccagttctggtagagatcagcccagaatgaccaggcctctgaacattccacaaaacgtgttccatggagagggtgtagaggagaatagggagcattaccgaacagcaaaggaaaacactttaagactctcctcaaccatttccattaaaatttcagaaacaggccaggtgcagtggctcatgcctgtaatcccagcacttttggaggccgaggcaggtggatcacctgaggtcaggagtttgagaccaacgtggccaacatagtgaaaccccatctctactaaaaatactactaaaatactactaaaaattagctgagcatagtggcaggcacctgtagtcctagatactcacgaggctgaggcacaagaatcacttgaacttgggaggcagagactgccgagatcacaccactgcactccagcctgggcgacagagtgagactctgtctccgaaaaaaaccaaaaccaaaacaaagaaaacctccagaaacagatgagaacatatttagatgttttgtattgtattaatactttttgctcaattttaacaaatgcctcagtctttgctaggagctacccacctcaacaagcatgggttcctggccataccatcaaggtcacagaggcaaagctgcctccagagctaggctctcaaacaatgctgcccatcagaatcgcctgcagttttaaaacacaaagcaaaaacaaactgatgctaagaccccagataccctctgaatcccaacctccagagccagagcttgggtgtgtcccagatgattagaatgcagctggtccaaagactggggttctaaaaccactgttcccaaagctatttttcaatgacttttttaaaactacatttcttttaaaaaatttccagagctacaacatcaaagaggcagtaattctcttctggttccttcaatgattgaaatgaagcatcgcattattttgatatttactaggacggcacaacaacagtcccacagatggagagatttcattttctagagccagagggtggtaggtagtcgaggaaaaggaaaaaggggaaaggaacaaagaactggcattcggacacaaagtgtgcaccacaaagtgccattacgtgcaagacagccacttagtgtgtctgaatccctgttggtgttctgtctccctacagtggcttcattcgcgatcaccagatgtcaggtctgccagatgtcgtttttagcaccatgaagcatagcaagggctggtgtctcgcacacacacaagcatgtgtgcacatgcacacacacacatgcacatacacacacacacatacatgcacaaatccacacacacacacacttgattgccacctcaatatggcaggcttccaacagtgagcacaccagccaacatggcaccatctttccactcactgtaagatttctccaaggtcttataaatgaatgaatgaacgggccatggggaaggggtatcttcagctatagatctcaagattctacactgcaagcaagccagtggttcctttgactgagcacccatccacatgctgggcccttggtatgagccatgttctcatttaaatgtcccagtgactctcaagacatcatcattgccaagtagtctcattttactgctgataagtggaagctacaccgcagaagtggcctggtgagatcagagaacagtcaaccaggtttgcctggctcagaggcccatcttctgactcactaggaaagaatcttttgcttttatcaaaacagaatttcaaggtagaaataccacctcttttttttttttttttttttaatgagacagagtcttgctcttcacccagcctggagtgcagcggcactatctcagctcactgaaccctctacctcccaggttcgagcaattctcgtgcctcagccacctaagtagctgggactacaggcatgtgccaccatgcttggctaatttttgtatttttagtagagatcgggttttgccatgttggccaggctggtcttgaactcctgacctcaggtgatccacccacctcagcttccgaaagtgctaggattacaggcgtgagccaccatgcccggccggccagcctcttaaaatgcatttgtgtaagtttaacagtcctggaggctataaggctttctagaaagatctggaaattgacttccaaataataacatcaaaatggggttcttgctttatctttttttctgagaactgaaacagagtcaccttacattttctaaaagtaaatactaccagcttggtggccaagttcatcagttctgtgctatgtgtctgaacagttattttcccagctctgtacgtattctgcttcaaatacttcattttcccttatgaaatttacataaattataatactaataagaagtttctttacctacagagtgaaggggcatctgaaacacctgggcaaacaaaggaacctgaaggtaacgaattccttcctacagaagggcagctccacccggccacttgggcccttgattttaccccaggtaccgtcgccttcggggtaatgacaaggaagaatgccctgccctgccagctggcctgaaaaccagtgtgcctttcaccaccctgacgccctgtgtgtcaccttcctctttccctctctcggctcccacctctcttcagagccttccctgcaccccgccctgccagagatcaaccaacacgccagagctcgtttgccgggatgcttagcaccagcttaactcttcactcagtgggacaaggggcctctttctttcaggcagggctttgctccatgacacgctgggtttatggcccccgtgaacgaaacctggttcggaatccaattctacaacagattttcgttcaaatggttattttccatcccttgcccccaattccattttctacccatctctcccggctctctgcctgtgggggctgaccccttgagacctgggtggattcgtgcttctgggtgggttctgtgctggcaagacattttatatcctgttctcttactgaatccttgtactgtttgtttagtttgatcgtttattctcaaggtttcccagatatactacaatatcatccacagatagagttttacttcttttctgattcttaggtctccagttggcttccgtgtccacttggattgggtaatacctccaggatgatgctaagtattatagaagtggaggcagtgggtgtatcctggccttgttcctcctgatctctgtggaaatgctcttaggtttccccaagaagcaggatgctagctttaggactctggatctcacccactccctcccacctatgagtctttggaaaatactatttcctcccttgctatttcaggcccaggtggcagaactcctctctctggggacccctccattgtgtgttttcccttccacaggattctgagttggatcctgtgtctgtctgtggccctgagagctgcaggtatcgactacaggctcagcatggtgggatgggctgtatcctcaaccctgtttcaacagggacacttctgctaggagaggagaatgggcccagatgtaaagctgcccttctccagggtttcctgaaccttctggtctctttgccttcatcttgcctcttcctgctccgttaaaaagaaaatgcttcccatttgttaattgttgagagtgtatgctgctgttttattttgcttgacatcttacaatcaatcttctgtatatgtttatatatgcttttctatttaagctttttttttttttaaatctaaaaaacacagtaccataccgccaaaggtgtcaggaaacacgctcaaataaggaagggctccaaagactgctttgccaacaaaatgccagtaaaatctgaaacccaggttcagacacactgggaacgttccaaaatttaaaacttaaagaacttctttattccagtaaatcagcttccctgtgaataccatcaaaatcctgggctttaatgagtaagggaatatcagaggaaggggtggagaaggaaaggatttggacgagcacaaaatttaatttaaaaactattatgagaagtttaatttcccctcccccaaccaaacacataaatcttttccatgcattttctttgtttcggtttttcctaaaaaatctggagagggaaaggcatcttgaaccatctgaaatgacagagtcagtggagtctttaataataaatatgtgtttattggattcctatgaattaaatgacatattagctatatgggaggatccaaggaaatcgtaagcaaaattgcattctcaccgaatgtgtaatcaaccagggagaaaagacattgatgggaaggataacgagtgatatgaggccttgggcctcttaaggagtagggacaacagaggtgtcagagtccaggcggggatggctcacttcggcaggggtggtcggggcccagcacacccccaagtgcactgaaagatgcgaccatgtagggagaatgaagctggccttcacagttcataattccatccacaggcagcactgagtgcagccacatttcaacattggaactttccagggcgaagaagcactgaacacgtcgcaagagcatggacttcctaggttttcaccaggccacgcgtgagcatggggctgtgggtgtcggtgtgcctcagcactgccacgtccactctgagtgcaggtccggctcagttttggatgttcctccgagagcagtcctccagggccaccgtgggacgaggcacctctttggtaggccatttgcactccagcacggcctctgttcctaaccacaatgggctgctggttcaaggactccctgccacagccaggaggcacagaagaccccatggaggcacttggctggttaagacccgcaggggtcacctgcctaggcttagcctcaatctccttgtagataaaactggaccctaacccttcactgcccagggcccctagggaataaatgtgccatgctgcgtgggatgcccaaggagagttctgtggcatttatttagccacactggttcctctcccctggtttcttttcatcatcaaatggacatgatggaaagctcctttgcggtctttctaggagaggaggcggcacctatattccagatgcagccatttcacaaccaggcgctgcttcctggtcagagccgctcgaccatgaggatattctacagaaagagaactcagctctctccttcctacctcacatgaccctaaggaaagttaagaaaagaggaaaagacctgtgaagatgcctgatcagctgtcagggttacgtagacactggctgctgttatttactgttccctggctgataaaatagccaggtcacctgtgccgatgaccagacccaccccctacccaccagcagggctgccagggctttctggggagacgctgcagcttggttcttatttcctttgctctgcatccctctgggttgacttgagtctgatcatgggtttattccatttccattttgctagattccctccactccctcaagcttctacaaaactgtggggccaccactccccacaaaagattaaaaccaagatgtttcctagaggtggcattttgtcttcctgaagctgttctgtgcacaggtcctctccacactcatgccaaatgctcggtgaagcgtcttcctgaatgtccctaaggggcacgtgccactggcagagctgatgggcacacctcactcccacacatgctgtgccgagctcatgactcagctgtgcagggcccgcccaagagtgaggcaaacaccaacaccgcacagcgaccctttgtcaatggtggggacctcagtggcttctccatcggaacttagggctgacgggcctccagacctactgttacacactggcccacggaatgaccctcataaacccaagaacagtaaacagagcttaacattctaacgaaatcaagattgctgtgtgtgctttcacaaaatgaaactgcctggaacttctcataacgttttttatgataagcattaaaatgcaaagaggaagattaaagttcctgctacagaccagagcagtaatgagtgtgggaggaggagctctgggtagggtctgggagagaggtttatgtactgcattacagttggatattattatataaaatgagtgtgttattaaaaggatcctgaagttataaaaactcaaaggaacttttactgaggatgaataacttctttggtaaagatgaatgactctcacgtcctagacactgaggtgcagtcacgtgccagagctctttaattgctagtagttggatttcgttgtttttgtggggcacttttttgcgggggaaggggcagaaagattaggaatacattctttgattaggaaagttctagtgggtaagagaaagtccctctagttagtaactgagaatcttgattatcctactagaaaaaggcaataagaagacgcatctcctatggccataacagccacctgattttttttgctctacttcttttaattttgtttgtttgtttgttttcagacagactctcattctgttgcccaggctaaagtgcagtggtgcaatcatagctcactgcaggcttgacctcccgggctcaagccatcctcccacctcagcctcccaagtaactgggaccacaggtgtgtgccaccatgcctggctaatttttaaattttttctagagacagggtcttgctatgttgcccaggctggttgttcgacttcttaaacagtacataccacctcatccatttaatgttacaaacacaatgaaatcagtaagtcagaaaactgtagagtgatgtggtgaaaaacattctttttaaatgtagttctacttattttaaatacatttaattaactaaaattataccagaatatggctttgggcttgatctactcaagtaatttatacattttccctataattttgtttgtgtccataaactaggaaatttccatgtaatctgtatcaagacaatcacaaattctaaattagtgaagaccaaagtaatgtttccctttaccatggttggaagtgtacaggatatttggtttattaattttaaaaattatgagagtaatcccgacagtctggaaaacagaaacaaaagatttcatcacacatactaacacaacgattgccaccttacgcattttctagtcctttctcaaagatgcatgttttaagattttaatctacgaattaataatttattgaaacctgctttttactttaagtggtctgagcatttctgtatcttgccatagtctttctgctgatggacaatattccattgagtgagtgtgtacagagtacttaactatacatctttgtgagtatgaactttccgatgtatctgatcatttcttaagggtagattactagaagtggtatcaatgggtcaaggatattaactttttacaactcctgatgcctactgccacactgcttttcaagaggttgctctaatgtacactcccactggggtttgaacaaggcttaaaagtacctgtttcattatatccttgcccaccctgggtattatcattaaaaaccgttttgggcctggcgcagtggctcatgcctataatcccagcactttgggaggccaaggtgggcccatcacgaggtcaggagatcaagaccatcctagccaacatggtgaaaccctgtctctactaaaaatacaaaaattagctgggtgtggtggggtgcacctgtaatcccagctactcaggaggctgaggcaggagaattgcttgaacccaggaggtgaaggttacagtgagctgagatcgtgcgactgcactccagcctggcgatggagtgggaccccatctcaaaacaaacaaacaaacaaacaaaaaaacattttggtgtgtgtgtttgttggctgatgtagagggtgaaaacagccaacaaacacaccaaaatcatggaggattaggaagtgggacctatggtgtttccttggctcttcattcagattgaagacaggaaacaaccacatagacatattctgtatctggctgcctttcccatgatcttacgcttccgtggctcaatggctgcctttcccacgatcttatgcttttgatcatccatggagaaaaacgcaaacggacgcaggaatgctccaatctgggctgtgaaggctcagacaggcaggaggctgtctgcccaggaaggcaggtcagaagctgctattaaccactctggcagggcagtgtttctgtcagcctgcagagcacttcaggttctgggagcagctgatggcagaactgtggtgttctctccgtggaaaaaaaatgaggaagtcagcaaaatgttcttaagccattccgtccaccattttgtccatctgtgttgatttggcagtggtgttggcaaagaacctgggtgtaggacaatgtgctttgtaaacagaagaaaatgaaatgatagatgcaggggtgcctttgtttgagcttgcttgtatttaaagttggctaaatatgcctcagcagagatctttggggacatgaatcataatagaaaaaaacagcaacatataggcttgtccaaaataaaacctgctcaccgtgcctcaggtaaccctaagaagcgtcctctgttgtaaaaacaattcaaatacataccaagtagcaagaatcgcataaggaaaccccacataggatgtccggggcaacaacatgcagacccccacccctgccggagccgagtacacaccaacccacacatccagggctctgggcagcggtgactgttcagtgagaccgctttcagcatttgcgagaagctgctcaccaactgccaagttcctgctgggtcggccaagaggtatgaaccaaaaatgaaaaaacatgaaaggtttgttttttaaaggcaatacatcaaacataaaaagagcccttttgtatgaattttcagtgtgggagccagagaggagaaaaaatcattttccctcctgggaggaagcagtttgacctcacctgcgacttttctcttacggtgtggatttttctcaccccattaaatgtaacctactctaggtgggttagtaccatgtgagagaaatagggggtgatggggaatatggcagacaggcaggctggggctcagacagaatgccgagcaccctcgagggtgggccctcgagggccacggaagcgggtgccacggggctgcatggaatgcggctgctccaaggggcctgtttgctggacacacaaggattaagtttccatggctccaaaacccttgcagcctcccaccccacccccggcaaaagcactctttgcaaaaggaaaggaaaaaagaacaaccaagttagaatggggttatcttcttaccactttcacaaagaaagggctggctgggatggacacagcaggtttcccactgtgaagccatcagaaaggcagcggaaaaaaacctcatggcagttaggtgtgggccagccacacagacaggaacaagcgagctttcaaacctagaaggtgagtgcgctacctgtcagcgttcacaggactttgctctgaagaacagtaaaagaccatctcagcaccgggtccctaaatccccttcccattaaccaggtgccaatagtgaaacctagaaggggaccctggtaaatcacccggcggctaccccgcaggctcccagcgctacgctctggggaccgtcagccttttcttctgtcacacagcaggagaatgagctcactttggcatctgtgtgaccagggacggctgccatctgtgtgtcactgttatcagtggtcagagcagaagtagcaggtggaaccatgtgaaatccctaacattcaaccgtttagacctgcaaaaatggctctttccttcgatttaccctgatgatgacaagaaaaggagaagggggggagggaagggagagggggagggaagggatggaagggaagggagcggggggaggaggaggacgaccatgatcatcagccaattgtgctacgtcagtccagagtgagctgctacttatgatttcatttcctccttagactgatgggagcaatgacaatccccatttgtagatgaggcacctgctcagagaactgaagttactcatccagggtcacatggctgtcaagaggcatgcccagtacctatgacaaacattcatccccaagtaacgaagccaacaacctgtgtctcactccagaaccacagagctgttacaacacgtggtgcctcctgagccagcagccaggggcaagaacgagaggatgcagggagaggctctggggaaagggctgtgtcccctcagtcatgtgacccccaggctttctagagtgactcatggtgaggacagcaaagatctcaaaatgctgtctagaccttaactctgcccatcaccccatccatttggttttgtttccctttcatttgcatgtgtagtcacatgctcagcatccttgggggcagctgcatctgtggtcctccagaaccccaagctttgcagttggacttgaacccctcatgcgcttttgattcctgattaaataacctgattcgagttgttgagatctttagtttacatcaaataattcttctttctattgctccattcacttctgcacattgccttaggtaccgattcattttctctacgacccccgctgcttacatgagttctaagatcatccacaggtgtgtgcctgtcggagggctcggagaacacgggacagcaggaagcagtcttttttttttttttttttgagatagagtctcgctctgttgcccaggctggagtgcagtggcgcaatcttggctcacttctacctctgcctcctgggccccagttcaagcaattctccttcctcagcctcccaagtagctgggattacaggcatgcaccaccatgcccaaataatttttgtatttttagtagagacagagtttctccatgttggccaggctggtcttgaactccggaccttgtgatccacccgcctcggcctcccaaagtgctggggttacaggtgtgagccaccgcgcccagccaggatgcaatcttattggtgtgtcacttttagcccaagaagcaaaaaagtggagtgagtaagctggtaggatcaactgttatttttatattaaaacaaacatgtaccagaattatggagtaaaaattatgcaaaatttacaagcatgttagagataaatcagaccttaaagaaatttagtgctagtcagaagctacataaatggtcaggcatgtggctgctggtgcaatattgtccctttacggccaagagacctcagacaagttacttaacctctcccatcgaaagcatctctcatgaagatgctgcttcagtcatagggttgtcaggaggatataccaagttagtgcctatgtggacagctgtttagaagcctcagagcaccctgtgaatgtgctttcagacctgccctggattcttagcttctactaaggacgagctacgggtgtgactgggttacgcttggctcattctggcctccctgccgcaacttttccaaagaggcgatctctgagctcctgggagcaaacccatgaggatacagatgattcggcaactttgtgccaggccctctccaggctctggggttgtttctgtgaacaaatgctctgtctctgcacccagggagctggcattctagtatgtgtgtgcaaggcggtgggagagagacataaatgcataatgtgtcaatgcagtgaaaacaaaatacagcagataaggggtacaaggaaggacaaaggatggggtgttcaagtggtccctgaaggctgctgcaataaggcatttgttcagaaagaagatagtgagagcataccatgaagacatgtgacagaggactattccaggcagaggcagcggcaaggccaaaggccctcagtgggattggagaggaacaaaaaggtgaccgacgtggctgaagcacactctgtgcgtatggggttggggggaataggaataagggttatgctggttgggggacagatttggaagtgtgcaggtcatagtaagaactctggattttttactgaatgaagtaggaagcaacactgagcctttctaagctaacagggatgagataactaagttacattttaaaggaattcacctggctgccacatggaaaacagcctggtggaaggaagaaagagatgtgttctgcacattttgaaagtggaacaaagaggacctgatgatgaactgagctcctgaaaggaagatggagtcaagggtgagttcacgacttctggcacacacaactcaaggaaaaagcgatgtgccgtttcccaaaagcaggaggcaagggctgagcaggctggagggtggaatctggtgctggacttagatgtagcaagcataagatgcctatgagacagcccacggaatccaagcagaagtctggagtgggagggagaggtctgggctaggatattcatttgggaatcattatcgtggagatggttcttagaaccatgggaccaggagaggtcagccagcgaatgagttgggctggagaggggaagacgtctgattaacctgactttgttctctggcaaaggcaccaggttgagaattcagaaactcatatccctggtttctttttagcaaacacgaagcatggtgaccaagccatgtcatcacactggaaccgcaaaaaagagaagaaaggaaatgcgcttcgtcttctgcgaggacacattgacggtgctcagctagccagcatctaggtcccacagagggcaggagggatccggaaacactgaggtcccctcctgagaggctcatgccctcacatactttcttaatataatcaaaatgggagtaaatgatgacaatatgcaactttccaaatactgagggttctggaccaagctactgaaacagatttcatagttgctatgctccatactctgcctagcatacggtagtcattttataaacatttgacaaatagttatatttctaacagaaaccagaaatttggggccatgactcctttacagctcaagaaatatgcaaaattagtattccctgagagacagatgtctgaaggccccaagcagtccaaccctgtcctgtcatagcctgagacatcctgccttagggagtaagttattactaactgtggacaagctctgtttcccttttggaggaactgagggcagagatcctgccattaattcctcccccagtgcctgggatagtgccctgtgcacagcaaatgcccaatacatctaaataaatgtcaaatgaatgagcgaataaatattcattaaaaattaaccaaacagttaatttaggtcattcagtggaaaaaagaaaaacagtgaaactagaaaagcatctttttaatttaaaaggttaattaaggacaaggttttaaaaaaatattttggtggatttagtaaaccaagcacacctgggactcaaaatagttgcaatctgtaactctaaacacagcccattatgtcccacgaattagaaaatgagggaaagttgcctgactcgcttcatgattctagtataatctcaattcttcaaccagatagtggacaagaaaataaaaaaccccaaacacttaaacacacagatgtgaaaatcatgaataaaatgctagttaactgaattcaatgctacatcttatgtgtattataatcagatattgtttatcctagaaatgcaaggatggtttaacatcagaaaaatgtatcaacataatacataacatatgggtgggcaaaatgaggaaaatcacatgattttctgaatagatgcagaacagacatttggtaatttcagtagccctaggtcagtccaaatgatctattagtctgatcaatttaatgattttattagattctctaattcccaaaagcatatttctttttactatttaagcattttacagcaatctgttttagatgtataagcagggcccacgagagctgtgaggaaccaggactcggataatccagggcgttgggagacttccccaaaccaggaaatgatcccatgcaccatctgagccttccagtcttcccacagactctaccaaacattatcggggccactaacaaagaaggaagaaaaactactttcaatgttagctctccctttgactcttctactgagggatatgtgggggacccatgtttatgaataataacttccagaaataaaaattcaggagagacaagcaatgcagcacctacagaaacaaaaataatcagacctaaatccacaagtttattaaagtgactttttatcatgatctttttttttttttcctgcaatggagtctcactctattgcccaggctagagtacagtggagtgatctcggctcactgcaacctccacctcccaggttcaagcaattctccagcctcagcctcccaagtagctgggactataggtgcacacaaccacacccggctaatttttgtatttttagtagagacggggttttaccatgttggccaggcgtatctcaaactcctgacctcaagtgatccacccgcctcggcctctcaaagtgctgggattacaggggtgagccacagctcccagcctatcacgatctctcttaacactgccctgacataactcatggctgtaccatccaaagacagtattttgtgctatgtctgaaaaccttccaatctggccttaaaacaaatattcagcaacataatagagtgataatgtcagaaaagagtattggctcccatatccacagttgttttaatagcatttaagaccaacattttataaatattattagaaataatatttattttttattaacattaaaattaatataataaaaatataatttttctcctagctttgcttatgtttgtgttttcataaatagtagaggggagaactaatgattaatcaatgggctgtgcatcacttgggaagttccctgtgtaaaaagctctaagttaacatctttgcaaaaccattaggaagaatttcccaataatccatttaaacatatcagattaatgaggaattaaatgcatctgcacttattcttggtgtggatttcaactgtttctcaaagctgaactgagccagagcctgctcagcagaagaaaaattgagaaggctaatggagagagccgttagcgtaggatgcaatggtttgcaacttggtgggcacacacggtctgaagcctcaccctgccctgacgcctgcattcctaattctgtgcattcacatgttgacttaacactggtttattgagcatttactatgtaacactgttctagagaccgagaaatacagcagtagaccaagtaggcttacgttctggcaggaggagtcagacactcaacaaatatgcaaatacagacacaaatattgggttgtggggttagagaagaagtagtgagagctaaggatggtggggagaagccctctctgataagctaacacgtgagcagagacttgaaggaagtgagagactcgggaagctaccttggcaaggaacgatccgggcagggagaagagtaaacacaaaggatggaggtagtagcgtgtgcttgacctgaggcccaacgaggaggcccagaccactggatgaagtgtgtgcacagtgtgtgtatgtgtgtgtgcaggtatttgggggaggaagggaggcaatcacacagggcttccagggaggtgaggactatgaattttcacttagcataatattttcaagattcacccatgctgtcacacaaattaatattttgttcttttatattgcttggattcctagttgtattctagtaatttgtttatccgttcaccaaatgatgactatttatgttgtttccagtttggggttattcaaataaagctgctatgaatatctacatacagtctttgtatggacaaatgttttcatttatcttggaaaggcatccatctatcaactgattgactgactgattgatctgctcactatgtatcatccagtaatgccattcctagggatttacccaagataaattccagactgttttcaaaagtggctgttatcattctgcattcccaccagtaacacatgagagttccagtttctccacattcttgtcaacatttggtattgtcagtcttttttaagttcagccctactaatgcatgtgaagtggtatcttatcatagtgttaatttgcatttctctgaagactggtgacactgagcattttctcatgtgcctttaggaatttataaattttctttgctgaagtgtcttttcaaatttttgccttttaaaaaaattgagttgtcttaatattgagtcgtaaggttctttatatattctggctatatgtcctttgtcagatatatgtcttgcaaatattttctcccagtctgtggcttaccttttccatttttaaactgtgttttataaaaaaaagaagtttttttagatcaaagtccattttaatcattttttcttttatagttcatgctttttgtgtctcatttaagaaatctttccctactccaatgtcacaaatatattctctgagaagcttaacagtttttgcaactaaatttaggtctatgatccgttttgacttaatttttccatatggtgtcatgtaacagttgagatttttttcctatgcaggcagatattcaatggttcaagtaccatttattgaaatggctatcttttctccactgaatgaccttggcacttttatcaaacatcaactggccacacacaggtgagtctacttctggacacttaccctgttccattcatctgtatatctctatccttacaccaacacgcatagtcttgaatactagggcaagttaattttaagatgtctcctggatatgtaaaaattatatctgagttgaactacagtttatttatatatccaggcagcaaataaatgtgagaatctggaggtgagggaagagatcagagataccaccttggaaaccatcaatttagagatgattcttaaggcaggggactaagggacactctgtaggacacagacatagagaagggaaggggctgcggcctgaacaccccacctgcatgctcactcacatactttcgtcggcctgtgttaacgaagtgctgggtctccccagcctctctcatctgtaagcagtgccaacaacgtccaacacagttccatccaatttggatctgccagatttccaaggagccgaaaacttgaccctacaaatcagagtcccgaattcagcccagaggctcagaaagttgctccagttttctaagcctcagttctcaaatttggaaaaatagaaattcagtaactagccaaaatcatagggttgtttgtggacaactaataagaataaaatgtaaacatttagacacgcaagccccgtgaggaaaatccagccgtccctctttctaatcagggtggtgtgagtttcctatgacccatttccaccatttccacatttatgaaccgtgatcaacattagacactgaaaacacaggaaaacaacttctggacaaatcactgtgagctcaaatgaccccgcagactctgtggccagcttgaccccaccactccatcatcaaagaggaccatggtgagagcctgagggatgaggcactacttgttgatgctggcagggatcagcagaaacatatgttttcatgctgaaaacagaagacacagatgtgggcacacttagaatgcactcctggcacacagtgggtactccgtaactacttggtgaacaaagagacacaaagaaacagcagtcatttgaacaatcagctgagaaaacagagactctgtgaccaagctctccatcaggtatggaacagatgcagtcacaggaatgataacagtcacaaggaaagctgagggtggctccctgccggtaccgctcttggcagtttatgggaaattattcatcctatggagcagcactattattaaccccgttgtaccagtgaggaaacagaggcaggaaggtactagaattactcccacttcataggttaaggaaactaaaacccaccaaaatggcagggctgggacttgaacctaggtcatcaggctatggggttccacggactatggctcagctataatactacgcgatattctctcccatcttcagaatgtttgcttcacttcaagtaaaagacagtaactaaaaattctctttccatcatctgttaccttaaaacagcctaactcacaaaacttcacaacgcaagcccaggtattatggaacccaccaagaatagcaagttcagtgttggctgccatttctaagtggacagtgttaattccctccacttagttgaggggcggagagaggtgttgaaggaaagagatgagatgacaagtctgaagtggcttcatcacaaagcatccatggctgtgatatgtagctgtgtcatccatggcaacattcgcctgaatggagattgtattatggacattgttctgggatgcctgaggctgatgacatgggacatgccggaaatttatgtatttcctacataaatatgcagctgaacatatttatgtaggaaaattaaagaccagactggtcaatcactggtaagccgtcaatgccccctcaatgattacccttgtcattcgtgccagccaaaacacacccagttcacaatagagacgcaagtaacttttcaacctgcaactgaccgctagaaattgattttagtagttgcctctatcctgtgatattttagaaatcaggttatcatgcataattagctctccagcccaaatcatctgtgccacattctattataacaatcggagaggttatgacaatcaagaaaaggaaaaaaacacaggcatctgtctcatagttcaattttaacaggaataaaaataatttgaaagaaagaacaaatacatagatcaaggccacatctgccatctcattgcaaggcacatgcccatcctgtctacaaagcttttggcatagcatgtctggtgcacagtaagtacttaatcagtggcagttcatctttttattattattaatgtttctagcatgaatggatctcagagagtctattaactttccttcctagtcaagggatgcacaaaaatttagcaaaacttcagatattaatttgcttcactgtgagtagttatgttctatttataaaaattgcaaacagattgatttcctttcttttttttttttaaattttttaatttcttttatagagacagttatctaactatgttgcccaagctggtctcaaactcctggtctcaagcaatcctcatgccttggcctcccaaagtattgggactacaggtgtgagccactgcattcagcattgatcttattttcatttgcaattttagcagcaatatgatatatataatattctttaataacaatattcataatgtatatgacataaggtatacaagaatacaactattttatacactaacagtagcaaataatattctctttcaaaattgtgattcatcgaggcaggctaacattagctgaaacaagtccaactgcagtggcccaagtccagggctagtcaggcagctctcctccaagcagtgactgagggccacaggcctcttgcaacttgggatgccgccattttcccacaaggcctccaagattgcagcataaggggaaagggacagtgggagaatctcatgggccaggcctggaagaagcgtacttcatgtccatctgtctgttggttgtccaggcaacgccagcccaactgaaaggggactatgcgcccaggagaaaaatgaaatagggttgggaatcactgttttctgtgtcataaacattctctccgtggacaattaacatctgccttgtactttacagatgtttacacggcacttttcactatgtcttatttattcattcagaaaatttagtcaataaaaaaagttgaaaagttgctattgttattgccattttccaggtgaagaaactgcggcttggagaagtcatttagcatccaagcagatgagtggcacagccaaggcttcattccctgacctccgcatccaaatctcaagccctttccacttttctttgcgtcgtactgaacttcaagaagaacagagatcctgtgataaaacagatttatgacagaagtagggttaccttttcactcccaatgggatccagtgttgtgtagttccataaaaaaggcacgatccccacacaattcaacggaacagcctgagagcaggctttcaccagtccatagtcatatatgagccagtacagggagtgtttcaaaactgaaatagaagttaatatcctgataatctcaaaataagacttctaattcttattttagaggtcaaagagatgggtgtagatatgggtgaacatgattaaatcaaaattatggatgtgaagaaaaactctgggcgatcagggtccagttcctaaccctgtccccttaactagacatgaaacccatgtggaatactcattgtcatggtgacaaccgggtggatggagtttgaagacaggtcagaacacactactaggtccacaaagcccaaggcgtcactgagctgggtgtgaagtggctgtctggcacatcttcttccattgacaagccggcctttgtgatgagaaggaggctcatggcacagtctcagctgagtccactcctgcaggcaggcagcagggaggacaaaacgtccccagcttccttctccatggtctctgcctagagagcatcagtatttcgatgttcagcatggaatagacttccataacattgaaagcagtgatcttctcttttcaaaacaaggtgttgtatgcagtattaaatctggattccagaaacgctcgcacagggcgaccttgtgtgcagaagtttattgccaaggttccagtttatgcccacgaggcgcacagcgaggcttctggaggcagcagcttgcttttggcattcccttacagagctcagagccccgacaggttttggctgtaagaagtatcccgcaactgatttattcctcaatttcaattatttttttctctacatgaatcatttccatgtttccaaagcagaagtagaaagaaagaaaaaaaaactcataaggtgaaaaaaacttccaaagtgttttgttttgttttgtttgtttttttattgaaaaaaaaaaaaagcctgcaatacaggaatggatttgctatcaaacatccatttcaggaaaccaccaggtagaatcgggcaatttgatgggcaattgggtctcaatttccccatcaggaacaacgtctgtgcacacacacatacacacattcactcccaagccatccacctcaccagaccatgagcttttagggagaccgaattccagccaggaaggcagtttccttttcactgtaccaacataatgcttcattacaccaagacacagcactctcccatctgccaggtcaataaagaatgaagcttaaaattcacagtcacctttacaatgctaagcatttcaaccttaaatgaatgtgcagtccaccaatccgcttccccggcctgcatccagctcttcccgtagctgaggctcaaatgatcttccacggggtccattagttcctcttggctggtccctgggttcaatgcaacgctcccagcaggtacggtaactgccactcatctgaaactcccaagttacactctgcctcactgacaagggcatggggcgctgcctcctattctgttttgtgggttctttgatcaccagaaggaatttcgagccactgtgctaagtaactcgaattactcataggctgggatcccagaagccgctgggttcctccatataccatcagaagctgagcttctccagaggacactgaagaggctgctcaagaaccctacagcaggttgtcccagaattacccaccatgacctaggtagctgactaaatgccacagcccacctgaagtttccccaggcaaacacctggagtgtctcatgactaagcaagatgtcctatggagctaaaaataaccctcctatcccttcctcctcctgccatccccatctctctgaccctctgtggtcctcaaagggcatttaagatttgagtttcctggccagaacgtgggcaagtgcttgtatttatttgctatttactaactgctgccatagtagatggcgtttctaaaacggtataaaacatctaccaacaacatcaggtttttggtattctatatgtgactgttaaaataaaaatggaccttggctacctataatgaatgagccaagtaaaagcactccaatcctggcgtccaattctatcagctgatatttgacacagggtttgacagttgacaaactgtctctccatggttccctcttaacagctccatgaggtggcagggccagtacaatcatccttgttttgtatctgagcaaaggacattgtggagagattaagcaaggctacaaaatcggtgaaggattccgactttccactacagcaagaggtctcagtgcatggctagccctaggcgatgccagaaacatgacgacataagtaatactttttttaatagcaaagaaagcaagccagtaagatgtccagcttgggaaatatgaagttggcaaggacaaaagatgcctccaaattttaaagaaaaaaaaatttctctctcggttaaccctcactactccatcaagagtaacagcagagtccaggtatcccctggaagtgggtcaggttcgggtctgcactgtcttccttgcttccaggtaccttcctcctcccaggccgcacggagtcccgggcccggctccgggcgctgtgtttacaggcagggcggcaggaaggacatgacctccccagctctgcggcaggttaagcagcctgattgaacgtggctgctaattaagggcccctcttgtctggcagggccaccagggtaccttctgcacttgttcatgaccactgcacctcgctcagaaattaactcttgatgagtgcagacaggggcccagctggtcctcccgagtcctcccaagtagataaatgaagtgtaataagaatgccgctgactgccaagggaagaggggctctccgtgacctcttggtaaaatccagagtatacttttactatgacttaattctctgcactggggacacctaacgtagccaggaatggtgtgaacagaccactagccacagggacagcatagaggcgtccatcactagacgtccacttcatgaagtaggagttaaaagaataaagaggtaatttatgagaaactaattttcaattgacaaatattttcaggaggtgtgatgacctacttttctccataactcttcatgggcccagggacaatggtggctcctattacagtttgcaaatggtacaatcattccgctcaggtttaaaatattaaatgctcatcttctatcacttacagagggattctttccctgaagctctatttaaggagagggaaattgcggccgtcattgtccaggcctcccacatacagaaacttggtagacagacatgttctgggtcacatggctaagctgtactgacatgctgctcgagtccagaggtatcgccattgagttcagcacagtcaggaccagagccttttccaccattcatctcaggaagccaacacacacagctggtaagggggagggcttggagctaggagactgggaactgtgtgtggtcagaagccacctcactgccctggcccacagtgtggttccctgtgtgacatcatctttgagatatgacagagacaaaaagcaggctgagagtccctgctctggactctagatcacaatgaagccacatctttctacaacttttgaaagaagcaggtgaggtttccgaaaaaaaaaccaagtgaaatgaaaggtgacggtcagtgtgctatcttttgaccgcacagcaaaaaagtggttgccgggctagaagcaagatggaaagatgaagaaatgggcagaaaaggcatttggtgccttgatgaaaaatttcaaaaataaaagggtcccatggtgaaactagagcaattcccagaagactaaatgtgggaggaatgggacgaggtaggggaagtcagcagagactctaagttgtttaagagagcgtattacttatctattgctgtgtaacaaatgaacgcaaaactaagcagcccgagacaacttaagaaacccacgatttccgtgtgcctggagtctgggttggctcagcaggatgcctttagctcagggtctctcacaaggctgcactcaaggtgtcagcgggcactgtggtcatctcaaggcttgcctgggggggtggctccgcctccactttgtcccttcccaacctcatctgtagtctgccacaggcctcggtgccccagtagctgctaatcttttgccatggggctactcatagcacgtcagcttgcttccctcagagctgggggtagggagaagaggaaaagcaagcaagacagaagtcacccagaagtgcaaaaaaggagttgccatcccattacttttgccatatttgatttgttagaagtgatccagtaggtccgacccacctgcaaggggagaggcttacgcaagagcatgaaaacctgaggacagagaccaccaggaccaacaaaggctgtggaccacagagacactctttattcatggaataaacctggagcccgattctcccaaggcgagcctcctgaaatgatagaagctacggagggaggccacatgctaggccacatgtcagcattattactgttcatcattcattcagggcccacaaaagcgagagcatctccatacgggtgtggattttaaaatcaggaaagcaggccagatagaattcatgcttaggcacagctgctcagaactgaccaccctaaggggcccactgttaataactcatcctttctgatgatccgcccactgcctggtgtggctgctgccactgttcagctctgtcccctgccctgagaaacatgtgctgccagaggttcgtcctcacaataataaccgctaacactgagtgacagcatgtgatggtcaagtacagagtctggcactttatgttcatcaccgcgtttcatcctcaccacgaccctgttctgtggatccggctggacgcatccagaggtgggagtccctgtggtctgggcactgatcagtgcctgaatgttctcagggacactccccttcattaaagcagacagttagacattaacaggtctcatgactcaatatataactgaattgttatattatgggcacattgcacaactgttcacttagaaaatctaaaagaatcagctaaaaactattagaaaaacttagtgaagtgtataaaatgaaacactaccgtgccactttaggactctggcaatagctaaaaagtaagttttgtgataactcatgttcattgtagaaaatctagaaaataaaaaaaaaaaaaagtaagactaaggcattaagtcactcatgactttaccaaaagacattttggtatattttctttgatgcatttttctatgttacatgggtgactatatcattgtattttaaaaaattgttgtcatactacactagctgagcatcttgcttttttcacttaatgtaacattgggagcattttcccatgctcatgttcttcaaaaacccaaggttaaatggttactgaatagctcatcatattattacaacctaattttaaaaaactatttccttttactcatttagtcaaaaaaatcaaatttttttcctctgttccccatttcctgtctttaaaaaattatttgaatatccatttcagttcttctattggcttaacacatatttatttacatttttaagttggctgcaagttagaaatataagttttcacagtctgcctacagtcagtactgtacaacctctataataaagaactcttctcaccatcgaggtccgtatctacccctggtctttaccttacagctgttacatgtatctcatctatagatgttataagcctcgcaagacagtgttataatttttgcttaaaattcttatatgattaacaatgaaattaagaagaaaaaagcagaaagaaaactagtattttgtgttgatccaaatatttaccagtccagtagtctttactcttttccaaggacctgagttcccaactggtattatttccctttaactgaaagaagttcctgcagcatttcttacagtgcaggtctgctggtgataaattcttttttcttttatcgaaaaatgcctttatttcccttcaatcttagaaggatatttctacaagatataaaattctgggttagggcaggcgtggtggctcacacctgtaatcccagcactttgggaggctgaggcaagcggatcacttgagggcaggagctcaagactagcttggaccacatggtgagaccctgtctctactaaaaagacaaaaaatagctgggtgtggtggttcgcacctgtagtcccagctactcaggaggctgaggcaggagaactgctcaaacccaggaggcagagattgcagtgagccgacatcatgccactgcactccaacctgggcaacagagcgagacctcaacttaaaaaaaaaaaaattctgggttagaattttctgattctctttcagtaccttgaaaatgttattccatgccgttctggtctgcaaggtttccagtgagaagtcagccattaactggattattactgtatggcttttctcttgttgctttcaagatttgctcttcaactttggttttcaaaagtttgcaagaaccagcgtgggatttttaaatatttattcttattggtgtttcttgagcatatgatcttatatctgtaaatttctacttgtcactgaattctgaaattttttagctattatttcttctactatttttttctgctccattttctctttttcctctgtcattttccccctctctgccttcagctgttaagtccactcagtaaatttttatttgagataactattttcagttctagaatttccatttggttcttctttttatcattctatttctctgctgagctatcttatcttttcattcatagtgagcatatatcatgttatttcatttaggatagttttgttttgctttgctttgagacaaggtcttactctgtcacccaggctggagtgcagtggtgtgatcatggctcactgcagccatgacctcctgggcccaagcaatcctcccacctgagcctccccagtagctgggactacaagggcacactaccatgcccagctaatttttgtattttttgtagacatggggtttccctgtgttgcccaggctggtctcagactctgaggtgggctcaagcaatatgcccaccccagcttcccaaagtgtcgggattacaggcgtgagccgtggcacccagccatttagtatagttataacagccactggaaaaccttgtgtgactctccatatctgcttccccttggggttgaacttcatttgatttctctttttcttgatttgagacagtattctatttccttggttcttcaaatgttggttattttagctttgtatcccagatgtgaggaaggttaaactgtagaggtttgggattttgcgatttttcttggatgactgttagttcttttggttggcaattagctgaacctgaactgcaaactctgaccctttcggcagcaagcacagatttttttgtcattattgtgatctgagtctattctatgcatgtatggttcagcgatcaaagatgtatataaacagaatttggggatcccctctccagcccttttcttctaggagtccctctcactgcaccacctgcccttggccctgagcttacttggtgcagctcaagagtgcagctcaagacccaccttgtcccaacgaggttctcccaccataaacttgcctgcttctgctcactctcaatggcttcaggcagctgctttctgaattatacccagttttcatagttattttctgtatgtgggggtgggagggatggaggtgggagatctgtctggtaagatcttgatctgccattctcagaagaagaagttcccagacctttgtatctaaataccattccccactaaaaggaaccagagttccttctaaaaatgtagaaagtaaaatataaaaacagctcattccagagctgggtacaaggttacgcctggaataccttattatgccagagagtgaggaagtgatcaaagatccaagaggccctgtcaaaaggagatgggagcctacttttcaaaccaaatctgggataatttgagcaaagagaataaggatcataattaataataaaattctgaagaaaagagagacttaatagtccacagtgctgattgagaggaaaaggaagagaagcatattactcatttaattggcagataaaactgaatgtatttgtcatgtacaacacgttttgaagtacctacacattatgaaattactaaatctagctaattaacatatgtattacctcacactgttaccatttgttacatttttaactgatgacgtatctctcatttattggactgataacgtatctattcctcattcactggattctacccagaaacagcacactttcaccctttcatggtacagctgccatgctcttcacaatgttattattctagactattacagtacaagctagcagtgacctatttatcttttaggatcatgaacaatatatatcacttcatttctagaaactgatcttcaaaaactataacctactgcaggacaggtgaggccagggaggcggacacctctgcctccaggaggctactctgtgcctcaagaaccaaagaacgaggggagttcgaccactgcctgtacagagcccgaatgccctccctgctgctgttctaatgcatgtcccatctgcaatgttagaaaacaagcttcagcttgatacagtggaacttggcagatggcacagtttgcttgttacagaactaagtatgaaaataaattcatttagtagtgctccttggagaaatgtggttcagaagtcaaataattttaaaagacctctttcccatgtaagacacccatgaaacaatgctctggtcataattagtctctaacctttcaaaatgcctgcttcagtgacctcacctgctattgaacacgatgcctgcagatggtgtgaggtggccaaagggtggaggactggcagcgggggctgcagcggctgctgtgaccagccactcacttgctgaaggatcagggagagacactgtgtctctctgggtctcggcttcttaacctgtgaaacccaggggttggggaaaagctcgccaagcccccctcctgctttggcatcctgtgagtctttattgtcctgggctagctgggacccctaggacactgggtggctccttccaccccacatgatcattctgctcaacaagaacttgcaggagccacagacctgcctcacaaacatgaggaagcgcatccttctacaaagcgagaggcttgaggtgtgtgtatagccaggtcaaggtgaaagctactgaggttttgcggaatcaactctgtatcaaatcttctctctctatccttctcagagtctgatcaaactgggaggtaacagattctcaacaaatctcaaggagagggaggaaaatatctacctactatggaattatctgtaatttttctaacacacagagtatgttagctaaagctttaatgccccctatcctttctgtcacttacggtacgctttatcctttgatttttgatcaactgttagtcgcagaatgaatatgcctaaattatcactgaaatctagcaaattatgtcttagaatgttagttttaaaaataagtttgaaaatcatttttatgagtctttgtaagctcaaaaatatagctctcattattttgacttagtttgtttaaattgctaagaaaattatttcctcaaaaaacagacactgtactcttcaccaaatttagtatgttgaaaactgaaaataagaaattacatatgaaagagcaagccagagacaacataccaatatacagaaaaaatagaggaaaaaaatactaaatttttcacctctgacttttcctccttttaaaaagaaaaaaatcagggctggcgcggtggctcccacctgtaatcccagcactttgggaggccgaggtgcgaggatggcttgagtccaggatttcaagaccaacctgggcaacaaagtgagaccctgcctctattaaaaataaaaaaattagccgggcatggtgctacatgcctatggtcccagctacttgggaagctgaggtggaaggattgcctgagcctaggagttcaaggttgcagtgagctgtgatcatgccactacacttcatcctgagcaacagagcgagattctgtctcaaaaagagaagaaaagaaaagatctaccagaagccttgggtccctgttttctggcaatatgctatgcatatttgcaaatatgtaaactgcatggataattttgctgtaacgaggaatgtcactttaccagactacaactttaatcagcattcctctgaacaaacttgctcatgatactaagcaacgcaaacatgcagccaaacaactggtgttttaatattctagcttctatttcttccacgtcataatttcctgtaataatctcactcatgcctgaactccacagacattcttatttatgtttttcaggtcagtatgccaatagcaagaagacttgttcttgaaaggttgagtttttcaaatgagtcctgaaagaattctaccacactgcctatttcccaagcagggatcatgggagaaaggaaattttgaagaaaatggttctaatgccattttgttaaaagtactgagagatttacaatgatcaagtaatatgccagttctttcaaaggatgccaacatctgatgccaacataattacaagttggaaaaatgtgtaatgaatcaggcggctcataatttcccttagaatatgtatgcacaacttattaaatgacataaaaagcaaagagtcacggcaaatgttgaaaccttaaatctgagtttcattgctttggggcattttcgtcaaactccatcatctggaagtacctaacaataagaaatattaggtcacaagctgttttagaaacacctgtaataccttcacctaatgaggccaataaacgagagcttcgtgttcctcatcaaataagaaaacttaatagtcaaatctgacataataagcccaaactcaaaccctgtagaaatggaaacactcacatggagagcattttctcctccaaattttcgattctgccaggtccctcccctaaagccacctggtggaaaaatgtgcccccagtgctaggtcagtgtgggtttcccagagtagggcttaattcatgtggtggtctttggaggctcagaaagaatagaatagagttttctcttgatggtcactgtcctcacctcctcctgctctcccccaaacacactacaacctaggtaaggagaaagaccctactgacatcttattcaaaacccccaatcccacccctttcaaggtacttgccagggaggtaaatggtggactctgcaggtttcctcctccaaaatcatttgtatactttgtctatggtcactgtctccccaaaagggctatactatcattttcttccaactagggctgtcagatttcacaaagaaaaatacagaatgcccatttaaatgtgaatttcagataaacaacagataatttcttagtatgtctcaaatcatgcatgggatatacttacactaaaaagctatctgttgtttatctgaaactcaaaatgaacagggcatcccggattttatctggcaaatttatgcaaaacattcataatatggggaatgagaaattaacacagttacctctttctggtagtccaggaagtagagaaaaggcagctctaagaaggggtagaggtgagaaaagggaaaatgtaaagagaaaataaagccttccttattttggtagaattccatgtggtcctttacaaactttaacgtgcatacaaatcacccagggacattgttaatttaacatgtgggttctgattggatagggtcgtggagtctggaattctccatttctaatccctctccaggcaatgctgatactgctggttcaaaattcgtttcactggtaacagaattccagcctcctttattccaggaattgcatggggtcaaaggcaagaagacccggtgcaatgggtggagaagcaggtggaggagtgggggccctgtgagggccagggaaggccatgtgagtgtgtggatgtgtggctgagggaaaggaggccagggatcaatgaagctttgctttttttttttttttttttgatggagtctcactctgtcacccaggctgggatgcagtggtgcaatctcggctctctgcaacctccgcctcctgggttcaagcaattctcctgcttcaggctcctgagtagctgggattacaggcatatgccaccacatcccactaatttttttgtatttttagtagagacggggtttcaccatgttggtcatgctggtctcgaactccagacctcaaatgatccacctgccttggccccccaaagtgctgggattgcaggcgtgagccactgcacctggcctcaatgaagcttttctaacagtgaaggtgaaatacaaagatttggtctcttctgaggtttcttctaattctgcactgtgagaaataaccactactgtcatccacactaagacatgagttttgagcaacaatagcaacaacaaaaaatgcacacacagcaaaagcagcaaacagttttagacattcatgcttctcatattattactgagaaacagagcagtacgcttaagaatccaacacaaatgccttgtcacatttggacaaatgagtaaagacgggggataggttgtgtagaattcatcaaattggtgcccctaaaaagtgaattgagatttcgggacctggccatggtttgacccttagtgatgtgtgtacctatatacacaccaaaacaggcactcgcttcactttccaaaagttatctggagaaaagttgttctagttcagagtgtttacatagaccaaggatggtcaactgagactccagggcaaatacatgagatttttaccggttcctggatacctttgactcaagacagaaaaaaagtcattaggaaaatggtaattattcttgtcattcatagaagcctacaattctcccacccaggaaattccactactcaattaattgattacatggaataggatgcctccactagtcatctagtcaaatgtggacactggtctgggttttaacttgtgggaaactgtttttctttaactcaggggactctaaagtacaatggctaagagtaccagagtcagactacttgtgctgaattctggctccaacactgtctccctgggttccatactactcttagcctcagtttttacatccataaaaagggatcaataaaagaatgtctgactggggcaacatagtgagaccccatctctataaaaaattttaaaaattagccaggccagacatggtgcatgcctgtagtcccagctcctcaggaggctggggtgggaggatcacttgagcctgggaggtcaaggctgcagtgagctgtgatcacaccactgcactccagcctgggtgacaaaggaagaccctatctcaaaaaaaaaaaaaatgtgactgtcactaggctgctgtaggggataaacttaataacgtatgtctaggaaatacacaggaggagttcagtaacgttgcctgttaataccttgtcactgtagttactgtttctttgctactttgcatgaagctctgaattgctcagtgttaccctgaagctggggactaaccatccttctctggattgccttctgccactcagccattctagtaatcaagctaagcctctactgaggtcccaggacacacagttgtatgggtaagccaatgcagccaatgaaatgtgttgtagatatagaaaatgagctatcggaaacgctgacttcaggaagtggagatacatggcacagctccaaaggcaagaagctcatagccaccacgaatctagtaagtcctccctgcttcttgccttacatccacaggtgtgagggaaattggtggtaaaaatttcctttcccatgactcgtaagcttctgagaaaagccttgtgatgatatactaagtacttcagcaaaggatcagaggagtcagctgtgagcactgctcagatcccagtaagactttcagtggccaagattaaagctggcttccctctgccacgccaagcaacccagcctggctacagtacagcaggctgctgcaggaacttttcagagcgaagagtaagcgttcgatgaagatgtagactcgattagagtggaagatggaagcagcagataacggatgcattacataccatactcttttcaaaatgaaaaagcaactaacatgcaatccttcaatataaaggtagattataaacatcggtattttttctttttactcgcacttggaattactttggttgtaaccatttacgtctttgctcagtctggatttaatcggtttctctgttcttccctgtaaaactgagtctttccaccaaatgaccctgcattcaccttaatttgattttctgggttttcgtcttttaaaagtcatcacagatcttatgccatagttgtgatcagttctccaacatttgtctgactatggctcaagattaaaaaacattttcttctaagatgtgagatctcctaattctccaacactcacctatcctccacccaccggcatttctctccctcaccctgctcctccgcctgcttcttcacccactgcactggggcttcttgcctttgacatcatgcaattcctggaataaaggagactggagttctgttaccagtgaaacgaactttacgttagagacatccaaactgtgtggatttggtataagcttctttcaaaaagtactactccattattgggaatgtttatgcctaaaaaagaagattctgtgttctattgtgtcagacgctttcaaagtgcaattgttcaatttgcaaactgcaattggttaaccaagctaaacttaattagtccaacgatcctacacatcaaaccctactgtttgatgtattctgcgagatgtccaagccgcctacagctggctaagggtcacaatgaaaaggcagccaggcttaggtctgggaactgaaatgagctgttctaagtggagcttttcttccattttctgaggctgcactgctctgaccttctccaaatcaatcctttgcggattaacatgtaaagcagtgtcgaattaatttcagaaagggaatatgagatcagcctaggatcatacaaaacatctaactcctaaatacactaatgcttctagccattcaatgagaagctgtcaataaagggaaaaaagtcggtgaggggggcggccagaaggatttgaaggttggagcaatctatcagactagttagcacattgcctacttctgtggcatggctaatgcattcctctagaagttaatcctatttctaaagaccctcccgcgaggagcacataggccgtgatgaatgagaactaaaatgcattaaaattctcaacaacttcaccaaaaggcacactattagattctgagtgtctaaaataagacggttcattaaaagtgcaggtcttaaagaacccgcttttgtccctacacactggggagagaggggccagtgtgtcacttgtgacacctgcagccaaaatatttttacattaggttgtccaagtaatcacatgagaaacactacatgaaacggcaagggaaggcctttttcacaagcgagcttaaatagcgttattatgtgcctacgctgggggaggatgtgtttccccagcattagccacacaacggtgtcattaaacccacttttaaaaaacagacatgaaagagcacttaatttcccttggaggagcggcggtatttgaacacttctctttttctctcattgtattttgcttgtactcaattaagagataatttagccatttatcaagatggagtcggggctgagcatttatacaggcatttactgcagctatccttacaggcgaaaatctgaaaccatctccagaagacagttcatagcggtgggcctaatattgactggaaattacaccttgacgagttagttttgagtctctgttaacagcacagggtatggctggatggccctcaagactgactgcgacaaattataaagcaacgtcgatgctaacgccagaaacaccaaggacgaaatgcttgagcccctacagaactggcaggaagcagcagcttaggaggctccgaaagatgaaaacacaaagacagaagcacacctagaaactggagggaatccacatggtgtgtttgttaaatgaatgaattaaagagagaataagtagactcagattgccacctggactcaggacatttatagcaacttaatgggctgaagttttgcaaaagttgatcctcagtgctaaacatcaggtccagcagaagggttccccagaggggtgtgggcatgggaggatgagagaggagcacgagggatgtatgatcctgcccactttgtttccacgcttcataatgaacacctgtgctgcatttactcttctgtatgaatcgaatattacactgaaaaaatctgaaagtaatacttcctctgacctttcgttttcacatcagcatctaccacttctttgtagggtcatcaatcctactataaacagtgttatcagtctaaactctgctatatctgaacattgtaataatcaagctatgatacggacagtatcatttacggaaagcttctaatacagcatctgttttacacacacactatctctaatcctcacaatcctttgggcaggtggcatctttgttttacagacagaacaactgaggctcagagagggcgagtcaggtgttaaaggccacacagctagcagccaccactgagaggattaaattgaggtctgctgggctcccaaatccatactctttccactttcccataaagaaacagtgcaggggaaaacataataccatgtatctaaaagaaagaaaaataactaagaagttgcacatctgaaagattgcaagttccctcaagcttaaagtaaaaatgcttgttaaatgatagggtcaaggattttatgaataaataaaaaagagccatcctacctaagccagataaagtgcactcacagggcagcaaaaataaaccagactcacgccatgtcagggtcccaccaaaagccaggctgtgcgacccatggagatgaccaccaaccagcacccctccctcagtgagaaggtgggtccttggccatcgggaatgaggcaaaggaaggggcagggcccagggagcagtggcctggcagccccttcccatgagttggggactagggggcaggtagtgatagtgaggccccgtgccagctgcagcggaggaggcatggttgaggctgcacctctacagagctggcaggaactgggaacaggtgagagccacgcccccttccgagttgaaggggctggagccccactctcccaggcgcagctgctgctgcccagccacggccgggccgccgactgggattcctcgcgctgtcagaggccccaggaagcccccctcccccacaggctcagaagtgcctgctcctgctgcagggcctgtccctgctcccggcacccactctgatttcagagcaaagttgtggccaagcccaggcactgtcatgacccagccaggtgtgcacatgctcagggcggcgctgacatgccagccccctgctgcctcagtccccactggactttgggcaccaacaagcacaggcttctgggatgccaagggggcgctgagggcagtttggcacaggcctgtacgcgcccttcagcatgaacagcctgggtgctgtgggcaccgtggatgtcaggttgatggctgcagaaggcagacaggctcctgggcagaaagtgggacgtccctggtgaagctccatcttcaagtcaaggacaacctgaagcatttcttggggctggatagcttttgtcttttcgatgaccccaaaagcacggaaaaaccagaagtcagctccgtgggtggtgaccccgtggaggggaaatataaaccagaaagtaggatgctgagtgcagactgggaggcgacttcatggtctggactagtgccagccctagcgcctgggacgtgagggtgcccggcaagagggtgtaaaaagacaaaccaatgagtgcgtgggaggcctgattctcatgtcaaaaagggtggaaggaaccacgtgttcatctgacagcatcgtcctcctgtttatttcctcagccaaggactggggactgggagacagtccacttgggtgacggcgaatttctttcaccccgagctgacaccaccttgggcagggggccacagtgagggctgagctggccactgtgtccaggggatcgtgccttgggcagatctgccttcatctccctgctcttcccctctgttttttgtgtatagtaggagcacacgagaattaggaagaacagaaaaaacaagcatctttcaaggttttattgaaccactgccaagaagatgtggaagagtgggttgactacaattgctagacatccgttcattcacttattcattcagttcactggcatccccagctaacacggccaccgtgtcacacttaccaaaaaatggttgggagatttatccttggccaactctgcagaaccctcctccccaaacctcctgctctgcgctttgctccggcagtgatctcaatgacaggattttaaaacgaggtttcagtacttctgcaacccaaatgttcacatcgttaccgcttaggaatctcagttatgtctatatgatatttaagcatgtgtttaaagacacaaaacactttccgcattttgtctgaatagactgaagacttgttgctgagttttcagtacaaaaaaacaccagcgattatcctgaaactgacaagtttgaagatgcaaagtctaggctgtaagaggaattttaaacgcacgcctttaaaatgagacttgtggctaaaatggagaaagggaagggagggaaggaaagagaagaagacgggaggggagaggaaagagggaagaagaggagaaactgacagctgacaggagggtcccatcacaggtacaggagacatcaggtggcctctgatgggaataggagagctgcagccagtcatcctcaccctcccacagctgctaatgagccattgtcaggccttgtaaaagtaagttaaattattgctgatatatcttccttgtaagtaagataaggtgacaaaaggtcactcctcggcgaggtgcagtggctcacacctgtaatcccagtactttgggaggctgaggcaggcgaatcacgaggtcaggagttcgaaaccagcctggccaacatggcaaaaccccgtctctactaaaaatacaaaaattagccaggcatggtggcgtgcacctgtaatcccagctacttgggaggctgaggcagaagaattgcttgaacccgggaggcagaggttgcagtgagccaagattgcagcactgtgtgacgcagtgacggagcctgggtgacggagcaagactctgtcttggaaaagaaaaaaaaagcatcaatcctctaatctaatggatgacacacagacttcataaagcatatttatctgacctgatgggttttttaaataaacttttattttggaataatttttcatttacattatttttaatgatagtaatcacggctctttcatgatgggcttagcacatgtgatgggcaccagcacatatacatatgccctttcaaatcaatcaacagcttgttcagggatgtatggagacagacagaaatgtagtatctggatcattactattaatgctaactattaattttacctctcctagtatttcaaaatatggttatgcaggccaattatccatgcatggaaaaattcccagaaaagggaagaacaagaacaagacaagatctagctagagcaggacagtgatttttaaagcaagataactaatttttaaaacctaccaataaatacagcatttaattcagagtagggttaaaagaaataaaaacaacaaagtaaaacttaaatgtatcactcactaaaattacctgttatattgattagggcataaccactcgggttttcttgacctgtgagcctggacttctcgtgtgtgttaaagcaccgccaaatacaacaatgactaatagcctttttaaatgaatctaagaccccgctgatggtagtatacatcccaatttcagaagtgttaaaatgtgtattttagaactgatcaaacagtaatacattaagctgaacccaatcaaaagtacatttcctgcttatttggataatgatgcacaatgcctggaagagaatgagaaccaggcaaatatttactgaatcaatggatagtctaagaggtgacagtcatctgtgaaatatggaattactcgcagtttgccgacacaccatcttctttcctctctacacttgcctgggacacccctctcttagcctttcattataaggaacagtcagttcaataatacaaataatacgaatctctcttcactatgcatgaagtgatcattccttgcaaactagaaacacgaacttgttaacctccttcaaggatgcaagacgactcaggaatccttccatgtactctgcattcacaaatacgtgtatgtgtgaacttagtctacgaggagactaacaacagcccatttaccagcttcaaacgtgcagggtgtgtgtgtgtgtgtgtgtgtgtgtgtgtgtgtgtgtacacatgtgcttcagggcaaggcatgtgctatataatttattttataagtttactaccaccagatgtacagtgtcagtatcacctgtgtaaattagacacaactgggttttgtattttgcattacctagataagtatttctctgcattagagctacatggaccaggcctatttagctacttccccctcccattcttggaggataaaaacaatttgttgtcctcataggttctctgagcatctaaccctatatatagcaccaagagaaaccaaacagagcactgatgccatgtttgctggaataccaacaaggagagtagaggacaatgagtagaattagtacaaaaataagccaggcatggtggctcacgcctgtaatcccagcactttgggaggccgaggcaggcggatcacctgaggtcaggagtttgagaccagcctggccaacatggtgaaaccctgtctctactaaaaatacaaaaaaagtgcacacatatgtttattgcaccactattcacaatggcaaagacatggaatcaatccaaatgcccattaatgatagactggataaagaaaatgtggcatatatacaccatgtaatactatgcggccataaaaaggaatgagttcatgtcctttgcaggcacatggatgaagctggacaccatcatcctcagcaaactaacacagaaagagaaaaccaaacaccacaagttctcactcacaagtaggagctcaacaatgagaacacatggacacagggaggggaataacacacactggggcctgtcagagaagggaaaaggggagggagagcatcagaacaaacagctaatgcatgtagggcttaatacccaagtgacggattaataggtgcagcaaaccaccatgacacacatttacctaacctgcacattctgcacatgtatcccagaacttaaagcaaaaaacaaacaaacaaacaaaactctgatgccatctctggcatctcaggcaatttctgctttttctaggttttgttttgtccatacacggtacagacttcctccacagagggattttacgagaactagaaccaacaggaaaaacttgggtgagaggtactaacataattaacaaaatgaagaacacgccaactttcctaaccagggaagaaacacaaaacaataaaggaagtcacatttccctccttttcccatcactgaagagacggcagccaaatggtcatgctcacatttggtgcatgaaagtgctctggcagtaatgatctacaggcagtcattggcatgcttatggtcactcacttgcgaccttgtttcttgagtttgtcctaaaacttctttttgaaagaaagaaagactttgacataaaaatgttcaatgtagcttcagaatcacaagaattagaaattacctcaatatctaatagcagggagaccactaaggaaattatagtatgaggccaggtgcagtggatcacaccctagaactttgggaaactgaggcaagaggactgcttgaggccaggaatttggaaccagcctggacaacatagtgagaggtcctgtctctataaaaaataaatacgaaactgatccaggtgtggtaggatgtgtctctggtcctggctacttgagcggctgaggcgggaggatcacttgagcctagaaggtcacagctgcagtaagtcaagatcacaccactgcactccagcctggacaacagagtgagactctatctcaattaaaataataataattgttattattattgtctttgtgttaacctattcttgagactggtttggttctggtgtgtgtgtgtatgtgtgtgtgtgtacacgtaaatatacatatatattgttctacgtgattaaaaaaatacacttcattcatcttccaagtaagttagccttcttgtttccattaaaatgcaggaggtgggtctggttctaccaaccttgctcgagatttatccccaggtcacccccgccccaggactctggcagagctagcgtaaggcagagcactggtggctgatcctgatgtcacctgcaggccacatatgcatctccaccatctccagacgtcggcaatgccacagcatgactctggggatacagcttctagacaataagcagcaagttagagactagaacaatttcacggataaaagacacctgctggtgatatatgacttcaaacaatgaagaggggactagaaggctggcattctgccaaccaacacctaagagggcaggggagccatagagtggggacagtaaagggcgggacactctctcccaacaaccaaggaatagacccacctggaaggcagagggagtttcttcactgggtacaaggaattagagtaagaagttattttttttttttaattagaaacaaatgaaagaatcccaccaacttcactctgtgaactatgattttaacgttaagagtaacaaagatgggaaatctatcaaaatcctcaattttgtattacactgcacactcgtgaaacagttcctaacaagcctagatgaatttcagttcttttaagccaacatttgaaatacaggtccccagtcccaccccttcctcagcagtggcccacttcggtggctgttttctaggagttgttcctggagttggtctggagtcagcacctccagccctcatactgatctcccagtgagatacgtggatctccagagttcagtactcgctacactgatggcactcagaagtttgtggaatgaatggacaaatgaatggatcgttatgcttcactggagcaggcaggatcaaccccctggaagggttaaagaaggtgctgaacgaaactctgcttttcttgccttcatgcttccttttttccaaaagggtaaaaagtagctgcattaaatccctttctgttcagatgtcctagaactgctacaaggcccaccacatatccccctcatctccaactagcacagggtaaatagtaacattctactgtaccacattttctagaatggctgtatatatgaagttacaattcacgctatgcactgctaatgaactttccacaatgccataaatgaaatatgtaatatcatgactcccattttacaaatgaggaagcttgtccaagtttacacagttaacagcggaactgggactccattctgctatactgcctcccagtaaaagtttacatggtgaatacagaacaaatattcaaaagagagaaagaggggaaacagaggtgacagaggatccagtgttggcttaataggtataaacatggtctgagcctgattataggcaaaagaaacaaagaagagcagaaaaaaaggagtcacatgcatggatagcagggtgctacaaggatgtctaataacacagacctgtggcggggagggtcacaggataatggcatgcttaaggcggcccaatagacacaggagaacactgatgcttgctggcaggctgggaaatagaggtgccttgaagaatccatggggagcttatactggaagtctgttttgggagtaaaaaaggatgaggagtgtaaagttaaagaaaaggactgaaggccattagatgttcttcagcgagcatactcagctgttaagtcaaaaatactgctgagctgaggccgggcacggtggctcacacttgtaatcccagcactttgggatgccaaggcgagcggatcacctgaggtcaggagttcaagaccagcctggccaacatggtgaaaccccgtctctactaaaaatacaaaaaaaaaattagccaggcatggtggcagatgcctgtaatcccagctactcgggaggctgaggcaggagaatcacttgaacctgggaggtggaggttgcagtgaaccaagatcgcgccactgcactccagcctgggcaagaaggtgagactccatctcaaaaaaaaaaaaaaaccaacaaaaaacaaaaacaataaaataaccaccgagctgaaagagatgggcatacaattcctacagcagaaggaaactcagttctccgggggcaatacttctcacttacaacttgagtgtgctcattgaagaaaccttggtgacctttagggattttctttaaattataccccctatccttttcgtacccccaaactcagtggtaagtatttttctttttctttctttcttttttttttttttgagacagagtctcactgggtcatccaggctggagtgcagtggcgtgatcttggctcactgcaagctccacctcccgggttcacaccattctcctgcctcagcctcccaagtagctgggactacaggctcccgccaccacacccagctaattttttgtatctttagtagagatggggtttcaccgtgttagccaggatggtcttgatctcctgacctcgtgatctgcctgccttggccccccaaagtgctgggattacaggtgtgagccaccatacctggcctcagtggcgagtatttttctacagttgtttcatgttctgagaaccaggagaaggatatttaatgttgttgggtgtgcaagttcaggtctgattcagcgggttcagaagtaactgaataacagcagggaaccagtatagggaatatcaacaagggagctgagctttgctaataggccataatttatttaaaaaaatttagtctcataactctagagttcagtacttggttcactgatggcattcagaagtgtgtggaatgaatgaatgaatgaatgaatgaatgaatgaatgagtgaataaatggttatacttcactggagtcggcaggatcaacaccctggaaacgttaataaggtgctgaacaaaactctttttttcctttattcttccttttttccaaaagaagaatagcctatgaagtaattcttcttttccctctaactgcaatagatacataataccatattttcactaacagcaaaaacaattcacattagaaggggttcttccattcaccagagttaattttttaagtggataagcaattaaagatgccaagtagattaaaattgatccctagcataaaagttgtgatcaataaaaaaacaatctgtaaatttgattgcataaatcctttttacttaagtccaccataagcataattttcaggatcactactttgatctcacttactggaaaataaaatgcaataaaaatattgctgcaaaacctagtttctagaaaataataaataaaacatccattttaaaatttttgaaccacccatgggagacaaatgcacaatgattagactatgctactactaatcaaggaaaatgcaggattaaaaagtcccttgggatctagccaagttcctaaactaacaggagaaatgctttctgaaatgcagcttgttttatttaactggttccaacggccccttactggttttcatggtttggcaactttacacattgtctttggattcttgctgttaggatctagctcacacatcatccatctctcctcctgctcacttacgcatctgttgtcagttctactggattcctgtgaaactccaaatagcgtacttcactgttttacctatgagatgtatgtcttgctgctcagtttgtatgagaagcacaaccacactcagcttttcagtccctttcccctcctctgcttccccgcccacctctgtcaccctttaccttgtcaaatgtagtaacattcacactctgttcagtagcaactgttatctttcatgatttgtctccagattcattaagttgacacattccaattttgtgtgtcatgacatataaacataatttacagtattaactatacagatgatacttattacaagagaatgcataatatacaggtattactataaatattgtcatattactagatattactgaatattaatatactatacagatatttgtaactatgcagacatttataatcctagtttgttaggattacatttccttctcaatgggttcacggtgccatccaatggaagatgtttctagtatcaaaataaaaaagaccctgtctcctccctcatgtaatttgcttttatttcaagatactaaaaaacctgagagatctccccactctattcccttcccagagaggacttacttaagttccagagtgaagccagcccctctccccggccctctcccgcagagggaaggaggggcaggcacgcagctacactatatgagctcacgtctgatggtttagggaccctctcctgtagtacaacccggctgcacatgcacagggttagaggctgaactgtgtccccctaaaaattcagatattgaagtcctcaacctcagcacctcaaaatggaactgtatttagagacagggtctttccagaggcgattaagttaacatgaggtaattcaggtgggtcctaatccagtatgactcgtgtccttgtaagaagaggacatttgaacacagacacacacacaggagaggtgacaggaacacacagggagacgacagcctctacaagccagagagaggggcccggaacagagcctctctcacggcctcagaaggagccagccctgctgacaccttatcctggacttctggccttcagagctgggagaaatgaatgtctgttgttgaagctaccccaggctgtggtactttgtcccagcagccctcgcaagataacacacagagtaacatcagccttttcccatccagtcctgtggtaacgggagcattaaaaagctctgcgaggaatgcgtgctttgttcttagactcagagatcccgtgtttcttgtcagaatatatctttctctgtatctgtagctacagacttagcagcagggagctctgtgtagcacatagggcttgtcaatagacaggtttcactttagtaaaagtggagacaggggccaggtgcggtggttcatgcctgtaatcccagcattttgggagactgaggtgggctgatcgcttgagcctaggggttcgagaccagcctgggcaacatgatgaaacccgaaaccttgtctctaaaaaaagtttaaaaaattagcagggcatggtggcacacatctgtagtctcaacaactctggacaagcccctggaagttgaggctgcagtgagccatgatgatgccactgtactccagcctgggcaacagagtgagaccctctctcaaaaaaaaaaaaaaaaaaaaaaaagggtagacacaggtgatccctacatccaggatgaggaggcttttactctgaggtatctaccctagttatccccagaaagccattccatttctttaaagggaggaatcaccctaaggcagcttcatcattgtcatcctccacctgcttttcatctccccaaattcggtttaaatcttatctgctgataaccacctttatttcctttgatgttgtagatgtttaactattagttttgtataatcttttcggagggttttaagaaggggagaagataaactcaacacgtgatcccatggccttattcaagtagaagctccaatctattttttttaacattgtttcctgatattaaatcaaataagagatgtagggttctcctgattacaattaactctctcatatggctaaataaggacatgacaagttatgcaaaacgtttctttaaagctctcttgaaagtgttcaaggaagtgggaagacatagaaatctttgagggtagccaaagggaaggaaataaattacatgtctcagaatatagaaataaagttactgggccggcatggtggctcacacctgtaatctcagcactttgggagggcgaggtgggcagatcactacaggtcaggagttcgagaccagcctggccaacatggtgaaaccctgtctctactaaaaatacaaaaaacattagccaggtgtggtggcatgcacctgtagtcccagctactcaggaggctgaggtaggagaatcacttgaacctgggaggtggaggttgcagtgagccaagatcatgccactgcacttcagcctgggcaacagagcaagactccaactctaaaacaataaatcaatcaaaataaagttattgtatcacagcagctatgtcatctggaaacaaaatattctatttaggtatggagtggtttagggttaggtctcctttatgagtagaagggaatatatttaaaattttttttaaatacaatttcctatatttcagtttcagaactggttctaaatcactggctctgagcaatttcgctagaaatgctccctaatgacctgccctgagctaatagcatcgagatcattgattagacacaagacaaggagcccaggacacagggcacagctaagctttcacagctcagattttcagcctttccatcaccacggtggaaggggaaaaaaaatcctttcagttccctgaaggatgtgttcttgcacataaattggcatttaggttcaattagatactgaaggcctggtcctttaaggccagccgggtgggttgcggctagatatgcctcggcgcctctcctctgtcctattactgggcaagtgtcctctggctgtatgtgctccaagttataacctaacgaaagggcaaaaaggtagaagagatggctgatgaggaggaagaggatggaaagaaaaggaagacaaagatttccctgactatgcacatagccagaatctcagcaggtgaaattacacagcacagagaatctcgatgaagattctaatatagatcacacaactctgaagcttttctctttaacatgagactcagttaagggttggaagggagctggtgagcaatgaaacagtaaagtacaagagggctccagcttcccgacctcactcacagtctaggctagattagcacatgccagacacagttctgttcactttacagccattgctcatttaatactcacaacaatgacactcacagtatcttcactttacagatagggaaaataaggcatagaaaggttaagtgacttgcccaaagtcacacagctagtccaaggcaaagcctcagctctgacatgggaggccattccctaactctttgttcactgttttctttaaaacatgatcttggaattactttctctcatttagcaatatcatgctaattcaagagtcagtaaaatgtgtccttgaaggtaggtacaaaaaaggatgttccctccaaaggcagccctcatcacagcctgaaccttcaaagggttgtaaggagcctcagatgcacagctgccttctctagcaccacacttttggttccactgcttagacaactaaggagaatgaagagcttgttccttattttccagcttctagaagggcaaaggaagggaataccatgagacagaggccacacagcacccaaaaatagaagaccattttttttttttaggcaaggtcacccaggctggtgtacagtggcacaatcagtccatagcagccttgacttcccaggctcaagtgatcctcccagctcagcttcccaacctgctgggactacaggcacatgccaccatgcctagctaaatttttttttttttaattttagtagagatgaggtctcactttgttgcccaggctggttcttgaactcctgggctcaagtgatcctcctacctaggcctcccaaagtgctaggattggccgggtgcaatggctcacacctgtaatctcagcactttgggaggccaaggtgggtggatcacttgaggtcaggagttcaagaccagcctggccaacatggtgaagccctgccactaataaaaatacaaaaataagccagatgtagtggcatgcacctgtaatcccagctactcgggaagctgaagcaggagaattgcttgaacctgggaggtggaggttgcagtgagccaagatcatgccactgcactccagcctgagggagagagttggagactgtctaaaaaaaaattatatatatatatatatatatttgatttggacactgactctgtatggagattttaatattcagtaaaggcagaataagttgtggaaatacctcaaataaacagaagaggataaggcatcagtcaaaccagggagggataaatcagataaaatgaagaagttcaaacataagcaagtggtaaaggagccaaagattcccaactaaaatgactactggaacaactgcagcttgaaaatatttcctgcgatcaaaatttgctcacgagctatggacgtgagttttgggaagagatgattctcctttacacaactgcccggattgaagaggatttgctagaatttagtacagtggacctgtgaatgacacaggttggaactgcatgggtccacttatacgtggattcttttccaaccaaacgcagactgaaaatatagtattggtgggacgcaaaacctgtaatgtacagagggctgacttttcctaggcgagggttccacagggctcactgccagacttgagtacgcacggactttggcgtacgccggggtcctggaaccaatccctcacagatactgaaggatagctgtatttatcccctgacacactgcagctcttcatgaatactgggagtcactatactcacctaagttctacacactgaggtaatgaggttccagattccaaatgtggaagtgaacttccttcttttctccttgtgagtgtgtgggagtctgtgggagtgtgcatgaggggagaaaagggaatgtcactgagcaccagcatgagcatgtccaagtgtgaccaagatgggccaagcattgaaagtagccaggtgggcgagtggccaagcgccagagaggccaatcccaagagtgactgagcccaggggtggccgagcctgacactgtctggctgctttcagtggtcccacagattgaggctgtgtatgaagagactcttccagcaaacacttttttttttgagacggagtctcactctgtcgccaggctggagtgcagtggcacgatcttggctcactgcaacctctgcctcctgggttcaagcgagtctcctgcctcagcctcctgtgtagctgggactacaggcacatgccagcatgcccagctaatttttgtatttttagtagagatggggtttcaccatgttggccaggatggtctcaatctcttgacctcgtgatccgcctgcctcggcctcccatagtgctgggattacaggcatgagccaccacacctggccccagcagacacttctaaggcatcctattctgaggtcaaaaatacatttttaggctgaaagatgagaataacttctttggagaaagcaatgagcagcaggaagtgtggggggtcaggagttaggctaagcactctgacacctgttagaagccttctcgagaacagaagattctcgagattcccaggtgagggtcttcagcctcatctcacccattccccaatgtcctggccggacaaaagccacaggctgggggaagagccatttctagcagagcaggcaactgcttctaagatttaaagtaaatgggggattccaagacgtctgattcagatgatcagtaaagtcactgatggtttagtctttcctaaatacagtcataaagattttaatttcacattatgtcaagagttttatggagccaaggatcttttcagtacgaatatgcctatacaaaccccacagaaatcaggcggcaaaagcaataatcataactatcaccttttgggtcaaaaacttgattaaagccaaatgacaactaaaatgtattttattagcagtaagatgaaatccagagcatatgtcaaagctggactatgaagtcataatttctctagatcacagttggaagcagtaattttatcactctgtccctccctagcctgtaaatccaaatatagttcagacagcagctctgggctgcagggtagtatcctactcactgtgagactctggggaggagctccactctcactggcccaggcaggccacacccagcctccctgctctcccgagtttatggccctgggcacctctcccaatccagggcagaatcagctgtcacaggagtaagatgctgccacacaccctggatcagctgtccccagtaggcatgccatggagtagtctaattagcctctgtgaagatgtcatgttttgtgagcaatgaggaggacctagacaattttagacatgagaacattccttcgggcatgtcagaggtgatgctctttccatgggcccttttgtgtgttcttaatacccacaaagacctgattcccatttttaaaatcaaaccaggagtcccctggcttagagtggccttctacaccccaccaccaccctgcccacaactaacacatcaccttacccaagaatgtcatgcaaatctgctcatggtctctccccactcctatccccagtgccacgtccgaaccttcattcttattacggtttgcttgtattcgtagcagagtcccacaaaagtcccccgagaaaatctcctagtcactgtgacaaaactattctggaacacggccccacttacacagctccatactggtaagggccgatgtccttccacagtcacctctcccactgcaagacaggagcaagagctacacttaccctggggctgcaacaggatgattatttgcttaccaggacagtgaaaatcctgagggaatttttttttattatactttaagttttagggtacatgtgcacaatgtgcaggttagttacatatgtatacatgtgacatgctggtgcgctgcacccactaactcgtcatctagcattaggtatatctcccaatgctatccctcccccctccccccaccccacaacagtccccagagtatgatgtttcccttcctgtgtccatgtgttctcattgttcaattccctgcacagcaaaagaaactaccatcagagtgaacaggcaacccacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactgctcatcagggaattttttttaaggcggtaagtgtcaaggcatgatctaagcttctttctcatgtagtcagaactggaccaaaattgcctgttgaatgtcaataaacatataaaaactgcacggcggctgggcacggtggttcacgcctgtaatccagcactttgggagactgaggcaggtggatcacctgaggtcatgagttcaagaccagcctggccaacatggtgaaaccccatgtctacaaaaatacaaaaattagccaggcgtggtggcatgtgcctgtaatcccagctactctggaggctgaggcagaagaatcgcttgaacctgggaggcggaggttgcagtgagccaagattgtgccactgcactccagcctgggcaacagagcaagagtccgtctcaaaaaacaaaacaaacaaataaaaaactgcatggcatttgacattcttggtattgggacctgacctgcttattgttcagaaagctatttataaaagttttgtgaaaacctgaagcattatacaaactatatgctatactgtaaagttttaataagtggggatccttttaaatagaaacttctgctaataggcaactcgaaatccccaactacacatcatctttctactttagacatttaaaaatacagcacacaaaaaacttcatcttggccatgtccacgtcaagtaggaaaaagtccaaacagaatgaaagtgtctgaattataaatccttgtgaaaatactattaatcaagagggaattaatgttaacttatctagtgggtactattatctataactctttaatatcaaactcacaaaattagcagcaggaatataattatacttaaaaaaattattttcttagtaaggttggcccatagaagaataaggattagtaagatgcacagtggtcaaacatgaagaaatgagtgaattttagggaaatttgcaagtcggctgcaatcatgaacattgtatcaagccaagtaatgaaagccactcctgcctgggtgggctcggtccagcccagcccctgttgatactctgatgcattctgcagctaaccaagttcttacagcggagaagggaagaaatggcaacaaaatacacattgaaaacaaaataaatatgtttcctgaagccaatatctgaataatccttaggtaatgaccatttatacacttgataagtttcccaagtttttctttcctctttcttaagtaaaagggaaatccaggccaatttttaagccggataatatttagaaactattttttttaggtcatttcatcccatttttggttgactagtgtaaccaaggcagcaactggatttcaaagcagcagaggaagacattctgagctcacctggagcccaacgctgggacgcagcctccaccctcccaggaaactagacacttacattcccttgccctcttgcccttctgcccttcctgccaccaggtagctggtcacaatgggagttttctttctttctgcagtggggtgaatgatcacacacacacacacacacacacacacacacccccacaaccaactcctagtacccacattctgtaaatgtttacttacttggaaaaagggtctttgcagatagaatagaattaaattacaatcttagccaggtgcagtggttcatgcctgtaatctcagcactttgggaggccgaggcgggcagatcacaaggtcaggagatcgagaccatcctggccaacacggtgaaactctgtctctactaaaaatacaaaaattagccgggagaggtgatgggtgcctgcagtcgcagctactcgggaggctgaggcaggagaatgacgtgaacccgggaggcagagcttgcagtgagccaagatcacgccactgcactccagcctgggcgacagagcgagactccgtctcaaaagaaaaaaaaaaaaaaagagagagacagaaaaggagaagacacacacacacacagaggagttcacatgaagacgggggtagagattgcagtgaaatagccacaagccaaggaatgcctaaagccacaagaagctggaaggggcaaggaacggggcctcccctggagcctccagagggagtgtggccctgctgacaccttgatttcagacttgtggcctccagaaccgacagagaattattttcagctgttttaagctgccagtttgcaggaatttgttacagcagcaccaagaaacgtacattccagatacacagatatattactctaatttttggagcagcaaaggagcatcacttaaacagttaacagggaccaacctcccgtctttagagcaatctaagcatttgttctctacaattagattaaatgggattaaacacaggcactgcttcacatatgaaattgctgtgcaaatacacacggctgaaaaatacgagaggtcaatggacagcattagcatgtccacttcatgaaaaaatgacacacttctccgtgttggtttagtggatactggatccagtccaacgtgaatggctcactttcagaaatgaatctgaaactgctgaccatcttctttggagtcacatgctaggaggtagcctgggaagaggcctgactctgaaatgtctcacacacactgtaaccactcactatttttgcaagaacttgcttttctttctagatataaacataagtacgctttgctcactgatggagtgtaattcttgaaagaagggagacgggagaggtggtagcccagggaagaaaggactgagggagagcagatagcagcagatgacctgagaggggaccagatatatgccagaaggaagaacttcaaagccaacacacaaaatacaggcaaaagaaattaacaggcacatcacagaagacatcccaacagtcaaaaagttcttaagaagatggtccagctcactggcaatatcctacacacatgtttctgaaaattccaaaatgtcttcagacagaagaaccttcaaacccaaatatggatccctaagatcattttccaacccaactacattaacacaagtaaaactccagagagccacatgatgctgcctgtgaacttaaatgacaaattctaacgttaacatttatttcgctggaggccaagatgacgtaataacaaaagtgttatgtagcttataaatggcctacttgtaatttgttagcacaattttggaagtgctttccaaggagcaagaaaaacttcaaaacataaacaaactaatcttcactatggctccatcactcataataaaggttaaggatgtaccttaaatagctcacaaacaggaaaagcatgtgtggatttctttgagaagcttgtaacatcttgtaactttacttatcctagtagaagctttattgctaatttttacataatcatagaactacatgaaatagccatattgcctaacatttatacttggctttaaaaaaattactattcctaaatacaaaaataacctatcattagaaaaggtaggtgaatatttaaaaaaatttttttaaaataataattcagtctacctttagtgttgaagtactgccttcataactattgatggggactccaaaaatatcctctatggaaaaatattcaggtatctaaaaaaggattcatctgaagaaattttatagtaatggtttcctttgaaatatttttggacctcttatagtgaaatcatgagccacaaaaataataaatgtctcccatattttaaaactaagtagtgacatatcgtcattataaagattataaagtaatcttcctatatgatgagactaaattacaattttgcttttattttatttcaattaattaatttttttgagatggagttttttgctcttgttgcccaggctggagtgcaatggcgtgatcttggctcacttcaacctccgcctcccaggttcaagagattctgccgcctcagcctcccgaatagctgggattacaggcgcccaccaccacgcctggctaatttttatatttttagtagagatggggtttcaccatgttggccaggctggtcttgaactcttgacctcaggtgatctgcctgccttggcctcccaaagtgctgggattacaggtgtgagccacagcaccaggccacaatattgcttttagattaaatttgtaatcttcagtggaagaaaaatccatgaggatttttgttttttcaaagaggggtgggacaacaatataaagatgaaactgtttggggtgggtattttatagtatataaattatacctcaattaaaaaattaaaatgaccttaaattttaaaacgacagggacttaggcgtgaaaaaaccttttggaagcatttagttcttttccatcttacagccataaattaaaggtatttcttaatttgctaaaaatatttcaaccgaattggcttatatttaagttttaatgggtcaaatatgttaaccaaggatattcttttggcttttcggggaatttgtctgtcttcaaacaaaacaaacaaaactaaaccactgtccgaatagtagagacaatttacaatgtgtgtcaagatccagagttcatgaaatgcgataataaatagcccaaaccacgagtacattatttattattactgctctaagagtaaaatgctatggtcatgtgaggtctgtgtaaaggataggacgatggcctctgccacgtgatctagaagccacataacgcaacttttgtggaaagcaagaggattcaatctgtgtgtgaagatggcaagggctagggctgcacaacgtggtggctaagagcacgggagtcaaaatcctaggctgggaaacagtatcatcttgggcaaaacactatcatcttcaggcaggcttctcatctgtaaaatggggataatgcaacgtacgattcttgtgaactaatcttgtgaaagcagtaggcaaacgcctggcttcacaggcaactaagacgtgagctatgttcctcaactggctgggctctgttctgcagccacagggtaggcctggcatcccagaaatgcttgtcattgataacacggggacatcaagtcagagaattcgaatgtcactcctgaaagtctaatgaccctcagctgtcatccacagctcattggaaaactgctaggtaggacccactaaggctgacatatgcatacctcacaacccagcaattctactcctgggtatacactcaacaaaaatgcttacatatgttcaccaaaagaatcagatggttcataacagcatgattcataatagccccaaaccagaaacaacccaaatgcccgttaatagtagaagataaacaaattgtgggatactcacccaaagaagtattttatggcaatgagaatgaacaaactatagcaacaacacagatgacaagtcagaatgcaagaggccatggtgtatgtttccatcggtataaaatataaaaccaggcaaaactaagatagcgtcagaaatcaggacagtgttccccaaagggaggatgcagatgggaagggacctgaaggtgcctctgactgctggaacccatttcttgatctggctacatgtgagagagtttaggccgtaaaaattcaaatgctgcaccctcaggatgtgtgcacttttctggaggcatattatacttcaataaaacttctaagaaactctctggccaggcacagtggctcatccctataatcccagcacttcgggaggccaaggtgggcagatcacatgaggccaggagttcgagaccagcctggccaacaatgcaaaacctcatttctactaaaaatacaaaagaagttggctgggtgtggtgacgcacgcctgtaatgccagctacttgggaggctgaggcacgagaattgcttgaacccgggaggtggaggttgcagtaagccaagattgtgccactgcactccaccctgggcaacagagcaagactcagtctcaaaaaaacaaacaacaaccaaaaaaactatctttattattgataaaacaattcaaggccacgaatccagggtagcccacaccaccctactctgaggccctgaaaaattctgcagacctacgtcagcctaaccagcaggatgaggggccccgggccagggagcaacatcctctctcaccaatgatctctttacatttctaagcctggcatctctctgttgctttgcacatgtctgaaactgagcagttcttcctgccatgtcttatcttctagactttggtggccatctgtatggaaggaatcttcaggtaaaagacacgccacaggatactaagctgaaatgggacccaacttcttttaattaaacacatcttgcctcaggcaagttatttaaaagaaatatctgttaagatactagaaagaatggtggctcacatctgcaatcctaacactttggaaggccaatgtaggaggatagcttgagtccaggagttcaagaccagcctgggaaacatggcaagaccctgtctccacaaaaaataaaaaattagccaggtgtggtggcatgtccctgtagtcccagctacttgggaggctgaggtagggcgatcacatgagcccaggaagtcgagactccagtgagccatgatcgtgccacagcactctagcctgggcgacagagagagaccctgtcctccccgcccaccccacccccgaaaaaagaaacaaagaaagaaaaagaagtatctgttgagatattaaagatacatcttttaagaaactacaaaagaataatttgtacaaaatttaaatgaacactagtaatgtacagaattttctaattaggcatacatcatatcctactaatcttagtgaattcaaagttactagtgtgcgcaaagttattttaaaatataaagcatgctggaaaacaaaagtttctgaaattctgtacattcacttctaaaatgtcaaactaggctgagtgcagtggctcatgcctgtaatcccaacacttaaggaggtcgagaggtaggaggcctgcttcaagcccaggagttcaagaccagcctgggcaacaaagagagaccccgtcactatgaaatattctaaaaaattacctgggtttggtggcatgcacttgtagtaccagctgttgggaaggctgaggcaggaggatcactagagcccaggagattgaggctgcagtgagccatgatcataccactgcactctagcctgtgtgacagagcaagacactgtctctgaaagataaaatgtcaaaatgactacttatttggatcactatgcatgagaaatagtttcttctcaaagtaaacacatgctcatatgagaatatttcagtcaataatgctccctctctccggtgcagcacagggaatgtttagggcacagaaactataaaatagtgtaaaggtggatacgtatcactatacatttggcaacacccatagaactccgcagcacgaggaatgagccatcgtggaactgatggacttcaacaacaatttatgaatagaagctcgtcaattgtaataaatgtaccacactaatgaaagatgttaataatagggggaaacggagggggattcggcgggcgagacagaaggacagggagggagtatatgggaactctatactctgttcaatttttctgttaaccttaaactgctctaagaagtgaagtctattgattaaaatataaataaataaataaataatgcttcctcccgccttctaagatgcccacattttacctttgatcatttctgcaggaaacacctagtttagaatacacaggccacaggaaagaacaaaagctttcactattttcagggttttgtgcttgtatgtgtgaacatctttgtcactcacggtcagtgatttatacagacatgatcttaacaattcagtatggagaacgactatcttttttttttttttgtacttggctggatactgtcctgtgtaagaaaatatattggaaaatgtattcaaataaaagcaagaataagggtcgactttaataccgtggggagaaatccgatcgattgggtccataaggaaagatgtatgcattcggtgctccctaattacaactgctttggtgggcagcagcagtggtgaaacagatgttggagacctattaaagacggggtttcaaacatctgcttacaattttaaggcaattgtaaatacagcagagaaggtcaattgggccaattaaggccgatgtgcaaatccaccactgcaggtttcttttcaagcttacatggacttgattttttatgctttcattttctacaaccacaatttttttttaaacccaggaaatgggtttaataacttttgtccatttttgattgttattcttcttaaatggaagaaaactttctgttcaaagaagtcactgcacaccttttgcctcacgatgactcattttccttccctcccctcccatgctcacagccggccactcggccccgatcaaagcgggttccatattaccagggaggtgaggaatcccgaatactgggcttcctttctaagccataatgaacatgggcaagtgtcaccttcagaaacttccgtgccgcggcacacaacagtgctcccagctgtacggatgggactgctgggagcatttgctgcttctaccctaggcaccttcaccagcctttattagaaaatcatgagtttcatgaaccgtaaatacaacggcaaactgcactatccctcttctaagtaggtaaaactgaaattctcatggtatgcaaggctcattcatgtcagaggcagtagcagggacacgctcccagttaattccaggccagtgctacaaagtctaaggcccacttgctgctcaaaaattggcccccagtggtggagcgggacttagagactgagggtcggcaaagaggcagagcagtccagctcaacattactaggtcatttctcttaaagctgcacgtgtaatcgttacttgtgctaagtaggtaaaaaaaagtccaagtatcacaggcatcaaaatggcctcctctgggagagtaagaaataagcctggcctatcttccttcctatgagctctgtgatggccaccggagtatattatgccacctcttcttggtggcccagaccactcaactgctctctttatatagagaaaaaaaccaaggttgggcaaacctagattcaaattctgcacttcttagctgagtgacctcgaagcctctgtttcctcatctataaaatgggaatattgccatttctagagctctaaaagttgatacaaagtaggtactcaataaatgttgagttcctaaaggtgatacacagtaggtactccataaatgttggtttcctaaaagtgatacatagtagacactccataaatttagtttcctaaagttgatgtgtggtgggcactcagtaaatgttggctttgtaaagttggtacatagtaggcacataataaatgttgcttcctaaagttgatacctagcggcagtcaataaatgttggtttcctaaagaaaatacacagtaggcactcaataaatgttggtttcctaaagttcctatacattaggcactcaataaatgtcgaggtcctctgtcctcctgagacctttgggacctccaccaagacatttccaaggggcctagactggtgtttccaaccaggcagggcagttcccctgaatgtttctatttgtttattttcggggggaggtatatccagtttttgtgctgttgttgatattgttgttgttattatttgctttgtttttggcgaaacaaagagtggataatgaaactacaaaaaaattctaaaagaagaatccttgaggcagcagaatgggaagaaatagttttcagaacaaagaaaattctgaaggaaagtcaatataccgcacagaaatctaggttgagaaagaactgtttttcccttacatctcctttttacttttcaaccttgaggctcagctcactcaggtctgagcaagaataaagagtcctgcttgtctaaacaactgctaaatctgaaggcaaacagctcaactccatgtggttcttcagcaacattcctgtcaacaaaccccgtcttggctcgattggtccaacaataccagatttagagccatccgctcatccttcttccaggatgcaaggggattttcaaaaggccattccaggaacagctctcacaatttttgtagccttttcaaaaacacaaaaaatctaattcatttgctgcactgcttcagccatccagcttaaactaattttaaaatctctccttttgtaaatagagatgttagaaacgccaccacagccacaatataaaatgatggtatctttctcttttgtaatcaaattaccatcatttattataaagcttcagacagaaacctgagagatgggcaagacgacctggcgttcagaagagagagatggcatttttgacattgaaataaaggcttggagggcataaatccttttttaaaaatcaagtatttagcacaggatttggtataaacactgatcaataaataagagccagcagtcatagcagcacgctagaatcaacatcatctgagttctagcacagactcgtttctatgaatcattgaaaaggaatttcatggtgccagcagcatcagtacagaaagtcagaataagcacttagacagtaataccagcaacttatttactatcctacgttagagtcagtttgctggattttatataaggtaagtaatggatatctaaggtactgtcaattaaaaaaagttctccaaagtaatttttatttaaagttgcatatgataaactgtaaaaccaaaataacatttgggtcaaaactccaaagagttgggctatcactaagctagaaagagaaaaacagcagaaagaggattttcttgctgatatgccaaaaacgtgactctatttctttcaacagggtttattgttttcttcctgttttacaacagcaatacatataagaattttttttaattcagaaaattgcagagataaggggaaatttctcccctaattctattccccaaagagaactgcctttcatgtattctggcaaaattctctcatcttctttcaatgcatgcagaaaccttttgtttatttacttttcgaaaacaaaattgggtcatacaataggtattgttttctgatctgcttttctaatttttaaatgctgtgcaacagttaatcaaacggatatacaattaacctcccattattaaacaccaagaacagcttctatttttctgtattataaatggcaaagcgacgaacatccacatatataaaactttgcatcacttcatctacttgggttaaattcctacaaactgaattgttgggtcaaaatacacgcacattttaaggtatgtgatatacaagacatgccagaaaaattgtgttaattctgcacaatgtatgagagtactcttttctccataactttgcccacataattgttgttttttttttttttttgaaacagagtctagctctgtcacccaggctgaagtgcagtggcataatctcggctcactgcaacctctgcctcccgagttcaagcaattctcctgcctcagcctccggagtagctgggattacaggcacgccccaccacgcccagctaatttttgtattttagtagagaggggattttaccatgttggccaggctgatcttgaactcttgacctcaaacgatctgcctgcctcagcctccaaagtgctgggattacaggcttgagccaccgcgcccagcctcaactgtaaagctttttgtatactgaaaatattaaacttttatgattatattccaactatttttcctccattagtaacctgtttcatagtgctgcttaatgcagagaattttattattgtagaccaatcaatctgcctttttcttttatcattttcccttggatttataagcttagaaaggcctttcctatcctaagagcaaatacaaaatctgctttacatattgaactaatattgggatggtactgatttttattgcaatatttgagaaggcaaaacagagtttaaggaaagaaaaaagaaatcccaaaggatggggaaagaggtgagaaggcttctaaaaataacatttggcagacaccggctcaatgcaagtctaatttgcttcttagttaatgaaggagaaaatggagatggcgaagaaataaaaggtccattctagaatggcaataataaaatcccctgtgaagacaataacaacattcttgttatacatggaaatctaatcctaaaataataacgcatatattgatataacagcactgtgaataaattccatttaagctatgttattttaacaatgacccagaaaatgttaaactaaagaagtttgttacatgcctagtttggcccacttagagagccacaggttctcagaaacatatctggaaaaggcctttttgtctgcaatcaatgcatccatcatggtgcaccaactggctgactacaaagagcttacacataaatatatgtgcatatacatatagattttacttgcatcaaaaggtaaaaatagaatttggtttattttgtaaagccattcaacgtaatcataatctcattaggatccagcagaaaagaatgactctggcagctttttgctgggaccctggtacctccttctgcgggtagaaaaggagcccctgggggcatctgggtggaaggaaggctcggaggctggagacttgcttgcctggatgccagccagtgtggcaaagatgtccagggcagcctagagtttctgctgggggcaggggtaggggtggtcagggcacagccaagtaccgggcagtatccaccccagcccccactgaactgccagcatccggctctgcctgtctttggcttctggcttgctttcctagcctgattctctgaccttcccctcggcattgagagctctccaacattcatccttccagtgcatttcttttctgcttaagtggcccaggtcaatttctgttgtttgcaatcatgaaccttgactggacaaactcttattagcttccggcagatattaaaagatgcatgagctcactttgatgcaaaagggcctcagcatggatgcacgccttatctatgagaaagctcctctgcttcctctcctggcctccttgtacttatctcatggtttatacttgattttgttcctttcaactttcttcttttcatgcccaactcccctccctaaaatgggtctggtggcagaggtgaaggcagagagcagaggtgagaagaaaataggaaagtgagtaacttttggatattacttttcagaaaacattctgtgtggcagtggccactttcctgtcaaaggcttaacatttttttcctataaatacattaaaagtgagtcagacttggatttgcaccttaacattattgccaacactttaaataactatatgttctctacaaatgttctctactaaagaagggactcggagaatggagggagcaaaaaggagaatggggaggcaactccggggcagctcacctgtctggccctgtgtggggtttcctctttagaattcagcaggctgtagggaaggtgaacactgggtactaggtaacccctgacctggtcagggagtctgagaaaatcggagagactgctctctatcctgcacccccaagccccaagctccacaggcttgcagggttgtcttgggaagcccctcccagaggccagccccaattcagcagggtgacggggcatggaccacacacgcatgcctgtccttagcgccttgagtccggagacccctgttcctcccagttcccttccttgtggaatggcgaagggagaggtgtccccagggagggttttggaccgtagccacctcttaagattctggggtcgggggacaagtcctgagtccaagggaatagcagggtgacactggtcaacaggtatgtgagtcctggttgaattcttgccctcaaatgttcatgctacattttctgtgtcccttccaccctcaatctacagcgaggagctcccctatcctgggccagtcggggtctacaagccagccagggaagcaaagggagagagggagaggccttcgaggacactacccctgctggaggggtgaggcgaggatatgccattgttgaggggctgtagcctacggccacaggtgatgggcagggtgggttaggaactgtgtactccaaaactggttgtggtttctctcagcaaaagctttttgtacctcccctccctccatggaaaaacaaaaaggttatgagagagaaagatattaggttaagagccttctacatttcaatagagctaccatacaatccagcaatcccaatcctaggcatatacccaaaagaatggaaaccaggatactgaagagctatctgcactcccatgtttattgcagcctattcacagtagccaagacctgggagcaacctaagcgtccatcaacagatgactggacaaagaaaacgtgctgcagatacacaatggagcactatccagccacaaaaaagaatgcgatattgtcatttgcaacaacatggacggaactggaggtcattatgctcagtgaaataagccagacatcgaaagacaaacattgtatgtccttatttatgtgtgggagctaaaaattaaaacactgaactcatgttgatggatggtcatcagaggctgggaagggtagtggggggcagggaggtaggtggggatggttaatggggacaaaatagtagttagaaagaatggaaaaaacctaatatttgctagcacaacagggtgactacagtaaaaaatattttaattgtacatttttaaataactaaaagaatataattggattgtttgtaacacaaaggataaatgcttgaggtgatggacaccccatttaccctgaggtgattattacacattgcatgtctgtatcaaaatatcccatataccccataaaatatacacatactgtgtacccacaaaaataaaaaataaaaattttaaaaagcttaagagtcctccacatttcagaaacatatatttttaaacattaggaaaaaggtagaaaaacagtagtctatggccgtaagagcccgcaggcaccctgcttgtccgatcacggacgctaagcggggttgggcctggctagtacttgcatgggagaccatgtaggaatgccgggtgctctaggcttaaatttaagtaagtctaagtaatttaaagagatttttttaagacgacagattataagtcaaagtgccaccctgtggcacccatgactgttcctgctgcagagatgctctgaggatgccattcgttctcacatggaattctttcatgaagatcccaaagaaattcctgtctggtctcaccttccagaatacatctacttttttctaagcgtctctctaagtttaatctgtgacttgttgacttctttacatcagctgttagtaaatctaaagacaaattcctaactgatgagataagctggattacctgaacattaccatggagcccctctgggttatctaacacgggaagaccagaggctttctctcctggcagagaggaccatacccagcttcccaggggccctcaagtccatgcacagggcagctggatttcccagacaattctggtcagcagccaacaaacaccccaggtcctgctgcttggtgccaggccagctgctgccccactgacaaggggctctcacaattcctatgccaaatgaaagcagtaaggaaacagagttctttctccaaaacacattcacacttcatggccagcacagagcccagcacacctctcagaggggtaccagaaggatcagaggaccagatccttggtacatctgcctctaaagcctgatcgttaagccatattctaagaccttgaggaccccaccccaagtcctagtgcacaataggtacctcctgcaaagatgcaacctgcctgaaaccatccctcagacacaggaccccgctgaggacatcacttcctcatccctgccagtgcacatctctggtgcagcttctccttttgcccctcccaattttaattcaggacctgacagatttataaattgcctccagtaatttctggaacacagcagcacagaagaaggagaaggagggaaaccaaaagaaaaaacacaaattctctatctttcaatgcaagtataactttttgccatgggttttggcttcctatgactcagtgcacactatcacctcgagattctcatgatgaataggattgaaaatgtcctaaaatagagccaccttcaaactgcagtaaaacaccttcccaagagggcacacaggtacaaatggtcttaagggcaaaaaaatccacagagcctcactctcccatatgtgctttcctaaaacacgttatttcggagcgagcttggagttcaggcacacaaagctctatctttaaacctctccttaaacaactgcctttctcccatgtgacaaagaaagggagagcactcaccctccctgggtgtaactatggaaggaagtatcctggaagcgtaaaaacctccatggggcaacagacaggtcatacaaaattctgatgacagcaaaaaatgtgcagatcaaggtttttataacagtatgtttaaaacatgggataaaatacaagtttttttaagtatgttattgtattgatgaggtagtattaaaattaaccatttcaattttctcaaatagttttaagtacagcagattaaactaaatgtctttaactaaagcactaacaggtataatgataacaatttggtaagtcacagtaaagtctcttaactatccttcagatattaataaagtgaataactctaataaccagtaacagattctttcacaaatcaggtgggttccagttctttgctttcaacaaaactgaaggaggacctaactgagttattaagtcaataaaaataattactgatgagagtgcaatataatttttggcatataacttgtaaacatttcaaaaaaactgagtggcaatgctgtttttaaaaattaattccatccaaatggaattaacatttgtttttgttgtagaaaagcatcctggagtgattaataaaagacttttcaagcataaaaatgggttatattagtatattgttctatggggaagaatggaaatatgagttcaaaaatataaaataacgatgtgaaattttgactattaaaaaagagtctcatataacttttaatggataatggcaggcatcaaataggtatggcatttaaattcattggataaattttagaaagacatgagactctttgaacgtcaatatttgtcatatgttaaaaatcacatcctacaattaagcttttgatgagaactgttagatgtcagcttaaacacgtgtaaggggatttacagattttcaaaattattttaggggtacacaactaagaacactgaacaatcactgctataatggcaccctattactctaccacaggaacaaaagctcccggggttcccaccagagacaggcacatctggggcacggggaaggacgcttagagtgatgctcatttaaaaagctcattttaacagggaacagtaagacaagcatcaaaaggaagtgcagactgtacagatccttggagctctgcagggggagtgacttcttaggcgctggttttcctcctgtttatgagagtaggactaataatttgagcagttcaaggtggggaaaagcttaagtactgagtgcactgaggaagcagaggtcacaggaaggaccccatagcgaggtcctctgtgggtgcaggactgccccctaggggacatttcagaactctatttttctggttgtcataatgaccagaacgtactgctcagaggggccaaggattcacgatgtcttgcaacacacaaggtcagccctggacaacaagattctcccactattaaaacaaatttttaatattccactggacacacatttagatgaaatacttgttcacaatgatctgacttgagaatctgattctatttttgcgggtacacagcaagtactttctgtacagcggtattaaactctaaatattccaaagataggaccaccatgtaaatcaagggggagttgggtaaagtccatacaagcacaatctgtttcgcactctgagaccagatcatctcaggctacactattcatagtgtccaggctgcccaagaccttgcagccatcatattcatgttttttttttgtataggtgcatgtgtctatttcatcacatcttcttaacagtcagatatgagcacatattccgatgcatattattttctttaactttttatttctatattggtttttagaattatctgtatagatcgtttatataatgtataaatccaacttcaagaagttggccacgcatggtggctcacgcctgtaatcccagcactttgggaggccaaagcgggtggattgcctgaggtcaggagttcgagaccagtcttgtcaacatggtgaaaccctgtgtctactaaaaataaaaaaaaaaaaaattagctgggcctgatgatgtgtgcctgtaatcccagctactcgggaagctgaggcaggggaactgcttgaaccagggagatggaggttgcagtgagccgagatcacaccactgcactccagcctgggcaacagagcaagactccatctaaaaaaaaaaaaaaaaaaaaaaaaaaggttaaaggtggcagtacaaaatgtttgtttgtttgtagacaggatctcgctctattgtccaggctggaaatggcacaatcatggctaactgcaacctctgcctcccaggctcaggcgatactcccatctcagtctcccaagtagctgggaccacaggtgcacgccaccacacctggctaatttttgtatttttttgtagagatggggtttttctgtgtttcccaggctggtctcaaactcttgagctcaagtgatctgccctccttggcttcccaaagtgctgggattacaggtgtaagctcacacacctggcccaaaatatttgttataaaaagagatatggacatgctacaacatgggtgaatcttgaaaatattatgctagatcaaagaagccagaggtgaaaggccgcatgttatatgattccatagctatgaaatgtccagaacaggcaaatccatagaaacagaaagtagatggtgacacccagggctggtgggtggggggcagggggaaggggagtgactgctaatgggtacagggtttctttttggggtgattttaaaaagttctaaatttgagtgtggtgatgaccatacaagtgagaatataattttaaaaaccaccgaattaattgtatgctttaagtggttgaattgtatgggatgtggtttatatttcaaaaagcttttttaaagtattggtcaaatttggttgaaaagcgctactccagacttgctcacatggaagagaactggaggggaaaaaggtaggccagaacatctaggtgggacccctacagggttaaaacagctatgaagtatcagaacacttctgctatttagactgcggaaggctttcattttaaaggacatacaaatggcaatgaacataggtgagactttccaaaatagaatctatctcagattgcaaataaataccacggcttctatgggtcgaaaagacataaataacacacaccaccgccaatagtagtcctttgaaaccctccagacccaattaacacactaagaaagcataaaaacataaactgttctaggaagtatatcatcaggtaaggtaacacagtccccccagcaacaaaaagaaaaatagaaggaaggaaaaaaaaatgaatgtccaaatagcacccaccaccaataatcacctagttaagagaaaaccacatctagggatcaagttccctcacctcaagttatgaggcgggtatgagccagtgcatgaaacagctaatgtattctgaaatcagaaaaccagagcaaaggaactaagatttactagcacgtaaaaccacacacacacacagacatacatacaaggtaatttctccaggcagcatcttactttgattaccttaaattagtaatttgctaatgcaggcagttctcactttgcatggtcccacattaactgaaagtcacgcatgtccattgcaaacagtgtaaagtgaggacactgttctgatatgcacaaatttcagtttacatggcgccatgcaaagcaataaatgcctctaccaaaataggtcaaacaacatgtttaaaagtcttctctaatatggaggtctgtttgaaaacccgtatcaggattgcttatctcttgttcaacattgccgtttcaaaacccaagccacaccaggtattcattccagttccaggtcagttgcttcagcgatattcccaaaggagaacatgaacaaaccctcaagatcctttcttcttccctttctttaacctttctgtttgttcgatccgattccaaagctgtaggtggaatggcagaaggcaggagtggggtaggagagatacagagaacctccgtctccttgctagactctcctcactagtcctattccgaagaggttcacaagaattcatgctgtttggtctttcatttgtgtactactggaggaagtccagctaggttaccaatgataccagcagtcttagcaaggcttggtaagaagatgagctgtcatgccaatgtcctcacatcgatcctcctttgttcacccaccccaaacctccagggccctcgctggggctcctgctcagagctcccactcctaggatggcatttcagtggcccaagttctggtggcttcatccaagctcccctcaacaaagcagagtgatcctgttttccccataaaagcccagtttttagctggccatcatttaatttaggatcttggttttttgttttttgttgttgttgttttttgagatggagtctcactctgttacccaggctgaagtgcagtggtgcaatctcggctcaatgcaacctctccctcccaggttcaagtgattctcctgcctcagcctcccgagtagctgggactacagacgtgaggcaccacacccggctaatttttgtatttttaatagagacaaggtttcaccatattggccaggctggtcttgaactcctgacctaatgatccacccgcctcaacctcccaaagtgctgggattacaggtgtgagccactgcgcctggccaggatcttgtttattttttattatattttaaacattttcattagatatttaaagtcatcaagattttataaaaaatttctttcactgcccttaaacttaagaaatcttatctcatcaagagcatgactaaatatccactttatcctctcctcctcattcatattttaatatttaattcactcatttatctggagtcctttttgatacatctctaaaagacagataattccacaatgagttgctagctaaacattacttgaaatttcaggatgggactctgtcctcaccaccaagctttgtttccaagagatgccatgactgataaaactgaggttggaaagatcaatgtcttacagaaaacagaagattggggggaaacgattgaaacagcactgaatatgtttatgaaatgcatccactcactcaacaaatatttaccgtgcctctgtgtcatccaagttccagggatacagcagtgagcaaagttcctgactttgtaaggtttaagtgatagagacagagacagatgttaaataacgcagtacatcaagggctgaggaggccttgaagaatagtggatggagggtgcctgcagtgaggtggtggctgctgttgtcaggctgggagggagcccgccctgccatgaggacctctgggcatctgcaggagacagggagcaggccatgcagctgtgcggggcaagtgccttccaggtgaagaggaagcccatgcacaacgcaccagaggctaaatgacccaaatttgcagagtgagccagttcccaaatgctcctcgtgcatcatcccctccccaggcttgggacatctacaacaggctgggaaccactggggcaggacttcctaccaggtttgtcatctacaggctacacctcttctgaggcccctaagtcacccaatgtttggcttggagttttttgttttttgttttgttttgagatggagtctcactctgtcgcccaggctggattgcagtggtgagatcctggctcactgtaacctccacctcccgagttcaagcgattctcctgcctcagcctcctgagtagctgggattacaggcgtgtgccaccaagcccagctaattgttgtatttttagtagagacggggtttcaccatgttggtcaggctggtctcaaactcctgacctcgtgatctgccccgcttggcctcccaaagtgctgggattacaggcgtgagccaccatgcctggccagcttggagttttttgtcttttgtcctggcattcttcctttcctgacttggttctcctagaacctccctggcttctcacaaatggtttctaagctgaagaatccattgttctgagtctgaccttgcaccctcagctctccccactctgcaaactccactgggacccccacagggtccacaagaggagaggggagcaggacaactgtagtcttgttcttttgcgtaagtggactgagttttgcagaggtaggaagatggaagattttcatcttttagtttcaaaagtctgtctcaaacccacagctggagtggccttgctgcacagagcagtgactttcatacaagttgtcttgtggttaaagggcatccaactccaaacccaggagtatccctcaaccttttgaatttcgtttaaaataaaactgtaggatttcaacaaggaatagaagtggtcccaaggtgggcttcacaaaccaccattcccagacatgtttgtggggaagccttcagcagcaatgctgctcaggtgggcattcaggcacagtgacaaggagatggggaagaagacggtttcgcaataatcaattacaccactggaggctcctggctgcctaagggcacactggccctgaccccatcctgaaattgttccttgcaggtcgcatatttactcaatcaatattcatgcagagtccactctacagcaggctctaggtcagaattagctggatgagaatgctcgggttccctgcatgtgtgcacacacgaaccctatatatagtacattttgcagtgggaggggttacttttaattgagcacctgctttggtgtgtctaatatagtgtttgatttcaaccttattctgagtaggcattactattcctttttttcaaatgaggaaactaagcagagacagatcacataacctcccccaaggtcagccagctagttagtggcggggcgggactcaagccagggtgatcagactccaaagccatgccccctccaggaagtcacacccctccaggaagccacacccctccaggaagccacacccgccaggaagtcaggctaattccccaaactagccactaaaagtggccaggactggtcagatcaacatgcagagaaagctgctgatgttttattgttaataaggtcccaagttcaagttttatttggagatgttcaaattttaattattacttttaattgaaatgcactgtaatttaatattaatttttgtgtaagtcaaatgaattaggctaaattgcaactttcattttattttggaaggaggagaggctgaagaaaaaaagcaataaataaaaaggaaaaattatttctcttagaaattcacctgatagagagggattactgcattttctaaaccatgtctagtttagacacggcacatctggtatgatagatgctgtgtatgaatggaaacaagtttagggtaataaatgtttcccagtgttaaaataaacgcctcagcggttcagattttggccaggcagtttctccacagtaggaggcacttatctactttaacactttgctacttagaaattatcactcaatcaattaccgtccacctgggtttatttttacagagagcttcaataaaatgagtgtgaaaataagttaaacacattctattcattttctcaatttttcacctctcccaatggtggttatgttgacagaaaaattacttcattttatttcaacagacatttatggaatgctgaccaggttctgtgctaagggctgggagacaggatatgaccaagtggaatgaaatgtggtccctctcattacagagcatatataacctaccttttagcacaggcggtgtctctacagcccaaatgaaggcaaccacgagaaaaattctggaccctacaatctccacagccctccccttcctcccctaccacaagagactgccctttgcccaggtaacgtccctgtggtgtttacctatgtggtccgtcaagctctcaggtgcttccagatatggaaatactctttcaccaaaagatgtttgttatactttcttttttctttttaaacttttcttttaggttcaggggtacatgtgcaggtttgtttaatataggcaaactcgtgtcagaggtttggtgtacagaccatcttgtcacccaggtactaagcctagtacccaatagattttttcctgatcctctccctcctttcaccctctaccctccagtaggccacagggcccattgttcccctctttgtgctcattggttctcattatttagctcccacttgtaagtgagaacacacagtatttggttttctgttactgtgttcgtttgcttatactttcttttaaaagagtacctccctcttacatcacttctgacgtaagctttagaatttctgtaccatctgtctttttaaaaataatagctttactgagacataattcaaataccataaatccaccctttcaaagtataagactcaacggtcttgatactttcacaaagttgtataaccatttccactatctaattccagattcatcacccccaaaagaaatccctcacacattagcagccactccccattcctctctcctccacccccctcaaccaatctcctggcaaccactgatctattatacttactatccccatggatttgcctatcctaggcatttcctataaatgaaatcacacaacatgtggtcttcttctgtgtctgacttctttcattttagcataatgttttcaaggttcatccatggtacagcatgcatcagtactgcattcctttttatggctcaataatattccatcatatgactagacattttatttatccattcatccactgatggacatttgggttgttcccaccttttggctatcatgaagcgtgatgccatgaatatccacatgcaagtttttgtgtggacctctgttttcatctctcttgggtaggtgtctaggagcagagttgctgtatcacatggttaactctgtatttaaccttgcaaggcgctgcctgttttccaaagcagctgccccattttacattcccatcaacagtgtggaagagttccagtgtctccacatccttgcgaatacttgttactgccttttttctgacagccccaggtgtgaggtggtatctcattgtggttttgattggcatctccctgatggctactgatgttgggcatcttttcatgtgcttaataataaatctattttcctttacaaaattttcttaggttttttgggtattctttcgaatttcacattttgacctacaagttcagaacctctccgcatccgttcctctcaccctcctgtaatgtggtgtggtcgcctgtctttcagctcctacagtcggggcctgggccaccatcgctgctctcgcatggctgatgagccttatagagcctacatcacatctcttggacctggaaggggaaggaagaggaaaggcctggagactcaccaaaaggaaggaattcagcaatggcagaagtgagccccgaagtcccaaagtctctggattattctttccaccaagccatgttacgcccctaattcaacacttgtcatttctctttctctctttttttttttttttttaaagcgacggggtctcattatgttgctcaggcctcaagcgatcctcccacttcagcttcccgaatagctgggactacatcgcgccactgagcctggcttcaccatttcttaattgctacaaattccccaaatcccatgagacagaaatgtatgttcagtcataaatatgagtgcacattattctcccaggcatgacatggaacaagtaaaacagtaatcctgctttctgggtgcagagtcagtgaagaaacataaaaacagtcgcatagaatgatgcacagagatttagaaatagcaccataaaagctctaaacagggagattccacctggagacatcagcaaggcttgcagaggagagagaactgaccatcgccgatccactgagaaggaatcagatggaaaatgtgggggtggggaataatcagggatgggaacagcacattcaaagatccagtttcaggaaatagcaggtgtttagtgaaactaaaacagaaagcatgagggtcacaggcggggtcacagaaagggtcaaggctggaaagagaggctggggccagtgcttgtcagtcttccctgccatgctcagggttgggattttgtaggttctgaaatgcaaagcctgtgagtttttgagaaaggaaggaacgtgattagatttgcacttaaagacctcactgcagcaaccacatctctggatatcatacagatagatcttttcagcatagtaatgaaaactgaaaattactgcaaaatgcctaaacttgttcaagattctctttgtatcatttcttcttggcaaagttccgctgctcaagacccaacaattcatctcaaccactcaccacaaggttaagaaatgctctgatgctgtggtgttggaactcagctatgttgccacaaagtagtgggcttcaaacctttggcttaaatgtcccctagtagaattacaaaaaaaactatgaaagccctgcatatttttaagttcacataaaagttttccgtctaagctaggacagttgcaaaggatgcaatttctggtttgggatcaatattgacatttaaatgaaactattatatcactcttgtaagtgtgttcaaaggaatcaaattatcataaaaatgtgttatccaccatcatctaaagtgcatgaacaggctgggtttcgtggctcatgcctgtaattccagcactttgggaggctgaggcgggcggatcacttgaggtcaggagtttgagaccagcctggccaacatggtgaaaccttgtctctactaaaaatacaaaaattagctgggcatggtggcgtgtgcctgtaattccagctacttgggaggctgaggcaggagaatcacttgaacctgggagatggaggctgcagtgagccgaggttgtgccactgcactccagcctgggcaacaaagactacgtctcaaaaaaaaaaaaaagtacatgaacaaacatttcctttagtcaaaaatttgcattccctttcctccttcaagaaaattctacttcaccccaattccatcctaatcctgcttaaaagtcttacttctctgttttatctacaataaaaatacacatcaaaaaattgtagtttttatttcctgtaaccattaagctctaagtgttaagttttcatattatgaattgattcagttacaattaccaatagtacagaatggatcaaaatataaatgttttaaattttaataaaagtattatgtataacttgaaatccattggaaatccatcttttaaaaagatgaatgggcctttttatcctttctatagatgaatattacttatggctagaataagacaaggttaacatcaattctatttctactttccattttttatagatgttaacactgagaaaccttgtccatatacctaagtacagggaaataaaggagttttattatagcaatgctgctcaattctttaaactgcttccaacatatttgtcaaaaatcatgccttatctatcattaaaaagtgttttttaaaatcttgtcttttgctttctgacaccaatatttcatgttgccctgtctgccaccctagaggctgctccgtctcagacaggctccatccatagcaagattatggatgggtgagaaaagtcagttgtggggcggggcagggtggggtgcgtggcagtgggtgggagaagaaaacaggctgatacccccaccactgacatctgctcgggcggatcaatctcaggcaagagtccacgtggaggctaagggtctgaaaactccaccactccccacttatgtgccccagaatgcgcgccagtttaaaggaatggctctgaggcaggtttgtagactcctgggtctcctactccggttaaaccttgaaacagaagctctgttcctggggaccccgagaaaggagatgcaagcaggaaagaagcaaagatggaaaaagatgaaaaatgttagaaaatggcataaaaacaaacaataaagtgtttttcagaaaaacagagaaaagctctataaattagaactctgtggcttgccccacacaaagccatcagattagggagcagaccctcttcggctttctcctccccagctcctgcctctcctaaacatacccagagaacctcttcagtctttgtaccgttttgttattgttatttttaagcagagggtcatcatttcaaccctggttgttccaaacgaatagtaaactgtgatagaaaattctgaacattccaccaccagtgacccttactattctgatatggtctaataactcagaattattccctatcatacatactttatataacatcagctaccacacaagtttttaatacacagtaagcaggtggccccagcaatttctcttatatctcacatctggtattgtactccatataaggtgctgagtccgattttttaataaaaacatggcctgagcttgtaaaagctcaagtaaaatatgcctttaaaactgctgtatttaatttccagtcatgaaagtctaaaattattgtaaaataatactcaacttttttcacagatccattcaatgaagcttaaaagtactttcctttcagaaaggtaaagagcttcataactaacagtttcttgaattcacatgtgctgtcttacttttgtgagcgtgaattgtatacattttatacctttcaatctggaccaaattagttggttagtagcaccaaagtaatatacatgtatgtttcggggcagaggtgggggaagggaatggtaagggaagggcagaaatgctggaaattaaaccaataacttgagacttggaggaattcattattttttcaaaaaggaaattgaagacataaactgaagatacacactaggtaggaaacatcaacaaatgtgacatgattatgaatattatcttataattagggaaatagccattttgacggtcattacactttatgtgaggttagtgtacaatgtggcgtaaaagactggtgtaaaaatgagatggatttctgcaagttcaaacttaaaatcgtgcatctgactagatataagctgttgcgagtgcattacatctcccactccagtctaggaaaggtggagtccctttcatttacacgactattttcatgactgggcaaattcacagaggaaacacagggatcacattccttcgatcataaagtcctcaaaagcaatcttgctccatgtcagctggtgctaaatcaaaaggtaactttcatttcctttaaataattcagtttcatctctaactatcatcttcaaccacagattttaaattgatgctaaattgggtaactaagtagaaataaattagtagtagatgatgctggctataaaaccaagccaagaatttgagtagtttttttttttttttttaaaggttctgctctactgaatctatccgataatatttctccaaagaacttttatgctagtgctcattttttcccttttgggggatgatggaaagggggcagttaccctcccttgttatcacaagtaaaatgcaaaaatcagcccacagatggttgcagagaaaaaggtcctctcaaaccccaaaggcccaagtgtaaactgatattaatagatctgctcagtttgtaggcagtttaacaatagctatccagactaaagacacatgcttgatgacccagttcccataaaagagaaacatcacacatgtacatatatctggggggcagagttcctcgatgggcgttgcaacattggttctcagagaaaaacaacagaaatcagctaactatccattaggaaggaaacagctagcagctaaacaaagcgtagcatgctcttattgtggtataatgtacagtagtaaaaaggaatgagatagatcaattggctacaacatagctaaacctccagagtacatggctgaattatagagtaacacagcagcaaacacagatcaaaatccaaccaaatctactttccccttcttggcaacagaattttggctgcaaagtgcatctccctgactcccctcctttcagctaggcaggctaggaccaggttcttgccaatgaagcataccactccagcctcacacgtttaagagaaaatctctacccctctatttccactcctttgtcttatctgctgtgtggaaaagcaatgaccagatgactgacctagaaagtcacatgttaaagacggcagagcccctgtcagcctgggtctctgaatgactgcatggaacactgcagcccaatgacctacatacactacttattatgttctgtcacatgagggagaactacatgcccttcttttaaagccaaattactgtcaagtctcttactatagcaacttaatcttttatcccaacatagaaacatacagtaagatgaccaggtgcggtggctcacgcctgtaatcccaatacttttggaggccaaggtgggaggatctcttacggttgggaggatctcttgaggtcaggagttcgagatcagcctggccaacatggtgaaaccccatctctactaaaaatacaaaaattagccaggtgtggtggcacacgcctgtaatcccagctacttggaggctgaggcaggagaatcgtttgaatggggaggcagaggttgtaatgagccaagatcacaccactgcattccagcctgggccacagagcaagaccccatcacgaaagaaaggaaaaaagggaagggaaaagggaggggaaaaaggaagggaaaagggaagggaagggaaaaaagagagagaaagagaaagagaaagaaagaaagaaagagagaaggaaggaaggaaggaaagaaagaaagaaagaaaaagaaaaacagtaagaccccttctatattaacaccatatcaaaaagacttgaaaaagcagatcaatctcctgacagtgattatagaggtgggaatgagagaaaggaagggcacaggcaaaacaagacagatgggattagggaaaactttagatttcacttttaaatatatgaacagaaaatatatccatgtattactcatacaattgaaagctgataatctatagaacgtaacaattttaatgaccaattctattttttcctctaagtttttcattgaggtggcatttggattctaagtgattccagtcaatatatctttccataaaatataaagaaaatgatgaccaaaataaaaatagtcataaaaaaaaaaggcgtcatgagaacattgtctggcactcacactctggaaaggggaaaaaacaattggctggcacgacgactttgtccccacggagcgttgtaccgtacaagcattcttccaccaggctaccatgtgagtgtgggcagttgtccccatctcagggtctccggaacctgggagaagtccatccaccctagtctgggagacagcacaggctccaggagacgaagtgaaggctctgtcccctgccagccatcaggtatagtacaacctccctctctccaagggacagtttcttccaatgaaaaactgaggcaccgcacaggttgtgtctgagatacgactcctcgcattcaagtctcagctggaaggccctaaggaaacaactgcaactttttttcaatgacctgagtccatgcattaagcaaaagatgtttaatttatttatttatttatttatttatttatttatttatttattttgagacagagtctcgctctgtcacccaggctggagtgcagtggtgcgatctcggctcactgcaagctccgccttccaggttcacgccattctcccgcctcagcctccggagtagctgggactacaggcgcccgccaccacgcccggctaatcttctaatcttttgtatttttcgtagagacagggtttcaccgtgttagccaggatgatctcgatctcctgacctcgtgatccgcccacctcggcctcccaaagtgctggggttacaggcgtgagccaccgtgcccagcccaaacgatgtttaattttagatgagtttctttccccatctcagcatctaccagaaaagagattttcattttcaaacctcatttctttcctaaggattacccatgcaaactgcatttcatactttcaaaatgccctttgcttattaaaaagcactgtgagaacacagacatgcttaagaaatttcatgatacacggagaacaaaaaaattctacttttgatcattctcatctttaccagacttgcttagtacaattaaattatccaccctaaaataaattttcttctagataccatatccttattttgttaatcctccatcttaagtgtattgatgtccttaatcttgtgtttataacatctgggttaaaatcacagactcacagaacaaatccaacccccctacttaaagagaaagaacagaggtcttccacctagaatcattttatgaacaataggggaactttaacttctgggaaaaccctagattcctgctttggaatcctttaggagtgggaacaggaatatgaacaggagaaaaccacctttaaaataaaacccgtgaaccctagttatagcacctttgaattgcaaagaatctgagaagttgtttgccacgattttaaaattaattccacaccaaagcatgcatgtttttcatttaagagacttcagaaattgactctgaaggactgtcagcagcgaaacctggttgcttttgtgtctcgccccagtactgctattaggagtgcagcctctggccaccagtgacctggacacacacccagctacccctctgagaagctgcgtctggaccactgcatctccccgggaacctcattgacaccacaggcttattaccatgaaggggtggggggaggaagaaaagagaatacacctaagttctccttagcaggcctgatacggtcttaacagtcactctcatgattattagctattaattccttatttttcttagttattacttgcatgattttcacttatatgagcatatttcccccaccatttcttaaagtatcttcccatataattattaattttaaaactaggttatcaataaatagacctatatttctacctatgtcatcctccaacggttattgataaatttgctacctttgcagatatgaggattttcatctcagctttccagtgagaagtgattgtttcggaatcatagttacaagtttcccttaaagtaactggaagtcttaaaagggggcttcatgacaaaacatcacatgaggaaaaatatcttaaggactagttagcagtgagaattttcaataaaatcatgagctagagatatcaaggctaaaattcaaatactaagagaagaaaatgttcctaactcccacaggtctggtccaactgttttaaaagacctgggcagaagggtttggaaaatggcatctaagaaggaggaaaatttagcacctacaccccagccctggccccccactccaccttcaactggagccttagagaggctcttttgagcaattatagagtaaaattacatcagaatatacattaatgagagtattttcaataatgcaaacgctgctaattatatcttttctttttaacacgaggtagaacattttacagcaaccctgagaccggccgtgtgcccagcagggagcctcgtattccgcacacacttggaaaggccatgacagcaggctgcatgatatgaggtgtgagaaatgaaaactttatgtgcatacaaatttagatttttaaaatattttcactaggggcataaataaagagaaattagaccactgggatttcagaaaacgagaatacagactgtgatttttgttttaaattttggtacttagagtaccccaatacctaaagaagtaaataattcagcaagttaccaaaagtaacacttcacttttaactttatactttttatataatttgagctattttgttcaaggaaggagagaaaattgcacacatttaaataaaagaaaggagacaaggaaggaaaacaaagggacacaggcaccaccacagacggccctttatcaggctaccatgacacatccatgcaacaagggctaccaaaaacgctacgaaaatacaatttccatcaatttacactgatttttattataccatagcacttgaaaaaactgtccacagttatttgcccccattataaaaatattgacactttaccacaaggttggaatttagcatgaacatccacatacccaccacctagacaagtcacatactgggagttaatattcgcaaaacatatatctgaaaaaggactggtatctgagatatacaaagaacttctacaactcaataataaaatgacaagtaccccaacttcaaaatgggcaaaagatttgaacaacatttcacaaattaagaatgccagcagtgtaataggtacaataagtataatcatcctcaacaatatctgttttcaggaaaatgcagattgaaagcacagtgagatacaactgcacacccaccagaccagttgaaagtaaaagactgaccacaccaaatattggtgaagatgtagaggaccacctaccattaacattttcttatacttgctttagtacatatcaacctatgcatccagccattaattcatcttcttgctttatgcctttcaatgtaaattgcagatataccctttaatacttcagctgggctgggcgcggtggctcacacctgtaatcctagcactttgggaggctgaggcgggcggatcacaaggtcaggagatagagaccatcctggctaacatggtgaaaccccgtctctactaaaaatacaaaaaaattagccaggcgtggtggcgggcgcctgtagtcccagctactcgggaggcggagtttgcagtgagccgagatcgcaccagtgcactccagcctgggtgacagagcgagcctctgtctcaaaaaaaaaaaaaaaacttcagctgcataccattaactagagttcaatattttagtttttatgtaaaattggcctaccttgatatgctaagatctgctgggttttgacaaatgtgtacaccaccgccaatcccagaaacaaccattcttctaattttctcccaccatagattagatgtgtctgttcttcaatttcataaaatggaatagcacactatgtacttgttcatgggatgtttctttcactctgcataatgtttttgagattcgtgcaagctcattcctttttattgctaagtagtgtacctttgtataaatatgctacagtttatccattcatctgtcagtggacatctaggttgcttccaggttttggcaattacaaataagcttctatgaatacgacctacaagtctgcatagacatgtatttttgtttatcttgggtaaatatctagggatggggttacagggtaggcatatgtgtgcttttatttaaaaattgctccactattttttttcaaaatggtcgtatcattttatattcccaccaacgatgttcagaaattgcagttcctctacaacttcaccaatatttggtgtgtcagtcttttcattttcagctgatctgggggatatgcagtggtatctcactgtgcttttaatctgcattttcctgaaaacagatattgttaaggattattacacttattatactgctggcattcttctttttttttgtttgtttgagacagagtctcgctctgtcgccaggctggagtacagtggcacaatctcgactcactgcaacctccacctcccgggttgaagcgattctcctgcctcagcctccccagtagctgggactacaggcgtgtaccaccacaccaagctaatttttgtatttttagtagagacagggtttcaccatgttggccaggatggtctcgatctcttgaccttgtgatccgcctgcctcagcctcccaaagtgctgggatcacaagcgtgagccaccacacccagccattgctggcattcttaatttgtgaagtgttgttcaaatcttttgcccatttttaaattggagtatttgtcattttattactgagttgtagaagttctttgtatatgtcagatacgagtcctttgtcagacatatgttttgcaaatattaactcccagtgtgtgacttatctattcatttcctcatcagtacctcttgatgagcagaatttttctttttagagacagggtgtcactctgtcatccagcctgaagtgcagtggtgcaatcatatctcactgcagccctgaccttttaggttcaggcctcctgggcaactgggaccacaggcatgtgccaccacatccagctaattttaaaaatattttgtagagatggagtttcactatgttgcccaggctggtctcaaactcctaggatcaagctatcctcctgccttgacctctcaaaatgctgagattacaggaatgaaccactgcacctggctagaatttttaaatgaagtctaacatcatttttcttttatagttattgctttctgtcatcagtttaagaaatttcttcttagtcgcaagtcatgaagatattgttttcctttaaaactttacgatttttcacttctgtattaaggtctatgattcatctcaaatcaattttcctgtatgaggtgaagtacagcacaagattcccttcttttcctatatggagcacatatctacttactgtatcaccacttcttgaaaacacatttctttccccatcggattgctttaacacctgtctcaaaaatcaaaggccctaacacagtgaaaccccgtctctactaaaaatacaaaaaattagccaggtgttgtggtgggcgcctgtagtctcagctactcgggaggctgaggcaggagaatggcatgaacccaggaggtggagcttgcagtgagccgagatcgcgccactgcactccagcctgagcgacagagcgagactccgtctcaaaaaaataaaataaaataaaataaaataaaataaataaattaaaaagccaataaggtgcagatctatttccagggtattctgctctattgttctattttcttgttaatgccagtaccatatagctttgattattgtcattttatagtaagtcttaaagttaagtagtatgacttctccaccaactttgttctaaattactttctccattatagaacttttgcatttctatgtacatgttagaattagtgaggacgtggtggcccatctggagcagccactgtggggacaccagctgcaatgggggaggtgtggccagggctgctgcactccatggagctaacacaggccaggaatgggcgggagccctgccccctaccaagtcggctgggcaggagccccatgctcccaggtgcagctgcggccacccagccacggctctggacccaggcatccctgcactctcgggggtccaggaagcacccccggtccctgcaggcttggaagtgcctactcgcactccctggcctctccccgctcccggcacccacttcagtgcaaagttgtagccaagcgcgggtgctgtcatgacccagccaggtgtgcacatatgcagagtagccagcactcccctccccgactggtgcttcagccccctctagactttggtcaccaatgaacgcaggagggagaccagaggactaagcgtgactttgtacaggcctgtgggtgcccctcagcatagacagctgggcaccacggacagcatgttgatggcagcgggaggcagacaggctcctaagcaggaagaagccagttcctggtgaaaccacaccttcaagcctgaagcctgggctccaggctgccagttccaggtgaggtccacggcctggagtgagaatttcattgacaactgtttggccattcggatggtgctttttccaggaccagccagggacacccaaggaccagtcagcacacacttcctccattgtgacaacataaaaaccccagattcagccactcacactctcctctggaagaccccgctgagagctggacacatgtcgggacaacctgtctgcagaaaggagctacccaccatgggtctcctcttcgctgagagccagacagatgttgggataacatgtctgcggaaaggagctacacactacaggtctcctgtccactaagagctggacactcatcgggacgatctgcctgcaggaaggagctacccacttcaagtctcctgagagctgttctgccactcaatgaagcttctctctgccttgctcgccctccaattgtccacatacctccttcttcctggatgcaggacaagaacttgggacctgcccaatggtggaactaagagagctgtaacacaaacaggggcaacgtccccctgctcgccatgttgcaggtgatgaggagagaagagaggcagctcttcggggagccagacctaggggctccccaagccagggctgtgacaccctctttggggctctgcagttcctggtgtctccaagtttctggatgccaccacattccccttgtctaggtgctggtgcctgcagcagaagccacttgtggtacatctgatctagcctcagccttgcacggaggcagcacccgtgccagggcatggagctgcctgccccaccgcagcagccactgtgcactggcctgcctgtgcacagtggccagaccccaagcttgctcgttcacaacccctcgccagtgtgcgcctggctcacccgtggcaggcatgggatccaggctgagagtgcgagccaagtgcagcctgccagggctgaatgagcccagcaggcccgaacaaaactcaggcaaaggtaccaccagccacagaggtttctggctggaaaagcaatactctaaggatcctgtgacattttcgtatacatttccacaaaaatacctgccgtgattttgattgagcttgtaccaaattcgtacatcaacttacagcaaactggcattttaccagtactaactcttccaaaccatgatcatggtttctctacgtaggtcttatgcagtttcaaaacagttcgtactttcccttgtgatttcttgcttgaccaatggactatttagatgtgtgctgtttactttctaaatacttgtgggtttcctagatccatttttgttattgatttctaatttaattccatggtggacagggaatatactctgtgatttcaatcactttaggcttttggagacttgttttatgacccagcacatagtctaccttggtgaacataccaagcacacttgaaacaaggtgagtttggcaaggtatagtgttctggaagtattaggtatcaggaaggtgaaagtggttgagagtgttatccagattatctatgtttttcatgatttttggttagctgttccatcatgggctaagagagcattgctgaaatctccaactatgacggtggacttctctatttcttttattctgtccatttttgcatcatatactttaaagctctgttattaggtaaatacacatccatgagttgttatctgttctctatgaattacccctattgtcactgtgaaatatccctccccatcttttgtacttctttgtcttaaagtgaattttgtctgctgcttaaaaagtcactccaacctccttaggctgttaatgtggtatataatttcctatccttttacttctaacctgtgtctttataattgaagtgtgtcttgaagagaacatatactcaggtcttgctttttaaaaaatccattctaacattttctgccttttaataacagggcttagtctattatcatttaatgtaaatattgataaggttgaattgagttaaaccatttggttaatttttatttttttctctcttttttttgtgtgtgtttctagtcctcttttcctgacttcttttagattttttttttagaatggcattttatctattggcttttgaactgtatcttttgccttatgtgtttagtggttatcctagggattacaatgtacatccttaccttttatatcaacttagcattaatattgtaccatgtcagatcaaatgcagaaatgttacaatcttataggtccatttaccacccctttgttgttcctttttgctagagttgtcatatgtattctaccaatgaatgtaagactatgtaagatgatgctacaattttgctttaggtagatatatgtgtgttgggggagtattttaaatttacccagatatttgtccagagagcattccttcctaaagactcaagtttccctctagtgtttttcctttcaccttttgaaacttcctttggcatttccttccagcagacctgcactatgacacattatcttagtgttcttttacctggacatgtattttgccatcattattgaaacattttgttggatatggaattctgggttgacaagtttatcttccttgagccctctaaaaatattgttccactctcttctggctttaataatttctgagaaaaagtccacagacattcaaatcattgttcctcactgcatgaaatgctgttttcctcagattactttcagtacttgtttttttttttaatctttggtctgcagcagttggactataatatgcctagatgtattttcatcatattcatctggcttggagtttgctgaacttcttgagcctggaaatttatgtcttctgccaaactgagggaacatctggccatcattttttcaaattttttttccatctctcctacacatatattaaacattctgatattatccataggtccctgaggctctgtttattttttaaatctttttctctcttcttcagattagataattattactgtcttattttcaagttcatagaacctgagaacatgaagatgataaaattacattctctgtgggtaatcattgaagggtcattgtgaactagacagaagctagaagaaacatacaattctaattttaaaaggaaattgtactaaccagagatattctatcccaagtgaaattcaagtaaataaacgaaactactactactgagcacctattaaaggtcagaaattgtactggcactttcatacttaccattgtatttaatttagatcacagctcattaataaaggtattactgcccacaatatacacatagtagtacagaggaacaaaaaagtaacttgtcccactaattagctcaagagctgagactttaacttaggactcccgttatagctttaccactcatctcattgaaaaaataaaaaattaagagaattgtcaagagttagacatattagctagcctgattttcttttgtaataagattagtatacaagtagatattggaagtatggggaacatagtacattacgatttcagcaaagcatctgtcagaagtaatatagtattacaaactaacaattagggctcttaacacagataaaactcttaaatgctgcttctatcacttactctttatgtcactctgtccaagcatttaaactctctaagctatagcttcccccttatctctttaaaggggaaccatgatgatactatctcaccaggttttagttaagaccgaatggtaaaaatctacagaatgcatttagcatagtactgtcacatagtaaatggtaaattagtgttaactattattattaaggcatgatatctcttgaacaaaaataattggaatataacataattatgaatattcatgaagtattgtaaacaacagttattaaccccattcctattcaacttctgtcaatgtctgctttgttttataattcaccaagtatcttccagaaaagaaagattgtaatgggttcactacagaattatacagaactgctggctcaaaaagaaatatgattatttataataggaaatcaccagcaatgacaagaatgcattcacagaagattgcttaaataaattatgatagactaatcttgcacatgtagtgtaggaggaaataaaagactagaaggagatacaccagaagattaacatgattcatatctcttcaactaattaacaaacatattaaataccatttgggaaaagattacatttttttcaacagtatttggattcagatttccattttggaatggggtgggtttataaggagccattctgggagacagaactatctccaaggtgactggaaggggatgcctcaagttataagagctcaacagaccaagcacagtggctcacacctatagtcccagaactttgggaggccaggaattcaaaaccagccttgggcaaaaaagtgagaccttgtctctacaaaagctacgaaaagttagccaagcatggtggcacgcgcctgtagtcccagctactcaagaggctgaggtgggaggactgcttgagcccaggagttcgaggctgcagtgagccgagattgcaccactacactccagcctggatgacagagcaagatcccatctcttaaagaaaaaaaaaaaaaaaagagctcagtaaatatttgactgaacaaatggtaggaaattgcccagtatctggtgctcagacacatccacaacactgcagagggcattcaagccctctggcccctgaggtgcctgccagagtttggacagacatttgtttgtctgatttaaggttcagtagaagtcaaatccctcattcgtttccaatgatgacaacatggtgctggaaacatttggtgcacttcatgacaattttccaggtatcaacagtaaaaacagaaactgcctgtaatcttacaacggtgctctatctccactgcctggaacaaaggttccaagaaggcctcttagcagttaggaaacatgctcatattttgcaacagaaagaagggaagaggaggcaggagaaggaagaaaagagaacaagatctgaaacgaagctagagaaggcattttaattgagctaaaaaacaaaacaaaacaaaacaaaaacaaattctaaaagtagctccacatcagagattcacagcccaggtttgcaacatctaagtttcttgtattacctcaatgggcatcacagaatgcaaaaaaaaaaatcatattacatttcatcttgtttccatttataaaagagaagatgccataggttgtttccggaagtggaaagggtattgaaaatgagtagaaaggatgaaaataaaaaccaggaaagcagggagattgccacgacttgcagaatccacctcgaacactccaccaggattccaagcatatcagaccccacactccgattccacggcaggttctatactatgttagtaagtcaaataagctttaacaaaacatcgaaatccaaaatgtcagccacgacctcatccaagaccactccacatctgcccaaactccccttacccctcccagagcactccttagggcgtgggagccgaggggcattttccaccacagctgagttcttcacgccactgtatcatcccctcctgcgttctgggtgtttgggttggaagcgatgccagcagagagtttttgtttgtttgtttgtttgtttgtttgtttgttttgagatagagtctcactgtcacccaggctggagtgcagtggcgtgatctcggctcactgcaacctccacctcccagattcaagcaatctcctgcctcagcccctcaactagctgggactacaggtgtgcaccaccatgcccgactaatttttgtatttttagtagagatggggtttcaccatgttggccaggatggtctcaaactcctgacctcaagtgatccacctacctcggcctcccaaagtgctgggattacagacgtgagccaccacgcctggcccggcagagatttttcttctcggatatcactcagctgtaattggagacatctgaacacccacccggatcatcacccccactcccaccccaggagccactttgtctaacaggggcatggaactcattcgactttccctgggttccagaaggaaactccaattactcagccaccactactgttagcgtgggaagctgggaagcacggaatgaagccgagttatgaatcatgcacacacagacagctgtcgggggatgcatgccaaccagaggggccacacatattccgtgttgatgggacagcacctgcaggaggcagagagaacttgtaacagatcatatgaaatccccattgccgtaattcctttttggaacagggcagggcataaaaagaagtaatccagatgatcagccagacatgaaaagaaaagaactgtcctcaggccagctgggcctcagtgtccgtgttggaaggacacttccagctttggtggtcttgatgtccataccctgaggaacctggcctctgagaaggctcccaggacccatgtggacaggggggctctgcaccattttacttgaaagggggctttacaggcatggtggcacgtgccttaatcccagctactagggaggctgaggcaggaggatcacttgaatctgggaagcagaggttgcagtgaaccaagattgtgccactgcactccagcttgagcaagagtgagactccacgtcggccgggcatggtggctcacgcctgtaatcccagcattttgggaggccgaagcgggcggatcccaaggtcagatcatcgagatcatcctggctaacacggtgaaaccccgtctctactaaaaatacaaaaaattagccgggcgtggtggcaggtgcctgtagtcctagctactcgggaggctgaggcaggagaatggcatgaacccggaaggcggagcttgcagtgagccaggattgtgccactgcactccagcctgggtgacagagcgagacttcgtcttggaaaaaaaaaattaagccacagatctagtataaccctctaatctcacagatgagaaacagacccggagaggctgagtgattcaccaacatcgcacaagctgctgtgtcaaaatggcaggcaagaaagttacagtctgagattttggggtttttttgttttgttttgttttgtttttgaaatagagtctcactctgtcgcccaggctggagtgcagtgccgcaatctcagctcactgcaacctccacctcctgggttcaagcaattctcctgccttagcctcctgagtagctgggactataggtgcgtgtcaccacgcctggctaattttctttctttcttttttttttttttttttttttagtagagatggggtttctccatgttaaccaggatggcctcgatctcctgacctcgtgatccacccacctcggcctcccaaagtgttgggattacaggtgtgagccaccgtgcccggcccagtctgaggtttttgtatttcatttttaggtaaattctgtatgcacatattacccaattttaaactgaaaactctattagcatcaaggtgacctctggaaccaaagggcaaagaaagaggcaggtacagacttccccatcattcctccttctcatctccttgcccttccacaaccagggaaaatccttctccgccaggcaatgacttcatcgtttccttctcactaatttgaatactcttatgggagagccaaacaaaaaatgaaaatgatgaatgactccttgtgcaatgcagaaaaaatgtggcgtttgggatctcacagtgacggaatacccctcatgcagaaacagaacatgcttctctccaaaacaaaaagcagaaacaacaaaggtatttcagagctcagaaggtgttttgccaaatggtaggtgtgtaaaagattttaaaggggcaggtgaaagcaaatcaactctcacctccaaagcaggtaactgttttatttgaaagaaaaacaaaagttccctctaaataagccacaaagctaagtcaggggagaaaaagaaatggaagagagggatgcctaacaagtaggaggaaaaatacctgctgggataactggcacatttattttaaacattgacagattttgactaaaacatatttttaagccggaactcaacctctatctgcacaccccatgtgtccaggtgactggtcagacctcaatcatgaacactaacgtctaagaatatctaaaaaagtttctacttagaaactactgttaaatcataatccaagtttgggcaatgctgctttcttatcatagatttcttactgcatcagaatcttgaaacatatgctcaggttttatttgcagtttccactgtcggtggctatcagcagcgctgtgtggggaaagcacctgtcttccttggtagctgaagaggagattaaaccaactcttggtggccaccccactccgtgtcagagactatgcaatgggctttccacagcaccacctgctctgaccttccccacatgaatggctgccaggtccgacccgcagaccatggctgaacaacggatgaacaaatgcactcagacacaagaatccagtgaaagagcaggctaggggacccggccacccacagacaccaaggagggtgctgtaatgagtcagcagccacagccccgaaaagccggcactgtgggcatttattcagtatagatttaatgacaaaggccttgagtcaacacatttgtgggcaattcacatggtcacccagacccggagagagtagttctgtgcgtggatgcttaagggcgaggttccaaggcctaagtaaactaacttacctagatcagtttatttatatccccttgttatctaacgtaagctttcaggcaccagataaaagaatctggctgccttcagccaaatccttttccgaagcttttgtaaaaccttccagccttccaagaaggtttgcatcttctgcaatttttcccaccacccttaccaatctcctacaaatggcattaccatgagtgggcattattgcagcttgtccattttaagatgagatgtcatggaatttgccccaggccagtagccaatgaagctccagagcctgccctgctttcagcatcccatgcagccttgcccagtgggaaaccagacttctaataaactcaggctggttattccaaggtcatgtctttggcccttctgctaaagaataactcctttacaatctaaagactagagtggaagcagttccaaccctcagcagattcagctcactactaaactaaaatcaacacatttggatttttctctaaggtaaacctgaactggggggaaaagagcatagagaagtccctgtcaccctctttattgattatcttttctaaccctaaaccttgccttattaccttttgtggtcttttattgcttgtttaaataaaacagaggcatttgacaaaatgaatattaaatgtagttacaatcaagcaattctgcagagtaataaacatctggggttttttttagagcttaaagagaatgtagtaatgtcaggtgcacgtgtttctgactgtcatggaaggttcaggggtctcaggaaggtgtgggtgatgcacaaggcatatccaagggactgcgaaaatgttcaaaccactgcagatttggctcttttgaaatgactgtgaattacctgtgaaaatgataactaaagggttaagatttcaaaaaaagagaaggttcaatgaaaaagagacttgcttcacatataagagaaacacaaacatggacaactgactatgttttctcatctttcaaaaaaagttggactaaaatatttttggcacaacagtaaccagcaacaaacaattggttctagtatgagaaaaaaactgtcgaaatcttcaaacaaaaactccattccaagaaaacacctaccacaccaggcacggtggctcatgcctataatcccagcactttgggaggccaaggtgggaggatcgcttaaattcaacagttcaaggccaacctgggtaacatagtgggacccctgtctctacaaaaaatttaaaaattatccaggcatggtggctcacgcctgtggtcccagctactcgggacgctgaggtgggaggatcacttgggcccaggaagttgagactgcagtgagccatgatcagaccactgtactccagcctgggtgacagagcaagatcctgtctcaaaaaaaaaaaaaaaaagatacacatatcacagtcctgaacacagaccacaccaatctgtttcatggacgtccacagcactgctgctgaaggatgcgttataaaggctaaaaagaattgcacacaaagtttaaataataatgagagttccataaatattatctatgtactaagagtctgctgacatattatctcggcgcatcctcaccctatccagtgaggcaccctgaaggagggccccacatcttctctattccccatgggtcccagagcctcacacaggatcttgcacacagctggtgtgccagagaaagtagttaagtaattaaactttttatttttaagtagactattaccagctacatgacacagataaggaaatagaggcataaaaggttactgattttcccaagtttactcgtctaataaattgggattccaaaccagggccagcaggaccccatcccaagatctaagtaatgtaaaatgaatgaaccacgggctgatatgcaatttctgcaaatactttctaccccagcttttctaccatgttatctacttttttttttttcctaaaagtctcatacaccctcaaaagatgaagactgccaccattgagaacattcaaaagataggtgctgttggccaggcaccgtggctcaggcctgtaatcccagcactttgggaggccgagacgggcggatcacgaggtcaggaaatcgagaccatcctggtgaacacggtgaaaccccgtctctactaaaaatacaaaaaaaattagccgggcgtggtagcaggtgtctgtagtctcagctacttgggaggctgaggcagaagaatggcgtgaacccggaaggcagagcttgcagcgagctgatatcgcaccaccgcactccagcctgagcaacagagcgagactccatctcaaaaaaaaaaaaaaaaaaaaaaagatgggtgctatgggtttgaaagagcttcagcagaatccctgccatggctgggcagcttgccctaccctgaaggaggccatgttcgctccactccaggtgacattcactcctgctgttctgcgcagtcaaatttgggatgcttcaagttgtccaatagtaaaatgatactcaactgcaatggattgaatgtttgtgttccctccccaaccctctgtcaaaattcatgtgttgaaatcccagcccccaatgtgatggtaatcacttttgcaggtgattaagtcatgagggtggagccctaactaatgggattaatgcccttctatctgaggaccgttgagagctctctcaccctctttctgccatgtgcggatacaagaagtcagcagtcagcagggtctggtggctcatgcctgtaatcccagcactttgaaaggccgaggcaggaggatcatttgaggtcaggggttcgagaccagactggccaacatggtgaaaccctgtctctactaaaaatacaaaaaaaattagctgggtgtggtggcacatgcctgtaatcccagctgcgcaggaggctggggcaggataattgcttgatccccggagacagaggttgcagtgagccaagatcctgccactgcactccagcctgggccacagagtgagattctgtctcaaaaaaaaaaaaaaaagtcagcagtctacaatctagaagataatttgaccaagccgggtagcaccttgatctcagacttctagcctccagaacggtgagaaacaaatttctgttgtttataggccattcagtggatgccactttgttactgcaccccggaatgatgaagacatcaacatcaacgctgagaggacactgggacggctcagttctaatgaaaatgcacctaaatagaacacattatcactatcacaaaatggtaaacatcaaaataactctaccatacttgaaaaatcggtgacaaaatatgaaaataaacaaccaagaacactaaaaattaatgtagaagcttctctgaaaaataccaggccacagaataattcaacttcaggagcttggcatgtgaaaggttaacttattcaggtgttgaattggaacaacaaaaaaaatttgatggagaatttgccagaataacccttcagtcacaaccgttgccaaagtcaaaggccaaagttatattttaaattttagaagtaaacattaaaatgaaggtttcttaaaattctccaataattttcacttttaaagtaccaaactgacacataaaaaaattcgtgctaattatcccaagcaatcaacttctttaaaaccctttatttcacaattacgctaatatcccattaatttgggacacttaccaatgtatttattctttgctcattacctatgtgcacattaagagtacaccaataacacaatacaggcattaatatgtaaaacatcaacaaaagccatctggaaagctaatgaataatcaagggatttcaaattaaactacagaattttcccttagaatctttaggacaacactgtcaagctcaatctattcacttcgcctccagaatcaatttttcaaactttatgacaggtctaatcgcttccacctgtgtctccagcttgactcttgactggcatgctaccagccagggtggaaatgtagacaaagacccctattaggatccggctgtttctctactgtgaggtcactcagccattaaattagttccagcccaatttctgtcctctcgggcctcgacttcaggggaggagggtgcagagttgagtcagttagcagcacagacccagaagggaagaaaagggggaaaagatgtttgggactgactaggtaggtgtgcacaaagctgaaaagctggagttggtcccaaactctgaaatcgaaatactatctttcttaaatgactgcagctattctccccaatgcgatcctgcccccttcccatttaaaaaaaaaaaaaatatatatatatatatatatatatatatatatatatatatatatatatatatttatttatttattttatgggattgtgtttccttttcttctccttcatttgtagaaagtcaactgtctcccacacaacatttcctcaactcacatgaggctgattcacaaaactagctcagcaacctaaaagcgccagaagtcactgagagataaaaggctggttggtggaggctctggcgtgggcgcatcaccaggtcaaaggaggtgagctgaagatgcctggagagcatctagtgttccaacgcccctgatctcacagctgaagacagtaaggctcagggaggagagactgtcaaggtcacagagctagtgaatgacaaagtcttggttccagcattttccctactagattacgagctctacagcatcagaaacaaggcccaacacacagtaactgcaaaaacaaaaacaaaacaccacacatcgctcctatatcactgtgcccacctcctttctgcccaaagccccaatgatcagaccaagaacggtgtacacaactttacaaactggcacaggcactaggatctccttctgcaaacgcaccgtcaggcatggacgctgcctgagccgccaggacacctctccagtgcctaacacagtgcctggcatacaggagttgctccagaactgcttatcccatgaggcaaagaagtcaaatctaagcctgaaacatcaagggactcaaacggtgacaaatgagaaatcagcttatttaataagaaaatctaaaatattctttacaaatacaaaacgtccaaccttggacaacttattcaggatgcacaagtatacgaaggaaattggcgtaagcaagtttatgcccatctgctcaccacacactgcggtttcacgtcatttcactctctgatggagacttggtataagtcaatcaaaaaagacgctattggccaaataaaagatgattccaaaaatagcacaatgactcagttaccccaagctcctatgtttcacagtctagcctcatgctgtctccagagggttgactatcatttatcaggagattaaatggaatgtgccacacacccactacgtcaaggcagactgaactctgggaggggcttttcctgcagtgacaatggatttgcagtggctggtccacacccacttccctagaccccatcaccaccaatagctcacattttgcaaagggattcctgagctgtagctgtgggatgtgagcctggaacacggagaagttcactgtcccagacacagacacagacacagactggacccatgtccctgggactctacttaactggctgagctaactgctcacagggaaacctactaggaaatagcacagaaaaataaaggtctctggcgtgaaacaaaactggcaatacacacagcatggtgatatggttatgccctgtgcccccacacaaatctcatcttgaattataatccctgtaatccccataatccccaggtgccaagggagagactgggtggaggtaatcggatcatgggggttgtttctcccatgctgtccttgtgatggtgagttctcatgagatctgatggttttgtaagtgtttggtagttcctcctgtgttcattctcctgcctgccgccttgtgaagaaggtgccttgcttcccttcaccttccgccacgattgtaagtctcctgaggcctccccagccgtgctgaactgtgagtcagttaaacctctttcctttgtaaattacccagtcttgggcagtactttatagcaatgtggaaacagactaatacacatggcatccagaaggtgttaccctgacaatagtgtggaaaagcaattcatggtcgggaagacatgtcagagaaaatgactggagcccaggataaaggatgaaatcacgttttctaagcaaatgagttgggtggcacagccaagtcagattcctggggaaagcgcatcactaacggggttttgagtttttactctgggggtggaggggactcagtcatcagcaagcggcacccacattgccctgtgctacttcctctccccagagtgctctcccctctattcaatcacaaacacacttccaaatttgtggggtggagacacaaggtgaaggcggtggggggttcatgctctaagacaagccactcacatgcccagagagatcaaaagaaagctctctacaccagtaccatggtagctcagctggtactgaaataccagccctcaaaaaataccacaccctcaaaaatctgtcagaaatctccaaatcctcctagatgtgtaaacacctaaaaaaaattcctctaattaccttgagtaagcactgaaacaaaagcagtgttataagtcaaataattatcttcacctgtgatcctaaatctggtagaccctggcactatcagaaggtatactactttcagggcctccaagtatttttcttggtagtctgaaaaactgaaagtacatgcctgaggcagaattctaattgtcttccaatgtctaccaatgtctaccctcctttcctccttagtgatagaagcctggtttccagttagatccatggttgcctactataaagaccacatttatttcccagccttgtttgtaggtcacgtgactaggtcctgttcataatacataaacaaaaaggccatgtgcaacttctgtcccttgaagaatggggatgtagcttctttaccccttcctcccacttactggctcaagtaagaacataaacactgggatcaccatcctggacatgtgctgaaggtggccgagcaactcagctgggtccttgacacgtgagccaacgcaccaatgctggacttcccatctcagcctatctcatttgcaggagagaaaagtaaacttccatcctgttcaagccacttctattttcagatatctgttgcacacagtgaaacctaatcttaattgacctaggaaccggtacctgaaccgggggtgctaggtctcagattttatgtatgccccagaaacaaggcctaaaaatgcagcctgatatggaggagatgggcagaggatcactggcaaagacacaggtctcacaggttctcgactgctgactgccgcagcaaaacctttgatcgagtcctgaccttctatatgttgggaggtagacctggtgtctgttagaagctgtatccttacaggaaacagctctgaaaattcaaaatgtcagtgcttgccagtccttgacactctcagcaaggttcaatcaagagaaatgatctccaactaaagctaactagtctcaagaaagtgggaaagaatacagatttgattagaaaggagctctgtgtcagcaaccagcaatctaagtgagcctatggggctgtccctgcagccccagcaggagataagacagatgctttaccacatagagcccagaagccttgtgccaaagatatgattaagggcctggccttccacccaagcccacggtttcatttggcccaagggagttgctattaaattgggagggaaaggaatggcagagcgctgaggcctttaaaagaccagagtttttaggctgaaaaactgtctagacaagatcttgatggttactcacatggaaccaatcagaagcaaacagactagagggctactaaagtcctgagagacttgtatctctacagaaaccttaaggctggcctataaaaagctgtgactattcagtcctcaaaacaacacccagaccccaaatcctcccagcaagcgggttttggaagcccatcctctccagcatccatctccgatgtggtgcagagaagaccctttcagaaggcaaagccatgactccaaaagatcccaggcaagagagttcccggagggcagaacgcgggttgccagacagcgacaaggaaacatagtggccgccagtgcagggggtgcagggagacttgatggtcgtgatttctactacagcagtgtggcacatggtgtgctgggggcagagagctcgtctgtttcagctaacagattgcaagacctcaacaggtacatccggccctaaaagagaaaacggcacatcatccagagatcctgaatctgatcaagtggaaggaaatgaatgtcataccagggccatcttccttgaggaagaggtgagagttttctatggaggggaagacaaatgcatgtggatatctgggacctcagcagaaactgctggctgttccccactgtgtccttccccgtcttccttaggaatacaactcccaattttcagctggtgcaggttccatgatggggaatggtagacggagaaaaagagattttgtaaatcatatgatcaagatctatatctaacataaatttcactcctacttcagcccattaggaaagagctgctcaattgctgaagaaatgatacacacagacgaagagagaaataagcattgagagaacccagtccatagttctgaaaattcttcttgttctatccaatagtttcatcaaagtgatagtctcatcatgttgcccaggctggtctcaaactccagggcttaagcaattctcctgcctcagcctcccaaagtgctgcaattacaggcatgagccacaaaaaaagtatcccacttttttttgagatgggagtcttgttcggtcacccaggctagagtgcaatggcgcgatcttggctcactgcaacctctgcctccaaagttcaagcaattctcctgcctcagcctcttgagtagctgggattacaggagtgcaccacaactgcctggctaatttttgtatttttagtagagacagggtttcactatattggtcaggctggtctcgaactcctgacctcaagtgatccacccacctcggcctcccaaaatgctgggattacaggtgtgagccaccgcgcctggccatatccaacattttttataaatattcagaaacaggaacaattccacacacagtaaattctgttacctagaattctacacactggtataatactagtgtttgacactgttccagtaacaactccaaagcactaaaacaacagtccccaacctttttggcaccagggtccggttttgtggaagacagtttgtccatggacagggggtttcgggatgaaactgctccacctcagatcacgaggcattagtcagattctcataaggagcacgcaatctagatccctcacatgcacagttcacaatagggtttgagctcctatgagaatctaatgctgccgctgatctgacagggggcggggctcagccagtaatgctcacttgcaccactcacctactgctgcgccgccccgttcctaacaggctgcagaccacagcccgggggtcggggatccctgcactaaaaaataatgtatgagattcgtggatttgtttaaagcacacaaaagcagcaactggaagagaacagctgccagtacacataacctattattactatcacaaatagactatgtttccataagtatagctcgttaacatggtttggatttgtgttcctgcccaaatctcatgtcaaattgtaatcagtgttggaggagggcctggtgggaggtgatttgatcgtagaggtggatattccccttgctgttctcatgatagtgagttctcatgagatctggttgtttaaaagtgtgtgacaccaccccctttgctctcttcctcctgctcccatcatgtaggacgtgcctgcttccccttcaccttctgcaacgattgtaagtttcctgcggcctccccagccatgcttcctgtacagcctgcagaactgtgagccaattaaacctcttttctttgtaaactacccagtctcagttctttatagcaatgcgagaacgaactgatacactcatgtaggatcaaatatagttttagaaatattttagtcttattcttagaatgtaacaggccatgtattttgtgcatccatctatctcgtggtccctctgacatcaagatgacctcttcaaatgtcttctccttaaaaaggcaactgcctccccgcgccaggaatttcttcccaggttcactgactcagtaggtttctgtgagtaacctcacttcgtagtgttaggaaggaaccctgggaacagcggatgcagggcatctggtaagctaaggccgccaacaaccattcatccagtatcagctctgcaccaagcaagggattcataattaataatcaaaccaaacaagaagagaaacaaagattcctaaacaccctcagaaaggccaaaatatttttcccctttgtaaaagtaaaaactcttaaccctatgggaggttccacctctagtgttggcaagctcagcttcaatgtctgtcaaacacttttacagacccaagtttcctaaggcagaggtttttttttttttaagtttaatatcaaaagtgaacttcctgatatccaagaatattaaggcaatatatttatacaggttcttttttcacccaaaaacacaggctggacagcgtgtggtgaagcccagccctctgcggatgtgcgggagcctcagcctgtccgcactctcagggcgtgtgctgccctcttggtgacgcgctgccctcttggtgacgcgctgccctcttggtgacacgctgcctggccacgagctccaggaccacacttccaaggttcccaggtggcaatgacacgaaatattcttcagtattctccacagaaacaacaaaaatggcctggaagtacccgtatttttctatctgaacttcacctccccaaatcttttgttcaataacttgtctcatttttttattcagaaaatgtaactatcgcgagttaccccttcgatataatgaagtcttcgcttgagtaacaaaggattattacagagtttgcaacaagcaagtgatgactgttccatctaaaagaacaggctttttccttttctactgggaatcaatggatgtcaggggtgaggtggaaacaggagagttaagaagcgctgaaaaatgaaagtacctatgacatcacaaattaactcagtacacaacaattactaatgaacacggctcacagctcccctcccagcctgcccccattgctctgataatcctcccaaacaactctgccaatgcctcctctaatacaacacacatactaacactgtcattctgatgactctaagtgtgacagtcaagaaaatgctaaagttggctcatcattttatatccatatagcattaaattccagaaactattatcaagaaaaaggccaaaatattcccatacattgaattatacatctgtctaatcatgtggtcccatgagtgaaatgcctagaaactatgaatccagttatttttggaatatttcacgccttaaattttaacaccgcactgagggaaggcacttttgttattccctccctctataaccaaattttttaaactaaaatagtattagtactattggggagttttaaaaaattcctttcatttgttttctatttttttaatctttaatcagagtctatgtaacagaaggaatcaaaaggaaaacctgcagtaagagtaaatttctaatatccaaatggggttatcaactgcttaaaaaaggtatgggggttgggaatgggtggctcacgcctaaaatcccagcactctgggaggctgactcagaaggatcacttgaacccaggagttcgaggccagcctgggcaacatggtgaaaccctgtctctactaaaaatacaaaacttagctgggcatagtggcgtgtgcctatagtcccagctacttgggaggctgaggcaggagcaacccttgagctcagaaggtcgaggctgcagtgagctgtgattgtaccactggactccagcctgggtgacagagcaagatcctatctcaatcaatcaatcaatgaataaatgtattggatagcaatgtaccaaaaacacttttcaaaatacaaagctctgacctttttcaatttacacagcttaggtgtcattcaaacttcctattcaaatgcccctgaaaaacatcctgtattaaatgtctaacactgattgtaactgcacaaaagaagaatgataacctgagcaataatgccaccggttaaacatcttttttcataatattcgtttatcaaagaacattctgagggcctgattcaaagaagcaagacacaaagcacaaccaccttccattcccataaaaaacaaacctgtgatcaaagaacttcaatttcctttcccacgatttaactcttctaggacaagagtacttccaccttgctaataggtctggtcaaacgtattcctctacaactctatcccctccccgtctattggtaagagaggatgatcaatggaacaggactcctctgagcagatgcagacctgctcacaccttacccatccaggagacgcatcgttgtgggggtcacttcggcaaacaaaattactttccccaactgcttggtctgcagattttggcgatagatctctaagttgaaatgttctgatgagaaggcctccatgttggtcaccacaggtatacaagatggggttatttctacttcagacacgtaggatgaaacaaatctaagagagagctggccggattttatttctccctcggagtccacatgtttcccaagccactgcataagaggatccctgatttcctgtgtcataaagaaagaaatgagatggtcgtaatttggcattacattagatcatggtagcttttccttataatgccattttggtaatatgagtacttcctaattcatgaccaagaaaagctagattaacatattccatacatctaaacgattagacaatatgataatcatatacttagtatacttatactataaaataagctcttcagaaaccaggatccaagaaaatcagttcagttcatgattatacttcctatcttacatcttacattctctcatgattttcaagattcccctccagtccagagttcataagtagttctccagtcctccgttcattttacggaaaacttttatctttttgccccacaaagaaattcattatcctatttgcaaaaacaacaacagaaaaccctgggtgaaagaagtcacagaacacaaagcactcaaatacaagaacactcggtctcagcctcacatcttagagaatctccgcttcctcttgtaaagacaaggcaagttgatcaccaacaaagaagacaataatcttcacaaagggaaagtggggtaccccaaagctgctttctgtttgccccaaatggaggtacaaggaggagaaggaaggcaaaacctagaagagacgttgtccaatccaggcacagagctctctactctatccccaaaaccacaaggctggaggaggttcccccacgccagaccttagaggtcccagaggccttcctccagggtggtttatcaggaactgagggctgagggaagtcatcatctcaagaggcctgtacaaaacttactaagatctcagtaaacacagatccaggctcttaggccatcctcctgcaaacaccaggccctttacgtcccaaagctccctgtggctacagagtagtggcatcagagatgaaacttaattcaactaatttcaattgatcaacctttaaaactcacatctagtttgcagataatacagaggagaagagaacgagtcaaatgacttcagaagaaagcattcaggtccgcgcgcagtggttcacacctgtaatcccagcactttgggaggcccaggcgggcagatcacctcaggtcagtagttcaagaccagcctgaccaacatggtgaaactccgtctctactaaaaatacaaaaacttgccaggcatggtggcgggtgcctgtaatcccagctactcaggaggctgagacaggagaatcgcttgaacctgggaggcagaggctgcagtgagccaagatcactccactgcactccagcctggcaacaaagagtgaaactccatctcaaaaaaaaaaaaaaaaaaaagacaagaaaagaaagcattcagaagaaatccaggggataaaacattttacagaacagccgggctggaatcttcaactagtcaatgtcacggtggagatggggtggggacacagaggtggagagggagaccccgtctagattagaaggggcttaaaagacataatgaaacacaatgggtggttctttattggatcccaacttgaacaaactagctggaaaggacaattaggaaatctgaatgtgaacagtatgcattagacagcaaactggaattactgtcagttttaataggtgtgacaagggtactgtgggggccaggcgcagtggctcacacctgtaatcccagcactttgggaggctgaggcaggcgaattgcttgagctcaagagtctgagaccagcctgggcaacatggtgaaaccctgtctctcctaaaaatacaaaaattagccgggcatggtggcgtgcaactgtagtcccagatactcaggtggcagcggtggaaagattgcttgagcccaagaagcagaggctgcagtgagccaagatggcgccactgcactccagcctgagtgacagaaccaaaccctgtctcaagaaaaaaaggaagtactgtggtgacataggaaaagtccttaatttttaaaaatgtatatacgtcatgaaatctgtaaaatttacccccaaaatacataaagtaaggcaaaatgttgataattattcaactatgttgataattattaaatctagatgatgggtatttggggtatgtgttacagtattctctctattcttttccatgtttgagaactgtcataattaagagtaaaaaaaagtggtgaaataaacataagctatttaaaaataataaattcaggccgggcacagtggttcacgcctgtaatcccaacactttgggaggctgaagagggtggatcacttgaggccaggagttcaagactaacctgggcaacatggtgagaccccgtctctaataaaaatacaaaaattaactgggcatggtggcatgcacctataatcccagctactcaggaggctgaggcaggaaaatctcttgaacccaggtggcggaggttgcagtgagccgagatcacgccatcacactccagcctggagacagagcaaaactgcatctcaaataataataataatgaattcaattgaccatacactggcaacctattccctctgtcatccattcaacaaatgttacgggatatctcccatatggcaggcagtctcacaggctctgaggacggagcaatgatcaaaggggtcaaaattcctgtctttggagggttaatgctataatgtgggagtcagaaagttaaaaaagtccgggcgcagtggctcaggcctgtaatcccagcactttgagaggctaaggaaggcggatcactcgaggtcaggagtttgagaccagcctggccaacatgacaaaactccatctctactaaaaatacaaaaaattagccatgcatcgtggtgggtgcctgtaatcccggctacttgggaggctgaggcacaagaatcacttgaacccaggaggcagaggttgcagtgagccaagattgcgccactgcactccagactgggtgatagagtgagactcagtctcgaaaaaaaacaaaaaacaaaaaacaacaaaaaaaacaaagttaaaaaacagtaaacacaatacacagaatgttagagagtaacacgtacaaaggagggacaagaaagcacagaagagagggaggccacttcagaccagacagatggaggacctgctaagaaggcaacgcttaaggaaaggcctggagcaagtgaaggaggatgctgggacaaaatccacagaactatgtttttatatttatttataaagggattccagcaagtgcagaggctcccggagcagggaaagagcctgatcagggcacagcatttgagcagagtgagcctgggcagaaggtggagtgccggggccagaaaggcagagggggtggtgagagccaccgtccacatcgcggagggcctcaaaggccacagtaaggacggggctttcactcgaggagcaacagggagccccagaaggttctggggaaggtcgtgggatgtcctacctctgttggagcaggatcaccccactctgactcctgtgttgagaagagcctgaaggggaacaaacaagcagagaaactagttataaagtcacctaaatgagctaggagtgagactactgcctggaccagcatgcagcagacatggtgagaaaggataggattcacagtagactctgaagtacaggctacaagatttgctaacaagtcatatctgagatgttagagaaaacaggggctcaaaaaagagcccaagatttctggcctaaacatctggaaggacagatctgctgctggaaatactataggaagagcaggtttggagaggaagaggcaggaggtgagccctgggtgtgctaagcttgagatatctattaaaaatcccacgggggctgggcgcggtggctcacacctgtaatcccagcactttgggaggcccaggcagtcaaatcacttgaggtcaggagttcaagaccagcctggccaacatggtgaaaccccacctctactaaaaatacaaaaattagctgggcatggtggtgggcatctgtagtcccagctacctgggaggctgaactcaggaggtggaggttgcagtgagctgagatcatgccactgcattccagcctgagcaacagagaaagactcggtctcaaaattttttttaaaaaaggaaaaaaaaaatcccttgaaaacaatgaattggcagtagaacatgtgagtccagaatccaggggagaggtctgcaccatggatatcaatttgagaattgtcagactatgggtgatcatttaaagccaagaaagaggataagatccatgaaaagagtgactgtagttaaaaagaggatgcaaagtagggctgctgtcacaaaggactacaaaccgggtggcttgagatgccagaaatctattcttacagttttggaggacagaagtcaaaaatgaacacgtcaacggggccgtgcctcctgggaaggctctggggaaactagtgttcacgcctttgcttctggtgccgctggcactccatggtgcccctcggcttgtacacacatcacccccatctctgtggccatcatcacatggcgttctcctctttaagtgtcccgattctgtgtgtcctctagtcttctgaggacagcagtcgtactggattagggatccaccctaatgacctcatcttcacttgattacatctgcaaagacccagcttccaaataaggtcatattcacaggctccagggctggggctttcacatatctttttgggggacacaactcaaccaacaatagcagtccatgcttaggtttcagggagatcaaaaagagtgtgcaaaagagattgagaaagggagagaaaaatcaagtgtgtctgtggacagcagtggggggcggtggttgcgggagtctcctgactccagtttggaaggttggaagacgatgacagtgccgtggggagagggctgagaagtcaccgctggccttggtgccacagagcccagactctgatgagagcagtttgagaggcgtgatggaggccaaagtcagatgggagtagtgaaaagagaaaaactgcagactccaggataaaactctggcaaagggtctcctttaaagggtagagaggaatggggcagtggctagagggaggaatggggtgaaagcaggttttgtttggtttagaggggagaaacagcagcattttcagattgatgtgaaaggtcccctagagaaaagaatccaaagggccaagtggggtgggacctagcacagaagcagaaaggtcagccttgggagcagagacagctcacccatagggatgggggtggctcaggttcccctctgcggacacctggtcttatgaccccactggctgcagaactcccttggcccttgccggttgcacagccatacgggacagcctggtaactgaaattcgctgctcccaccctgctccacagctgcagggaggtgggaatcctggtgctggcagccggtagaagtcatcttatgattgcttctatgttctcaataaataggaagcaagatcatcggctaagagagaaaagaaggaaggaggtgttgaagtttggggagggaggaacgaacatgacaacagggagaatgagaagacgaatgcagtggggagaatcttctgagcagcgccttccccagggcagctggaagcatttgagcaccacggaaggtcagcgactctgaactgagagtgagaagtccgcatgattttgtgtttttatcctgccacagtcagctatccagccatgtgggcttagcagagaggaggcagtgagctgaaggtgtacagaaagcagtaactgagactaaccgaccacaaatgagacactgctggagacaggaagataaatatgagtgatcctgttggggaggagagtgagaggaatgccccaggaccaaaaagcttaggtcagcaccagagagagctcccagagaaggcatgcaaaataaggggtgatcctgcttgcaaagaaaccagaaaagttgttggaagaggtcaagctcaaatgagctaccaaaagctacatttgggtcctatcacagtactaattttcggttttcggactacagaataccaagatatatttcaaatggattattccctgttcatcattctttccttggtatatactctattggaagaagaagaagaaatgaataaataacatacaaaggtgatccccaaacctcaaatctggccattagttataaccaactctgcccctaaaactttggtcaatgcccttaaagcataaaatgcacagatctgaatttccatcactttccccagggcagctggatgtcaccaggtcaccacacaggctagagatacatataggtgaattaggttaaatcacaaaaacagaaagataaaactattatttaactcaagcagagagctaagaggttattcatcagatgatggtaatacaaatatcccattcaaagtcaatgaaaaccaggataaaatgaaaaagaaacaaccagcactaagtagaactttcagaacaggaataatgcaggaattatcctctaaagtgaatcatccagattgactatggtatacatcattcatttaagaaacatgtatggagtacccacggtgtctcaaacacagtaccatggtagaaagagaagaggaaggacagatattgctatagtttgaatctgtcctccaaatttcatgtgttggaaacataatcccccaattatatgttgatggtacttggaggtggggcctttgggaagaaattgagattgaatggggtcatcagggtagggcacctatggtgggattggtggctttataagaagagaaagaaagacctaagctggcacactcctgccctctcaccatgtgattcccttcccatgttataatgcagcaagaaggccctcactagatgctggcaccacactcttggattttccagtctccagaaccaagagctaaataaacgtctattctttctaaattgcccaatctcaggtattctgttatagcaacagaaaacggactaagagagatgcatacacataactacaagacaaaaattcactcaaactattcaaacatacacttctctttggcaaagtaagtcaacctgacttgccaaatttaatcatctattcttatgtgcatgcaagttgagagccatattctcaagaaattacatcatcattgttatgtctactaattactaaagtaacaatctaaattatttgtttttgaaagcaatacttagacacgtacaaatctgcaaaataaaactgataaaagcaaggcatgcaggtttttttcttatacttattttacataatctttcagggcttactcagaaccaagtgaattactcagaacaaagagaatctaaaaggtatcaaatgaaaccagggccctcttatgaaacataactatataccacccataattctcttaaatatttatattcactatagtcaaatacattttaagtaccataggaagcatttagcctcccccaaaactttctccccgctccaccattaaccctggacaacataaaaattctgaataaaattctggttgtaagaaataccaaaattactatctgtttgatataaatctgcctggcatgtcttctcaaatgcactcaaattatgattatgacttgagagttgcatatacagctgctaataatacatgtagggaaaaggaattaattcatgactcttgcctaaactctcctaatgaccatgcaatgtaaaaatgttactgaagaaaaaaggtttggatcatagacatcaagacaagtgggctgacatataagtagcactacccactctgcaatacgcaaatgcacctatttctttgaactcaactatcagaggatagctaaaacgtcacttctatagggaggatgtctctgacccacagccgttcacaaactttcgtaaacccttagttactttatagcacttatcacgactatacataatttgtataagtgcttattcaatgccacactgtcttattagaatataagttccataaagataatatacatatgttcctgttttgctcccaacggtatccatggaacctaggacaaaagtgcatgcttaataagcatttactgtataaatgcacattaaaaccttaccaaggaaaactctccaaataacagatagataggtaatcaagaggtaaaactcaaaaaagacaatgagagagtatggtcttgagatggctacgtaagcatcaaaaataatgcacagtctttgaaatcattacagctagttctattgacaacaaacaaccactatcagattccacttcaagggggtttataaaattctaattaatgttatttttctaacatttaatcttcaagaatttagtatttctcttcttctaggatttcaggttaattaaatatgatttgggtggaaccaacagctgaatgctttatagtcacataaatgtggcccttttaaatcagccacagcaccagtcattctcaagaaaggtgaatatattctttgtcttttattgggtcatgttgcacaggacatgaaaatccaaaggaatcttaaaaaaaaaaatagaactaataagtgagtttagcaaggttgtgggatacaaggtcaatatacaaaaattggctgggcacagtggctcacgtctgtaatcccagccctttgggaggccaaagtgggtggatcacttgaggtcaggagttcaagaccagcctggccaacatggtgaaaccccacttctacaaaaatacaaaattagccgggtgtggtggcacacacctataatctcaggtacttgggaggctgagacacgagaatcacttgaacctgggaggcagaggttgcagtgacctaagattgtaccattgcactccaggctgggcaacagagtgagactccatctcaaaaaaaaaaaaaaacaaaacaaaaattgggtgcatttccatatactaacaataaatatttggagcctgaacttctttaaaatatcattttaatggcatcaatagatctgaaatatttagggacatatttaacaaaatatgtgccagacctgtttactgaaaactacaaaacactcctgaattaaaaattaaagatgtctgagcatcataactcatactcgtaatcccagcactttggaaggctgagtatggaggatcacttgagcccaggaatttgacaccagcttgggcaacatggaaagacctcatgtctaaaaaaaagagtttttctttaattagctgggtgtggtggcatgcacctgtagtcccagctagtcaggaggctgaggtgagaggatcacttgagcccaggagctaggctgcaacaagccatgatggcaccactgcactccagtctaagcgacagagcgagaccccatctcaaaaacacaaaaagaaaattaaagaggctgtaaataactgaaaagatacaccatgttcatggatcagaagactaacactgttaagatgtcaattcttcaaattaatctatgggttcaatgtaatcccagtcaaaatcccagaaggctttttttttttttttttgtagaaattaacaagctgaaaatagaaactattttaaatggtcaaaacaattttgggaaggaacaaaaagttggaaaacctacattatctgctttcaagacttactataaagttgcagtatatcaagacggtgtggtattggcacacagagataggtatagattactggcacagaatagggtacagaaatagggccaaacatataagtgtgattgattttttttaatttttttgagacagcgtcttgcgctaccacccagtggggagtgcagtggtgtgattacagctcactgcagcctcaaattcctgagctcaagccaacctcccaccttggcctgtttgattgatttttgacaacagtgcccaagataactgacttgaaaaatgataatctttgcaatacatggtgctgaaacaaacattcatatgcaagaatatgaaaccttgatctctatctcacatgtatataaaaattaacttgaaataaatcatagacctaaatgtaaaactacaaaccttctaaaataaaatacaggagaaaacctttctgactttgggtaggtaaagtttttttcagatggaacaaaataagcatgaaccataaaaggaaaaaagtgataagctggactttataaaaattaagaatattaacaactgctgttcttgaagagataatgctggccagacatggtagcccacacctgtaatcccagaactttgggaggctgaggtgggtggatcacctgaggtcagcagtttgagaccagcctggccaacatggtgaaaccccatctctactaaaaatacaaaaattagccaggcatggtggcatgaacctgtaatcccagctacttaggaggctgaggcagcagaattgcttcaacccaggaggcggaggttgcagtaagttgagatcatgcgcactccagcctgggcgacagagcgagactccatctcaaaaaaaaagagagagaaagggaaagagagataatgctaagaacagtgaaaagacaaacaacaaactgggagaaattattctcaatacttatatcagacaaaggacttgtatccggaatataaaaaagaagtcttaaaattgtaagaaaacaaacaattcaacttaaagcctgagcaaaagagctgaatagacactgcccaaaagaaaatatcggatcgccaataagcacatgaagaaatgcttggcaccatttggcaacaggaaaatgcaaattaaaaccacaattagataccactatacatccacctgaatggttaaaattaaaaaactattttaagcccaggaatttgggcctgcaatgagctgtgagcacaccactgcattctagcctgaacaacagagcaagaccctgtctccaaaaaaaaagaaaaagaaaaaaaaaaacattctggccggccacagtggctcatatctgtaatcccagcattctgggaggctgaggcaagaggattgcttgagcccaggaatctgagaccagcctaagcaacacagtgacacccagtctctacaaaaaataaaaaaacaaaactagtcaagagtggtcgtacacacctatatcccagctattcaggaggttgaggtggcaggatcacttgagcccaggaattcaaggctgcagtgagccatgactgtgccactgcactgacagcctgggcaacagagcaagatcctgtctcttaaaaaaaaaaaaaaagaatctgacactttacaatggttggcaaagatgtggagtaactagaactctcatgccctactggtgggaatgtaaaatggtacaatggttttgaaaaacagttggcagtttcttgtaaagttaaacacacacttctcatatgaccgagaaattctactcctaggtatttacccaaaagaaatgaaaacacatgtccacacaaagacctgtatgtggatgttcatagcagctttactcaaaacagccataaatgacagcatatccatacaatggaatactactcaggaataaaaagtaatgggctacccacacatgcaataaggacaagtctcaaaaacataacactgatcaaaaaaaagaagggtatccagtacactatatgattccacttagatgacgtttcagaaaaggccaatctaatcatctagtgatagacagtatatcagtgatctcctgaggctccaggcttaggggtggatgagcgcatgagaactgattaagaaaagtaacaaaggcagtggctcacgcctgtaatcctagcactttgggaggctgaggcgggcggatcacaaggtcaggagatcgagaccatcctggctaacacggtgaaactccacctctaccaaaaaaagacaaaaaattagccgggcgtggtggcaggtgcctgtagtcccagctactgagggagactgaggcagcagaatggcatgaacctcggaagcggagtttgcagtgagcctagatcgcgccactgcactccagcctgggcaacagagcgagactccatctcaaaaaaaagaaaggtaacaaaggaatctttcggaatactggaaatgttctgtgtcttgattgtaaaggtagttacatgtaaaacatttatcaaactgtacactaaaatgggtgcattttcttgaatataaatcataactaaataaagttgattttttaaaaaagcaaacagcaacaaacctatgcaacattaaacaatactaaggcccaggagactccatattcactaacgtccaaataacaccaatatctccacttctaaagagagtgaatgcttgaatctgtatctagtgcaaattcacagaagtgactactctatggtgggtaaacatattgcagcatctgctacagacagagtgcaattaagatcagaaacccatgttatactgtgtctcgccactttatttattgattggaggcagcgtcttgctttgttgcccaggctggagtgcaatgacgtgatcatagatcactgtaaccttgaactcctgggctcaagcaatcctcccacctcagactcccaaagtgctgggtttacaggtgtgggccacatcactttagagcggttccacccctgttacttgtcttatctgctaaatttacccagctaacaagattcagtgttgaattcaaaatatttcttatgatctccatgtatgttttggagcttcttttcccaagaaacaccaaataattgatcttaacccataaaggttttctatctcagagacacatttgcctcattgcaaataataagattagttgtgcttcagtcataacatcgtaagttgctaggcagccagaagtgagttaatcagaaaatgaatcatcaaagacatggtacgcaatctccttttatgggtgtctcattcttaaaacactttcaaggaagcagaagcaaatatttgtctactcgtatggaatttatatgacgcaatccaattcttactattggtatttgacacgcaaaatactcacacgcaatttcatgttcgcttggtgtcttcactcacaggacaaagccagatggcacagcaaatctttataatcaaaagatggcactcctgggccgggcgcagtggctaatgcctgtaatcccggcactttgggaggctgaggtgggtggatcacctgaggtcaggagtttgagaccagcctggccaacatggtgaaaccccatctctactaaaaaatacaaaaattagccaggcgtggtgatggacacctgtagtcccagctacgtgggaggctgaggcaagagaatcgcttgaactccggaggtggagggtgcagtgagcagagatcgcgccactgcactccagcatgggggacagggcaagactctgtatggaaaaaaaaaaaaatggcgctcctgaaataggactatttttttttcctgacttcatctaaggcagggattgatcatctgacaacccttggggtgggcgtttattcagcgtgccagtaccaagcaaagcaaggctccatgcaggtttgcgaaatgcctgtctgggtgtctgcgtgtgtgcacctcctcaccagcctggtcccttatgcggcagcttctgtctagccacactggtcccctgtggtctaaccaacccctgcctgacctgtccaggttccacgctgcacggcactgcaccctggcatgagttcccaaaactgctgcttcctgcttcccaccctgtgttctgccactagccccaagcaccggcacacaaaagcgaacggctctgaagggcttccaccttccagtggcttactttgctgaaaccagtccattttcacaaacatccaggctgaccgtcacttagggacaccctcgggccaaaatgaatctggagatgtggtttatttagcccacattttgaaccagctgcaacacttaaaaattgagatatttcatatcaaatttcctgcctcttttgaagcagcagcaactctttccacacagcagtaatgggctacagccaagtagccaccctcatcccgtggagaacgcgctccagctggccctgtgtgtccccagcagccagctgcactctgcgctgcctctcctgccccctcccctggcctctgggttagagaccactcgtctcagccccagcagcaagcctggaacccatccagccatccttctctggggccctgatgatgcgtccttccagttaggtccattttaactccccagactgagtctagtgacactgactctcagaacagaaggggactattttggtagttcctcaaaaagttaaacaagaggccaggcacagtggctcatgcccgtaatctcagcactttgggaggctgaggcgggcggatcacaaggtaaggagatcgagaccatcctggctaacacggtgaaaccccgtatctactaaaaatacaaaaaaaaaaattaaccgggtgttgtggcaggtgcctgtagtcccagctacttgggaggctgaggcaggagaatggtgtggactcgggaggcggagcttgcagtgagccgagatcgcgccactgcactccagcctgggcgatagagcgagactccgtctcaaaaaaaaaaaaaaaaaaaaaaaacattaaacagagagggccgggcgcggtggctctcacctgtactcccaacactttgggaggggccgaggtgggtggatcacctgaggtcagaagtttgagaccagcctgaccaacatggtgaaaccctgtctctaccaaaaatacaaaaattagccaggcgtggtggtgagcacctgtaatctcagctacttgggaggcggagacagaagaatcgcttgaacccaggaggcggaggctatagtgagccaagatcatgccattgcactccagcctgggcaacaagagcaaaactccgtctcaaaaaaaaaaaaaaaaaattaaacagagaattaatacatgatccagcaattccactcccaggtataaacccaaaagaactgacagcagggacccagatatgtgtgtgccaatgatcatggcagcattattcacaacagccaaggctggaaataacccaggtgtccctcaatagacaaatggataaacaaaatgtggcatatacaattaaggggatattattcagccaaaaaaaaaaaacaaggtatgaagttctgatacatgttataacatggatggaccttgaaaacattacactaagttaaataaaagccagacacaaaaggacaaatattgtatgatgtcacttgtatgaaatatccagaataggaaaattcataaaaatggaaagtagaacagaggttaccaggagccacagggagaggggaaggggaattatttattcactgttacagagtttctatttaggacgcttaaaaaaaaagttttggaaatatagagtgaaaatggttgtaaaatagtgtgggtgtaatttacaccactgaatcggagacttaaaggtggttctaacagtaaacttattttatatatattttatcacattaaagagagaaagggagagagagaaggagtcaggatctcagttcctttactctcacaaagctccctgtcctctatgcaattagccaccccccccaacccctgccatcaattagccctgcagaccagggggagcaaagggacagcttgcacaggcaaccgaggggtctcgctgtgctctcctctgggtccctccttgctgtccctgagtatcactaagagaggccactcaaaggacctctcagaacaaaagtcatttccaaggtgactttccacccacttctccagctaaatgattttaagttctgcttaggcacccacttagctacaacaagagtatgaaagccaccactttctgcacatccatccactgccaagcactgctgggtgctgtggacccaagatccccagtcctttccaggcgacacctctgcatcattagcaccgtccacagcagaagaaatgggaccccagacagcattaacgactgcccaaaccacacaggcagtataccgcagagctggaatttgaacccatgaaaccaaatctgtctggctcccaaatccttgctctaattcctatcccacggtcctcacaaagagacctacctaacccaaaatgcagcaaattaggaaatgcctattttctataatcaaaatgctgatggtatcacaaagatataaactcaatatgcaactatgaataaacataaaatggatgtgtatggctcagagctgggggtggggtaggagggagaagggcagtgggcaggggtgggagcagagtgtttgataagaaaaacttcaatttggcggggtgtggtggctcacgctgtaatcccagcaatttgggaggcccaggcaggcagatcacctgaggccaggagtttgagaccagcctggccaacatcgtgaaactccgtctctactaaaaatacaaaaattagcagggcatggtggtgggtgcctgtagtcccagctacttgggaagctgaggcagaagattcacttaaacccaggaagtgaaggttgcagtgagccgagatggtgggccactgcaacactccagcctgggcaacaaagactccatcttaaaaaaaaagaaacttgaatgtgaaccttgaagctaccacccactagctgtgcctacttagacaaggctgtgagaggacactttcacaaagaaataaaggttttatcatgtaagtgagctactgctgacctcacccctatctggtttctgcaggaaagaggtgtcatattcacaagggttctgtaatggaaggactgtgggcagaggtaagagaacccaagaacaaggaaggggtgccaaagcacttggaaccagcaagggactgaaggagcaagagggggagctgctaatgggaaataatattaataccttgacctctctcaaatcctgcccatcaatctcctgccagtgcagccagtgatgagaaacatccagagttaggagcacgggagcccagggatgggccgacaggtgaacggtccaggggccagcacatctggctgggtgggcttgctggttatgcgtcccctctcacatccagccctgcacaactctgacttagtcccagcaacaacatgaacttctacacagcctgatctagcgatgagcccaaatcgattcagcaactccaaaggacttaggattgatgtcattggctatctaacccccaggaatatgagttcctccagggctgaacttgccacagggctttctagatccccaatgcctgggacacagtaggcactcaataaatgtctgttaagcggtcttccttttataatgtaaagtgatagctcaggctcagacgctgaaaggcccaggatttactgcatttttttgttacctgccaactagcgaagaccacaaaaggcttgagtagaacagtaaaagcagggagtgaataagtcatttctaataaggctggttttataggcatcacacctccaccaagccaaacaggctcactgtagaagcggaatctattctgcaagtgcagagaccaaagagaaagccagggttggctctaacggcgagggcggctctatggggcagctcagccactgcctccacaatgagagacgcgaacttccactcactggtctcgtgggtgcgggaccgacacccacaggagtctctggggccttcattaagcctgcccaaggaaaacgcccgccatttgtctcagcccaacacaaacaggcttctgacagagcaggcagcgtgggggtggagggcatggaaaacgctggggctgagccctgggggcccataggcagccctgcctggtgcacccagaggtgcccatcctagccgacatgcacaccaacgtgaccattcacacgttcccttccttctgatgctgacatgtccccccgccccaccatcctcagctatttgcctgttacctgccagccccacctgggcttcttgtgggggcaggggactctggcatgggatcctgccctcagctctgccaccatcagctgtgaggccgcaagaggcactccctgggctgaccgcagcttcttcatttttctaacgagaaaacgagaacatctctctctggtaaaacggagcttcaagattcaatgtttagcctccactgtttaattctcagttgaaattttaacatcatgttatgttaaaatatatgttacctggaaagagagaagcggccccatatcaagaggccaagagctttctgctccaggaccttatcttagcaaaggttcactggtccaactggctgtcaccatgacacttgggaacattcagagaatcccagggaataacacctggccaggcctggcaggagagaggggagcggcgtccaacactgccctacgtgtgcaaggagagggcgggtctaaccccacacactcaaggccacggtctaagaagctccggctcagaaggtgcattcgttcataggagaaaagcagagtttctactgaaaagtgtttttaataacacacaaaacaattccaacttttccctgaaactccatctggccagtttcctccggcatgcccacagctgattcttctagaaactgtttaacatgattgttaagaataacctaacaacctgttaggttatttatcctgctttcccagaatacagagctggactgtgcgggcagccgctcgggcagagagggctgtgcactgccggcctgtccctggggtctctgggggctctcggtgcacaggagccaaggaagcagctcccaatccattagggggaaaaaccaaaacactttgcaagtgtccaaataaaatgtgcttactaaatgtctactataagcaaaatactgggaaagggatacaaagattaacaacatatggtccttgctttcaaatcagcttgcatgacagtttaatggggaaaacagatatttatacaaataatacaacaatagcacttatacaaaccacctaaaaaaaatcttatggaagtgactagatctaaggttccaagtcacgatacttgggttaggaaattgcaagaaaaaattcaaatcctatacccgtgacatgatcatcagtggaattttcctagatcagaggggtagaatccctttgttgagtataaaagatcaactatctgtcctcatagcatccggctgtaagatttttttatgttctgtaatttaagacttttcttttaagagatagggtcttgcttgctcaacatgttcctcaggctggagtgcagtggcgcgatcacaaactcaactcccgggctcaagagaacctctcatctcagcctcccaagtagctgggattataggtgcacaccatcatgcctagctaatttttttttttttttttttttttttttatcttttgtagaggtggagtctcgctgtgttgcccaacctggtcttcaacacctggactcaagcgatcctcccacctcagcctcccgaagtgctgagattacgggcatgagccgctgcacctgaccaatttaaaacttaaaatcttactactctaagaactttatacacatgtgctttataaatgctggttcatatgaagatggaatatccccctcaaccctgtagggtgatacacagccatacggaaccatcacaaactagtaggctactgcttttacttcaaataaaacaaatactccccgggccaagtagaaactagagccgttctcctggaagcaaagatgtcaaagcctctcactcttagaaacaacccacaatagggtctgggctttgtggtttacttaaaggaagtaacatttgcatcttcaaaacaaaaacaaaaggccctctttatcaggaaaatgtggcaaaaggttcaccagtggtaaatctgggtgaaggctccacagggcttatagggttggtgtatgactcttttaccttttcttcagttccaattttttttaacaaaaaattgggggagaaataaaggattttccccagaagcttgaaaggccctgccagctcctacatgatctgtagatttttgttctgctgttaatcgtggaatcatcaaagaaacagccttcataaagaatcaaaaagcaaaacagcaatgaagaacaccttttagcttttgatctgaacaagccttcatgctgcctttgccggggaagggctgctgaaccattctgaggcaagaacacctccctgaaaaaccacagatttccatcctcatggagccatccctccacagacccagatcttgtacagcccaaatgcagggcgcactttccccgagtacaaaccccagtgcgtttcatgaagctgttcagtatatgcagaatcagtgcattaataacagcttattggcaccgaatgaaaaacacacaagtcttaatcttaggtcttgaattttgtccagttcctacgtcatacctggctgtaagggctacagccgtaagcatgcttggtgactggaggctgtgtagtgagacctgagttttgaaaccaggattggtagcttaacaaaatttactggttgtagaaaaagtaaacttgcctccggggaggtgagctcagcctcaccattctgacagcagcctctggtggccagtttagtaaaaagtgttggctctcatgctgaaagctcggaccttcccttcttaatgaaggtcgctgcaagcagacaggccattctaggtaacagctggaggtgactggggaagctgcagaaatccaaacgaaggtgtgactttggaccacgtaaatcaccaagtcattggatgatctgtctcttgcattaaaaaaaaaaaaaaatgaagtactctctttcaaaagtagaaaaataaataaagagaactgttttaaaagggctcaagtcacaaggcagataatacatactcagtttgaaagtaatctcattccttacttgcatagaaagcctttaaatattcaaggagcacagattcctgaacaaaataaagcccagcctgtctgctttcttacatagcaccccatggtacactaactcctatgtactgagtgccggaaattcttcctgcaaagtaaggaattgctccatatggcagaaacttctagaaaatgctgcaaccattcattcagagaacaaaattaaatattcaggattgtaggtgaggcctgatttctagtgccacagattcacaccatttcactggatataaatagaggaatgatcagaggctgacagttggcttcaaaggcagagagggtaagaaggagacgccatcagcttcaagccaacttcttcgtaaggtgcactctgtcctcagctgtcagagaacaatctggaaacaatctgctgagcagctgctctcatcaacaaactgtttattgtaagaaagtggctgggtcaaaggctaaacatcaacccgagctgaaagcatacagaacaaaaatcaataccgtccctgctaaagagacccaggacttagcatgcagaaaagagagggtgaggaactcatgtttagttctgaaagagtaagagttggaacaaaacccccatatttcaacattcagggttcttctgcatattattccaattggcgacttgctgctatttgcagaatggccttgtaatgggggctaaaatgtggcattcaacaaggacacagaaatcaactttgccctaaaagttacaggggttaacatcagttgtttctctctcacatttgttttgcaacaggaccaacgtgctcatcatacacatgtgcttattatacacaatgcacagatactacagtccatctttaaatatgtctaattggaaactggaaggctgactggacatgagattatatgaagagattgtttcattttaggtatgacggtggaattgtgattatgtttttaaacagagctcgcatctttcagagacacatactaaaatatttgcagatgagaaaactgaaacagtatctgggaattccttccaaataatactggcagagaagtgggtagaaagaagtgaaataagattggccataaatggataactgtgaaagagagtgatgagtacagaagaattcactcattatttatatttacttttgcatatttgaaattttctatgaaatgtttgcttttacttgtgtgtaaagttcaacagttactttgaaagaaaaaaagttttcttaaatataagagaagtattaacctaccgaggcaaattaattaagtcatatgccatggtattgctaggtatccaatttaacgtttttgagcaatgtccgagatatggttgttatgtcctgagttgaacgatggagaagtagaaagagatgctcaaagtgttcccactgcatacgtgctccagcaagccagaatgtgacacagaaacagataagacggtttcccatggtttaattgcagtatggggcaagaggacatacgtgagatgctaggaaaacccaactgtcataaataatggggaccaaattgttaaaagacaagttagcacacaaattttgaaaacacaatttctttgtaaatctgaggctgctatatagtgtattgataattcttaaattaacagtaaaattagagaattagcctgaaataaataaaaataaagcagatagcaaaacattatttcattgtgctgaaattaactgtgaagatgtatctatgattttaacttgttccaatataaagatgaaaatggtaataatcacaaattcttagaaaagaatgcattcaaaggaactgcttaaaaagttaaaaaaaattttttttagtctacttgctttgccaagaccagcataaatactgcagagagtcctgcaaaggatgagaaaggtcatcttgtctaccctccctcccaacagaacagagaagggtttggtcatgagaatttggtgacgcaccaggcacggtagctcatacctgtgaggccaagtactttgggaagctgaggcggaagaattgtctgagcccagaaatttgagaccagtttgggcaaaaagtaagactccatctctacaaaacacaaaagtaaaatagccaggtatggcgatatgtgcctgtagtccccgctgcttgggaggctgaggtgggagattacctgagctcaggagttcaaggctgcagtgagccatgatcatgccactgcactccaacctgagtgacagaacgagaccctgtctcaagaaaaaagaaaaaaaaaaaaagacacccaccctagtgggaaggtggggcagagatgggaatggttaatggatgcaaaaaataaaaataaataaaaagaacgaataagacctagtatttgatagcacaacagggtgactacagttaataataatttaactgtacatgctcaaataactaaaataatataatttgtttgtaatataaaggataaatgcttgagaagataggtaccccattttatatgatgtgattattatgcacagcacgcctgtatcaaagcatctcatgcatcccataaatgtatacacctactatgtacctattaaattaaaattaaaaaaaatttttaaagccgtctaccaagaaaaactcatttggccaatctgagacactacacctaaccccaacatcacagaaggaaaaaatacacagagcaaaaccttcaaaattatagacctttgacctttaaagcattttattaactaaaaagctacagaaaaacttaaatcctgaaatgcatcaaggttgcctatgaaaagtaatctagacaatcctaggcagagtctggctatccccccacccccaaattaaccatcattttttaatttatgaaactactgtttgatgtttcttttaaaaggtgtattttcttatttacggaaattaaaaacaggaagagggatcagtggtgccatcattcaatcactcttcagtgaactactctacgtaggattcatttttgttcagagaagagagcaacttaccaaatgtttacctagggcatacaaaagcaaactcagtaagttttctgagaagaatattcactttcagccgggcacagtggctcacgcctgtaatcccagcactttggggagccgaggcaggcggatcacaaggtcaggagtccaagaccagcctgaccaacatggtgaaaccccgtctctactaaaaatacaaaaactagctgggcgtggtggtgtgtgcctataattccagctactcaggaggctgaggcaggagaatcgcttgaacccgggaggtggaggttgcagtgagccgagatcgtgccactgcactccagcctgggtaagagtgagactctgtctcaaagaaaaagaaaaaagaatattcactttcaactttaattttaattttctaaacttttccttaatgcatgtaggaggcaggttgaattaaactaaaagtttttatagaccagtggctcaggaaagcctcatggtgggtgaaactgacaatggtcctatgatacgcatgttcaggacccagcgatctagctgactgctgatgggcaacgctgttctcctttcgctcacacctagaatctgaatctcagcctcggaggcgcagcagcacagtgccaaagcagccctcctcttcacccagagcccctgtcccctgcactcagacacacatgccagagacccaccagagacacaaacacctacacaacaaaattgtgctgtgaacctcgtgtcaagggaaagtgcatttcccttttaccagaaatctccagacccgctactctaagtcttctctcactctctgggagaaatgaccactccacaaaggcacgttctatctcagcaatcttaagtttttctgtagttctggttaaaacagacatatgcacttaaataaataaatatataaatgtatatgcatatatattatcataatatgtattcatatggttgaaattttaaaaactcaaatacccttaaaagtatcgattaaaagactctgtttttttaaattaaagccacgttcctcaattcacgaaataaaatttgagttatagaatttttttgtaaaggacagtagctccaatgatcaatgagaattgaaatcatagtctttaactccaatatctcctttttagaaaaaaatatttattttaattgacaagtaaaaagtatgtacatttctggtataccacatgatgctttgatatatgtgtatgttacggaacagaaactccaatattccttccactgattctattattaaaccaaagcctaaaaacattttaagaaagaaaagacccacgacaccagcagagggataatgtagaattgtactggaaacatggtagtacctggatagctgtgtggccaaactcggcatgctgtacctggggagacgcagccatacacaggcagctacaacaaaacaaacaaattaggaagatctctcagaaaaaaggagtcttcccttcttatctccaggagaaagtgcctgagggaccgacagacggactaaccttggctgagtcttcctgctttcacgaggaagcccgcaaaatcctcctggtgctgcccagcatcggccgagctccagcacaggagcgctctccttgcaccccaagttgtttctccccttaccactcaggtgggggaaatgggggattaaacaccactcaggtccacaaactgcctgtcagttttgaaacccccgaaacactataaacatttttccaagacagtcagtgcaaatctccaggcggcattctcaaatcattagcatgcatggaaacaaaatgtgctccccagctataattcacatcccaagaactgaaggagaacatttatcaaatgggattcgggtctcagaccccgacattcctgagctgacaccaccagctccgcggcccgggagcgccagactcaacggttccgtcatcgccgggcgccccaccgccgcacccaccgccagctctggtccttggccctgcacctgaccacaggagccctttgatcatgctctctaacccggcaccagtatgggcttattcctgggatgtgttttttgaactgggagacaaaaatccgcgtgtgagaatgttctaagcccttctggagacagcctccaccgacttccctgggaggtgaggccagaatccatacccgctcacacatggcagctattaggaagcccgggtaggagacaaaaagcatgtggtcttggaggattttttttattccaaaagaggccgtttcccatccacaagtttgtgactgcataaacggtggatataaatagacggaggaaagaaaaccacgcttcttagacgggatgctatcccaagaaggaaagtgctgagcgggaatgttccctcggcctcagagaccttatcaccccttcaccaggccagacagcaaagaccgcaacgcacagaagccagaatcatcacaaaactaattaaacgtggaaaacaacaaaagcgtttgtgcagatttcccacaagcacacatctctgccccgggtatttactctgcaggcgctgctttgaggcacacttgtggaaacaagattcaagtaaaaagacaggacacacagtagctgaaaagccttcttcccacaaaaataaaacattctaaagggagcacaggaaaaccccccaagtatgatttcttttgcaattcaacatcaaaacccatcatgtcaccttttgccatgggtattatgtttgataacaggaagtcagtcaaaatgaacaaaaaatttccagcgtaggtgaagggcgaaggaagaaagaaacgagagaaagaggtatatgaaagacccttaaaagcattcatagctataaaagcttttaaatgtttgctttaatctgctagctgcctttagccggtgccgtattgtaaaacagccgcacaagaccacagcagccacatgtcaaaagctattcaaggtgcacctggaattctgacttcctctctaatttggatctctaaaaattatttttaagctgtattttaaagttatgcccaaagcttcgccctatctatacattcgagactcagaactaggattaaaaataggagaaggggaggactccacatcaagtactatgttaaaaaatggcaggcaaagattttttttagtggagaattctaattaactcattagaaaaatacattaagccaggtgcagtggctcatgcctgtaatcccagcactttgcggggctgaggcaggtggatgacctgaggtcaggagtttgagaccagcctgactaacatggtgaaaccctgtctctactaaaaatacaaaaattagccaggcatggtgatgggcacctgtaaccccagctacttgggaggctgaggcaggagaatcgcttgaacccaggaagcagaggctgcagtgagcagagattgcaccactgcactccagcctaggcgacaagagcaagactccatctcaaaaagaaaaacaacagaaacgaaaaatacataagcctcttcactgtcctgtacgccagcttcctctcccgggggcaaggactccttccccgccctgccctacttatcagggtcactatgagacccaaatgagatggcgacacaggtaaaaaagcttggttaactagaacgcatgccacaaagacgaggaattatccctcgttttccagaaacttctgcagcaagggcttgtacttagtaggcacacagatgtttgctacatgaaggggccagttagagaaggaggaacaactgtgtggtatgtatgactgagtctaagtttcttcataaagctatcaacgtctgaaaagcagctccatctcagtatgttcatgtatatcaaatcatcatgctgcataccttaaatatatacaatttaaaaaaaagtaacataaaggacttcccggagtagaagggcctgtacccgttttttgatatgtttacaagtatctaaactatccttaccaacaaaacctgctttttatggggggaaaaagtttcacagtaaaaatttggggttaaatcaaaatgaaatgtcataactagtttctgtttttaagtacgtattacccattccataactccccactaccaaaatcacacaaacacacctcatggtgattttgcccgatcatttcagtaacaaacccagttgtcacttcttgtgacagctacatcttgatcccagctggacacaggacccctgctaagagtccagccggcttgtgtttctcaggtcacctacacactgttagccaccgttggccacgatgaacacccacaaggttcccaagctttttcattttggaaaaattcttgtgctccccagatcctaagcagatgtcccaggctacgggagcaatgcacaagctctctagttccccaaggtaaaggtgccgaccttcctgggggcagcacgtccagttccccaaggtaaaggtgccgaccttcctaggggtggcacatcccaccttcttctgcttcctctggactcactggggggaccaaaaggggtccactggcaggcaactctgcaggggtggagggtggggggctggctctgccccacacacagattcaggtcccagccggtcctaacccgccagctgcccctcccagtgagaccctgcagagcgtggcagcctgtgctttctttctgccattgctctggcagagataaaaaggaaaatggaacccagagaaacagaaacaaggcagctagcttctcaactgggaaagaattacattttctctagaacatcagattcgatagaaaataaaatctattaaaatgtttctataaaatataaaagaattatgttttttctggtgttctgtaagggaaaggattatgtttcttctataaaatcagtgtttctcaaaaacattcatgtcccagcacagtaaagatgtattgctgctgactgcctgtcacccactggtggcgggaagatgtggtggccaccaggtgatcgcaccccggacaccccacagtgagccatgtggtgtatcagtctctcacccaccaacatctgcagagaggaagccatggagaggtccccatatatatggtcttggagaaacagttcaaagggctctgccaagaaactggaacatccaagcaggggtagggcacccaggggtaccttccacccacagaagcaaagggacagcttcagctcggaggcccccacacaccaactcagagctcacagttaaccctggaagtcacagctgccacaggccatgaacaagagtcacgtgttttactatcagagcgaaccctttctaaataatatgtcaaatattaatattaaccaaagtatcaacacctatgagattccctgccttttaacattcaagtgtgaccatgtgtgagatgccttcaaagtccaatgacacgcagtcatttgtttttagtttttaataactaatttggctcattataaaataactcataacaaataaccaatttggctcattataaaataactaataactaatttggcttattatatatataatcattatagaaaatttggaaaatacagagaaagttttaaaagattattaaaatcacccttaagcactccaccacaaataagtcccatatataccagatttccttccagtcttgtttcctttttttttttttttttttgagacagggtctcactctgttgcccaggctggagtgcagtggcacaatcatagctcactacagcctcaacctccctggctcaggcaatcctcctgcctcagcctcccgagtagctaggactacaggtatgcgccaccatgcctggctaatttttgtatcttctgtaaagaatacgaaattctgccaggttgcccaggctggtctcgaattcctgggcttgagcgatccacctgcctcagcctcccaaggcattgggattacaggcttgagccactgcacctggcccagtcttctttctacggagataggtgtgtggtaaacgtgtgtttgtgtgtttgttttatggtttaactttttgtcattttgctgagacccaaatttcaatcctgctcctgggaggttcaattaaacgtgaaagccttggtcggaggaagcccagctcagccgcccacagcctgcatctcagccaagccctgcttcctcttggtatcgtgcacagtgacactgatggagccacacatgactgggttttatagtgggaatcacacgctaccatggtgtctgggtgtcgatgaaggtctccgagcacatccttcccaaatgccaagggctgaccgtcgctgaggcgagtgttttttctctttgggtcttgctactattctttccagttatatcacagtaacggagaagcacataaatcttctgcgctattcgtcataaagagcaagtgtcaaggcaccaaactgtgtaaacacagctggtacgcagtaaaactatttagataactagcatatttattttgttctttcatatcccatactataatagtacctaggacacagtaaacgttgaatgaaagatgaatattattaactgggacattgaaataatttctgcagacccaaaagaaagtgccaccaatataatggaaaactataaaattatactatgtgaaactgatatagacagaaaaaaattaaatctctgaagaacaactttatagttctagggtcctgtatgcgaggcagcctagctcagcagcgacaccctgtggtgagagatctttgactcccagcaacagagtgtcttgcagggcacaggaagcagaaagccagcccaggcatccaatccctaaggcaggcgatgagccaaatggacaggcaggatttagcagatgactgggtgccaagatcctctccatggaacttaattccgtgaggatgactgagatctgttaagtagggatgccagaaagaaaaccaaatacaaagcacaaacccaattccattcccagtctctgtggtccagatctataaatactgacccatagcacagtgactagatgcaggaggaattcagctgcctccggaaagaccacctcaggcagtgcatatccaccttcaaattcatttgcactataatcctttagagaacttgtattccaagaaaacatcatataaaaccttgacttctgccatttccttctacagcagattcaaggacacctaagcagagttaataaacattaagaggccgggagcgccatgcctgtaatcccaacactttggaaagccaaggcaggcagattgcttgaactcgggagttcaagaccagcctgggcaacatggcgaaaccctgtctctacaaaaagtattaaaaattagccaggcatggtgatgcacacctgtagtcccagctactcggggggctgaggtgggaggatcgcttgagcttgggaggtggaggctgcagtgagccatgattgcaccactacactccagcctgggcaacagagcaagaccctgcctcaaaaactaaaaataaacattaagaaatgaggatatgtacaacatacacgtactcattccattccttgggctcccaaagtaaagcagaattcagtcagaaataagcagctgagaggaaagtagtccacagcacagatatccaagaaaatcaacaaggccaagtggagggcccgcaatgggaagtgaacatttctgaaaataattattttccaaagttattatgtaataaggggcttagtagggagtgtccatgtatgtgtatacagagcaaatatttgctttaatcatgttcaagcatttcattcccaaagtttgtgaaaggggaaatcaatactccctcaattgatcaatgaacaggtgaaaaagtatcacctcccactgccccaggctgtttaaaaaactggaaggacaaaaatgtgaagcatctgttgtgtgcttgaatataagcagacacatgatacaaagccctgacatgggtatttcaggttatactcatcctaaatacaccagaaatgccaagagttccaaacttccactcacaagagaataacctggggcagggccactcttcctatccactactctgtccaagagtccggaggtcaagtccgaagaccagcatgatcagaactccgagaaagggcagggagctctgccaagggcaaggccaggccacctcactcccggacttccccagctgggagcctcagagcaggcactggctaaggtagccagccccagccctccatccccaggaaaaggcgacagagaaggtctaggggactggcagtgctctcagattttctatctgtcttctccaagtgagcccatcacacccagatagctcatagctctgctctcctccaaaaactaagggacacagtgtaacacaaaagaaagtgcctcctttttaaaaaatgttgggatgagaggtataatttgtttgtttcaagagaaagtaggtaagtttagtgtttaaagtcacctagactattgggtgtttgcagaaactacatggttatgtcattcaactcacaaatttgtctgttcagagaagacaacagaaatagacaaaataatttgtcacaatgactatgaaactgatagtatggccaagcagggggattagcaagaacctacacctggagaatctggcgacctgcccaaaaccaggtatcaatcacaggcagcaagtgcaggcatgggccaagagaattcccgaacacattcccagctccgtgggcattttcctgtcagacacgactcacagacgtgaaacccagagcgctgttgccacaagatggcagacattagcacaaatgtgattgttccaaagatttgctgaaagtggctcaagtcaaaacaaatgttttcaatcccaaatgaataaagttacagtctgaatatactcttgacacagggaccctcttccccctaacgtggaaagggccacacctgcagacttaacacctttctaaactctactagttggccctctcttatatataatcctcccccaacaaaatgaatatttgcacatcttgaagatgatttccaaacccgaagtcaaaacagaaatggaaaatcaaaaccaaccaaaataaaacaattaaagcaacgggtcgccactgtgaagagggccacgtcacagcgcgctctgcccagctgagcccacaactcacctccgcagctgacagcaagtaaagaggagttaaggcaggaacttgtttcatgtcacagctgaggccaagggttgtcagaatctctctaaggacttcgtatcttctaaaattgcttgacttgagcaagttaaaatcttctggagtttgcactatgttggagctgggaggtagttctaagtgcacctgaaggggaaagatagcactatgtaaactgagggcactcacaggcaatgagaaaaacagtttcttttttctttttctttttttttttaaatttagagacaggatctcattatgttgcccaggctggtcttgaactcctgggctcaaacgatcctcccacctcagcctcccaaagtgctgggattacatgtatgagccaccacatctggccaaaaaatttctttaccagttttcttctccaagtgagcacatcacacccagatagctcatagctttgctctcctctgaaaattaagggacacagtataacccacaagagaaaacttgaacatgaatttttctaattatcaatagcatataaactctgaagctgtatatctggaaagtcatggccaacaaaagaacgattccaaagagcctactcaaattttggttgtcaggctgagaggccacggtggaaatgaccctggacagtcatcatctctctccaggtactgatgttccacactcatcagtcatatgaccttccgcaagttacttaacttgattataggaacaaaatatctagggccgggagcggtggctcacgcctgtaatcccagcactttgggaagccaaggcgggcagatcacctgaggtcgggagttcaagaccagcctgaccaacatggagaaaccctgtctctactaaaaatacaaaattagccaggcgtggttgcatgagcctgtaatcccagctactcgggaagttgaggcaggagaatcgcttgaacccaggaggcggaagttgcggtgagctgagatagctccattgcactccaacctgggcaacaagagtgaaactccatcgcaaaaaaaaaaaaaaaaaaaaaaaaagacctagaaagacagttatgctgaaaacctaattgctagtgagttcagggaggcaaatgggtcatgctggaaacttccattttgcctattagccataactggaaaacaatacctaggaagagagcagcgttattcatcattttaagagcgtttgcaggaggctgggtataaaggctcacacctgtaatcccaacactttggaagaccaagatgggaggattgcttgagcctaggagtttcagaccagcctggacaacatagtgaaaccctgtctctacaaaaaatacaaaaattagccaggcgtgggtggtgcggctgtagtcccaactacttgggaggctgagctgggaggatcccttgaacccaggaggttgaggctgcagtcagccatgatcgtgccactgcactccagcctgggcaacaaagtgcgaccatttaaaaagaaaaaaaaaagagagagagagtttgcaggaattcaaaacagcaggtccttgaataatgttgtttcactcaaagtcattttgttatgatgttgatgaggggaaaaagaaatcacttcccagccggggccactgtctgtgggtccgtacgctctccccatgtctgcacgggttttctctgtttctccgttttccccccacatccccaagctgtgcacattaggtgaaccgatgcgtctacatggtcctgatctgagcaagtgtgagtacgggtgtgagtgtgccctgtgatgggagggcatcctggccagggctgactcccccaccagtagtaccctgagcttcctggatgagttccagccacgcggccacccaccatgctgaactgaaataatcaggtaaataattatctttgtttttattaatctttcttaaatgtacatataattcatatttatttcagtgtttcagtgttttggcctttatttagaagtctggtgatgtctttgtgaccagaaatacactatgggaactgacttcttgtttatatcaattagcctatggtaacattggtttcattgtttgtcatttcacttaagggtgcagtttccaagaatctatcaacaactttaagtgaggacttactgaggaaggcatacgatttcttggacaccagaaaggcctttcctcccaccctccttcccctgattgaattttaagatttggaacttcacctagttacttcaggctttgttgtctagttaaaattaaaatatctccacctatcagcagcctttgtctgggtatgaaggaacttactggaacctctagctcccctgagatcagattttaaatgagcattgaagcctggaggttgccagaacactgagtacccagaaaagcaaactgagctcgtctgccttattttgtttcagctttgcctactgtatgcaaagcttctagcctgatattatagaagtattatgaaaataaaaagcataatgccagctttcaggcgacttagaatctctcaattcctaccttaaccaagccaaatatactaaccaaatgttagaagttgaggcttagctgggtgtggtggctcacgcctataatcccagcactttggcaggccgaggcgggaggatcatttgaggccaggagtttgagaccagcctggacaacatggtgaaaccccactgccactaaaaatacaaaaatcagccaggcatggtggcgcacgcctgtaatcccagttacttgagaggctgaggcacaagaatcacttgaacctgggaggcagaggttgcagtgagctgagatggtgccagtgcactccagcctgggtgacagagtgagactccggctcaaaaaaataaaggttgaggccaatcagaaaaggtctgcagggcaccgtccaacatggtccccaaaccacagctgattggctgcaggctggctgcttcctccaagactgaggatgccaatcatgggacaacaggtcaggtgggcctgtttgtagacagccctggagaggggaagaggcagaaaagcaaaaccctctaaagaatccatatcctcacctgatgtcaggagttcgaaaccagcctgaccaacatggtgaaaccgtctctactaaaaatacaaaaaaaattagccgggcctgatagcgcatgcttgtaatcccagttacttgggaggctgaggcaggagaatcacttgaacccgggaagcagaggttgcagtgagccgagatcgtaccactgcactccatcctaggcagtaagaatgaaactccgtctcaaaaaaaaaaaaaaaaaaaaacaatctgtatcctactcagtgcacttctaccctaaatgtgtacctctcctctccggtggacaaagccatgccagtatagacaaacagcatagcggcgagacccgtttaattcacttgagcacacggctatcccggagattaacccttacaggtggcagaaatgaaataagtcaagttctgttcccactagagccgaagggatgagaggggtgctcgactgaatgcatgtggactcactggtcagggtgaatacacagagtagccaagatgcacacgcagtgaattgtatgaactcgttttcacatgagaacgatgccaggacggaaaacaggatggcgctacaagcgggcggagttcctggagacaagggggaagatggccgctgaaaccccgagaactgcttggcttcactgtcttagggtttcaagatgtaggtgcttctacaatggaaacaagaaaagaggccacctctggttctacgctcccaattagcagggagaaatggcacaccggagtgtgtgggtggtagatttgtactcctcgtccacagaggtactggactagaatctcattctctgagtgtaaccctgttaccataatgacaggtctatttctgtaacttggcttcttgtaaaaataagactttttagttggaccgaaaaccggaactaaaaaaatgtctccagccacaaatgcgtggagagggtgatactggcatccagtggggagagaccagggatgctattccgcagccgaaaatgcacaagactgttgttgccacgaagaattctctgacccaaaatgtcaatagtgccatggttgagaaactctgtcatcaaaggcgacccactgctgccatgtgctaagctaaacaagaaaacaaaatcttttaaaatcccttttaaagattttctgtggacaacttcatggcaaattcctggtccatttgacagtcaaatgtcagcattaatccacagccttaagttttccctgcaaacttgatcagtacagcgagcatacaaacatttcctctctttctttattattatgaatggcaaaggcatcaaatctgcagcttactcggctgggacaccagtgcctagggtgcagctgtgttctgcccttgaaatactttacctcctcttattgggttacatcattactagatttattacaaaggtgaagactatgaaattgaacagggaaagaggaaactaaccagcctgtgataatatttattttttgatctcagtaaggtatcacagagacacaggcctgtggagaaaacagtgaccctgtcacacagaagactggaagtcatttaaaatcaaaaatgacattctaatcctctgaatctgatttgtgaagctgcatcatattgccttttttttctagggcaatgcactgcagtatcaaattttatgatagtaatggggtcaatttaaatggtgcagcaagcagatttgctatgtaactcggagaaatggatcacaacagtgccaaatcaattttctagtacaagtctgtgctcaggggtggtaaaattcactcttcaaaactgaaatatggctctaggaagtcgggtttttaagtggattttctgagaatatgcagttactatagttacaatatttgcagagaaaaagataagaggaacatttattacgcctccaaaagctaattcatgtggcctgcagcactgcaggaaacctgcttgggctgtacgtgttcatctgtcctaatgtccaaattccttaattttaagcatctctgcttgagtattatcttaagaacaagtgagtcggctttagaatagtaaagaaacaaatatatactctggaaaaaaatgtttggccagaaaattcaagaaacttagcttccaggagaactggaaaaagacaaggcattacaaaatgaaaacaaaacaaaaaaggaaacaattctctatctcaataaaaagatccctataataaaacaaaatcgattacacttatcttgggaactcttctggacaaaatatctacatctgcgtagttttctcattagagcatcaaatcctttagggcaagtgaatgttcatctaactctaatgaaaaccttttcccctaaggattaaaagatttggagtcaatgacaaggaattctgaaatagtttatccgctaccgtttgcttaaacaaacaaaaagctaaaaggaaaaagaagatgagccaaaggatctcctacgcaagaaaaagaaactagcattttcctttcatcctctttccattttccccctacctatgtattagtatgccacaaatctaagtagcttcaatattctcttatttgaagtttttcttttcagcacttggaagagtgacaaaacataagaaaggaattgggaacctgaagatgttttcaacaccaactaccttggcaatcaactgcagtatttcatcgcagtggtcactgacgtctagaatcactaccctgatggtttcaacttcctaccttaaataaagactcaattatattaaccaaggggtgctctaaggcaagaaagcagaccgatgaatttgagaaagatcattactagtaaagaacaaaacgagaattttctgactaagcctcagttaaccagcaagctcatttaaccctgacagctgccttgttcctccctcacaagtcttttggttaaccagggtattcaagaaagccctgaactaaactaaactttctgctcactatcagcaaaagctcccagccaatagtcaaaaacagcccgcagcacacgaactcctgaaacttttaagcgtgtacctttaaaagacatattccctcgcaaaaatacccacagatacccaaagatcaccaaatccatgctgccctgagtacctggcaaagaacagcttctcccccgcgagttccaaaaggcacatgcacaatcatcctgtccttgtcctcattctccaggtggccctggagcctgccggggctgagccggacggggccttcctggtacctgcagccactgctcaagacgctgagcttcacctcgctctggtcagccttggagaaaaccaagttctggactgtcttgtgcagtgcacccttgcttgtcacctgaaagccaccaaaggtgaaggatgaagacaggcccaacaccttccctccctgagaaagataggccatgaacttctggtacaggtcttcgggaatggactccctggtagcaatgaccaacagcagacagttgtccgtccacgggtctctgagagcactgtcctccagcaggtggtagagaatataactgtcaatgtccacacagtcggccagcacagaccggacctcgtggaaccggccgagggcttcctgggagtcggagcccacatagaggaggatgttgggtgcctttcccgtgaggttgactctcctcccttctctttcgggggaggtctcatcagcaacactctccaaactgctgctataatcgtagggaaggtctggaatgttctcggcagacgcaaacttgactgactcaatggtgctgttctcaagttccagacactcgtggcaactagacagatggaggtgataatgctcaacggggccccctcccctgtcactgtccccagcaggctcactcccagaggcactgcctctcctttgtttgggttcttcaccaagagcctttgggtcatctctgccaacatgctccataccgtcctgctcaggcttaatctcaagagaaggttcaggcttcggctctaggatctgggcttgcttgtttgagacctgatccttaacttccttcagagtggagtcctgcaagtgcaccgctaaggcatgaataggagagagagacagaaaattaatcaacacttcttgtatgacacatagctcatctcaagaatctcatcaccctctctgcattctgggacttacattccaggacagcctctggcacggctcccacctgcatcccccctcaactcgggggcatcctttggaaacactaattgttcccacctgaagaccccaagtgaaatcagcagtttgcccaacatcttttatacctattggagaacctaagaccctcttacggaatggtgaagaaagtgagattcagagaggtgcctttgcctccttacttacagattctatttcttgggtgttattctccttcacaataatgaaactgagcaataaaaaggacacatatctagagtctaccccagcacgccccagtgaaatgtcactctcaagacatgccataggatcaatgggagaagattcttcccagtatcttgtctcaggactggaacataagttgacaatcactaattcaaaaacatttattgagcacttgctacatgtcggacatggtattagagacatgtacgaggtgattctggatattaagggatttacataaacttccaaagctgataagggacatttatttgcccatcagatgaaagaagacattcatagacataaaaagcctgcttttaagtctaattaaggaagaacagtttgtgtgtttcctgaaaaacgatttgtcccaagaaattgtgatacatatattttaagtaaaaagcggtttgatttagaacttcatagtaacactagctatgcttcccactcaatcagaactgtagtctagacactagttatactgtattaaactatgtgaaataaatattatatgggttctgaatttgaatgccacctcatgagcaatgcagtcatgaaaacttcttgtttaagaaatttaataagcactgaaaatgtaccctgcagccccccaaaaaaatcttgacacatgcatgaattgtatattattacagtaaaatcaaacctgtggactgaattaaactgaaaccaagcatagcctttatgtcataccagtaagagtgctcaacagtccttaagctaataacttatagtgtcccactatgataaaaacagggtctcactttgtcacccacatgggaatgcagtggcgtgatcatggctcactgtggcctcaacctcccagctcaagtgatcctcccatctcagcctcccaagtagccgggaccacaggcatgcaccaccacacccagctaatttttttgtttgtttgtttttttggagataggggtctatgctgctcaggctggtctcgaactcctgggctccaagcgatcctcctgcctcggccttccaaagtgctgggattacaggcatgagccactatgcctggccaataaaaacattttctaaagttacttacacacaatcttttggggtaccagtccattatccatgtggagtctatcttccatgaacgccacccccagcttgctgaagttgtccacacttgcttcagcaattagccgataaggatccccaggtctgcaagctaatggcaaacaacagtctgaccacttgacaatctgagaaaaagcaggagagggaggaggtgggaaaagacaggttgagatttttcttctctaaaataaccacatactttatttttcccttgaggctcctaccactaaattacagtcattaataacaaattactggatattacattttactaatatcagagttgttttgaattcagcattctcatctctacctgacaacagtgcttacgaaacactaaatataactctctcatttaaaagtaactgaagtctccacctttttaaggaattaaaagataaagggacattccccagacactggaaaaacaccatgctgccctttaaaaacagagaagaggagagaacaagaagtccacaatacccagttactttcaatgtaacctgtggacccgcttttctcaaagtgtggtccgagaccaagtgcaactgacctcccagggagcacatgagaccttcagagtcccgagcacaactccctccctatctggtgcactggactttctggagttgaagtccaggaatcaggatttaaaacatgcttcccctggggttcctgcactcgaactgtgagaacaatccaaaaagactctccagacagttcctccctgtaaggaggttcacgttcctaccacaagggggacagggagaaagagagcaggcaaaacacccggcttagccttccagttcttactacagaagaccgtgacactggggcctggaacacccatgctctctctgagggttcccatggagaagacagcctgtgaggtgaagagcccggcgctgcagtcaggggtctgaggccgagtcaaaggcaactaatcatcactgtctgtcctcgggcaagcttccgaccctcacagcatcctaatttgtaaaacaagaatactctactaaaaatacaaaaattagccgggcgtggtgtcgcacacctgtagtcccagctactcggggggctgaggcaggagaatcgcttgaacccaagaggcagaggttgcagtgagctgagatcgtgccactgcactccagcctgggtgacagagcaagactccatctcaaaaacataaataaataaatataatttaaaggttggttgtgttcatgagatcaaagagtatacgtaatgcccccagtaaaaagcttagattgactggaataaagtactcaattaccgacagctgcttttattagctgtcacaaatgtggctttaaaagcagcagtgagcagcacagtctttttctaagatgccatgaacgattgctctacttcctaaagataccttctcagggacacactgccccgaatttcataattatagataaataattttttattccatttttatttatttgtatttatttattttttgagatgagtactcgctctatcacccaggctggtcttgaactcctggccttgagtaattctcccgcctcagcctcccgagtagctgggacaacaggctcgggccaccacactgggcttgaattctattttagatattggtgggctaggattttagaactaactcctcctaaaaactattttttaaatgctagataaaataaatgaataaagcattaccttaaaagtctggaagaacagactagataatagtgaacttccaggccaagtgtgggataaatcctgaacctacagaggaaaggggtattcctgcaagacacgccacttctgcccccagggtccttgctcatccaagcaacttgggtttcaaaagtcatcgtccaactggcataagcatagacatatagagatatggtttggctgggtccccacccaaatttcatctcgaactgtaatccccatgtgtcaagggacggacctggtgggaggtgacaggatcctgggggcagtttcccccatgctgttctcgtgatagtgagttctcatgagatctgatacttttgaagtgtttgggctgggcgcggtggttcatacctgtaatcccagcattttgggaggccaaggtgggcaaatcacctgagctcaggagttcatgactagcctgggcaacatggtaaaaccccgtctctactaaaaacacaaaaattagccaggcgttgttgtgggtgcctataatcccagctattcaggaggctgaggcaggagaatcgcttaaacccaggagttggaggttgcagtaagccgagatcatgccattgcactccagcctgggtgaaagagcaagactctgtctcaatcaatcaatcaataaagtgtttggtagtttcctctctgtctctgtctctcacctgccaccatgtaagacataccttgcttccccctttgccttctgccatgatggtaaatttcctgaggcttctccagccatgaagaactgtgagtcaattaaacctctttcctttaaaaattacccagtcttgggcagttctttctagcagtgtgaaaacagactaacacatatagaccaagagaacagagctgacagtatagaaataaacagattcatggacaactgaatttggacaagggtgccaagacaactcaataaggaaataatagtcttttcaacgaatggtactggtacaactacatactgacgtgtaaaagaatgaacataggctgggcatggtggctcatgcctgtaatcccaacactttgggaggccgaggcaggtagaccaccaggagtttgagaccagcctgaccaacatggtgaaaccccatctctactaaaaatacaaaaattggctgggcgcggtgtctcacgcctgtaaccacagccctttgggaggccaaggcaggtggactgcctgaggtcaggagctcgagaccagcttggccaacatagtgaaaccttgtctctactaaaaaatacaaaaaattagctgggcgtgctggcgggtgcctgtaatcccagctactcaggaggctaaggcagaagaaccacttgaacccgggaggcagaggttgcagtgagccgagatcgcaccattgcactccagcctgggcaatgagagcgaaactgtctcaaaaaaaaaaatacaaaatttagctaggtgggagcaggcacctgtaatcccagctactcaggaggctgaagctaggagaattgcttcaactcaggaggcagaggttgcagtgagccaacactccagcctggcactccagcctgggcactccagcctggcgacagtctcaaaaaaaacctattaaactttaaaagactcagatttgcattaaattgatacagaaaaagaaaaaaaccacagatagagaagcgttaaagacctcttttagaaaaaggagaaactggccaggctcggaggctcacgcctgcaatcccacctgagaggtggaggttgtggtgagctgagattgcgccattgcagtccagcctgggcgacagagcaagactccgtctcaaaaaaaaaaaaaaaaaaaaaaaaaaaaagaatgaggataaacctcttcctcacatcatgcaaaccacgtacaaaaattaactcaaactggatcaaagacctcaatataagagctaaaactacaaaattcagagaaggaaaacacaggcataaattgtcatgacttttgatcaaccaatgacttcttagataagacaccaaaaacagaagcaacaaaagaagaaatagataaattgaacttcatcaaacattcttgtgcttcaaaagatatcaagaaaatgcaaagacaacacagaaaaataggagaaagtattggcaaatcatataagaactcctacaactcaacaataaaaagacaatccaatttaaaaatgggcaaaggatgtaaggcacccggcaaaggcacctgtagtcccagctactagggaggctgaggcaggagaatggcgtgaaccccggaggcagagcttgcagtgagccaagattgcaccactgcacgccagcctgggcgacagagcgagactccatcttaaaaaaaaaaagaaagaaaagaaaatatacaaacgcccaataagcacaagaaacactgctcaacatcagtcacgaaggaaatgcatctcaaaaccacagtgagacacaaagtcatacccactaggatggctggaatcaaaaaagataccaacaaggacaaggaaaaactggaactctaatacactgctggtagaaattaaggtgctgcagctgccttggaagactttgggagttcctcaaagagttaaacatagagttaccatatgatctagtaattctactccccagtatatacctaagataactggacctgaacatacgaacacatctagattaggctcagaggatcttcccaaaggcaagccccagaggccttcacaaaagaaacaaactacgttcactgagaaacaactggaagatctgaacttgttcaataagaacgtatacccaaaccccagccttcagaaagatatggtctccaaaatggaaatagatccaaaagtactgtaggtttggctcaaaaaccttggagcaaaactcaagaaagccaaatgcaagcatatttggcaaaaacaagaagctcaacaacagcaaatatctgagaatgaggctgggtgcggtggctcactcctgtaaatcccagcactttgcggggctgaggcagaaggatcaggaattcaagaccaacctgggcaacatggcaaaaccctgtctctatgaaaaactacaaaaaatagccaggagccaggtgtgttgatgggcacctgtagtccccgctactcaggaggctgaggtgggatgatcgcttgagcctgggaagttgaggctgcagtgagctgtgatcatgccactacactccagcctgggcaacagagtgagaccctgtctaaaaaaaaaaaaaaaatctgagggtagactcaagaccaatccttctcagggaaatatggacacactacccacatccccaaatgaggcccatcctagagtttacacagatcatcaggcaccctcattccaactaaacttaggccccagtggtagggaccctatagaccaccccagtggccccaaaatagttcattttggctgctgccaagatctgaacatatacggcttctagacacttcagaatcccaagttcattctccaagcttccattttaattcttttggttcctcatctctacaaaatagagacatcagacacaaaaggtcacatattgtaatggtttatgatgattctcatacaaaagaatacttttcagcaggaagaaacaaacttgagatatgcacaacatggatggatttcaaaaacattatgttgagtggagaaaaaagatgccaaaggatacatgctgtataattccatttctatgaattcctagaacaggagaaactaatttaccatgtcaaaaagattcgtggcccaagtagaaagaattgaatagaaagaggcgcaagacaaatgcattggggtgatggtaatgtttcatgtcttaatgacctaggcagttacctaggtgtataaattcatcaaaacacacagaactgtgcatctaaaatctgtgcattttattttatataaattatacctcaattaaaaattaatatacaacaaaactagtaaggacaatttctttattttttttcctgcttctttgttttgattttggttttggttttttaattgttgttgttgttccatttgttcagctaatgagatttagtcagcatcactaagtggacagttggcttatgtttctaaatcctgtttttgggtcacctccctccatcatcatacttgaatgacctcgtcaagctcccttcattcattttggctctccccaagacgttcttcacgtagtcaccagggtaatgttattattcctttaaaaatgttgcactattccttggcctggcacggtggctcacgcctgtaatcctaacactttgggaggctgaggcgggtggatcacgaggtcaggagatcgagaccatcctagttaacggtgaaaccctgtctctactaaaaatacaaaaaattagccaggcatggtgacaggcgcctgtagtcccaactactcaggaggctgaggcaggagaatggcgtgaacccaggaagcggaacttgcagtgagccaagatcacaccactgcactccagcctgggcaacagagcgagactctatctcaaaaaaataaaaatgttgcactattcctctgcttaaaatccttccatgaataagttctgaagatctactgtacgtcatggtgactacaggtttttttttggtttttttttgtctcaaagaaaaaaccacatcatatgttgtaccccataaatatatacaactaaaaaaatactttcatggccatttttcatcattcaggaaaaaaaaatatgcccacatataaagcttgtatgcagatgttcacagcagcattattcacaatagccaaaaggtagaaacaacccaaatgtccatcaacagatgaacagataaataaaatgtatatagctatacagaggactattattcaaccataaaaaggaatgagaatgaactactgatgcatgttacaacgtggacgaatctcgaatacattacattaagtgaaagaagccaacaactaaaggtcccatattctatgaggctatttacatgaagtatctaaaatagacaaatctagagtcagaaagtagattcgcggttgccaggagctgaggtgtcagggagcagacagtgaatgctgacaagtgtgtggtttctttctggtgtgctgaaaatgttttagaattagataatgctaatgattgcacaactttgtgaatatactaaaaactactgaattgtttttcaagggtgagtttcatgtgaattatatctcaattttttaaaacaaaaagaaaagagtccaggcagtttgtttgtctctacactcttccagcacagcctagtcagcccaacttcccaaacttcaatcctggctcccctggttaagagcgtgtgacctgagcaagctactcaaattccccatgcttcaatgtcctgtctgtaaggtagagataagagcacctaccttggaaggttactgggagcactaaaagggatcatccataaagtgcctgggccacaagggtgctcttatggttccaaaatataaagtcctttagagcaagtaacctcatgagaaaccacatcatccctagtgggcaaaaaccgaacctggcagggaatggggaggtgaaaaaaatcttagacattacaacagtttgtggccctccaaggctcaatcctatccctcaacttttttattttttatttttattttttttgagacagggtcttactttatcacccaggctggagtggtgcagtcatggctcattgcagcctcgacttcctgggctccagcaatcctcccaactcagcctcccgagtagctgggacgacaggcatgcaccactatgacgggctaatttttgtattttttgtagagacgagaattcgctatgttgcccaagctggtctcaaactcctgagctcaagcgaccctcctgcctcaacctcccaaagtgctgggattacaggtgtgagccaccatgtccggccccccacaacaaaatcttattccttagtagctcatttctcttctcagagtgaacgtgaatttaattattctcctcggaaaaacaatcatgaaaaaaaaaaacttgagaaacattgcgtttgaggggaaaagaataaacgcaggcctttatggccaactcactaacctgtgtagaatatttggacaaagagaaactccagaattttcatttagctctacttgtatctttccttccactttaccacctacttctcccacctcctcgcagacacacagccaagggaagcagaattcacctagagggtcaggcccacccaatgtttcagcagagttctacatttcagaaatgacatctttgattcaggacagagagttcgttgatttcagctttgggaatgggggaaaggacgtcagttcaggaagatgagaagataaactaacaccgtggcagggcagacttctgggatgaaggtgcgtgggaaacagggaaacgaacagggcaacctcccgcgggaagctaaaggcaccattgtcctcagagcaatcaaaggaggaggagaaccgctcagccaatggagactcaacccggaatttagctgtaaaaacattgatttagccccctgcggtagcaggcactggcagtgtaaaaggagccaatgatgaaattcccacacacctctgaagaggaatgaggcaggagataaacaaaggaagaggaaggaccggaagagcccaaagaatacatccacacatcccggatcaagtttctccactctgccaactgtttcctcacctaagtgcatttccgttttctaggagcgtggtccatgagccatggaccatgcaaacgccttcaagcagcgctgggtgctccgatcaaagcagaaccgcgctgtcactgatacgtcgtccagggtgtttgccttccagtggataaaggcaaacaggacactttaaatttgcacttcgagatggaaacaaaggcatggaaaagagaagggaagtcaagcaaaaggctcactcccaaagatcaaagctaaggaagccctggctgtccctaaacaaaggagtttcctcctataatagcagccagcagaaatctgttaagtaactaaagctcttgacttgatgttacaatgtatggcagcaggcaaggcatatcttctctgctcaacttaaaactcacatccaagaagcagtccgggagtgaaagaccccaggttaaactagcacaggtggccctgcccaacagggggcattggcaggcagcagctctgcagtgagtggggaacagaaatctcaacaacccactggtacccagagtcagatcacggatgctgctaatttttctgactcttgtttctcctcttccaaatcatcttaattcaacgtgaaattgttaaaaagctctagtaacaaattggatggagcaaggctggaaacgcagaggtaaagaatttgaaaatacagggccaggcgcggtggctcacacctgtaatcccagcactttgggaggccgagacaggtggatcacgaggtcaggagttcgaaaccagcctggatggcatggtgaaacccccgcctctactaaaaatacaaaaattagccgggcatggtagcgtgcacctgtagtcccagctactcgggatgctgaggcaggagaatcactggaacccagtaggcagaggttgtggtgagccgagaccacaccactgcactccagcctggacgacagaacgacactccgtctagaaaaaaaaaaaaaaaaaagaatttgaaaatacaagactaaagggaaaaagttatttttaacttttggctatccttgctgtcttttgtgtttggaaatagagaggataaaggagagctacaaaattgactttcacttgatattatgtaaaaagacaggccagatgcagtggctcatgcctgtaatcccagcacttggggaggccgaggcaggaaggatcgcttaagcccaggagttcaagaccagcctgggcaacaaggtgaaaccccatctctactaaaaacaaaagactagctgggtgtggtggcacacgcctgtattcccagctacttgggaagattaggtgggaggatggattgagcccaggaagtaaaggctgcagtgagccatgatcatgccactgcactccagcctggatgacagaatgagaccctgtctcaaaaaaaaaaaaaaaaaaaaaaaaaagacaatataccctatggcacttttaagggtattggaaaatcaagtaacagcgtaagagttatcacaaagtcactgcaagcaggagctgaaatagtcaactaacccagatggagctgaaaagaggaattgcgaaaccatgactgacaagatgctcagggaaagggcaggtctcgctgaataactgagaaaataatacaaatattatgagaataaatatctttgttgccacacagaagaatgttattattgtgttctgtagacagccgatacaccgccgaggcctgctaaggtgtgctgcattcacatccacagttacctcccacctcatccccccattccactgatgtaagctgaggaagaagaggagttttaagaggtatcccaagtggtttagttacccactcatgtgtaacaaaccaccccaaaattcagtggcttaaaactaatcatttattttgctcacaaatctcaatttggacaggactgggcaggaacagcttaactctgctccatgtggcatcaggtagagtgactaaaccagggctggatgacctactttcaagatgcctctgtcactgagctggagctgcctgtcagctgggagctcagccagggctgtccacgaagagccacatgtccttctacttcatgtggatctcgccacagggcagcttgagcttcctcacagtatgggagctggactcccagatggcatgttccaaaagcccagatggaggctccaaggtttctcatgatctggcctgagaattttcagaatgtcacttctaccatatcccaatggacacacaaatcactaaggtcagttcagattcaagggagggggaagtgactccacctctcaataggaggaaagaatttgcagccatcttcaatgcgctgcaacaagtttgtgccagcaattagtcttccccttctgcatgagaatgacatgtccctaaatgggcatgctcctttggcccaggaccctgcacaagagagatgtagagagcagagagctcaaagcagagtcacagctggaaacagcgcagcgaacctgctgagcatgagtaacatacccaagaaactaggattcactgttagaagccactgggattctaagcttatctgttacttcagcaatctgattaacacaatgtgcaaaactgcattcctgacaacagccttctaagcccttcctgctacattccccatctgcacaagtgacccaccatccacccacaggccatcacctcctaaccagtatggacatgtctctatctcagcgttcctactcccaacactcatcaagcccattatcttttcccatgtggccacaatctgttccaggtttgctcccctccaatcccttctgcaatctgcctgaattgtgaccttcctaaagtgcaaatctgatcattctgctttaaaaaaaaaaatagttttagcctactgtccctgggatcaagtccaaattcctggttaacacatataagccttgtttgatgtatatattatgtccaatttgagtatattcaattctgctacatagaaaacaagaaaaccaatagcatggatgaaactcatagtgagtcaaaagcttgtaagacacgctcaagacagacaaaataagtggaacatacgtgcattgaacatagataaaaaggacaaaaccagagtgttagtcctaggcagaaagtcacgggagaaccaatcttttttttttttagaggaagacagggtctcacagctttgtcacccagcctagagttcaatagcgcaatcaggactcattgcagcctcgacctcctgggctcaagcaatcctcccacctcagcctcccaagtagatgggaccaaaggcatacgctaccatgcctggctaaattttttttttttaatttcttgtagagacagcatcttgctatgctgcccaggctgaccagggccaatcttatcaaatcttaaatattagtaagacacaaactatgccacttgacagttatatcatccttaatttggccacccattttgaccccatttatatactgtctagaaacacatgaaaaaacacacacagcatcccagcaggtctctggtaagccacagctattgcagacatatatatccaaatatctccaacaaagcaccttccaccttctgggcccttgtgtaacttcagctctagtccttgtgctgacaccattggcagggaaggctgatgcagcagagagacaggactccatgtatgaacattgcatggcccaggattcaggttgtgctgcttccattccataggcacctgatcctaagtgttaaccaatcccagaactctccccttatttcttgctgcatgttttgaattgatgtgataaacaatgtgattcgagcgtcttaactcagcctatgagcctctctattctgtgactgctggaataggctgcttggccatgttcttggaagctaccaccatatcagggtaatttcccacacaacattccagcccctgctttcccctctggccttatctagggccattccccaactcaggtgaatgcagactccaaatgtactgagctgtgtgcaggggccaggtgcaaatgctttctgtgcatctgcacatgctgttctacctgggaagtcctttcctcctttcacctatttttaccttaaacctcagacatcatctaccctggaaagtccttcctgacctcacgcatctaagtaggtcccccccataatccctatccatgccttctatagtacttaacatggtgacctttaattgttcatttacttagctctctgctctcccacactgtgaactccttacaaacagggaatgtcatctctgaatgaatctttcatctccatgtaacacatgcctccaaccctacctagcacacaatctggcatataacaggcactcaataaaccttcaatgaatgccttgatcaagtacaaggaacataagcaaatttcctgtggaaaaaaagaattgtattaagttctttgggtcaacaattcttactaaatgcaattgctaatataagtatagaaaatattgaaaactgagctgaatctgccatcacttgttggtattactgcatcaagcaaaataagtgaaacgtagctgttcaataaatgttaatgaatgaataagcgaaaatatgagtatgtgaatgctacattttttaaaactgaattttaagatccatttatctgttgttggtaatctgtagaattaccacagatcaaagccatttgaaatatccaaaattcaaaaagatattttaaatatctttaagagttgtatagtcttaaagatgtgaaaaaatataagatcccatcaattcaaatgtccttcttccataatatatttttctatttaataccttaggaccctgttaaattcaaatggctgtgaagtcaggtagaacatacacacacagattcataagaaccccccaaaatgcaaaatcccatcaagcagtcaacccaaatgggaactgtcaacttggctagaagacagtgagctatgagatcaatccctttttaagttttgaatcctaatttataaaatggagctcggggtaacagccagagtggtcaacatgaatggctctggacgtctctagctcctggttgcaagacccactgatgtctctgatcataagtgaaattagttaactggactgtggcaatcctccttgttgggaaggcattctcctaccccagaaaattaagaattaagtaaccacggccgagcgcggtggctcacgcccgtaatcccagcactttgggaggccaaggcgggcagatcatgaggtcaggagatggagaccatcctggccaacatggtgaaactccgtctctactaaaaataaaaaattagctggttgtggtggtgcaggcctgcaactccaactacccgggaggctgaggcaggagaattgcttgaaccaggaagtcggaggttgcagtgagctgagatcgtgccactgcactccagcctggtgacagagtgagactccgtctcaaaaaaaaaaaaaaaaaaaaaaagaattaagtaaccaccattcagcaagaaggtcttaattaaatcttccttggaaagtcagttaactgaaatgatagctgtgacagagatgctaattatctcccaaaatctagcctttctttctcccttacaagaacagaactcccagtttctgctgaatccatgactgtccagctagggaatgcattttgcagactaccctgcacctaagtgaccaagggggctatgtgacaaagttctgtacaatgaaatgggagcagaagtcgccacgtgaaatttctgaatcacaacagtattttttttaatttactaattttttagagatgaggtttcactctaatacaatggcaatcaaagctcactgcaacctcaaacttctggcctaaagtgatcctcccaccccagcctctcaagtagctgggaccacaggcgggagccaccatgccaagatggatcacagttttaaagaggaaactggttgtctcccaaccttctctcttcccccactctgaaggctagatgaagctgacactggtggagtagcacgggagccagactctagcaagagagaaccactacctaggatagaggagggaagacaggagaaggaaccaaggaagaagatgaggaaaaaaatgggtccctggatggacttccaaagcaaaaccactgcccagagagagaaatttaacttctagcttgtttgagcccctgtagctctgggtcccactgttatacaacttagcctgtatcctacataatatagtaactatgttccttaagacgctgtacatcttttagccccataaagacatataattaacaatttaggaaattaaaagcacggcagtcattattttatgctaaaaaggaacctgaacatatttgatattttatataattgcaatattttggaaagtctgatcttggctttaagttgaaatcttactaaatttatatataatattagaatatataagaaaacttcaagcttaccatatttgtaaatttaatacagtcatgtaccacataatgtctcgcccaacgatggaccatatatatgatggctgtccctcataagattacaatggaggtaaaaaattcccatggtctaatgacattgtagtacagcacagtactcacgtatttctggtgatgccggtgtacacaaacctactgggctgtcagtcatataaaagtatagcacagacaaggccagacgcagtggctgatgcctgtaatcccagcactttgggaggccgaggagggtggatcacctgaggtcaagagatcgagaccatcctaggcaacatggtgaaaccccgcctctactaaaaatacaaaaattagccgggcatggtggctcgcgcctgtattcccagctactagggaggctgaggcaggagaatcacttgaacccgggaggcagaggttgcagtgagctatcacaccactgcactccagcctggcgacagagcgagattccatctcaaaaataaaataaaataaaataaaaagtataggccaggtgcagtggctcacacccataatctcagcactttgggaggctgaggcaggcagatcacgaggtcaggagatcgagaccatcctggctaacatggtgaaaccctgtctctactaaaaaaatacaaaaaattaaccaggcgtggtggcgggcgcctgtagtcccagctacttgggaggctgaggcaggagaatggcgtgaacctgggaggtggagcttgcagcgagccgagatgcgccactgcactccagcctgggcgacagagcaagactcagtctcaaaaaaagaaaaaaaagtatagcacagacaattacatacagtacacagtacctgataataaacaactgttactggtttatgtgttttctatgttttctattattttagagtgtactccttctacttattaaaaaaacaaaacaaaacaaaacaaaacaaaaaaaacagctgggtgtggtgcctcatgcctgtaatcccagcactttgggaggccgaggcggggggatcacttgaggtcaagggtttgagaccagtctggccaccatgtgaaacctcatctctgctaaaaatataaaaattagccaggtgtggtggcaggcacctgtaatcccagctacttgggaggctgaggcaggagaattgctggaacctggggccggaggttgcaatgagccaagatagtgccattgaactctagcctgggcagcagagtgagattctgtctcaaaaaaaacccaacaaaacagttaactgtaacagcctgaggcaggtccttcaggagctactgtgggggaaggcattgttatcacaggagttcactgctccatgcacgttactgcccgtgaagaccttccaggaggacacatgtgcagtgaaagtcagtgatactgatgatcctgaccctgggcagcctagactaatgtgtgtgtttctacgttagtttttagcaaaaaaagtttaaaaagtaagaaacaggctggacatggtggctcacaactataattccagtgcttggtgagggctgaggtgagaggactgcttgaagccaggagttggagatcagtctaggaaacatagcaatttgtatgttcacaaatttgtagagataaataaatgaaaataagaataaaattttaaaaacaaaatttttttttaaatatataaaatcttagaaaaaagcttttagaataaggatagaaagaaaatattttttacagctgtacaatgtgtttgttttaagctgttattacgaaagaatcaaaaattttaaaaaatcaagtttataaagtaaaaatatgatagtaagctaagattaatttattatcgaagaagaaggctgttataaattcagtgtagcctaagtgtacagtgtttataaagtctaaagtagtgactgttgtgtcctaggctttcacattcacacgccactcactcactgactcgccctgagccactttcagtcctgtaagctccattcatagcaagtgccctagacaggtgtactgttttttatcttttatactgtatctttactgtgccttttctatgtttagatacacaaatacttaccactgtgttacagctgcctacagtatccaatgcagtaacatgctgtacaggtttatagcctaggagcaataggctaccccataaatcccaggtgtaaagtaggctacagcatctagacttgtataagtacactctatgatgtttgcatgatgaaatcacctaaggacgcatttctcacaatgtgtatctgtcgtgaagcaacacattaactataatgtatacgaattatgtaagtgttcaaaaacgtggtgtctgttaatccagacaacttaaaaatctaaaaagaaactgggaggaggggtagggggagtcatgaggaaggagcaggagcaagtagatggactcagggggtggggaggcacgtgtagttctagcggtgagttcatgggtatttattgtattatttcaaatccacaggtgaatgagatccatgcataaaccaacgatgagagtacatttggaacaaggagtatggttaacccaattctgtgtacctagagtcctaaaatgaaatgaaatattttaagatatttgagtttgtaggccaggtgtggtggctcacacttgtaatcccagcactttgggaggccgaggtgggcaaatcacaaggtcaggagatcaagaccattctggctaacacggtgaaaccccatctctactaaacatacaaaaaaaattagccgggtgtggtggtgggcgcctgtagtcccagctactcgggaggctgaggcaggagaatggcatgaacccgggaggcagggttggcagtgagccgagatcgtgccactgcactctagcctaggcaacagagcgagactccgtctcaaaaataaataaataaataaaaaataaataaaagtccaaggagccagaatggtggctcatggctgtatcacagcacttcgggaggctgaggcgggcagatcacctgaggtcaggagttcaagacccaccctggccaacatggtaaaaccccgtctctactaaaaatacaaaaaattagccgggtatggtggcaggtgcctgtaattccagctacttgggaggctgaggcagaagaatcgcttgaacccaggaggtagatgttgcagtgagccaagattgcaccactgcagtccagcctggacaacagagccagactccgtctcaaaaaaaaaaaaaaaaaaagcccaaggaattggttactgatagaatctggaagtttgtcccctccaaatctcacgttgaaatgtaatccccagtggttgaggtggggcctgtgggggaagtgtttgggtaatgggaacagatccctcatgaatagtgtggtgctgtcctccctatagtgagtgagttctcacaagacctggttgtttaaaaatgtgtggcacctcccccagctcagtctcactctcattcttgccatgtgacacacctgcacctctgtcactttctgccatgactgttcctcaaggccctcaccagaagcacatgctggcaccactcttcctgtatggctcgcagaacctcttctttataaattatccagctccaggtatttctttatagcaatgcaagaactgcctaatacagttaccatatgacaaggcctctttgtagttcaaaaagaaaagccagatattagcaatttcatgtgatttgacctacttgattatttaatttatattttcaataaattcaaaatcatttttaaaataaaaataaagtttatgaatcgtcttttctgcatatgaaaattagccctgaattggctgggcgcagtggctcatgcctgtaatcccagcattttgggaggcagaggcaggcggatcacgaggtcaggaaatcatcccgactaacatggtgaaaccccgtctccactaaaaatacaaaaaattacctgggcgttgtggcacgcgcctgcagtcccagctactcgggaggctgaggaaggagaatggcatgaacccgggaggcagagcttgcagtgagccgagatcgcgccactgcacttcggcctgggcaactgagcaagactgcgtctcgaaaaaaaaaaaaaagaggccgggcgcggtggctcacgcctgtaatcccagcactttgggaggccgaggcaggtggatcccaaggtcaggagatcgaaaccatcctggctaacatggtgaaacaccgtctctactaaaaatacaataaataaataaataaataaattagccggatgtggcagcatgtgcctgtagtcccagctactcgggtggctgaggcaggaggatggcgtcaacctgggaggcggagcttgcagtgagccgagatcgcgccactgcactccagcctgggcgacagagtgagactgtctcaaaaaaaaaaaaaaaagaaagaaagaaagaaagaaaattagccctgagttcaccaaaaccgtcgtatcaacagctggtcgtcttctaccaaacataagagacacaagtactgtttgactggacctaggttaataaaagctttattttggaatctcaatgatctagatctctttaaaaccattaattcgttctctagttactagaaaggatagaagcattggttaaaatcttatctctcacttagcagctggttaaaaccttgtctaggccgggaacagtggctcacgcctgtaatcctagcactttgggagcctgaggcaggcagattgcctgagctcaggagttcgagaccagcctgggcaacacggtgaaacccggtctctgctaaaatacaaacaattagctgggcgtggcagcgtgcgcctgtagtcccagctacttgggagggtgaggcaggagaattgcttgaacccgggaggtggaggttgcagtgagctgagatcgcaccactgcactccagcctgggcaacacagcaagactccatctccaaaaaaaaaagaaagaaaactttgtctgtcacttagcaatgatattcctatcactttaggaatgtcatttaatcttataacctaagttttcttatcttcaaaatggcaataataataatgataatactttgtagagccgttaagtattagtgatgacagctgcagccagtctggagcagggtaggcgcggccagggatacgcgctctgtggaaccagggggagctgggagcaggcaggagcccttcccgcttctgagttggcagggcaggagcccagtgctcccaggcataactgcagcctcccagccacagctgcggacctgggcatccctgcactctcaggggtcccagaggcccccgcttccccacaggcttggaagtgcctgatcccgctgcctggcctcttcctgctccctgtgcccgctctgattctggagcaaaattgaagctgagcctgggcggtgtcgcaacccggccaggtgggtgctgctcaggatggcgctgacacaccagccccctgccacctcagcccccctctagactttaggagccactctggaccacgaggatgggagggaggccgaggaggggctgaggacggctggttgcaggcctgtaggcacccctcagcacaaacagcctgggcaccttggacaacatgactgacagcagaaggcagacaggctcataggtagaaaggggcgggtccctggtgacgccctgccttcaagccaagaccagcccaaaacctggggacctggctgtcagttccaggtgaagcctgtggcccagagtgagaacttagagtgctttttctggcccgcccatggctgcccatggaccaatcagcacgcgcttcctcccttctgagcccatgaaaacctcagacccagccagactcacacagaggctgggactaccagctgcagaaaggagctacccacttcaggtctcctgagagctgttctgccactcagtgaagttcctctctgccttgctcaccctccacatacctcattcttcctggatgcaggacaataactcaggacccaccgaatggcagtactaaaagagctgtaagacaaaccagggctgaaacatgtccccgtactcactacattgcaggcaacaagaaggagagaagaactgtggccctttaagaagccaagatctaggggctccccaagccaaggctgtaaacaccctctttggggctctgcggttcccagcgtctccatgcttccaggtgccaccatgttccccttgtccagacacaggtgcccacagcaaaagcctcattcagtacacctggtccagccacagccttgcatggagccacccaccccccccccccccgaccctgcacttctcacccacacaccccttgccgctctgcacccagcttgcccctggtaggtgtgcaatctgagctggtagaatgagctgagtgcagcctgccaggccaagtgggtggaataagaccagtgggcacaagcaatacttaggcagaaggcaccgctagccacagaggtttctgtctggtgaaacgacaccccaaggatcctgtgacattaggggtaacgtttataaaatacctagcaagggctcaataaatggcttattattatcataagtgtctacagggctaaacgaaacattacaaaccttcaggagagaacgtactgtcttaacacactgcactgctccaggcccatctgcctgatgctctgcccgctccagggcccccatcagaaagtctctcgctatcctatactatctgcacctgcctccccttattttggttcaccctgaattccagtcaattacttcttgtttacttccccatttttcttcttctctcaatacagcatcttacagataatcttcatgaaatgggaatccagtaaacatggctagcatcagcaaaatccccactggatgatctacatagcagggaacaatggcgggtgaggacccacaagtgaggggaaggaagctgcaagggtacactggggtcagacctccaggagcctcagggcatggactgcacctggagggatgacatccaccaaaagcttatgcaacactgtcccaactggatgtgggtccagaatgactaactctggccatcaagaggaatgcccaaagaagggacatgagacagggtattttcacagctcagacaaaagataatgaacatgaggatggaatgaggagcagtggagatgaaggagaggagctaacaatttagggagtgctgttacaactcataacttcacggaagcgaggaggaggtgcgaggaaaagccggctggcgtgttaatttgggattttctctctttgaagcagaagaatacaaacacaactcattttggacatgtggctgaggttgaagtattttcagaatactcaaggaaagacgtttaggacgtaggtggtgatataccccagccactcaggttgatttaggaagcaagaaattgtaggaatggatgagatgacctgagagagagtgctgctcaataaaaatataacgtgagccacaaatacaagccacacacgtggttttaactttcctagcagtgaccaggcgtggtggctaacatctctaatccaagtattttgggaggctgaggaggtaggatccctggagccctgagtttgaggcttcagtgagctataatgaccactgtactccagcctaggtgacacaataagaccctgtctgaaaaataataacaataaatttttctagcagccacattaaaaacataaaaagaaacaggtgaaaataattttactaatatatttaacccaaaatatccaaagagaaagggagccacaaaggctaggaaagagcactcataaaaagacaaatttgaggccgggcgtggtggctcacacctgtaatcccagcactttgggaggccgaggcaggtggatcacttgaggtcaggagttcaagaccagcctagccaacatggcaaaaccctgactctactaaaaatacaaaaattagcctggtgtggtggcacacgcctgtagtcctagctactctggaggctgaggcatgagaatcacttgaacccaggaggcggaggtcccagtgagccgagatcacaccactgcactccagcctgggtgacagagcaagactctgtctcaggaaaaaaaaaaaaaaagcaaatttggttttgactaagacacatcagttccttatgggacacaagtaaacatggtactcactgtttctgaagaggatgatctctgtaaattctcactttgtacccaaatgctctccgtcacaaatgctatgtgttctgcttcaagtataaaaggagacacaagaaatagggcccacttgttcaagtcttcaatggactgtatagagggaaagaaatataatgagattgtcacttcataccacaactgccataaatttcaaccccctctgaaacataccctcccctataattccaagtgacatggaaataagcttatctgatgctcctctgcaggccgcaggaaccgtgtgtttcttgtttagctgtgactgtttaagcacctgcaaaagcccatcgatgactcaggacagctttaatatctctagaccactgttttcaagccatgaattctgaaacggggcctatccccgccattcctcactgcttagcacacagtagctaaccgggaagtacatttaaagatgaggaggctggccggcacagtggctcacgcctgtaatcctagcactttgggaggccaaggtgggcagatcgcttgagcccaggagttcaagaccaccctggccaacatggtgaaaccttatctctacaaaaaacataccaaaaaaatgagttgggcatgggggtgggtgcctgtagtcccagctactcaggaggctgaggtgggaggatcactcgagcctgggagcccgaggttgcagtgagatgagatcatgccactgcactccagccttgggtgacagagtgagaccctatctcaaaaaaaaaaaaaaaaaaaaaagatgaggaggcctagaagtacgtacccaccaacagaagctccttactcacagaagcctgaagggctgttccttcattccctacagccatcacagcacagggcaccaggcagtttttctttacaccttccttatagtgaaatcaaccctgctcctctcccggagatctgggaagtgtgcaagtctctggatgctcacacagcagttaaatccagagagaaaagctatttcagggaaaggcatttaccatatgcagacgcaatcagacatactttaatggaatgtaaactccagtcaggagtgattgtagtttttcaaaaagaagattagaatcaagattggttagcaaatcagaaatacccagttatctctcgttttctttcctgaaatctctctaagaaaaacagcaaattgatttgaaaaggctttcacatacaggatatagccagagaagaaaaagatgaaatctgagcggggtatgcaggaggctttcaccatcacccagaacgaaggtaactaggcaggctccactgtgctgcatatcagttcaaatctgcttgataaaaacctattgaactaaataatgaatgaaaatttaggggagaatttgcccctccctcagtaaacataattatcaatatagtggttaaaaagtatgtccacttaggccgggcgcggtggctcacgcctgtaatcccagcactttgggaggctgaggcacctaaggttgggaattggagaccagcctgaccaacatgaagaaaccctgtctctactaaaaatacaaaattagccgggcatggtggtgcatgcctgtaatcccagctactcgggaggctaaggcaggagaatcatttgaacccgggaggcagaagttgcggggagccgagatcgtgccattgcactctagcctgggcaacaagagcaaaactccatctcaaaaaaaaagtatgtccactttatccaagcatagaatgtgtacattaaacagacaaaaagcttgatactgccaatttgtataaactgtctttggttaaacttatcaattgattgtagggcattcaattataaacacacatattcagtattcatgcatttgattttaagtgtataacatatgagaacacgccaggcttggtggctcacacctgtaatcccagcactttgggaggccaaggtgggcggatcacctgaggtcaggagtttgagaccagcctggccaacactttggtgaaaccctgtctctactaaaaatacaaaaattagccaggcgtggtggctcatgcctgtaatcccagctactcaggacgccaaaggaggagaatcacttgaacctgggaggtggagattgcagtgagcggagatcgcgccactgcactccagcctgggtgacagaatgagatccatctcaacatatgggcatgagattcaggtgtgtccttatttcagcccaagtagactgaggtatccctcaaaagtagacccaagcagactgagatatccaccaaatcatcaacctgatcatattttaaatctcaaaataacagtagccaaccacaaataaatggtcaagctttccacctgtagaccttcaacatcacagcttaaacccaacaactattaaatttactatttcaggtcaagctgctatgctaaacagtctcatttcctaataagaaaaagatacgaactagaataggaactgtgatttaaaggctacagggatgcagagcatggccatcccatctagtctggaaaactaggaaatgacgcagcaatatctaaccaaatctgtaggcaaagcttactgtgcagagtgacagagcagagttacagaatccatgaaagcaccaggccactcctactccggcctgcacaggtaggcaagggctgaaaatcactagttatggttagtgtagttaacagaaggccagcggagtcatgaaaatgttcaaaagtaaaactgtccaagaaaatcagacattcccatctccatgtttttatatgtccaaaatttctattctgacttaaatcctaaatgtaattgatccaatttggaaactactacaaaaagctcacccctcaattttttgccattttattgagttatctttctcaatcaggttaattcccaacgctctaagccatacattgtatgtaatgcatgaacttcttccccttttgtctgggtagtgtcagttatgtggaggtggtactagttatttgcataactagtaccttgggggacctgagaaaacagtcattcatattcagtgtgacataatacatatatggtactaacaagaaagagtattttttatttgctagtggcacaatttcaacccatatctaagcacagcctccaggcaatgttcaaacctgagataagattcaattccccacaggggctttacggtgtgacatatgcagaaaacgtcattttagtgctaaaagtgaggcaatattccagaaaacagaggaaagggacaagaaacagattaaaagcaaaacacgtttaaatattaatgagaacaatgctaccgatgtccatgaaattttgtgcagtactgcactgtgaagctaagcccatttccaaaaacagctgaatggaaagatctattgttccctttacagcaaggcagcagactttttacagagattaattgactggcccaagtcacaaggtaggtgacagagtgggctgaacacgtaaccaccatcctaagcactgggtcaaaaaaaacaaaggctgactgtcaactgaaatttaaaagacgcaaagaccatcagtcgggtgcccaagttggtgaatgatgcaaccaactgacagaagatggagagggaaaagggcagtttttgtaaatttggggacatctgacaaaaagctgatgacacaggtgggagttttttgtttgggatttttttttttttttcttaagacagggtcttgctttgtcacccagactggagtgcaatggctcaatcatagctcactgtagcttcaaactccggggctcaagtgaacctcccgggatcaagtgaccctcccgcctcaccctccagagtagctgggactacaggcgcgtgccaccacgccgacctaagtgttttttttgttttgttttttgtagagaggggtctagctatgttgcccaggctggtctccatctcctgggctcaaagctgtccttcctcctaggcctcccagagtgcagggattacaggcataagccaccgctcccggcccgccacagctgtctctcctggttcacggtcacccaaacgccggctcgaagtgtgggagaggaggttgggggcgaccccaggtgggcactgctggcgtccggctgtcaatccacagctcacgtcctcacaggtgcgcgcctagagtcacgcgtccagcaccgcccggctggccgggaagaggcgaccgggtccgtggtccgagtcccgcacctccggcctctctctgggccccggggcaacagcccctcccgggccgcacaggccgcactgagggcgccactccggggctcccgaactcccgggctcccggcggggacgaggcgcagggacgggggcacttccggctcgcggggcccgggtcgcccgcccgcccgacccgcccacctggctgtcgctgacgcagaagacgcggccgccacggctcaggcacacgcgggcgcccgggggctgcgcggccgcgccgcagaaggtgaaggaacagcgcgaggcacgcagccgccgcaccgtggcgcgcacgagctcagccggccggcgaccccagcgcgcccacaggtacaggtagcacagcgtgatgagcatggccgcgccgccggcagg

SEQ ID NO: 679 - DNA, 230076 bp, Homo sapiens
tgttgttacattaaatttatttctcacctccattaaaagggtttttgctttggagttttgttaactttcgttctttggagtaataatatttctcttgtgtatggcgctgaatacatttgtcaataatacgtcaaaaaaaaaaacacttggcttcttaatacttggaaatacgtacatattccttactatgtaaaacactttatttattttgtaaaaatgtttaaatatgaataaaaatactgtaacccaaagtagttgcctacttttaaaaatgaaacttgtaaaaataagagggagcccaaaccacatagaaagtcttagtttattttggtagacttgctttttataggcattggtttaaagtgattcttttcagagacatcctttgagaagttaaaattgcagaggcttacgctttcttttatttcaaatatgcatagtgattaaccaggaataaggattctcccatgttctgcctgttaagagcaaacagatctggagaacggaagcccaccctgcctcccttttccatctgaagcagtgcggggaggctggctcctctctttgttcccagactccagggcaaggggcgaccatgctgtatatgctgtgccttgggggacccccagaggctgcgctctgtggcctgtgctcccccgacctgtgcacccgcaccccagtcggccacttgctctcacatcaggcaacgtcagcctgctgcagtgaaactcaaccacgattttcctttgcacacaaatccttcctacttccaccactccctagcagagttcccagtgccagagagcactgctggggtgggggtggggacaggaagcccagttattgctgtgttctattttagggggcacttcctcaagagtccccttgaaacccgttaccagcctggaagggaggatatcttgccttttacaaaatacggtcgatactcaatgcacagcctctaaaacaagggctactccagtgttctaaaagcacacgccaatcctgagtttagtgaccacattttaaagatcatcaggaaaatgccaagttcccattaagactttaaagctccttgagatcccaggttgcggggtgcataaatggcccaaatcggagagtgtgctatagcaggtagacaggtttcgctaacacgaacagctatcagtaaaatgcctttattcagctaattctatagaagcggagttttgagagtctttggttcatgtgaggcaaaatcaggtttatggaaaacgcagcatctgcttcaaggctgcttcatctctctcaggacaactgagtctcctgcgtgagggaggagcgcctgctggaaagcacagagcacagcagtatgcccggaacatctccatagcctttgacaaggccacacttcattagttttaatttgcagaaaggaaattaaatgataacattttttcccaaagcagagtgtccagaataggacttcagcttaaaacaaaacatagcatgtttttcattaaataacccccaaagaaattcaaaaagtgatgatggcagctctgagagagggcttgccttatattacaaagtctgagaaatgaaacctacatcgttagcctcgagatctttgtccctgatgatattctgcagatgccctctcaagggtaagtccattttgtaatttggggatggtgtggacttgtattttacttaagtttctaactaattttgaaagaaggcttgggcatttggagaagagtggttttttttgtgttttttgtttgtttgttttttgagaaaaataattctaattgaagcctcatttccaaaaattactttttaagttcttttaatgtttcatttccaaaaaatatatattgggtattttttcatagggctgtcctgtgcctggctaaaggtagacagactatactaaaaaccacaagtttctggaattagcctgactgggtaagacctggataaagatggtgctagtttacaatgaagggattttgttcaaagctgaaagctccatcaaactttctttccactaatttcagctgggactggaagagagaaaactggacaaaaattggccttttaaaaagctgaaaagtaatgagtatgattcataagttcaacagagataggagggacatggaaaaggcatggcgtacatctgggaatagcgaatgcatatcaaaaggcttcatttcttttgttctttcatgaggcttgtagcacatcaaattttgaatgtcttcttttaaagctatgtgcgcacacacgcacgcacacacatatgcgggcacacacacacatcctccctctgaactgatggtgtttagtatcgataacattttctttcttggtaatacgaggtaaatgaggggggcaaaaacttatgacttctgagtaaaatgccatgtcttctatattccgtgagctgcacagtcttgcaggaatgctccacatttcagagtaaatctgaaactggcttaaaagctccaaatcctcccttgtatgtggtatgagtgtgccttcatctccagctgtcagagccaaatcgcccacctcctcatccaagtgatgcctaatcagacatttaaggattctgaacttgatcctgtctcttcacaatatgtagtaaatttaaacttacttaagaaagtcagtccctaactaaggacatttaaacttccttaggaaaggagagctcactgaatgatgtcaaagtaatgaactgatttcctctacaaggtcactgcaaccacaccagctagctctatctctacaggcatttagacttcgctatggggccacaccaccgggtggacagtaactcttggaagtctgtcttcccttttcttcattaataaaaacacagaacaatgactaagtgtccaagcatgttcttacagttcagtacctccccagatgcttacaaacagtgatagcatacctctaactcaccactggcctgggcgcaagagcatattttggtttgttttttcatagactaggggtaaaggtctgcactactaagaaaatatctgaattttcccattgtcatttccatgtaaaaactccccttgacaataaacgtaagtccaagccacagaggggagagcaatttcccacctgtgggagggctttccctaaactaaattttctacttcttaaccatctatcccagagcctcttcaaacaccaaagaaaacgacaacaaaacaaacctaaaaacaaacagaaacacagaaaaagaacaaagacttaacaaatgaattggaggaaaagaaaattcacctacaactctaaattagatttccagatgcatgggcacggacaggcagccgcgtctcggggacgcccggcattaccgccgtttggggaggatgaggtttctcagcatgtcgaaggagttgccgtccgggtgcacagtcacaacctcgccgccctcctggtgaacctggaggaagccagaatcgtccaggccaacgatggacacctttggtccctctgcgctgcccagatggacttgctgaccactgaaaaggaagaacagcgtgcggtcactgggaggtgtcacaggacgacttaagacaatgagctgaagaataatccatgatgagagagctgggcgtgctggggagagggctgaggctcgctgcagggaaaaggcagcctgggctgagctctgactttcttccaccctggtgaatggttttaagaactgctcaaataaccagcaggatgcaagttcaacaaggagtcgaaatttcttcacacaacgtcactcctcctaattctggtcatctgcggtgatggctggaaccacttcctcacctcccagcgcttttaagaaacactgtgcaactctaggttttttggctgagattggaggaaaataggccgagttggcaaacaatgttttatcttataaaacaaagttggctcatatcagccacaagtgaaactcatcctgatcctacttcttttgaatattttccaaatgtactcaagtcacgtccttcttaacagctttcgaagtatagaattttctcaagtttttattttgaagaattttaaatctaaagaaaagctgaaagaatagtgcaacaaacctcatattctcttccattctcacaccaaatgaaaatattttctgtatttgctttctttcttcacacataaacacacacaagcacacatttttttttcctgcaacatataaagataagttgcagctgggtgtggtagctcatgtttgtaaccttagcactttgggaggccaaggtgggaggattgcttgaggccaggagttcaagaccagcctgggcaatatagtgagaccctgcctctacaaaaaaatttttttttaaattagcgggccgtgtggcacactcctattgtctcagctacttgggaggctgaggcaggaggatcatttgagcccgggagttcaaggtttcagtagtgagctatgatggcaccactgcactccagtgacagagcaagaccctctctaaaaaaaaaaaaagtgaaaataaaaaaagttttttaaaagctgcaggcattgtgacactttctgcttaaatactttatctcctgagaacaagaacctcccataaaattataatagcattaactatgaccactcaagaaagtctggatacaaacggtccatgttcacgtcattcccactgtccttttaatatcctttgtggctatttccctccatccaggatcacacacattacatttagatgtcatgcctctttcgtcttctctaatcccaaacaattctgccaccttcttttggtctaattgtttgtgcgcagacctgacatttttgcagggcacaggcctgttgttgtggaatcagtgagcggtcctcggacttcagctgcatgagaatccctggagtatctgttatgacacagggtgctgggcccagcccaggggtttctgatgcagtagcccctggttgaggctgaggctgcttcctgggatctcactttgagaaccactgttacctggaaggtttgacaatttagatgcgtctattgtttcctcacaattagaatcagattaaaccaatgttaaactctctcactatttcggttcttcccatcgcatcccaccaggaggcataagatgcccgtttgctccattacttgtgatgctaacttggtcaaggtggtgtccctgcagtttctctaacagagacacagaaaataatcattcagaccagtgctcggtccctcattttaagatactgaactacggccgggcgcggtggctcacacctgtaatcccagcactttgggaggccaaggcgggcagatcacaaggtcaggagatcgagaccatcctggctaacacggtgaaaccccacctccactaaaaatacaaaaaattagccgggtgtggcggcgggcacctgtagtcccagctactcaggtgactgagacgagagactgaggcaggagaatggcgtgaacccgggaggcggagcttgcagtgagccaagatcgtgccactgcactccagcctgggcgacagagtgagactccgtctcaaaaaaaaaaaaaaaaaaaaaaaaaaaagatacagaactactaagatactaataaaggagttgaaaagaatgaagatgagccagcactgacctgtggacccagtatcggtaataaaggggaaggacgctgttgggccctttgtcctgaaactctttgatcagtttctccagcacagtcacgactctggcgatgagataatcggctcttaagggcttcagttctgccttgtgttgtttattgtattctgtgatgaggtcgttgatgcagatggtagggttactgttagtcacattaaatccacagcctggacaaaaacaaacaattgagcagctcagcctgttgatggcatcacacattcctctctgccacatggaaaaagttacagtcttgactgtcaacttcctccttccttgtcctcatttcagatttcgtgtctctaaccacttgaagagtgacatgtatttctgtccatcttcctttttgtccttcttttattattcttgttcaagctaaaaccatctcaaccttactgcaaataaaaaggtgggaaaaaagaaagccacatttgattcaatttaattcaatagaagctattaaatatgggacaaaacgtatcagtgttgcctctgaaataagtggtctaccaagcattgtagctctgcactgagtccaggagagaataaaatctctggtttcttctcctgcttgaataacagatcccacgcttgaaaatagagttttattcaggacttgggaagtaaactctggactcagagatttcaaaccttggtcatggcataaccctagaaatgcatcttttaatactttattcttggaagtctttggtgctaaggttacgctgttggcaagacgccgactcatgttcagtggctttttgcagggtcctaaaccaaggcttcatgagagttaccagggatggtgtctgaataggcttatctgtgcagttacttaacaccactatcctctccaggcagagggcggtgtcttcagaaaagctggacttcagtgttcagcagggccctgaatcggcctgcgagaggtcttcagtaagaaatgaaatactgcaaaaactaagcagtaagaaaactaccatgttttcagtgactttaagaaaaaaaatccccaaaacattcgccacaggcagaacaatgccatttgtaacaacagccttcccggcaagtgtcctgccgtttccagtgtgaagggaaggattgactggtctcagattttaaaacaatatactggctattaaaatacaaagcaattgtcaattacctctggaaaaaaaacaagtaactacagcaacaggggcaggacttgcagttgctcacgtattcattcattcaatacatacaggatctgaagcacctactgaacgttcgtaaggcattaaatcaagtgctgtacagcactgaaaattctcccgtgttcagaaaactggaattcctaggaggagtagcaacactcactactggccacttaggctatgtccttctaaggaccggtgagcaccctgctggctgctctgaatccccaaagtcagagaccccatcctatggccttcagaattcaataaaagctatgggttctcaccataggaaaatgtttcattcccctactttattttttatttttatttatttattttttggagacggggtctcactccagttgcccagactggagtgcagtggagccctcatagcgcactgcagcctcaacctcctgagctcaggtgattttcccatctcagcctcctgagtagctaggactacaggcaggcaccaccacgcccagctaattttttgtatttttagtggagacagggtttcgccatgtcactcaggctggtctcgatctcctggactcaagcaatccacccacctcaggctcctgaagtgctgggattacaggcattgagccaccacacctggcctattttttatgttttatttttgaaacagggtctcactctgtcatccagaatggagtggagtggctcgatcaaagctcactgtagccttgaactcctgggctcaagtgatctacctgcctcagtctcgcaagtagctgggattatgagctcaagccactacgcctggccttcgcttaccccacgctgataacatttgttagctccctgaagccatccatgagcctgcttgtggcccctacctaggaatctctgcatcaactgcaattactcacttaaagataggaaatgggggagactgggcaagtggctcacgtctgtaatgccagcactctgggaggccgaggcgggcggatcatgagttcaggagtttgataccagcctggccaacatagtgaaaccctgtgtctactaaaaatacaaaaaaattagctgggtgtggtggcgggcacctgttctcccagctacttgggaggctgaggcaaggagaatcacttgaacctgggaggcggaggctgcagtgagccgagattgcaccactgcattccagcccgggcaacagtgctggactccatttcaaaaaaaaaaaaagataggaaatggagctttaagggtatgaagtagcttgcctagaataatattgccccttggtggcagagctggtaacacaggccttgtattccctggctggcacttgaaacacatggttacatgttttttgaccattgctggtttctgaacacagattaggttctactgccacagagtgaggctgatgactggacggccaggaacctaaggacttctgagattgcctctgaatccatcttcttgcctgatttggatgtgctaaggtgaaacagggattctttaccccgccttgaccagcatggagcttcttctgaaggttaaaatgatgccagctctttcatggcccaggaaggtcacgataagaatgcaagacaccaggagaactatttaggaaattaacttttctttttcttattacagaatagaacgttaaatgtttattttcaccatttcaaattcaatgagtagcaggagtgtggaaggatgtaggaacatacctgtttgatgtgataccactttggtggttcccgtggtcacacacagaaaatgctaaaccctgtgaagtgctttcgaccaatctctctgcatctataccctgctccaaaactacaagactcaaagtaacctcatatgataatctgctcctgccaatgtaggcatgcataaaccgtctttatttttattgttttattaatctaaaaatgctgggggaaaggtttttgaaacttaccaataagtatataaaatgtttctcccatgagtgttgagttaaccagaactccgccgatcttcatgaggtcactgtaataaatatcgttgggccacttcactcgtaagttgatatcctaaagggaaatctgcacattaattaagccgtcacaggacacaaggggcccaggcaagtcactgagctaagggaagataagcagaaaccaaggtaacatgggcctcgtcctctcctctttttcaggcagctaatcacttctttgggacaatccgatattgaagtgcctcttggggccaggaggtaaaagccctgaagaacacagttgacataaaccccagcattcttccccatcccccagcactgtttctcatcatccaaaaccctttctgaagatgcttaccttgtaaatgaagttcattatgtcagtatccaccaccaccaccaccatggagtagctaactaacgtgctagggccagagggtggggagagaatagtaatctcagggggcgtctcccttcaggaacccatgcttgagagacaaagatggccctgaattaaccaaggtcacaaaaggcaggtagaaatgtcttgagtagcaggcagtggccaggcgcgctggctcacacctgtaatcccagcactttgggaggctgaggcgggcggatcacaaggtcaggagttcgagaccagtctggccaacatagtgaaaccccatctctgctaaaaatacaaaaaattagctgggtgtggtggtgtgcatctgtaatcccagctacttgagaggctgaggcaggagaattgtgcgaacccgggaggcggaggttgcagcgagccgagatcgtgccactgcactccagcccaggtgacagggcgagactctgtctcaaaaaaaaaaaaaaaagaatgctgtgaagatgcagaggagaaattcaccttagcgaaagcctcgcagaactgctaatggtcatcttgggtaatggaactggacttgtcatgtggcctattgcctctgcgtcttgaatggtgtggcctgggggtgggggggctctccctgtcatcagcttacagaatggaccaacactggacagtgtctcgaacaaggccacccaggcctctgcctatccactgtgactctgaagttgggacacagagacggggctagccgagtgggtgtcagaaccaccaggtcttttagacctcgggctggcagccaggctgtgccatgtgtgggtaaaggaagcctgtctggagatgcaaggctggaagagaacattcagcaaaataaagctaagggagcagagagtagctgatggcctccaagggccacggggctggtcttcccacgttgcaggccgggcatggcaccaagcaccttctcagcattagtctacgtgttactcacacccagcctatgtgttggtgctagcgcatccccagggaacagagggagaaacggaagcttagagaaattatgtggcttgcctgaggttatagcacttgaaagccacggagctaaaattcaaacctttctgccaccaggcctgggtgaggaatcctatgctacgcggcctgttgcttccatgaaatcccttcctccttccaacaggccttcttttgacttcggcccgttagagcatattggaagctcatctgccctaaaacagtagtttaggctgagagaaaaaatacaggaataggagcacaggagaacaaaaagtctaagtaaaccaagcatggggggtgcgcaatgacccagaactgatcaacagcttcacgtttcttttctctctagaacgggggttctcagtgggagaggggtggatttggcgatactgggagacttccctggttgtcacagcctgagggagtgctaccggcgtctagagagtagaggccgcaatgctgacacacatcctttaaggcacaggacatccccacgacaaacatgccagggcccacatatcaatagcactgggctgagaaagtctcctctaggaaacctgtgtctaggaggctctgctcttcatcactgcccccagttccctttccttcccctctctcgccttcccacatccccctgtgcccaccacatggccaggggaatgagcccctgcctcgccggcgggaggacacctgcagagttcccagagctgtcaagctcctccgccacgtgcgtggcagctggtgcctgggcgggccctgcacttgggctccagctcgccttcatggcttcagatctcctcggctcatgaagcagctcatgaaactctgggttctcacgcaggtaaacaggaccagcatttccacatgaagaggaggactgtgtgctcatttttcattttctcaatcatttattccaacagctgctgtgatcctcccacataaaaaaagaccaaaatgaaacaaatcctgcttttgaagagctgctaacatcatgggagacggaacaggtgcacacatcactcctcttcaaagccacacgtggtggataccctaaaagaggcttcaacatggcaagtgctggacagtgctggaggaaagagctggaagtagctggagggtctgagaatggcactggagctgggccttaaggatgaacagaattttaagaagcagagaagagagcaggggtaggggtgtgtgggtggagggagggtgcggggcccggggggacttcatggacagaagaaagagcaggagtgagaatgggcggcccaaggcgagttccggaaggaatgcctgcatcccagcgaggccgccttgggtctggggagggtggtcatgatttgtgtgctgacggtgacatctggttagggaccagttggggtcctagtgaaggccacacaaaaagtgaaatccaaacaacaggggcctatttcaatcaaagtagctgcactgtgtcagctaacttgactatgttaaaaaagaaacccaattcaaaatcaaatgtcccatcacacaggtgaggctgggtagctgactgcagaagagggaaagaacattggtacaagcttcttaaggagaacgggaacacaaattcccccgaccccgttcaccgctgaaggcaagcttcccacttccatcctggcctccagcgcctggcgcacgcagcctctgagcacagcaggccctcaaagaatgctcgctaagggaactagtggggctccaaggtcaaagtcagagccatgaaaaagctaaacagaccaaacagactcatttaatgttctcggcttagtgtttgttttagttattttcctaagactaacttgttgctagagttaatttctcccatgacaggactttctttcttcctttttttgatacgagtctcactctgtcgtccaggctggagtgcaatggcacaatctcggctcaccgcaacctctgcctcccgagttcaagcgattcttgtgcctcagcctcccgagtagctgagattacaggcacccatcaccatgtctggctactttttgtgtttttagtagagatggggtttcaccatgttggccaggctggtctcaaactcctgccctcctcaacctcccaaagtgctgggattacaggcatgagccaccgcgcctggccaggactttctattttgattgcttcctgctagacagaatgcacagctcaggtgctcaaggccgggcacctgaagccctgtaatggtgtgatgcccccaaaccatcagatatgcaaggatgctgggtgcctggtagtaagcgtccgtttcagcgatgtgatgtaatacaggaaacagagacgtcagcattaactacatctgtggaataccaaaaattcatacacagcaaatacatcacagagggatttaaggggcagtgagaaggaccttttcttcaatgaaatgatgacaggacctccaagtctcctttgagagtcacgctcttaacatcttgcttcaggaatcaatccaatcatttctctttagcctgacataggagctgctgggggagggaggcaggaatctcctatttatacccatatgaaattcttccaggaacatttgggagggggctatgggaagtgaagcccaagtagggaagaaaatgcttcggtcactgagctaattgttccctgttgcttgtctttttaataactgacaacaaaacatccaacagtaataaggaagcaggcacacgggtcctaatagctgggggaagatggccccaagtggatctgcacattgtatgtggtcaacagtggataaaggatagttctgttagagcacagagtctggtaaacagaagtaggaaatgagaaaggtttttaggtccccaaataacccttttcaacagaaaatgcagatgaacaacttcaatccagtccaacaatcaaatctcatccagtgcttcaaacaaaaaacaaacatgcagctgggcgtggtggctcacgcctgtaatcccaacactttgggaggctgaggcgggcggatcacaaggtcaagagattgagaccatcctggccaacatggtgaaactccatctctactaacaacacaaaaactagctgtgtgtgatggtgcacacctgtagtcccagctactcaggaggctgaggcaggggaattgcttgaaccctggaggcggagattgcagtgagccgagatggcgccactgcactccagcttggtgacaaagtgagactctgtctcaaaaaaataaatacataagtaaacatgaccaggtgcagtggctcatgcctataatcccagaactttgggaagctgaagcaggcagactgcttgagctcaggacttcaagaccagcctgggccacatggtgaaaccccatctctactaaaaatacaacaaaagagccaggggtggtggtgtgtacctatggtcccagctactcgggaggctgaggtgtgaggattgcttaagactggaaggtggaggttgcagtgagccgagatagtgccactgcactccagcgtgggtgacagagtgagaccctgtctcaattaaaataaataaataaacaacaacaaaaaccaaaaactaaagcgttgccctcatcaggctgtttgagaaatctgaaaaactgggtagaaagggagttctggggaatgaatgcattcaggcaagcctgaagcagcattagcacctggtggtgctctgaaaactccgagagcactttgctgccagctgtgcaaagggtaggctgaggttctacagccaccaattatgcaagcacatgctataaacaagaataagccagattctgcatgcatcccagggacatagaaggagactgaactgtacctacctgatactcgggaatggacctcactgcttccacgacagccacggacatcagatgctggacaaacgggatcctctgtcccagctgggatctcagtggaatggagatgagcagagtagaaagagcacatcccacagggctcagccacacattccctccccgtcctggaacacaggccacagtgggaaacatgctaccttgccacgtggacagacgcagacacacgtcatgccagggccacacactcaaataaatctgaacttattacaatgcttattgtattacaacgcttattatattctgggcttaataaaagaaaagctttttaaaatctgaagctctgttgctgaaaaagtttccaataattagcataatgttctgcttctgtgagcatatcatttgtgccttgatgactcagagtcttacagcgtctgaacatgactatatgactataggtttaattcccagcatatggtcatgaaggcaaacacagacattgggaaactgaactgaatctatactgatccatgagaggtcctggaagccactgtttagaagcaattcctattgtggcgatggttgctcagcccagcaaatatgccattaaataagagccacagaactgtgtactttatttatttttattattattttttaagatggagtctcactatgccacccaggttggagtgcagtgcgtgtgatctcagctcactgcaacctctgcctcctgggttcaagtgattctcctgcctcagcctcccaagtaactgggattaaggtgcccgccaccattcccaggtaagttttgtatttttagtagagacagggtttcaccatgttggtcaggctggtcttgaactcctgacttcaagttatctgcccgcctcggcctcccaaagtgttgggattacaggcatgagccaccacgcccagccacactttaaatggaggaattatatttcaataaagctgtttaaaaagggattcctgatattaactgagttgttatttttctttacttcctttctttcttcctttttatttttgagacagggtcttgctctgttgcctaggctggaatgcagtggcgtgattacagctcactgggctcaagtgatgctcccacctcaggctcccaagtagttgggactacaggtgagtaccaccatgcccggctgatttttgtattttttttaagagatgggtcttgctaagttgtcccagctggtcttgaactcctgggctcaagtgatcttctgccttggcctctcaaagtggtgggattataggcatgagccactatgcctggcctacttttcttaaaattgaagttagaaaaatagaagaatccaaatgagaggtagagttcatcaaagttcttcttgaatgtctttttcaaaaaacaaaaaaaaaatccacatattgagatccatagcttttgacaaaaacattttttttttccatttgaattatatttgaaagacatggttcaggagaaagaagtggagaacagcagatttcttatttctttggttcttatgaaaaagtcataagaggctgtgagagtgagaagcacatgtgggtgagcctggcactggctggagcagggaggggccaagccccgtggagcagcccctgtacagggtcagaccccagatgggtctgggaggatgtgggctctcgtctccgggatctgcaggtggtggagccctgggcagcgctctgcttctctgtggtcactgtgtgaatgggcactgatgcagagcccaccatgtacatgcaagcccagcccagggccagctggggtgagaactggcatgcaaaaggcctcccacatgacgctcagtacagacacagaaggctccttatggagaaccttcaggaaaataaacgtctctagagcacagtgacgatccccaaattggaaagcccggaattcatgtaggtcacatttgccatcacaggcaaatgtccagtgattcataagcattatgatttgacagaatgctttagttctactaagggtgaaccttctgatcactgcttccctcttcctcttcctccattccaggcggttatgaaaacagaatctactaacttgagtcccccagatgatcagcacacacattcaatgggctcctgggccacaagagttgcagagtttagaaaacagaagtaacagcaatgatcacaaaagatgactgacctttgccctcggtctgccgggccgcgatcactattaagcccatttcctgcggtgtctgaaacatcagcctgccgaagagggggaaagaccggttaggccagacatggacacgcccgcggcaccaatggctcacacaggagggacagggtttgcatgcatctgggggtgtgtggccatggaagggccaactttggttccactggccttcaggaatgtggagccatgagggatatcaccctcctttctaacctgggtcgtgagaatgaaagagatgaagaaagcaccttttaacatcaaaaaaagagcatgcgagggggcgtgtgtacctgcctgagccgttactccatttattaaagacttggttagattctatttcatcagaatatcctgccaagttctttctccccccacccccaatgtatgtaccttcttcaagtgacaactagcaattcctgacatttgttcctacttagggtgcacttctgtttgaacactagaacacaatcataacagaagtttctgattattcagaaaaccaatatggtggcaataaagccgtttaaaagacacactatcccctgagaactaattatgatttaactatggtaaataaatccacaccttctgaggacgcaggagaactctgcatcgttttcggcttcagtcctgcttttaaaatggtttcattgaaaagaatacaaactttcctttgggggataggtagaaaagggcattacatccccaccaaatgagtcgatattaactttttttcaaaaaaaggaaagaaaaaaaaatcacacaaaaactcccactctgagaatttcctgcaagctgcgctctccctattttaaccccgtggtaggacagttcctctctacgtgcccaggaattgccgatcaggtgctgcgcaggcgcggttcgaggtaggattcatcaacagagcaaagatcaggtttggccactttgtcagtgcagatgagggggcctctttgatttttttcttttcttttctttcttggaaggaggggagcagccaggacagggatgcggaagggatggcattttgtaataacataaagtttctaataataagtctccaggcttccacagtggtcctgctgaggacaaaggagcgctagagaaagaccacgctgagaagcttatcatcctcccctcccagctacagaaactgggtggaactttacaaatggctggaactcggtaagagaagaaaaatacttaaaagcagagagaaacaacactgtgtccactgtgcacccatggctcacagagctccgtctgacggcgcatgcaggcctcagttgggacagaaggagcccagaagacccttcacgtgttaaaaagacctcaggacacacagggcaggggctcagctgctgagatagctgtcttcccacacggctgctggaacaggcacaggacgctttcggcgagcaggctggcctcgccgcccatgtgccaggcccactccatctcacatgaaatacagctcagaagtatttctcttggacgccatgaataactcattgagatcgagtgtgctgtatgccactgggtccaagaagaaagcgtccttttcttgtgttggaccagcagaaaatctaagaaggagtctttgtctgtgcagggagttaacattgtctttcaggcacctctgttttctagagggtccagcaaccctccacctggcttcctaaggcccagggctctcgaggtgatggggcaggggccgaggggatgatttagcgtgttgtgagcagatcgcaaaagcaatctaggatgttctgtaaataaacatgtagacggtagacagtcatgggctatagccagggacagtgatgggaggggcaggaaaaaggttggttcagaaaccaaacacagacttctagaacaaagagaaatgattaagggaacatatgcactaaactgctagaggtttggcagcagttaacagggcatattaatgagaagagggagtctgtgctgaaggccaagaggaaattctgcaaggagggagacaaccggggaaggagctaatgctcagtttgagacaactggaggccgccagatttatttgtgctatctgagataactctggggccaaaccgcatggctcacagtcaacaaagcagcatttataaaccttgtcaattctgcatttctgaaaatgaagctgcttgagtttgctttagcagaaaggagaaaccataaatgcatttccatccttagcggatgatgtccttacaaaaagaaaaaggaaaaacaaaaaggaggggggttccataatgattacctccctgcttctgtatattttccttccttgctggcaaaggttgtggaataaaagctttctgtgagtggcagccgagtgcattcactgtggaaccaaagcggcactcaggaaaagcgctctgttttgtactcttgtgttgagtctgaaacatttggagcctcctaagggtcactctgcaaatgagacagcctcctgaccactttggttactaaggacagcccagtagccacggaggctctgccaatggaactgtcctgattgtcacatggtcctttaagattaagctttaatgattgggaataacctaagacaggccagcatgaattaatgaaaaatccgaatgaacaaaaacgtaaattcagaccaagtccatccacttcggggatctgaacctaagaaaatagtccacattcacaacagtgttataaaggtaaaaatatggaaacaacctcactgttaataaacaaatggttaaataaattctgataaattaagtcaatggaataatttgtaatcaaatcattatagttctgaagactatatagcaacgtggaagaaaggcttgcattggtatgtcaaattaaaaagcagcatacaaaactatagatgcttttttttttttttttttttttgagatgcagtctcactctgtcgcccaggctagagtgcagtggcatgaatctcgggtcactgcaacctccatctccaaggtttaagcaattctcctgcctcagcctcccgaatagctgggattacaggtgtgcaccaccatgcccaacaaatttttgtatttttagtagagacgaggtttcatcatgttggccaggctggtcttgaactcctggcctcaagcgatcctcctgcttcagcctcccaaagtgctgggattacaggtgtaagccaccacgcctggccaaaaactacatatacttttattccaagtatgtaaaattcaaaaagggcaggaaggagattagacaaaatgttaatgatggctatattaagattttttttcttttattttaaaactttaatatgatgggtaacctttctttttttttttcgtttgagatggggtcttattctgtcatctcagctagagtgcagtgactcactatagcctggacctccagggctcaagggatcctcccacctcaacttcctgaatagctgggaccactatgggttcataccaccacacctggctaatttttgtattttttggtagagacagggtttggtagagcccaggctgggtaaccttttgatttaaaatttattttgaattttttttggaaaaaagcatatttttacatttagatataatattgtaattgactattcataaatacagaacttctaagtataagaccaaaaggtccgttttaaaaagaaataagacaattggccgggcgtggtggttcccgcctgtaatcccagcactttgcgaggccgaggcaggcggatcacgaggtcaggagatcaagaccatcctggctaacacggtgaaaccccgtctctactaaaaatacaaaaaaattagctgggcatggtggcgggtgcctgtaatcccagctactcgggaggctgaggcaggagaatggcgtgaacccgggaggcagagattgcagtgagccaaggttgcaccactgcactccagcctgggcgacagagcgagactccgtctcaaataaataaataaataaataaataaatataaaataaaataaaaagaaacaagacaatcaacaatagttatttgcagtacccatttcattataactagtgagcagcttatctgatactaacaagtgagcagaaattcttgaaaccagtctgttcagacccagtgatagccttaaacatggtttacttcctgacccggggactgtatttctacagaattgaagcctgaggaggactcagacagggacacaaaataattcaggggctcaactgttcaccacagcattactgatgcagtgtgaaaaatcagaaataatccaaacagcccactgttgaagaattaaaaaacccacagcagtcccacatgaaagcccatcatgtggtcatcagtaatgtgggcagatgaccaccggacacttttaggtgatttaatcaggatgcaaaatcctacagacagcgtgagtccaatcatgttttgaagtatgcttttaaaaattatggccgggcgcggtggctcacgcctataatcccagcactttgggaggccgagacgggcagatcacttgaggtcaggagttcgggaccagctggccaacatggtgaaaccccatctctattaaaaatacaaaaaattagccgggtgtggtggcgggtgcctgtaatcccagctatgtgggagattgaggcaggagaatcacttgaacccagggggcggaggctgcagtcagctgagatcacaccactgcactccagcctaggcaacatagagactccaactcaaaaaaaaaaaacaaaaattattaggaaatataccaaaataatagctgcagttaccttggggagtgaacatatttgaaaaatatagaaaaatattaagtagaacataagtcatctaggtaagtcccacttctcattaaaagtgtatattcttttagaatttctctctttttagaaaacacagatatattttacaaagtatttttctgataattaaaaattttttattttggagctcttacaatgatgtagatatataattatagacattatattgttaaaaagtgaaaaagaaggttaaaaacagtatcgtagaatgattctctttatatacgatatgtatttatagaaaaatacaggggccaggctcagtggctcatgcttgtaatcccagcactttgggaggctgaggtgggtggatcacttgagcccaggagttcaagagcagcttaggccacatggcaaaaccccatgtctatcaaaaaatacaaaaatttagccaggcatggaggtacatgcctgtggttccagctacttgggaggctgagatgggaggatcacttgaggcagggagttcaaggctgcagtgagcaaagatcatgccactgcactccagcctgggcaacagagcaagacactgtctcaaaaaaaaaaaaaaaaaaaaagaaggacacatattaacagtggttatctcaagaaggtggaagaggccgggcgtgttggttcacgcctgtaatcccaacactttgggaggccaaggcgggcagatcacgaggtcaagagatcgagaccatcctggccaacagagtgaaacctgtctcactaaaaatacagaaattagctgggcatggtggcgcgcacctgtagtcccagctactcgagaggctgaggcaggaaaatggcttgaacctgggaggcagaggttgcagtgagccaagattgtcccactgcactccagccaggtgacagaacaagactccatctcaaaaaaaaaaaaaaaaaggtggaagtgtggaagtagaattatatgatgatttaaatgtctcctttatgttgttctatataatctctgggtggtaagatttcaagtgatttttatttctctcttatactttactgaattttccaatatttttataattgtagtgcattcattttataaatcctattaaaaaaagatttatttaagcccaacctatcagtggattaagcttgcagctgccagttcactagttggtggagcaatctcctttccagcacagattggcaaagaaagggcggccaagtgcaggcagctttcccaggctgccatacctgtcccgtggctcattccctgccgcacaggccaaggccacggagggctggcagtctgccactgggagcagctggcctctggaagctgggctgtacctcagactggcctccctttctaaaagatgttgtaaagtctttctctggaaaacacaccccaaaccctcctaagtctgaggcatcgtgccctgcagcagtctggcatggggtgggtgtgaggcgacctcgaagtctccctcgggcctggagggcttcctcagctcatggtcctggcctgacaccagtctgtgcttctctttgctatcttctttaccccccagttttctcagctctgaccctgttcttagcttacagagagacacacactctcatgagtgaaaaagaaagccaatgggaggtggcgaggaagagggagaagggggccccaggcagtcacacattgaaggttcataagttatttttcattttaaaaaagctgactggaagatgaattcccactgttcataaccctgctgccctctgcttagttcaaaggaagcagtgccgaacttcatttcagaactacttttaacacatattacattgtaaaaaccaaccattacatctgagtagcactttctaaaaagttaaaacgctaaaatatcaagatatttcatttttgttaaagtcacactttaacaatacgattgattttttttaagctactttctaggcaggaatgcacaagattgttttttgaaaggaaatgaacagtggtttctgctaaaaaacgcctccaccgtaaaatggagtgaggcccatgagacagctgtgcaacgcatggggacacagtcaggggcagaagaggcccgacttctgacaggtgacttctgaactggcggcagggtccacggcacaaagctgaggtggctgccccaggacactgcagggtcctagccagggaccctggggatattattcctggcagctacaggaaggttcccaaggaactttagaaacatcacagcagagtggagactcagacagggaacgggacagatctggactcgaatcccagtgttgatatgaacatggagtaagggaatccatctctctcagtctctccagtcacctataaaatggaacattttgtgcagtgtcagtaaaaatgaaatatgatggaatttgcaaagtggtccctgtcatgtcgatcctagaacttcttgctgccagaagacaagcagcgcctccccttacctcctcctcttggggataaggagggaagtcagggagacagagggaaggaatggaatggtggggacaaatgtgtgtgttttacgactcctcaaaaattctatacgtgatgcctctcctctctgtacccatccctcatcacttctacctacacacactaaggtgatctctatctgggctaaaaaccttgtaagtgacactagcaatgggggatgcagaatcttcacttccagttctagggtctctgaacctactcagcaaagctacacatagttggttgaactggctcttcggctgactttgtttaggtgactgcttagaaacactgttggtcagaggtgtgcccaggcagataatagaacagttttattgatatattcttccattctattctggatttgacactacggcctgccctttcctcaatgcactctgttggtatgctttaaatcatatcccctttccgctcttggtgtagaacaggatgaatgtttcagtaggaggcaacacgggaatcgggactgttcaaagagcagagccatcacaatcctcccactggagctccccagaagcagagagatgcctgtgggtcaggccctctgttagagacacccgcttcatttccgtagctcctggcatacctgcccttcttacgtttttggctaatcttccccacgtccagcataagagcgtccacattgctgctaaataaatcatttcatggctcccaaggagcccagtggattcagctttcagaatgaggctcctttttggtaagtcaagcatttactaatgttggtctgtattatccaatcaaagtgaatacaagccactgtttcttaccctgacacttcaccataaatactagatgcctgcgcatccactgccttctatcttaaactggtgctattacagaatttacagatgagcaaagaagcttgcatagagagaaatattcatggtgcccacagccacctctgtggctgtacctcagcggtagccctgatggcagatccctgcctctgacggcgagccttcactgcgccactgcacaccagtactcagactatctgtccccactcctccgccaggagtctccggatcctccacaagatcttctcaccccccttttcaggctgttcagatctcataaatatgtccatttttctacaactgggtgtggagcggctcttggtggagagtgtccacagccttgaccataagtcacctgcccctaaagagggtctgctactgggaagtgctgccgctatttcagaggatggacaccgactcacgtggacgacacagcaagcagatgtctgcgaacagtgtttctgcaggcaccaggtagatgtttcaactggtcacctggaattcacaccaattttttgtgctatgagtggcattttaggttcgtgatctcatccaagccttccaaagctgagaagaagtccttcctcacagacaagaggacacagtctcagaaaggcaaaaccactgctataaagccacatagcaagcaaaccagaaattcaaatcatgttctggttggttgtaaggtctataatacttttttctttttaaccttttacttcgaaataatatcagacttaaagaaaagttacaggaagagtacaaagcattcctacatgcccttcacacagcacccagatttcctaaaggttcactttttaccatatatgttttgtccatctgtctatccatcattattttctgaaccagttgagagtgagctgcagccctaatgtctctgtattcctatatgcgtctgtgtagcttcctaaaacccagggtttatcttacctgattatagtacaatcacggaaatcaacagccttgttacaacactattttatgcttttttttttcttttgagatggagtttcactctgtcacccaggttagagtgcagtggcacaatctaagctcactgcaacctccgcctcccaggtttaagcgattctcctgcctcagcctcctgagtagctgggattacaggcgtgcaccaccatgcccggctaatttttgtatttttagtagagatggggtttcaccacgttggttgggctggtctcgaactcctgaccttgtgatccacccatctcagccccccaaagtgctgggattacaggcgtgagccaccgcacccggctgatatggcactattatctaatccagaggtcagcagaattctctataaaaggtcagagagtaaatactgtaggctctgcagccgtatggtttctgtgctcaattgctcaaacctgccgtccgagggcaaaggcagccatgcctgtgtctcaacatttacggacataaaaatttgaattttacataatgtttgtgtatcacaatatattccttttaactaataggcttttttattttttttagagcaactttaggtttacagaaaaattgtgcagaaagagttcccatatgtccccttccccaacagtttccttatcattcacatcttgctgtggtgtggtcatttgttacgatttctgaagcagtcttggtataggactattaaccacagctcactgcttctgttagggttcgtgctttgtgctgtacattctgtgggttttgataaatgcatcgcatcttgtggccaccatgtcagcattacacagaacagtttccctgccctaaaaattcccctgtgcttcacttattcatccctcatcccttcccctccccgaaccctttggcaaccaccggtatttttactctctctatagttttgcctttcccaaagtgtcatataaattttattctttaaaattttttctgaccctttaaaatgtaaaaaaacatgcttagctctcatgcggcacgaaaactggcagcaggccagactcggcccaagggccaaactttgccaaccccagatctcatctatagagtgtattcaaattgtgtccattgtcctagtaataatgctctttttttctggtctaagatcaaatccaggatcatctgatgcattgagctgtcacggcttcttcgtctcctttaatctggttcagtttcttagtctttttgtttttcatgatccagacatttttggaagagcaggggcagttattttgtcctatgtccctcaatttagataatcagatacccccgttataagactcaggggtgcatttctagcaggaatacatggaagcgatattgtgacctcagggcctgacatcgggaggcaggcagtgctgtctcctgacatcagggatgttaactttgacccacagggttatgtggtttgtgctgggttttcccactaaattgcctttgtaattaataagcacttatggggagataaatctatttctcatgaaatttaatctattagttttagtatccatgaatgattcttgcttgaatcaattattatttttatttattttttatttttttggagacacagtctcgctctgtcgcccaggctggagtgcagtggcacgatctcagctcactgcaagctccacctcccgggttcacaccattctcctgcctcagcctcccaagtagctgggactacaggcgcccgccaccacgcccggctaatttttttgtatttttagtagagatggggtttcaccatgttagccaggatggtcttgatctcctgcccttgtgatccgcccacctctgcctcccaaagtgctgggattacaggcgtgagccactgtgcctggctgcttgaatcaattattattattattttttgagacagagtctcactctatcacccaggctggaatgcagtggtgcagcctccactcactgcaacccctgcctcctgggttcaggcgattctcctgccacagcctcccgagtagctgggattacaggtgtgcaccaccatacccagctaatttttgtattttagtacagacagggtttctccatgttgaccaggctggtctctaactcccgacctcaggcgattcacccgcctcggcctcccaaagtgctgagattacaggtgtgagccaccgtgcctggccttgaatcaattatttacttgatggttgccaaacagatttttctgaaccatcatttcttccatattcacttgtgaggttctactgtaaggagtaactttttcttctcccctccacttattatttatcttttaatttatttatatcagagtagacttatagattcttattatttcagtagattgtatgccttcctatcattttttattttgatactcaaatagccacatatctggcaagtgaatgctccttcagtctggctcctgggtcttactggtgtgtcccagtcatctttcagcataagaggtctctactttcaggcataagaggttctaggctcatcttgaactttctcagcccctgccctggaatcagcgatttctccaaggagctctggttccttttggtgaaaaacggtcttttaaaaaaactggggctaagaaagagatagaaaatgtgtgcatgtgtgtctagggtgtatatatgcattacaattgtcccttggtattcatggaggatttgttccagactgcctcccaagtcccacagtgagctctgtggaacctgagtacacaaaaaattggcctccatatacatgggtttcacatcccatgaataatctgctttggttgaaaaaattccatgtgtagtagacccctgcagttcatacccctgatgaatcaaaggtcaactgtatttccttccgtccatccatccctccctccttccttccttccctccttccttctttctttcttccttcctctagattctcatcttctttctctatctaatctatccatctaccacccatccatccatccagtttgaaaaccataagttcatcataaactccaatccaatccaataccacaaggttcattctagcccctccttttctatattcataaattctttctccaatagtgggaaatctggcttgcattatctacactatttattcatttgctcaatgccataatacacagggggaagtggtctcagcagtgctgatccatattactgcgaaatcacacttactaactagagttcaatatttgtttacagttttttttgcccttagcctgagggtatagattcaaatattgtattgaacatttccttggatttgttcttttttttttcccctttactttagtgtggttattttatttgtctgaaatcaggttaggtttaactgtacttctatattacattttacccccacacccaaaccccaccaatccttctttctttttcattgtttaacctggttcagagtcggaactgtacacagacaagtatactccgagaagtgtcacactcccctacccattccttctacctaggtctcccactccacctcctttctgtaaaccacaaatcaaaatctcattcatttctggtttattcttcctgtgttcctttttgcacaaatgaatggatacatgcatattttcttatttccttgtcttccttacagaaagttaccattttgtagatgctcttttgtctcccccatccacctaccccacacaattaatatacccgggaaccactaggttgcatactccttatgagaatctaaggcctgatgatctgaggtggagctgaggcggtgttgctagtgctggggagcagctgcaaataagttcatagagcttttcctcattttttctttttttcagacggagtctcactctgttgcccaggctggagtgcagtggcgcgatcccaggttcacaccattctcctgcctcagcctcccaagtagctggaactacaggtgcccaccaccacgcctggctttttttttgtatttttagtagagatggggtttcaccatgttagccaggatggtctcgatctcctgacctcgtgatccgcctgcctcagcctcccaaagtgctgggattacaggcataagccaccgcacccggctcctcatttcttcttaaagctgagcagactccattctgtggatgtagcacagcctcttcaaccactcttttatgtataggcatttaggtagttcctaaaaggacagtataatgaacactcttattcgcatggatttttatattgctggaggtatatcttcagggtaaattgctggaagtgggatgctgagccagaaggtaaacacactggtagctttatcagattctgccagaacccccactactgcacacagccgcgcagagatacctgtttccctacagcctaaccaatggacagtggcgtgtgtctgtgcatgtgcgtgtgtatacacagtcaatgaccagttaatgtcttttgagttaactcaaaagttaagagtttcttatatattagggcagagtccccagctctgccccacccccccaccccccaggctgcacagcaggaggtgagaagcaggcaggcaggtgagtaagaaagctagaaaagcttcctctgtatttacagccgctccccacagctcacgttaccacctgagctccacttcctgtcagatcagcggcagcattagattctcataggagccctactgtgaactgcgcatgcaagggatctaggttgcatactccttatgagaatctaaggcctgatgatctgaggtggagctgaggcggaggttgcagtgagctgagatcatgccattgcactccagcctagacaacaggagcgtgaaactctgtctcaaaaaaaaaaaaaaaaaagccttgatggtatttttagtctaagtgcattaaatgtataaattaacttggggagaactgaccatctttgtgattttgagttgtcctacctatgagcaaaggatgacttacatttgttcaaatatacttttgtgtctttcagattgttttaaagtgatcttgtgttgattgtgcatatttcttatgcactatcttacgtattttatcttatttgttgctattatgaatatatcccataatttcctttaactagttattgcttgttgtatataaaaactattgatttctgtataataattttatatcctgctctattactgaattctcttattgtttgagttagagaatcactgattctttaaggtttctcatttcctctgcaaacagatagttttacttctttttcaatgatacctttaattgacttctcttgtctgtttggattggctaatacctttagtacaatgccaaacagaggtggagacagtgggcctccttgccatgtttcttagtgtttccctgctatataagatgctatctaggactcacagacacttacaagtcagtaaattatccactaagtcctatttttggaatttttaaaaatcaggacagggtgttgaattttataaagtgttttctcagtatctatggaaataatcatacatttttcttttttgatctattaacatattaatgagttaagagatctattaatttttttaatattaaaccaatcttgcattcctagaaaaaaaaatcacatttgtcttaatgttagattctgttagttaatatttatttagaatttctgcattgatgctcattagtgatactggcctgtaatttttatactgtctttaacagatttaagtatcaatattatttacttcattgaaatgaatttgaaaattttccttcatttttgatgagcccatcctttttccactgaagtactccttctgaggaagactaaaaaaaaatttctgccaatgatcctgtaggaaaattccaaaagaaacctttttgatttcttcttgaaatagctttcagaactcctgttctcaatcaaatatctttgcacctacaggtctatgtgaggtacttgcagcacatgggtagtaagacaatgagtttatattaatgtggactacatttaagaatctacatataagaaccttaactgaggctttaccttaatactccagacaaacaggctggagacctgacctccttaagaggtctggaccagttctggtagagatcagcccagaatgaccaggcctctgaacattccacaaaacgtgttccatggagagggtgtagaggagaatagggagcattaccgaacagcaaaggaaaacactttaagactctcctcaaccatttccattaaaatttcagaaacaggccaggtgcagtggctcatgcctgtaatcccagcacttttggaggccgaggcaggtggatcacctgaggtcaggagtttgagaccaacgtggccaacatagtgaaaccccatctctactaaaaatactactaaaatactactaaaaattagctgagcatagtggcaggcacctgtagtcctagatactcacgaggctgaggcacaagaatcacttgaacttgggaggcagagactgccgagatcacaccactgcactccagcctgggcgacagagtgagactctgtctccgaaaaaaaccaaaaccaaaacaaagaaaacctccagaaacagatgagaacatatttagatgttttgtattgtattaatactttttgctcaattttaacaaatgcctcagtctttgctaggagctacccacctcaacaagcatgggttcctggccataccatcaaggtcacagaggcaaagctgcctccagagctaggctctcaaacaatgctgcccatcagaatcgcctgcagttttaaaacacaaagcaaaaacaaactgatgctaagaccccagataccctctgaatcccaacctccagagccagagcttgggtgtgtcccagatgattagaatgcagctggtccaaagactggggttctaaaaccactgttcccaaagctatttttcaatgacttttttaaaactacatttcttttaaaaaatttccagagctacaacatcaaagaggcagtaattctcttctggttccttcaatgattgaaatgaagcatcgcattattttgatatttactaggacggcacaacaacagtcccacagatggagagatttcattttctagagccagagggtggtaggtagtcgaggaaaaggaaaaaggggaaaggaacaaagaactggcattcggacacaaagtgtgcaccacaaagtgccattacgtgcaagacagccacttagtgtgtctgaatccctgttggtgttctgtctccctacagtggcttcattcgcgatcaccagatgtcaggtctgccagatgtcgtttttagcaccatgaagcatagcaagggctggtgtctcgcacacacacaagcatgtgtgcacatgcacacacacacatgcacatacacacacacacatacatgcacaaatccacacacacacacacttgattgccacctcaatatggcaggcttccaacagtgagcacaccagccaacatggcaccatctttccactcactgtaagatttctccaaggtcttataaatgaatgaatgaacgggccatggggaaggggtatcttcagctatagatctcaagattctacactgcaagcaagccagtggttcctttgactgagcacccatccacatgctgggcccttggtatgagccatgttctcatttaaatgtcccagtgactctcaagacatcatcattgccaagtagtctcattttactgctgataagtggaagctacaccgcagaagtggcctggtgagatcagagaacagtcaaccaggtttgcctggctcagaggcccatcttctgactcactaggaaagaatcttttgcttttatcaaaacagaatttcaaggtagaaataccacctcttttttttttttttttttttaatgagacagagtcttgctcttcacccagcctggagtgcagcggcactatctcagctcactgaaccctctacctcccaggttcgagcaattctcgtgcctcagccacctaagtagctgggactacaggcatgtgccaccatgcttggctaatttttgtatttttagtagagatcgggttttgccatgttggccaggctggtcttgaactcctgacctcaggtgatccacccacctcagcttccgaaagtgctaggattacaggcgtgagccaccatgcccggccggccagcctcttaaaatgcatttgtgtaagtttaacagtcctggaggctataaggctttctagaaagatctggaaattgacttccaaataataacatcaaaatggggttcttgctttatctttttttctgagaactgaaacagagtcaccttacattttctaaaagtaaatactaccagcttggtggccaagttcatcagttctgtgctatgtgtctgaacagttattttcccagctctgtacgtattctgcttcaaatacttcattttcccttatgaaatttacataaattataatactaataagaagtttctttacctacagagtgaaggggcatctgaaacacctgggcaaacaaaggaacctgaaggtaacgaattccttcctacagaagggcagctccacccggccacttgggcccttgattttaccccaggtaccgtcgccttcggggtaatgacaaggaagaatgccctgccctgccagctggcctgaaaaccagtgtgcctttcaccaccctgacgccctgtgtgtcaccttcctctttccctctctcggctcccacctctcttcagagccttccctgcaccccgccctgccagagatcaaccaacacgccagagctcgtttgccgggatgcttagcaccagcttaactcttcactcagtgggacaaggggcctctttctttcaggcagggctttgctccatgacacgctgggtttatggcccccgtgaacgaaacctggttcggaatccaattctacaacagattttcgttcaaatggttattttccatcccttgcccccaattccattttctacccatctctcccggctctctgcctgtgggggctgaccccttgagacctgggtggattcgtgcttctgggtgggttctgtgctggcaagacattttatatcctgttctcttactgaatccttgtactgtttgtttagtttgatcgtttattctcaaggtttcccagatatactacaatatcatccacagatagagttttacttcttttctgattcttaggtctccagttggcttccgtgtccacttggattgggtaatacctccaggatgatgctaagtattatagaagtggaggcagtgggtgtatcctggccttgttcctcctgatctctgtggaaatgctcttaggtttccccaagaagcaggatgctagctttaggactctggatctcacccactccctcccacctatgagtctttggaaaatactatttcctcccttgctatttcaggcccaggtggcagaactcctctctctggggacccctccattgtgtgttttcccttccacaggattctgagttggatcctgtgtctgtctgtggccctgagagctgcaggtatcgactacaggctcagcatggtgggatgggctgtatcctcaaccctgtttcaacagggacacttctgctaggagaggagaatgggcccagatgtaaagctgcccttctccagggtttcctgaaccttctggtctctttgccttcatcttgcctcttcctgctccgttaaaaagaaaatgcttcccatttgttaattgttgagagtgtatgctgctgttttattttgcttgacatcttacaatcaatcttctgtatatgtttatatatgcttttctatttaagctttttttttttttaaatctaaaaaacacagtaccataccgccaaaggtgtcaggaaacacgctcaaataaggaagggctccaaagactgctttgccaacaaaatgccagtaaaatctgaaacccaggttcagacacactgggaacgttccaaaatttaaaacttaaagaacttctttattccagtaaatcagcttccctgtgaataccatcaaaatcctgggctttaatgagtaagggaatatcagaggaaggggtggagaaggaaaggatttggacgagcacaaaatttaatttaaaaactattatgagaagtttaatttcccctcccccaaccaaacacataaatcttttccatgcattttctttgtttcggtttttcctaaaaaatctggagagggaaaggcatcttgaaccatctgaaatgacagagtcagtggagtctttaataataaatatgtgtttattggattcctatgaattaaatgacatattagctatatgggaggatccaaggaaatcgtaagcaaaattgcattctcaccgaatgtgtaatcaaccagggagaaaagacattgatgggaaggataacgagtgatatgaggccttgggcctcttaaggagtagggacaacagaggtgtcagagtccaggcggggatggctcacttcggcaggggtggtcggggcccagcacacccccaagtgcactgaaagatgcgaccatgtagggagaatgaagctggccttcacagttcataattccatccacaggcagcactgagtgcagccacatttcaacattggaactttccagggcgaagaagcactgaacacgtcgcaagagcatggacttcctaggttttcaccaggccacgcgtgagcatggggctgtgggtgtcggtgtgcctcagcactgccacgtccactctgagtgcaggtccggctcagttttggatgttcctccgagagcagtcctccagggccaccgtgggacgaggcacctctttggtaggccatttgcactccagcacggcctctgttcctaaccacaatgggctgctggttcaaggactccctgccacagccaggaggcacagaagaccccatggaggcacttggctggttaagacccgcaggggtcacctgcctaggcttagcctcaatctccttgtagataaaactggaccctaacccttcactgcccagggcccctagggaataaatgtgccatgctgcgtgggatgcccaaggagagttctgtggcatttatttagccacactggttcctctcccctggtttcttttcatcatcaaatggacatgatggaaagctcctttgcggtctttctaggagaggaggcggcacctatattccagatgcagccatttcacaaccaggcgctgcttcctggtcagagccgctcgaccatgaggatattctacagaaagagaactcagctctctccttcctacctcacatgaccctaaggaaagttaagaaaagaggaaaagacctgtgaagatgcctgatcagctgtcagggttacgtagacactggctgctgttatttactgttccctggctgataaaatagccaggtcacctgtgccgatgaccagacccaccccctacccaccagcagggctgccagggctttctggggagacgctgcagcttggttcttatttcctttgctctgcatccctctgggttgacttgagtctgatcatgggtttattccatttccattttgctagattccctccactccctcaagcttctacaaaactgtggggccaccactccccacaaaagattaaaaccaagatgtttcctagaggtggcattttgtcttcctgaagctgttctgtgcacaggtcctctccacactcatgccaaatgctcggtgaagcgtcttcctgaatgtccctaaggggcacgtgccactggcagagctgatgggcacacctcactcccacacatgctgtgccgagctcatgactcagctgtgcagggcccgcccaagagtgaggcaaacaccaacaccgcacagcgaccctttgtcaatggtggggacctcagtggcttctccatcggaacttagggctgacgggcctccagacctactgttacacactggcccacggaatgaccctcataaacccaagaacagtaaacagagcttaacattctaacgaaatcaagattgctgtgtgtgctttcacaaaatgaaactgcctggaacttctcataacgttttttatgataagcattaaaatgcaaagaggaagattaaagttcctgctacagaccagagcagtaatgagtgtgggaggaggagctctgggtagggtctgggagagaggtttatgtactgcattacagttggatattattatataaaatgagtgtgttattaaaaggatcctgaagttataaaaactcaaaggaacttttactgaggatgaataacttctttggtaaagatgaatgactctcacgtcctagacactgaggtgcagtcacgtgccagagctctttaattgctagtagttggatttcgttgtttttgtggggcacttttttgcgggggaaggggcagaaagattaggaatacattctttgattaggaaagttctagtgggtaagagaaagtccctctagttagtaactgagaatcttgattatcctactagaaaaaggcaataagaagacgcatctcctatggccataacagccacctgattttttttgctctacttcttttaattttgtttgtttgtttgttttcagacagactctcattctgttgcccaggctaaagtgcagtggtgcaatcatagctcactgcaggcttgacctcccgggctcaagccatcctcccacctcagcctcccaagtaactgggaccacaggtgtgtgccaccatgcctggctaatttttaaattttttctagagacagggtcttgctatgttgcccaggctggttgttcgacttcttaaacagtacataccacctcatccatttaatgttacaaacacaatgaaatcagtaagtcagaaaactgtagagtgatgtggtgaaaaacattctttttaaatgtagttctacttattttaaatacatttaattaactaaaattataccagaatatggctttgggcttgatctactcaagtaatttatacattttccctataattttgtttgtgtccataaactaggaaatttccatgtaatctgtatcaagacaatcacaaattctaaattagtgaagaccaaagtaatgtttccctttaccatggttggaagtgtacaggatatttggtttattaattttaaaaattatgagagtaatcccgacagtctggaaaacagaaacaaaagatttcatcacacatactaacacaacgattgccaccttacgcattttctagtcctttctcaaagatgcatgttttaagattttaatctacgaattaataatttattgaaacctgctttttactttaagtggtctgagcatttctgtatcttgccatagtctttctgctgatggacaatattccattgagtgagtgtgtacagagtacttaactatacatctttgtgagtatgaactttccgatgtatctgatcatttcttaagggtagattactagaagtggtatcaatgggtcaaggatattaactttttacaactcctgatgcctactgccacactgcttttcaagaggttgctctaatgtacactcccactggggtttgaacaaggcttaaaagtacctgtttcattatatccttgcccaccctgggtattatcattaaaaaccgttttgggcctggcgcagtggctcatgcctataatcccagcactttgggaggccaaggtgggcccatcacgaggtcaggagatcaagaccatcctagccaacatggtgaaaccctgtctctactaaaaatacaaaaattagctgggtgtggtggggtgcacctgtaatcccagctactcaggaggctgaggcaggagaattgcttgaacccaggaggtgaaggttacagtgagctgagatcgtgcgactgcactccagcctggcgatggagtgggaccccatctcaaaacaaacaaacaaacaaacaaaaaaacattttggtgtgtgtgtttgttggctgatgtagagggtgaaaacagccaacaaacacaccaaaatcatggaggattaggaagtgggacctatggtgtttccttggctcttcattcagattgaagacaggaaacaaccacatagacatattctgtatctggctgcctttcccatgatcttacgcttccgtggctcaatggctgcctttcccacgatcttatgcttttgatcatccatggagaaaaacgcaaacggacgcaggaatgctccaatctgggctgtgaaggctcagacaggcaggaggctgtctgcccaggaaggcaggtcagaagctgctattaaccactctggcagggcagtgtttctgtcagcctgcagagcacttcaggttctgggagcagctgatggcagaactgtggtgttctctccgtggaaaaaaaatgaggaagtcagcaaaatgttcttaagccattccgtccaccattttgtccatctgtgttgatttggcagtggtgttggcaaagaacctgggtgtaggacaatgtgctttgtaaacagaagaaaatgaaatgatagatgcaggggtgcctttgtttgagcttgcttgtatttaaagttggctaaatatgcctcagcagagatctttggggacatgaatcataatagaaaaaaacagcaacatataggcttgtccaaaataaaacctgctcaccgtgcctcaggtaaccctaagaagcgtcctctgttgtaaaaacaattcaaatacataccaagtagcaagaatcgcataaggaaaccccacataggatgtccggggcaacaacatgcagacccccacccctgccggagccgagtacacaccaacccacacatccagggctctgggcagcggtgactgttcagtgagaccgctttcagcatttgcgagaagctgctcaccaactgccaagttcctgctgggtcggccaagaggtatgaaccaaaaatgaaaaaacatgaaaggtttgttttttaaaggcaatacatcaaacataaaaagagcccttttgtatgaattttcagtgtgggagccagagaggagaaaaaatcattttccctcctgggaggaagcagtttgacctcacctgcgacttttctcttacggtgtggatttttctcaccccattaaatgtaacctactctaggtgggttagtaccatgtgagagaaatagggggtgatggggaatatggcagacaggcaggctggggctcagacagaatgccgagcaccctcgagggtgggccctcgagggccacggaagcgggtgccacggggctgcatggaatgcggctgctccaaggggcctgtttgctggacacacaaggattaagtttccatggctccaaaacccttgcagcctcccaccccacccccggcaaaagcactctttgcaaaaggaaaggaaaaaagaacaaccaagttagaatggggttatcttcttaccactttcacaaagaaagggctggctgggatggacacagcaggtttcccactgtgaagccatcagaaaggcagcggaaaaaaacctcatggcagttaggtgtgggccagccacacagacaggaacaagcgagctttcaaacctagaaggtgagtgcgctacctgtcagcgttcacaggactttgctctgaagaacagtaaaagaccatctcagcaccgggtccctaaatccccttcccattaaccaggtgccaatagtgaaacctagaaggggaccctggtaaatcacccggcggctaccccgcaggctcccagcgctacgctctggggaccgtcagccttttcttctgtcacacagcaggagaatgagctcactttggcatctgtgtgaccagggacggctgccatctgtgtgtcactgttatcagtggtcagagcagaagtagcaggtggaaccatgtgaaatccctaacattcaaccgtttagacctgcaaaaatggctctttccttcgatttaccctgatgatgacaagaaaaggagaagggggggagggaagggagagggggagggaagggatggaagggaagggagcggggggaggaggaggacgaccatgatcatcagccaattgtgctacgtcagtccagagtgagctgctacttatgatttcatttcctccttagactgatgggagcaatgacaatccccatttgtagatgaggcacctgctcagagaactgaagttactcatccagggtcacatggctgtcaagaggcatgcccagtacctatgacaaacattcatccccaagtaacgaagccaacaacctgtgtctcactccagaaccacagagctgttacaacacgtggtgcctcctgagccagcagccaggggcaagaacgagaggatgcagggagaggctctggggaaagggctgtgtcccctcagtcatgtgacccccaggctttctagagtgactcatggtgaggacagcaaagatctcaaaatgctgtctagaccttaactctgcccatcaccccatccatttggttttgtttccctttcatttgcatgtgtagtcacatgctcagcatccttgggggcagctgcatctgtggtcctccagaaccccaagctttgcagttggacttgaacccctcatgcgcttttgattcctgattaaataacctgattcgagttgttgagatctttagtttacatcaaataattcttctttctattgctccattcacttctgcacattgccttaggtaccgattcattttctctacgacccccgctgcttacatgagttctaagatcatccacaggtgtgtgcctgtcggagggctcggagaacacgggacagcaggaagcagtcttttttttttttttttttgagatagagtctcgctctgttgcccaggctggagtgcagtggcgcaatcttggctcacttctacctctgcctcctgggccccagttcaagcaattctccttcctcagcctcccaagtagctgggattacaggcatgcaccaccatgcccaaataatttttgtatttttagtagagacagagtttctccatgttggccaggctggtcttgaactccggaccttgtgatccacccgcctcggcctcccaaagtgctggggttacaggtgtgagccaccgcgcccagccaggatgcaatcttattggtgtgtcacttttagcccaagaagcaaaaaagtggagtgagtaagctggtaggatcaactgttatttttatattaaaacaaacatgtaccagaattatggagtaaaaattatgcaaaatttacaagcatgttagagataaatcagaccttaaagaaatttagtgctagtcagaagctacataaatggtcaggcatgtggctgctggtgcaatattgtccctttacggccaagagacctcagacaagttacttaacctctcccatcgaaagcatctctcatgaagatgctgcttcagtcatagggttgtcaggaggatataccaagttagtgcctatgtggacagctgtttagaagcctcagagcaccctgtgaatgtgctttcagacctgccctggattcttagcttctactaaggacgagctacgggtgtgactgggttacgcttggctcattctggcctccctgccgcaacttttccaaagaggcgatctctgagctcctgggagcaaacccatgaggatacagatgattcggcaactttgtgccaggccctctccaggctctggggttgtttctgtgaacaaatgctctgtctctgcacccagggagctggcattctagtatgtgtgtgcaaggcggtgggagagagacataaatgcataatgtgtcaatgcagtgaaaacaaaatacagcagataaggggtacaaggaaggacaaaggatggggtgttcaagtggtccctgaaggctgctgcaataaggcatttgttcagaaagaagatagtgagagcataccatgaagacatgtgacagaggactattccaggcagaggcagcggcaaggccaaaggccctcagtgggattggagaggaacaaaaaggtgaccgacgtggctgaagcacactctgtgcgtatggggttggggggaataggaataagggttatgctggttgggggacagatttggaagtgtgcaggtcatagtaagaactctggattttttactgaatgaagtaggaagcaacactgagcctttctaagctaacagggatgagataactaagttacattttaaaggaattcacctggctgccacatggaaaacagcctggtggaaggaagaaagagatgtgttctgcacattttgaaagtggaacaaagaggacctgatgatgaactgagctcctgaaaggaagatggagtcaagggtgagttcacgacttctggcacacacaactcaaggaaaaagcgatgtgccgtttcccaaaagcaggaggcaagggctgagcaggctggagggtggaatctggtgctggacttagatgtagcaagcataagatgcctatgagacagcccacggaatccaagcagaagtctggagtgggagggagaggtctgggctaggatattcatttgggaatcattatcgtggagatggttcttagaaccatgggaccaggagaggtcagccagcgaatgagttgggctggagaggggaagacgtctgattaacctgactttgttctctggcaaaggcaccaggttgagaattcagaaactcatatccctggtttctttttagcaaacacgaagcatggtgaccaagccatgtcatcacactggaaccgcaaaaaagagaagaaaggaaatgcgcttcgtcttctgcgaggacacattgacggtgctcagctagccagcatctaggtcccacagagggcaggagggatccggaaacactgaggtcccctcctgagaggctcatgccctcacatactttcttaatataatcaaaatgggagtaaatgatgacaatatgcaactttccaaatactgagggttctggaccaagctactgaaacagatttcatagttgctatgctccatactctgcctagcatacggtagtcattttataaacatttgacaaatagttatatttctaacagaaaccagaaatttggggccatgactcctttacagctcaagaaatatgcaaaattagtattccctgagagacagatgtctgaaggccccaagcagtccaaccctgtcctgtcatagcctgagacatcctgccttagggagtaagttattactaactgtggacaagctctgtttcccttttggaggaactgagggcagagatcctgccattaattcctcccccagtgcctgggatagtgccctgtgcacagcaaatgcccaatacatctaaataaatgtcaaatgaatgagcgaataaatattcattaaaaattaaccaaacagttaatttaggtcattcagtggaaaaaagaaaaacagtgaaactagaaaagcatctttttaatttaaaaggttaattaaggacaaggttttaaaaaaatattttggtggatttagtaaaccaagcacacctgggactcaaaatagttgcaatctgtaactctaaacacagcccattatgtcccacgaattagaaaatgagggaaagttgcctgactcgcttcatgattctagtataatctcaattcttcaaccagatagtggacaagaaaataaaaaaccccaaacacttaaacacacagatgtgaaaatcatgaataaaatgctagttaactgaattcaatgctacatcttatgtgtattataatcagatattgtttatcctagaaatgcaaggatggtttaacatcagaaaaatgtatcaacataatacataacatatgggtgggcaaaatgaggaaaatcacatgattttctgaatagatgcagaacagacatttggtaatttcagtagccctaggtcagtccaaatgatctattagtctgatcaatttaatgattttattagattctctaattcccaaaagcatatttctttttactatttaagcattttacagcaatctgttttagatgtataagcagggcccacgagagctgtgaggaaccaggactcggataatccagggcgttgggagacttccccaaaccaggaaatgatcccatgcaccatctgagccttccagtcttcccacagactctaccaaacattatcggggccactaacaaagaaggaagaaaaactactttcaatgttagctctccctttgactcttctactgagggatatgtgggggacccatgtttatgaataataacttccagaaataaaaattcaggagagacaagcaatgcagcacctacagaaacaaaaataatcagacctaaatccacaagtttattaaagtgactttttatcatgatctttttttttttttcctgcaatggagtctcactctattgcccaggctagagtacagtggagtgatctcggctcactgcaacctccacctcccaggttcaagcaattctccagcctcagcctcccaagtagctgggactataggtgcacacaaccacacccggctaatttttgtatttttagtagagacggggttttaccatgttggccaggcgtatctcaaactcctgacctcaagtgatccacccgcctcggcctctcaaagtgctgggattacaggggtgagccacagctcccagcctatcacgatctctcttaacactgccctgacataactcatggctgtaccatccaaagacagtattttgtgctatgtctgaaaaccttccaatctggccttaaaacaaatattcagcaacataatagagtgataatgtcagaaaagagtattggctcccatatccacagttgttttaatagcatttaagaccaacattttataaatattattagaaataatatttattttttattaacattaaaattaatataataaaaatataatttttctcctagctttgcttatgtttgtgttttcataaatagtagaggggagaactaatgattaatcaatgggctgtgcatcacttgggaagttccctgtgtaaaaagctctaagttaacatctttgcaaaaccattaggaagaatttcccaataatccatttaaacatatcagattaatgaggaattaaatgcatctgcacttattcttggtgtggatttcaactgtttctcaaagctgaactgagccagagcctgctcagcagaagaaaaattgagaaggctaatggagagagccgttagcgtaggatgcaatggtttgcaacttggtgggcacacacggtctgaagcctcaccctgccctgacgcctgcattcctaattctgtgcattcacatgttgacttaacactggtttattgagcatttactatgtaacactgttctagagaccgagaaatacagcagtagaccaagtaggcttacgttctggcaggaggagtcagacactcaacaaatatgcaaatacagacacaaatattgggttgtggggttagagaagaagtagtgagagctaaggatggtggggagaagccctctctgataagctaacacgtgagcagagacttgaaggaagtgagagactcgggaagctaccttggcaaggaacgatccgggcagggagaagagtaaacacaaaggatggaggtagtagcgtgtgcttgacctgaggcccaacgaggaggcccagaccactggatgaagtgtgtgcacagtgtgtgtatgtgtgtgtgcaggtatttgggggaggaagggaggcaatcacacagggcttccagggaggtgaggactatgaattttcacttagcataatattttcaagattcacccatgctgtcacacaaattaatattttgttcttttatattgcttggattcctagttgtattctagtaatttgtttatccgttcaccaaatgatgactatttatgttgtttccagtttggggttattcaaataaagctgctatgaatatctacatacagtctttgtatggacaaatgttttcatttatcttggaaaggcatccatctatcaactgattgactgactgattgatctgctcactatgtatcatccagtaatgccattcctagggatttacccaagataaattccagactgttttcaaaagtggctgttatcattctgcattcccaccagtaacacatgagagttccagtttctccacattcttgtcaacatttggtattgtcagtcttttttaagttcagccctactaatgcatgtgaagtggtatcttatcatagtgttaatttgcatttctctgaagactggtgacactgagcattttctcatgtgcctttaggaatttataaattttctttgctgaagtgtcttttcaaatttttgccttttaaaaaaattgagttgtcttaatattgagtcgtaaggttctttatatattctggctatatgtcctttgtcagatatatgtcttgcaaatattttctcccagtctgtggcttaccttttccatttttaaactgtgttttataaaaaaaagaagtttttttagatcaaagtccattttaatcattttttcttttatagttcatgctttttgtgtctcatttaagaaatctttccctactccaatgtcacaaatatattctctgagaagcttaacagtttttgcaactaaatttaggtctatgatccgttttgacttaatttttccatatggtgtcatgtaacagttgagatttttttcctatgcaggcagatattcaatggttcaagtaccatttattgaaatggctatcttttctccactgaatgaccttggcacttttatcaaacatcaactggccacacacaggtgagtctacttctggacacttaccctgttccattcatctgtatatctctatccttacaccaacacgcatagtcttgaatactagggcaagttaattttaagatgtctcctggatatgtaaaaattatatctgagttgaactacagtttatttatatatccaggcagcaaataaatgtgagaatctggaggtgagggaagagatcagagataccaccttggaaaccatcaatttagagatgattcttaaggcaggggactaagggacactctgtaggacacagacatagagaagggaaggggctgcggcctgaacaccccacctgcatgctcactcacatactttcgtcggcctgtgttaacgaagtgctgggtctccccagcctctctcatctgtaagcagtgccaacaacgtccaacacagttccatccaatttggatctgccagatttccaaggagccgaaaacttgaccctacaaatcagagtcccgaattcagcccagaggctcagaaagttgctccagttttctaagcctcagttctcaaatttggaaaaatagaaattcagtaactagccaaaatcatagggttgtttgtggacaactaataagaataaaatgtaaacatttagacacgcaagccccgtgaggaaaatccagccgtccctctttctaatcagggtggtgtgagtttcctatgacccatttccaccatttccacatttatgaaccgtgatcaacattagacactgaaaacacaggaaaacaacttctggacaaatcactgtgagctcaaatgaccccgcagactctgtggccagcttgaccccaccactccatcatcaaagaggaccatggtgagagcctgagggatgaggcactacttgttgatgctggcagggatcagcagaaacatatgttttcatgctgaaaacagaagacacagatgtgggcacacttagaatgcactcctggcacacagtgggtactccgtaactacttggtgaacaaagagacacaaagaaacagcagtcatttgaacaatcagctgagaaaacagagactctgtgaccaagctctccatcaggtatggaacagatgcagtcacaggaatgataacagtcacaaggaaagctgagggtggctccctgccggtaccgctcttggcagtttatgggaaattattcatcctatggagcagcactattattaaccccgttgtaccagtgaggaaacagaggcaggaaggtactagaattactcccacttcataggttaaggaaactaaaacccaccaaaatggcagggctgggacttgaacctaggtcatcaggctatggggttccacggactatggctcagctataatactacgcgatattctctcccatcttcagaatgtttgcttcacttcaagtaaaagacagtaactaaaaattctctttccatcatctgttaccttaaaacagcctaactcacaaaacttcacaacgcaagcccaggtattatggaacccaccaagaatagcaagttcagtgttggctgccatttctaagtggacagtgttaattccctccacttagttgaggggcggagagaggtgttgaaggaaagagatgagatgacaagtctgaagtggcttcatcacaaagcatccatggctgtgatatgtagctgtgtcatccatggcaacattcgcctgaatggagattgtattatggacattgttctgggatgcctgaggctgatgacatgggacatgccggaaatttatgtatttcctacataaatatgcagctgaacatatttatgtaggaaaattaaagaccagactggtcaatcactggtaagccgtcaatgccccctcaatgattacccttgtcattcgtgccagccaaaacacacccagttcacaatagagacgcaagtaacttttcaacctgcaactgaccgctagaaattgattttagtagttgcctctatcctgtgatattttagaaatcaggttatcatgcataattagctctccagcccaaatcatctgtgccacattctattataacaatcggagaggttatgacaatcaagaaaaggaaaaaaacacaggcatctgtctcatagttcaattttaacaggaataaaaataatttgaaagaaagaacaaatacatagatcaaggccacatctgccatctcattgcaaggcacatgcccatcctgtctacaaagcttttggcatagcatgtctggtgcacagtaagtacttaatcagtggcagttcatctttttattattattaatgtttctagcatgaatggatctcagagagtctattaactttccttcctagtcaagggatgcacaaaaatttagcaaaacttcagatattaatttgcttcactgtgagtagttatgttctatttataaaaattgcaaacagattgatttcctttcttttttttttttaaattttttaatttcttttatagagacagttatctaactatgttgcccaagctggtctcaaactcctggtctcaagcaatcctcatgccttggcctcccaaagtattgggactacaggtgtgagccactgcattcagcattgatcttattttcatttgcaattttagcagcaatatgatatatataatattctttaataacaatattcataatgtatatgacataaggtatacaagaatacaactattttatacactaacagtagcaaataatattctctttcaaaattgtgattcatcgaggcaggctaacattagctgaaacaagtccaactgcagtggcccaagtccagggctagtcaggcagctctcctccaagcagtgactgagggccacaggcctcttgcaacttgggatgccgccattttcccacaaggcctccaagattgcagcataaggggaaagggacagtgggagaatctcatgggccaggcctggaagaagcgtacttcatgtccatctgtctgttggttgtccaggcaacgccagcccaactgaaaggggactatgcgcccaggagaaaaatgaaatagggttgggaatcactgttttctgtgtcataaacattctctccgtggacaattaacatctgccttgtactttacagatgtttacacggcacttttcactatgtcttatttattcattcagaaaatttagtcaataaaaaaagttgaaaagttgctattgttattgccattttccaggtgaagaaactgcggcttggagaagtcatttagcatccaagcagatgagtggcacagccaaggcttcattccctgacctccgcatccaaatctcaagccctttccacttttctttgcgtcgtactgaacttcaagaagaacagagatcctgtgataaaacagatttatgacagaagtagggttaccttttcactcccaatgggatccagtgttgtgtagttccataaaaaaggcacgatccccacacaattcaacggaacagcctgagagcaggctttcaccagtccatagtcatatatgagccagtacagggagtgtttcaaaactgaaatagaagttaatatcctgataatctcaaaataagacttctaattcttattttagaggtcaaagagatgggtgtagatatgggtgaacatgattaaatcaaaattatggatgtgaagaaaaactctgggcgatcagggtccagttcctaaccctgtccccttaactagacatgaaacccatgtggaatactcattgtcatggtgacaaccgggtggatggagtttgaagacaggtcagaacacactactaggtccacaaagcccaaggcgtcactgagctgggtgtgaagtggctgtctggcacatcttcttccattgacaagccggcctttgtgatgagaaggaggctcatggcacagtctcagctgagtccactcctgcaggcaggcagcagggaggacaaaacgtccccagcttccttctccatggtctctgcctagagagcatcagtatttcgatgttcagcatggaatagacttccataacattgaaagcagtgatcttctcttttcaaaacaaggtgttgtatgcagtattaaatctggattccagaaacgctcgcacagggcgaccttgtgtgcagaagtttattgccaaggttccagtttatgcccacgaggcgcacagcgaggcttctggaggcagcagcttgcttttggcattcccttacagagctcagagccccgacaggttttggctgtaagaagtatcccgcaactgatttattcctcaatttcaattatttttttctctacatgaatcatttccatgtttccaaagcagaagtagaaagaaagaaaaaaaaactcataaggtgaaaaaaacttccaaagtgttttgttttgttttgtttgtttttttattgaaaaaaaaaaaaagcctgcaatacaggaatggatttgctatcaaacatccatttcaggaaaccaccaggtagaatcgggcaatttgatgggcaattgggtctcaatttccccatcaggaacaacgtctgtgcacacacacatacacacattcactcccaagccatccacctcaccagaccatgagcttttagggagaccgaattccagccaggaaggcagtttccttttcactgtaccaacataatgcttcattacaccaagacacagcactctcccatctgccaggtcaataaagaatgaagcttaaaattcacagtcacctttacaatgctaagcatttcaaccttaaatgaatgtgcagtccaccaatccgcttccccggcctgcatccagctcttcccgtagctgaggctcaaatgatcttccacggggtccattagttcctcttggctggtccctgggttcaatgcaacgctcccagcaggtacggtaactgccactcatctgaaactcccaagttacactctgcctcactgacaagggcatggggcgctgcctcctattctgttttgtgggttctttgatcaccagaaggaatttcgagccactgtgctaagtaactcgaattactcataggctgggatcccagaagccgctgggttcctccatataccatcagaagctgagcttctccagaggacactgaagaggctgctcaagaaccctacagcaggttgtcccagaattacccaccatgacctaggtagctgactaaatgccacagcccacctgaagtttccccaggcaaacacctggagtgtctcatgactaagcaagatgtcctatggagctaaaaataaccctcctatcccttcctcctcctgccatccccatctctctgaccctctgtggtcctcaaagggcatttaagatttgagtttcctggccagaacgtgggcaagtgcttgtatttatttgctatttactaactgctgccatagtagatggcgtttctaaaacggtataaaacatctaccaacaacatcaggtttttggtattctatatgtgactgttaaaataaaaatggaccttggctacctataatgaatgagccaagtaaaagcactccaatcctggcgtccaattctatcagctgatatttgacacagggtttgacagttgacaaactgtctctccatggttccctcttaacagctccatgaggtggcagggccagtacaatcatccttgttttgtatctgagcaaaggacattgtggagagattaagcaaggctacaaaatcggtgaaggattccgactttccactacagcaagaggtctcagtgcatggctagccctaggcgatgccagaaacatgacgacataagtaatactttttttaatagcaaagaaagcaagccagtaagatgtccagcttgggaaatatgaagttggcaaggacaaaagatgcctccaaattttaaagaaaaaaaaatttctctctcggttaaccctcactactccatcaagagtaacagcagagtccaggtatcccctggaagtgggtcaggttcgggtctgcactgtcttccttgcttccaggtaccttcctcctcccaggccgcacggagtcccgggcccggctccgggcgctgtgtttacaggcagggcggcaggaaggacatgacctccccagctctgcggcaggttaagcagcctgattgaacgtggctgctaattaagggcccctcttgtctggcagggccaccagggtaccttctgcacttgttcatgaccactgcacctcgctcagaaattaactcttgatgagtgcagacaggggcccagctggtcctcccgagtcctcccaagtagataaatgaagtgtaataagaatgccgctgactgccaagggaagaggggctctccgtgacctcttggtaaaatccagagtatacttttactatgacttaattctctgcactggggacacctaacgtagccaggaatggtgtgaacagaccactagccacagggacagcatagaggcgtccatcactagacgtccacttcatgaagtaggagttaaaagaataaagaggtaatttatgagaaactaattttcaattgacaaatattttcaggaggtgtgatgacctacttttctccataactcttcatgggcccagggacaatggtggctcctattacagtttgcaaatggtacaatcattccgctcaggtttaaaatattaaatgctcatcttctatcacttacagagggattctttccctgaagctctatttaaggagagggaaattgcggccgtcattgtccaggcctcccacatacagaaacttggtagacagacatgttctgggtcacatggctaagctgtactgacatgctgctcgagtccagaggtatcgccattgagttcagcacagtcaggaccagagccttttccaccattcatctcaggaagccaacacacacagctggtaagggggagggcttggagctaggagactgggaactgtgtgtggtcagaagccacctcactgccctggcccacagtgtggttccctgtgtgacatcatctttgagatatgacagagacaaaaagcaggctgagagtccctgctctggactctagatcacaatgaagccacatctttctacaacttttgaaagaagcaggtgaggtttccgaaaaaaaaaccaagtgaaatgaaaggtgacggtcagtgtgctatcttttgaccgcacagcaaaaaagtggttgccgggctagaagcaagatggaaagatgaagaaatgggcagaaaaggcatttggtgccttgatgaaaaatttcaaaaataaaagggtcccatggtgaaactagagcaattcccagaagactaaatgtgggaggaatgggacgaggtaggggaagtcagcagagactctaagttgtttaagagagcgtattacttatctattgctgtgtaacaaatgaacgcaaaactaagcagcccgagacaacttaagaaacccacgatttccgtgtgcctggagtctgggttggctcagcaggatgcctttagctcagggtctctcacaaggctgcactcaaggtgtcagcgggcactgtggtcatctcaaggcttgcctgggggggtggctccgcctccactttgtcccttcccaacctcatctgtagtctgccacaggcctcggtgccccagtagctgctaatcttttgccatggggctactcatagcacgtcagcttgcttccctcagagctgggggtagggagaagaggaaaagcaagcaagacagaagtcacccagaagtgcaaaaaaggagttgccatcccattacttttgccatatttgatttgttagaagtgatccagtaggtccgacccacctgcaaggggagaggcttacgcaagagcatgaaaacctgaggacagagaccaccaggaccaacaaaggctgtggaccacagagacactctttattcatggaataaacctggagcccgattctcccaaggcgagcctcctgaaatgatagaagctacggagggaggccacatgctaggccacatgtcagcattattactgttcatcattcattcagggcccacaaaagcgagagcatctccatacgggtgtggattttaaaatcaggaaagcaggccagatagaattcatgcttaggcacagctgctcagaactgaccaccctaaggggcccactgttaataactcatcctttctgatgatccgcccactgcctggtgtggctgctgccactgttcagctctgtcccctgccctgagaaacatgtgctgccagaggttcgtcctcacaataataaccgctaacactgagtgacagcatgtgatggtcaagtacagagtctggcactttatgttcatcaccgcgtttcatcctcaccacgaccctgttctgtggatccggctggacgcatccagaggtgggagtccctgtggtctgggcactgatcagtgcctgaatgttctcagggacactccccttcattaaagcagacagttagacattaacaggtctcatgactcaatatataactgaattgttatattatgggcacattgcacaactgttcacttagaaaatctaaaagaatcagctaaaaactattagaaaaacttagtgaagtgtataaaatgaaacactaccgtgccactttaggactctggcaatagctaaaaagtaagttttgtgataactcatgttcattgtagaaaatctagaaaataaaaaaaaaaaaaagtaagactaaggcattaagtcactcatgactttaccaaaagacattttggtatattttctttgatgcatttttctatgttacatgggtgactatatcattgtattttaaaaaattgttgtcatactacactagctgagcatcttgcttttttcacttaatgtaacattgggagcattttcccatgctcatgttcttcaaaaacccaaggttaaatggttactgaatagctcatcatattattacaacctaattttaaaaaactatttccttttactcatttagtcaaaaaaatcaaatttttttcctctgttccccatttcctgtctttaaaaaattatttgaatatccatttcagttcttctattggcttaacacatatttatttacatttttaagttggctgcaagttagaaatataagttttcacagtctgcctacagtcagtactgtacaacctctataataaagaactcttctcaccatcgaggtccgtatctacccctggtctttaccttacagctgttacatgtatctcatctatagatgttataagcctcgcaagacagtgttataatttttgcttaaaattcttatatgattaacaatgaaattaagaagaaaaaagcagaaagaaaactagtattttgtgttgatccaaatatttaccagtccagtagtctttactcttttccaaggacctgagttcccaactggtattatttccctttaactgaaagaagttcctgcagcatttcttacagtgcaggtctgctggtgataaattcttttttcttttatcgaaaaatgcctttatttcccttcaatcttagaaggatatttctacaagatataaaattctgggttagggcaggcgtggtggctcacacctgtaatcccagcactttgggaggctgaggcaagcggatcacttgagggcaggagctcaagactagcttggaccacatggtgagaccctgtctctactaaaaagacaaaaaatagctgggtgtggtggttcgcacctgtagtcccagctactcaggaggctgaggcaggagaactgctcaaacccaggaggcagagattgcagtgagccgacatcatgccactgcactccaacctgggcaacagagcgagacctcaacttaaaaaaaaaaaaattctgggttagaattttctgattctctttcagtaccttgaaaatgttattccatgccgttctggtctgcaaggtttccagtgagaagtcagccattaactggattattactgtatggcttttctcttgttgctttcaagatttgctcttcaactttggttttcaaaagtttgcaagaaccagcgtgggatttttaaatatttattcttattggtgtttcttgagcatatgatcttatatctgtaaatttctacttgtcactgaattctgaaattttttagctattatttcttctactatttttttctgctccattttctctttttcctctgtcattttccccctctctgccttcagctgttaagtccactcagtaaatttttatttgagataactattttcagttctagaatttccatttggttcttctttttatcattctatttctctgctgagctatcttatcttttcattcatagtgagcatatatcatgttatttcatttaggatagttttgttttgctttgctttgagacaaggtcttactctgtcacccaggctggagtgcagtggtgtgatcatggctcactgcagccatgacctcctgggcccaagcaatcctcccacctgagcctccccagtagctgggactacaagggcacactaccatgcccagctaatttttgtattttttgtagacatggggtttccctgtgttgcccaggctggtctcagactctgaggtgggctcaagcaatatgcccaccccagcttcccaaagtgtcgggattacaggcgtgagccgtggcacccagccatttagtatagttataacagccactggaaaaccttgtgtgactctccatatctgcttccccttggggttgaacttcatttgatttctctttttcttgatttgagacagtattctatttccttggttcttcaaatgttggttattttagctttgtatcccagatgtgaggaaggttaaactgtagaggtttgggattttgcgatttttcttggatgactgttagttcttttggttggcaattagctgaacctgaactgcaaactctgaccctttcggcagcaagcacagatttttttgtcattattgtgatctgagtctattctatgcatgtatggttcagcgatcaaagatgtatataaacagaatttggggatcccctctccagcccttttcttctaggagtccctctcactgcaccacctgcccttggccctgagcttacttggtgcagctcaagagtgcagctcaagacccaccttgtcccaacgaggttctcccaccataaacttgcctgcttctgctcactctcaatggcttcaggcagctgctttctgaattatacccagttttcatagttattttctgtatgtgggggtgggagggatggaggtgggagatctgtctggtaagatcttgatctgccattctcagaagaagaagttcccagacctttgtatctaaataccattccccactaaaaggaaccagagttccttctaaaaatgtagaaagtaaaatataaaaacagctcattccagagctgggtacaaggttacgcctggaataccttattatgccagagagtgaggaagtgatcaaagatccaagaggccctgtcaaaaggagatgggagcctacttttcaaaccaaatctgggataatttgagcaaagagaataaggatcataattaataataaaattctgaagaaaagagagacttaatagtccacagtgctgattgagaggaaaaggaagagaagcatattactcatttaattggcagataaaactgaatgtatttgtcatgtacaacacgttttgaagtacctacacattatgaaattactaaatctagctaattaacatatgtattacctcacactgttaccatttgttacatttttaactgatgacgtatctctcatttattggactgataacgtatctattcctcattcactggattctacccagaaacagcacactttcaccctttcatggtacagctgccatgctcttcacaatgttattattctagactattacagtacaagctagcagtgacctatttatcttttaggatcatgaacaatatatatcacttcatttctagaaactgatcttcaaaaactataacctactgcaggacaggtgaggccagggaggcggacacctctgcctccaggaggctactctgtgcctcaagaaccaaagaacgaggggagttcgaccactgcctgtacagagcccgaatgccctccctgctgctgttctaatgcatgtcccatctgcaatgttagaaaacaagcttcagcttgatacagtggaacttggcagatggcacagtttgcttgttacagaactaagtatgaaaataaattcatttagtagtgctccttggagaaatgtggttcagaagtcaaataattttaaaagacctctttcccatgtaagacacccatgaaacaatgctctggtcataattagtctctaacctttcaaaatgcctgcttcagtgacctcacctgctattgaacacgatgcctgcagatggtgtgaggtggccaaagggtggaggactggcagcgggggctgcagcggctgctgtgaccagccactcacttgctgaaggatcagggagagacactgtgtctctctgggtctcggcttcttaacctgtgaaacccaggggttggggaaaagctcgccaagcccccctcctgctttggcatcctgtgagtctttattgtcctgggctagctgggacccctaggacactgggtggctccttccaccccacatgatcattctgctcaacaagaacttgcaggagccacagacctgcctcacaaacatgaggaagcgcatccttctacaaagcgagaggcttgaggtgtgtgtatagccaggtcaaggtgaaagctactgaggttttgcggaatcaactctgtatcaaatcttctctctctatccttctcagagtctgatcaaactgggaggtaacagattctcaacaaatctcaaggagagggaggaaaatatctacctactatggaattatctgtaatttttctaacacacagagtatgttagctaaagctttaatgccccctatcctttctgtcacttacggtacgctttatcctttgatttttgatcaactgttagtcgcagaatgaatatgcctaaattatcactgaaatctagcaaattatgtcttagaatgttagttttaaaaataagtttgaaaatcatttttatgagtctttgtaagctcaaaaatatagctctcattattttgacttagtttgtttaaattgctaagaaaattatttcctcaaaaaacagacactgtactcttcaccaaatttagtatgttgaaaactgaaaataagaaattacatatgaaagagcaagccagagacaacataccaatatacagaaaaaatagaggaaaaaaatactaaatttttcacctctgacttttcctccttttaaaaagaaaaaaatcagggctggcgcggtggctcccacctgtaatcccagcactttgggaggccgaggtgcgaggatggcttgagtccaggatttcaagaccaacctgggcaacaaagtgagaccctgcctctattaaaaataaaaaaattagccgggcatggtgctacatgcctatggtcccagctacttgggaagctgaggtggaaggattgcctgagcctaggagttcaaggttgcagtgagctgtgatcatgccactacacttcatcctgagcaacagagcgagattctgtctcaaaaagagaagaaaagaaaagatctaccagaagccttgggtccctgttttctggcaatatgctatgcatatttgcaaatatgtaaactgcatggataattttgctgtaacgaggaatgtcactttaccagactacaactttaatcagcattcctctgaacaaacttgctcatgatactaagcaacgcaaacatgcagccaaacaactggtgttttaatattctagcttctatttcttccacgtcataatttcctgtaataatctcactcatgcctgaactccacagacattcttatttatgtttttcaggtcagtatgccaatagcaagaagacttgttcttgaaaggttgagtttttcaaatgagtcctgaaagaattctaccacactgcctatttcccaagcagggatcatgggagaaaggaaattttgaagaaaatggttctaatgccattttgttaaaagtactgagagatttacaatgatcaagtaatatgccagttctttcaaaggatgccaacatctgatgccaacataattacaagttggaaaaatgtgtaatgaatcaggcggctcataatttcccttagaatatgtatgcacaacttattaaatgacataaaaagcaaagagtcacggcaaatgttgaaaccttaaatctgagtttcattgctttggggcattttcgtcaaactccatcatctggaagtacctaacaataagaaatattaggtcacaagctgttttagaaacacctgtaataccttcacctaatgaggccaataaacgagagcttcgtgttcctcatcaaataagaaaacttaatagtcaaatctgacataataagcccaaactcaaaccctgtagaaatggaaacactcacatggagagcattttctcctccaaattttcgattctgccaggtccctcccctaaagccacctggtggaaaaatgtgcccccagtgctaggtcagtgtgggtttcccagagtagggcttaattcatgtggtggtctttggaggctcagaaagaatagaatagagttttctcttgatggtcactgtcctcacctcctcctgctctcccccaaacacactacaacctaggtaaggagaaagaccctactgacatcttattcaaaacccccaatcccacccctttcaaggtacttgccagggaggtaaatggtggactctgcaggtttcctcctccaaaatcatttgtatactttgtctatggtcactgtctccccaaaagggctatactatcattttcttccaactagggctgtcagatttcacaaagaaaaatacagaatgcccatttaaatgtgaatttcagataaacaacagataatttcttagtatgtctcaaatcatgcatgggatatacttacactaaaaagctatctgttgtttatctgaaactcaaaatgaacagggcatcccggattttatctggcaaatttatgcaaaacattcataatatggggaatgagaaattaacacagttacctctttctggtagtccaggaagtagagaaaaggcagctctaagaaggggtagaggtgagaaaagggaaaatgtaaagagaaaataaagccttccttattttggtagaattccatgtggtcctttacaaactttaacgtgcatacaaatcacccagggacattgttaatttaacatgtgggttctgattggatagggtcgtggagtctggaattctccatttctaatccctctccaggcaatgctgatactgctggttcaaaattcgtttcactggtaacagaattccagcctcctttattccaggaattgcatggggtcaaaggcaagaagacccggtgcaatgggtggagaagcaggtggaggagtgggggccctgtgagggccagggaaggccatgtgagtgtgtggatgtgtggctgagggaaaggaggccagggatcaatgaagctttgctttttttttttttttttttgatggagtctcactctgtcacccaggctgggatgcagtggtgcaatctcggctctctgcaacctccgcctcctgggttcaagcaattctcctgcttcaggctcctgagtagctgggattacaggcatatgccaccacatcccactaatttttttgtatttttagtagagacggggtttcaccatgttggtcatgctggtctcgaactccagacctcaaatgatccacctgccttggccccccaaagtgctgggattgcaggcgtgagccactgcacctggcctcaatgaagcttttctaacagtgaaggtgaaatacaaagatttggtctcttctgaggtttcttctaattctgcactgtgagaaataaccactactgtcatccacactaagacatgagttttgagcaacaatagcaacaacaaaaaatgcacacacagcaaaagcagcaaacagttttagacattcatgcttctcatattattactgagaaacagagcagtacgcttaagaatccaacacaaatgccttgtcacatttggacaaatgagtaaagacgggggataggttgtgtagaattcatcaaattggtgcccctaaaaagtgaattgagatttcgggacctggccatggtttgacccttagtgatgtgtgtacctatatacacaccaaaacaggcactcgcttcactttccaaaagttatctggagaaaagttgttctagttcagagtgtttacatagaccaaggatggtcaactgagactccagggcaaatacatgagatttttaccggttcctggatacctttgactcaagacagaaaaaaagtcattaggaaaatggtaattattcttgtcattcatagaagcctacaattctcccacccaggaaattccactactcaattaattgattacatggaataggatgcctccactagtcatctagtcaaatgtggacactggtctgggttttaacttgtgggaaactgtttttctttaactcaggggactctaaagtacaatggctaagagtaccagagtcagactacttgtgctgaattctggctccaacactgtctccctgggttccatactactcttagcctcagtttttacatccataaaaagggatcaataaaagaatgtctgactggggcaacatagtgagaccccatctctataaaaaattttaaaaattagccaggccagacatggtgcatgcctgtagtcccagctcctcaggaggctggggtgggaggatcacttgagcctgggaggtcaaggctgcagtgagctgtgatcacaccactgcactccagcctgggtgacaaaggaagaccctatctcaaaaaaaaaaaaaatgtgactgtcactaggctgctgtaggggataaacttaataacgtatgtctaggaaatacacaggaggagttcagtaacgttgcctgttaataccttgtcactgtagttactgtttctttgctactttgcatgaagctctgaattgctcagtgttaccctgaagctggggactaaccatccttctctggattgccttctgccactcagccattctagtaatcaagctaagcctctactgaggtcccaggacacacagttgtatgggtaagccaatgcagccaatgaaatgtgttgtagatatagaaaatgagctatcggaaacgctgacttcaggaagtggagatacatggcacagctccaaaggcaagaagctcatagccaccacgaatctagtaagtcctccctgcttcttgccttacatccacaggtgtgagggaaattggtggtaaaaatttcctttcccatgactcgtaagcttctgagaaaagccttgtgatgatatactaagtacttcagcaaaggatcagaggagtcagctgtgagcactgctcagatcccagtaagactttcagtggccaagattaaagctggcttccctctgccacgccaagcaacccagcctggctacagtacagcaggctgctgcaggaacttttcagagcgaagagtaagcgttcgatgaagatgtagactcgattagagtggaagatggaagcagcagataacggatgcattacataccatactcttttcaaaatgaaaaagcaactaacatgcaatccttcaatataaaggtagattataaacatcggtattttttctttttactcgcacttggaattactttggttgtaaccatttacgtctttgctcagtctggatttaatcggtttctctgttcttccctgtaaaactgagtctttccaccaaatgaccctgcattcaccttaatttgattttctgggttttcgtcttttaaaagtcatcacagatcttatgccatagttgtgatcagttctccaacatttgtctgactatggctcaagattaaaaaacattttcttctaagatgtgagatctcctaattctccaacactcacctatcctccacccaccggcatttctctccctcaccctgctcctccgcctgcttcttcacccactgcactggggcttcttgcctttgacatcatgcaattcctggaataaaggagactggagttctgttaccagtgaaacgaactttacgttagagacatccaaactgtgtggatttggtataagcttctttcaaaaagtactactccattattgggaatgtttatgcctaaaaaagaagattctgtgttctattgtgtcagacgctttcaaagtgcaattgttcaatttgcaaactgcaattggttaaccaagctaaacttaattagtccaacgatcctacacatcaaaccctactgtttgatgtattctgcgagatgtccaagccgcctacagctggctaagggtcacaatgaaaaggcagccaggcttaggtctgggaactgaaatgagctgttctaagtggagcttttcttccattttctgaggctgcactgctctgaccttctccaaatcaatcctttgcggattaacatgtaaagcagtgtcgaattaatttcagaaagggaatatgagatcagcctaggatcatacaaaacatctaactcctaaatacactaatgcttctagccattcaatgagaagctgtcaataaagggaaaaaagtcggtgaggggggcggccagaaggatttgaaggttggagcaatctatcagactagttagcacattgcctacttctgtggcatggctaatgcattcctctagaagttaatcctatttctaaagaccctcccgcgaggagcacataggccgtgatgaatgagaactaaaatgcattaaaattctcaacaacttcaccaaaaggcacactattagattctgagtgtctaaaataagacggttcattaaaagtgcaggtcttaaagaacccgcttttgtccctacacactggggagagaggggccagtgtgtcacttgtgacacctgcagccaaaatatttttacattaggttgtccaagtaatcacatgagaaacactacatgaaacggcaagggaaggcctttttcacaagcgagcttaaatagcgttattatgtgcctacgctgggggaggatgtgtttccccagcattagccacacaacggtgtcattaaacccacttttaaaaaacagacatgaaagagcacttaatttcccttggaggagcggcggtatttgaacacttctctttttctctcattgtattttgcttgtactcaattaagagataatttagccatttatcaagatggagtcggggctgagcatttatacaggcatttactgcagctatccttacaggcgaaaatctgaaaccatctccagaagacagttcatagcggtgggcctaatattgactggaaattacaccttgacgagttagttttgagtctctgttaacagcacagggtatggctggatggccctcaagactgactgcgacaaattataaagcaacgtcgatgctaacgccagaaacaccaaggacgaaatgcttgagcccctacagaactggcaggaagcagcagcttaggaggctccgaaagatgaaaacacaaagacagaagcacacctagaaactggagggaatccacatggtgtgtttgttaaatgaatgaattaaagagagaataagtagactcagattgccacctggactcaggacatttatagcaacttaatgggctgaagttttgcaaaagttgatcctcagtgctaaacatcaggtccagcagaagggttccccagaggggtgtgggcatgggaggatgagagaggagcacgagggatgtatgatcctgcccactttgtttccacgcttcataatgaacacctgtgctgcatttactcttctgtatgaatcgaatattacactgaaaaaatctgaaagtaatacttcctctgacctttcgttttcacatcagcatctaccacttctttgtagggtcatcaatcctactataaacagtgttatcagtctaaactctgctatatctgaacattgtaataatcaagctatgatacggacagtatcatttacggaaagcttctaatacagcatctgttttacacacacactatctctaatcctcacaatcctttgggcaggtggcatctttgttttacagacagaacaactgaggctcagagagggcgagtcaggtgttaaaggccacacagctagcagccaccactgagaggattaaattgaggtctgctgggctcccaaatccatactctttccactttcccataaagaaacagtgcaggggaaaacataataccatgtatctaaaagaaagaaaaataactaagaagttgcacatctgaaagattgcaagttccctcaagcttaaagtaaaaatgcttgttaaatgatagggtcaaggattttatgaataaataaaaaagagccatcctacctaagccagataaagtgcactcacagggcagcaaaaataaaccagactcacgccatgtcagggtcccaccaaaagccaggctgtgcgacccatggagatgaccaccaaccagcacccctccctcagtgagaaggtgggtccttggccatcgggaatgaggcaaaggaaggggcagggcccagggagcagtggcctggcagccccttcccatgagttggggactagggggcaggtagtgatagtgaggccccgtgccagctgcagcggaggaggcatggttgaggctgcacctctacagagctggcaggaactgggaacaggtgagagccacgcccccttccgagttgaaggggctggagccccactctcccaggcgcagctgctgctgcccagccacggccgggccgccgactgggattcctcgcgctgtcagaggccccaggaagcccccctcccccacaggctcagaagtgcctgctcctgctgcagggcctgtccctgctcccggcacccactctgatttcagagcaaagttgtggccaagcccaggcactgtcatgacccagccaggtgtgcacatgctcagggcggcgctgacatgccagccccctgctgcctcagtccccactggactttgggcaccaacaagcacaggcttctgggatgccaagggggcgctgagggcagtttggcacaggcctgtacgcgcccttcagcatgaacagcctgggtgctgtgggcaccgtggatgtcaggttgatggctgcagaaggcagacaggctcctgggcagaaagtgggacgtccctggtgaagctccatcttcaagtcaaggacaacctgaagcatttcttggggctggatagcttttgtcttttcgatgaccccaaaagcacggaaaaaccagaagtcagctccgtgggtggtgaccccgtggaggggaaatataaaccagaaagtaggatgctgagtgcagactgggaggcgacttcatggtctggactagtgccagccctagcgcctgggacgtgagggtgcccggcaagagggtgtaaaaagacaaaccaatgagtgcgtgggaggcctgattctcatgtcaaaaagggtggaaggaaccacgtgttcatctgacagcatcgtcctcctgtttatttcctcagccaaggactggggactgggagacagtccacttgggtgacggcgaatttctttcaccccgagctgacaccaccttgggcagggggccacagtgagggctgagctggccactgtgtccaggggatcgtgccttgggcagatctgccttcatctccctgctcttcccctctgttttttgtgtatagtaggagcacacgagaattaggaagaacagaaaaaacaagcatctttcaaggttttattgaaccactgccaagaagatgtggaagagtgggttgactacaattgctagacatccgttcattcacttattcattcagttcactggcatccccagctaacacggccaccgtgtcacacttaccaaaaaatggttgggagatttatccttggccaactctgcagaaccctcctccccaaacctcctgctctgcgctttgctccggcagtgatctcaatgacaggattttaaaacgaggtttcagtacttctgcaacccaaatgttcacatcgttaccgcttaggaatctcagttatgtctatatgatatttaagcatgtgtttaaagacacaaaacactttccgcattttgtctgaatagactgaagacttgttgctgagttttcagtacaaaaaaacaccagcgattatcctgaaactgacaagtttgaagatgcaaagtctaggctgtaagaggaattttaaacgcacgcctttaaaatgagacttgtggctaaaatggagaaagggaagggagggaaggaaagagaagaagacgggaggggagaggaaagagggaagaagaggagaaactgacagctgacaggagggtcccatcacaggtacaggagacatcaggtggcctctgatgggaataggagagctgcagccagtcatcctcaccctcccacagctgctaatgagccattgtcaggccttgtaaaagtaagttaaattattgctgatatatcttccttgtaagtaagataaggtgacaaaaggtcactcctcggcgaggtgcagtggctcacacctgtaatcccagtactttgggaggctgaggcaggcgaatcacgaggtcaggagttcgaaaccagcctggccaacatggcaaaaccccgtctctactaaaaatacaaaaattagccaggcatggtggcgtgcacctgtaatcccagctacttgggaggctgaggcagaagaattgcttgaacccgggaggcagaggttgcagtgagccaagattgcagcactgtgtgacgcagtgacggagcctgggtgacggagcaagactctgtcttggaaaagaaaaaaaaagcatcaatcctctaatctaatggatgacacacagacttcataaagcatatttatctgacctgatgggttttttaaataaacttttattttggaataatttttcatttacattatttttaatgatagtaatcacggctctttcatgatgggcttagcacatgtgatgggcaccagcacatatacatatgccctttcaaatcaatcaacagcttgttcagggatgtatggagacagacagaaatgtagtatctggatcattactattaatgctaactattaattttacctctcctagtatttcaaaatatggttatgcaggccaattatccatgcatggaaaaattcccagaaaagggaagaacaagaacaagacaagatctagctagagcaggacagtgatttttaaagcaagataactaatttttaaaacctaccaataaatacagcatttaattcagagtagggttaaaagaaataaaaacaacaaagtaaaacttaaatgtatcactcactaaaattacctgttatattgattagggcataaccactcgggttttcttgacctgtgagcctggacttctcgtgtgtgttaaagcaccgccaaatacaacaatgactaatagcctttttaaatgaatctaagaccccgctgatggtagtatacatcccaatttcagaagtgttaaaatgtgtattttagaactgatcaaacagtaatacattaagctgaacccaatcaaaagtacatttcctgcttatttggataatgatgcacaatgcctggaagagaatgagaaccaggcaaatatttactgaatcaatggatagtctaagaggtgacagtcatctgtgaaatatggaattactcgcagtttgccgacacaccatcttctttcctctctacacttgcctgggacacccctctcttagcctttcattataaggaacagtcagttcaataatacaaataatacgaatctctcttcactatgcatgaagtgatcattccttgcaaactagaaacacgaacttgttaacctccttcaaggatgcaagacgactcaggaatccttccatgtactctgcattcacaaatacgtgtatgtgtgaacttagtctacgaggagactaacaacagcccatttaccagcttcaaacgtgcagggtgtgtgtgtgtgtgtgtgtgtgtgtgtgtgtgtgtgtacacatgtgcttcagggcaaggcatgtgctatataatttattttataagtttactaccaccagatgtacagtgtcagtatcacctgtgtaaattagacacaactgggttttgtattttgcattacctagataagtatttctctgcattagagctacatggaccaggcctatttagctacttccccctcccattcttggaggataaaaacaatttgttgtcctcataggttctctgagcatctaaccctatatatagcaccaagagaaaccaaacagagcactgatgccatgtttgctggaataccaacaaggagagtagaggacaatgagtagaattagtacaaaaataagccaggcatggtggctcacgcctgtaatcccagcactttgggaggccgaggcaggcggatcacctgaggtcaggagtttgagaccagcctggccaacatggtgaaaccctgtctctactaaaaatacaaaaaaagtgcacacatatgtttattgcaccactattcacaatggcaaagacatggaatcaatccaaatgcccattaatgatagactggataaagaaaatgtggcatatatacaccatgtaatactatgcggccataaaaaggaatgagttcatgtcctttgcaggcacatggatgaagctggacaccatcatcctcagcaaactaacacagaaagagaaaaccaaacaccacaagttctcactcacaagtaggagctcaacaatgagaacacatggacacagggaggggaataacacacactggggcctgtcagagaagggaaaaggggagggagagcatcagaacaaacagctaatgcatgtagggcttaatacccaagtgacggattaataggtgcagcaaaccaccatgacacacatttacctaacctgcacattctgcacatgtatcccagaacttaaagcaaaaaacaaacaaacaaacaaaactctgatgccatctctggcatctcaggcaatttctgctttttctaggttttgttttgtccatacacggtacagacttcctccacagagggattttacgagaactagaaccaacaggaaaaacttgggtgagaggtactaacataattaacaaaatgaagaacacgccaactttcctaaccagggaagaaacacaaaacaataaaggaagtcacatttccctccttttcccatcactgaagagacggcagccaaatggtcatgctcacatttggtgcatgaaagtgctctggcagtaatgatctacaggcagtcattggcatgcttatggtcactcacttgcgaccttgtttcttgagtttgtcctaaaacttctttttgaaagaaagaaagactttgacataaaaatgttcaatgtagcttcagaatcacaagaattagaaattacctcaatatctaatagcagggagaccactaaggaaattatagtatgaggccaggtgcagtggatcacaccctagaactttgggaaactgaggcaagaggactgcttgaggccaggaatttggaaccagcctggacaacatagtgagaggtcctgtctctataaaaaataaatacgaaactgatccaggtgtggtaggatgtgtctctggtcctggctacttgagcggctgaggcgggaggatcacttgagcctagaaggtcacagctgcagtaagtcaagatcacaccactgcactccagcctggacaacagagtgagactctatctcaattaaaataataataattgttattattattgtctttgtgttaacctattcttgagactggtttggttctggtgtgtgtgtgtatgtgtgtgtgtgtacacgtaaatatacatatatattgttctacgtgattaaaaaaatacacttcattcatcttccaagtaagttagccttcttgtttccattaaaatgcaggaggtgggtctggttctaccaaccttgctcgagatttatccccaggtcacccccgccccaggactctggcagagctagcgtaaggcagagcactggtggctgatcctgatgtcacctgcaggccacatatgcatctccaccatctccagacgtcggcaatgccacagcatgactctggggatacagcttctagacaataagcagcaagttagagactagaacaatttcacggataaaagacacctgctggtgatatatgacttcaaacaatgaagaggggactagaaggctggcattctgccaaccaacacctaagagggcaggggagccatagagtggggacagtaaagggcgggacactctctcccaacaaccaaggaatagacccacctggaaggcagagggagtttcttcactgggtacaaggaattagagtaagaagttattttttttttttaattagaaacaaatgaaagaatcccaccaacttcactctgtgaactatgattttaacgttaagagtaacaaagatgggaaatctatcaaaatcctcaattttgtattacactgcacactcgtgaaacagttcctaacaagcctagatgaatttcagttcttttaagccaacatttgaaatacaggtccccagtcccaccccttcctcagcagtggcccacttcggtggctgttttctaggagttgttcctggagttggtctggagtcagcacctccagccctcatactgatctcccagtgagatacgtggatctccagagttcagtactcgctacactgatggcactcagaagtttgtggaatgaatggacaaatgaatggatcgttatgcttcactggagcaggcaggatcaaccccctggaagggttaaagaaggtgctgaacgaaactctgcttttcttgccttcatgcttccttttttccaaaagggtaaaaagtagctgcattaaatccctttctgttcagatgtcctagaactgctacaaggcccaccacatatccccctcatctccaactagcacagggtaaatagtaacattctactgtaccacattttctagaatggctgtatatatgaagttacaattcacgctatgcactgctaatgaactttccacaatgccataaatgaaatatgtaatatcatgactcccattttacaaatgaggaagcttgtccaagtttacacagttaacagcggaactgggactccattctgctatactgcctcccagtaaaagtttacatggtgaatacagaacaaatattcaaaagagagaaagaggggaaacagaggtgacagaggatccagtgttggcttaataggtataaacatggtctgagcctgattataggcaaaagaaacaaagaagagcagaaaaaaaggagtcacatgcatggatagcagggtgctacaaggatgtctaataacacagacctgtggcggggagggtcacaggataatggcatgcttaaggcggcccaatagacacaggagaacactgatgcttgctggcaggctgggaaatagaggtgccttgaagaatccatggggagcttatactggaagtctgttttgggagtaaaaaaggatgaggagtgtaaagttaaagaaaaggactgaaggccattagatgttcttcagcgagcatactcagctgttaagtcaaaaatactgctgagctgaggccgggcacggtggctcacacttgtaatcccagcactttgggatgccaaggcgagcggatcacctgaggtcaggagttcaagaccagcctggccaacatggtgaaaccccgtctctactaaaaatacaaaaaaaaaattagccaggcatggtggcagatgcctgtaatcccagctactcgggaggctgaggcaggagaatcacttgaacctgggaggtggaggttgcagtgaaccaagatcgcgccactgcactccagcctgggcaagaaggtgagactccatctcaaaaaaaaaaaaaaaccaacaaaaaacaaaaacaataaaataaccaccgagctgaaagagatgggcatacaattcctacagcagaaggaaactcagttctccgggggcaatacttctcacttacaacttgagtgtgctcattgaagaaaccttggtgacctttagggattttctttaaattataccccctatccttttcgtacccccaaactcagtggtaagtatttttctttttctttctttcttttttttttttttgagacagagtctcactgggtcatccaggctggagtgcagtggcgtgatcttggctcactgcaagctccacctcccgggttcacaccattctcctgcctcagcctcccaagtagctgggactacaggctcccgccaccacacccagctaattttttgtatctttagtagagatggggtttcaccgtgttagccaggatggtcttgatctcctgacctcgtgatctgcctgccttggccccccaaagtgctgggattacaggtgtgagccaccatacctggcctcagtggcgagtatttttctacagttgtttcatgttctgagaaccaggagaaggatatttaatgttgttgggtgtgcaagttcaggtctgattcagcgggttcagaagtaactgaataacagcagggaaccagtatagggaatatcaacaagggagctgagctttgctaataggccataatttatttaaaaaaatttagtctcataactctagagttcagtacttggttcactgatggcattcagaagtgtgtggaatgaatgaatgaatgaatgaatgaatgaatgaatgagtgaataaatggttatacttcactggagtcggcaggatcaacaccctggaaacgttaataaggtgctgaacaaaactctttttttcctttattcttccttttttccaaaagaagaatagcctatgaagtaattcttcttttccctctaactgcaatagatacataataccatattttcactaacagcaaaaacaattcacattagaaggggttcttccattcaccagagttaattttttaagtggataagcaattaaagatgccaagtagattaaaattgatccctagcataaaagttgtgatcaataaaaaaacaatctgtaaatttgattgcataaatcctttttacttaagtccaccataagcataattttcaggatcactactttgatctcacttactggaaaataaaatgcaataaaaatattgctgcaaaacctagtttctagaaaataataaataaaacatccattttaaaatttttgaaccacccatgggagacaaatgcacaatgattagactatgctactactaatcaaggaaaatgcaggattaaaaagtcccttgggatctagccaagttcctaaactaacaggagaaatgctttctgaaatgcagcttgttttatttaactggttccaacggccccttactggttttcatggtttggcaactttacacattgtctttggattcttgctgttaggatctagctcacacatcatccatctctcctcctgctcacttacgcatctgttgtcagttctactggattcctgtgaaactccaaatagcgtacttcactgttttacctatgagatgtatgtcttgctgctcagtttgtatgagaagcacaaccacactcagcttttcagtccctttcccctcctctgcttccccgcccacctctgtcaccctttaccttgtcaaatgtagtaacattcacactctgttcagtagcaactgttatctttcatgatttgtctccagattcattaagttgacacattccaattttgtgtgtcatgacatataaacataatttacagtattaactatacagatgatacttattacaagagaatgcataatatacaggtattactataaatattgtcatattactagatattactgaatattaatatactatacagatatttgtaactatgcagacatttataatcctagtttgttaggattacatttccttctcaatgggttcacggtgccatccaatggaagatgtttctagtatcaaaataaaaaagaccctgtctcctccctcatgtaatttgcttttatttcaagatactaaaaaacctgagagatctccccactctattcccttcccagagaggacttacttaagttccagagtgaagccagcccctctccccggccctctcccgcagagggaaggaggggcaggcacgcagctacactatatgagctcacgtctgatggtttagggaccctctcctgtagtacaacccggctgcacatgcacagggttagaggctgaactgtgtccccctaaaaattcagatattgaagtcctcaacctcagcacctcaaaatggaactgtatttagagacagggtctttccagaggcgattaagttaacatgaggtaattcaggtgggtcctaatccagtatgactcgtgtccttgtaagaagaggacatttgaacacagacacacacacaggagaggtgacaggaacacacagggagacgacagcctctacaagccagagagaggggcccggaacagagcctctctcacggcctcagaaggagccagccctgctgacaccttatcctggacttctggccttcagagctgggagaaatgaatgtctgttgttgaagctaccccaggctgtggtactttgtcccagcagccctcgcaagataacacacagagtaacatcagccttttcccatccagtcctgtggtaacgggagcattaaaaagctctgcgaggaatgcgtgctttgttcttagactcagagatcccgtgtttcttgtcagaatatatctttctctgtatctgtagctacagacttagcagcagggagctctgtgtagcacatagggcttgtcaatagacaggtttcactttagtaaaagtggagacaggggccaggtgcggtggttcatgcctgtaatcccagcattttgggagactgaggtgggctgatcgcttgagcctaggggttcgagaccagcctgggcaacatgatgaaacccgaaaccttgtctctaaaaaaagtttaaaaaattagcagggcatggtggcacacatctgtagtctcaacaactctggacaagcccctggaagttgaggctgcagtgagccatgatgatgccactgtactccagcctgggcaacagagtgagaccctctctcaaaaaaaaaaaaaaaaaaaaaaaagggtagacacaggtgatccctacatccaggatgaggaggcttttactctgaggtatctaccctagttatccccagaaagccattccatttctttaaagggaggaatcaccctaaggcagcttcatcattgtcatcctccacctgcttttcatctccccaaattcggtttaaatcttatctgctgataaccacctttatttcctttgatgttgtagatgtttaactattagttttgtataatcttttcggagggttttaagaaggggagaagataaactcaacacgtgatcccatggccttattcaagtagaagctccaatctattttttttaacattgtttcctgatattaaatcaaataagagatgtagggttctcctgattacaattaactctctcatatggctaaataaggacatgacaagttatgcaaaacgtttctttaaagctctcttgaaagtgttcaaggaagtgggaagacatagaaatctttgagggtagccaaagggaaggaaataaattacatgtctcagaatatagaaataaagttactgggccggcatggtggctcacacctgtaatctcagcactttgggagggcgaggtgggcagatcactacaggtcaggagttcgagaccagcctggccaacatggtgaaaccctgtctctactaaaaatacaaaaaacattagccaggtgtggtggcatgcacctgtagtcccagctactcaggaggctgaggtaggagaatcacttgaacctgggaggtggaggttgcagtgagccaagatcatgccactgcacttcagcctgggcaacagagcaagactccaactctaaaacaataaatcaatcaaaataaagttattgtatcacagcagctatgtcatctggaaacaaaatattctatttaggtatggagtggtttagggttaggtctcctttatgagtagaagggaatatatttaaaattttttttaaatacaatttcctatatttcagtttcagaactggttctaaatcactggctctgagcaatttcgctagaaatgctccctaatgacctgccctgagctaatagcatcgagatcattgattagacacaagacaaggagcccaggacacagggcacagctaagctttcacagctcagattttcagcctttccatcaccacggtggaaggggaaaaaaaatcctttcagttccctgaaggatgtgttcttgcacataaattggcatttaggttcaattagatactgaaggcctggtcctttaaggccagccgggtgggttgcggctagatatgcctcggcgcctctcctctgtcctattactgggcaagtgtcctctggctgtatgtgctccaagttataacctaacgaaagggcaaaaaggtagaagagatggctgatgaggaggaagaggatggaaagaaaaggaagacaaagatttccctgactatgcacatagccagaatctcagcaggtgaaattacacagcacagagaatctcgatgaagattctaatatagatcacacaactctgaagcttttctctttaacatgagactcagttaagggttggaagggagctggtgagcaatgaaacagtaaagtacaagagggctccagcttcccgacctcactcacagtctaggctagattagcacatgccagacacagttctgttcactttacagccattgctcatttaatactcacaacaatgacactcacagtatcttcactttacagatagggaaaataaggcatagaaaggttaagtgacttgcccaaagtcacacagctagtccaaggcaaagcctcagctctgacatgggaggccattccctaactctttgttcactgttttctttaaaacatgatcttggaattactttctctcatttagcaatatcatgctaattcaagagtcagtaaaatgtgtccttgaaggtaggtacaaaaaaggatgttccctccaaaggcagccctcatcacagcctgaaccttcaaagggttgtaaggagcctcagatgcacagctgccttctctagcaccacacttttggttccactgcttagacaactaaggagaatgaagagcttgttccttattttccagcttctagaagggcaaaggaagggaataccatgagacagaggccacacagcacccaaaaatagaagaccattttttttttttaggcaaggtcacccaggctggtgtacagtggcacaatcagtccatagcagccttgacttcccaggctcaagtgatcctcccagctcagcttcccaacctgctgggactacaggcacatgccaccatgcctagctaaatttttttttttttaattttagtagagatgaggtctcactttgttgcccaggctggttcttgaactcctgggctcaagtgatcctcctacctaggcctcccaaagtgctaggattggccgggtgcaatggctcacacctgtaatctcagcactttgggaggccaaggtgggtggatcacttgaggtcaggagttcaagaccagcctggccaacatggtgaagccctgccactaataaaaatacaaaaataagccagatgtagtggcatgcacctgtaatcccagctactcgggaagctgaagcaggagaattgcttgaacctgggaggtggaggttgcagtgagccaagatcatgccactgcactccagcctgagggagagagttggagactgtctaaaaaaaaattatatatatatatatatatatttgatttggacactgactctgtatggagattttaatattcagtaaaggcagaataagttgtggaaatacctcaaataaacagaagaggataaggcatcagtcaaaccagggagggataaatcagataaaatgaagaagttcaaacataagcaagtggtaaaggagccaaagattcccaactaaaatgactactggaacaactgcagcttgaaaatatttcctgcgatcaaaatttgctcacgagctatggacgtgagttttgggaagagatgattctcctttacacaactgcccggattgaagaggatttgctagaatttagtacagtggacctgtgaatgacacaggttggaactgcatgggtccacttatacgtggattcttttccaaccaaacgcagactgaaaatatagtattggtgggacgcaaaacctgtaatgtacagagggctgacttttcctaggcgagggttccacagggctcactgccagacttgagtacgcacggactttggcgtacgccggggtcctggaaccaatccctcacagatactgaaggatagctgtatttatcccctgacacactgcagctcttcatgaatactgggagtcactatactcacctaagttctacacactgaggtaatgaggttccagattccaaatgtggaagtgaacttccttcttttctccttgtgagtgtgtgggagtctgtgggagtgtgcatgaggggagaaaagggaatgtcactgagcaccagcatgagcatgtccaagtgtgaccaagatgggccaagcattgaaagtagccaggtgggcgagtggccaagcgccagagaggccaatcccaagagtgactgagcccaggggtggccgagcctgacactgtctggctgctttcagtggtcccacagattgaggctgtgtatgaagagactcttccagcaaacacttttttttttgagacggagtctcactctgtcgccaggctggagtgcagtggcacgatcttggctcactgcaacctctgcctcctgggttcaagcgagtctcctgcctcagcctcctgtgtagctgggactacaggcacatgccagcatgcccagctaatttttgtatttttagtagagatggggtttcaccatgttggccaggatggtctcaatctcttgacctcgtgatccgcctgcctcggcctcccatagtgctgggattacaggcatgagccaccacacctggccccagcagacacttctaaggcatcctattctgaggtcaaaaatacatttttaggctgaaagatgagaataacttctttggagaaagcaatgagcagcaggaagtgtggggggtcaggagttaggctaagcactctgacacctgttagaagccttctcgagaacagaagattctcgagattcccaggtgagggtcttcagcctcatctcacccattccccaatgtcctggccggacaaaagccacaggctgggggaagagccatttctagcagagcaggcaactgcttctaagatttaaagtaaatgggggattccaagacgtctgattcagatgatcagtaaagtcactgatggtttagtctttcctaaatacagtcataaagattttaatttcacattatgtcaagagttttatggagccaaggatcttttcagtacgaatatgcctatacaaaccccacagaaatcaggcggcaaaagcaataatcataactatcaccttttgggtcaaaaacttgattaaagccaaatgacaactaaaatgtattttattagcagtaagatgaaatccagagcatatgtcaaagctggactatgaagtcataatttctctagatcacagttggaagcagtaattttatcactctgtccctccctagcctgtaaatccaaatatagttcagacagcagctctgggctgcagggtagtatcctactcactgtgagactctggggaggagctccactctcactggcccaggcaggccacacccagcctccctgctctcccgagtttatggccctgggcacctctcccaatccagggcagaatcagctgtcacaggagtaagatgctgccacacaccctggatcagctgtccccagtaggcatgccatggagtagtctaattagcctctgtgaagatgtcatgttttgtgagcaatgaggaggacctagacaattttagacatgagaacattccttcgggcatgtcagaggtgatgctctttccatgggcccttttgtgtgttcttaatacccacaaagacctgattcccatttttaaaatcaaaccaggagtcccctggcttagagtggccttctacaccccaccaccaccctgcccacaactaacacatcaccttacccaagaatgtcatgcaaatctgctcatggtctctccccactcctatccccagtgccacgtccgaaccttcattcttattacggtttgcttgtattcgtagcagagtcccacaaaagtcccccgagaaaatctcctagtcactgtgacaaaactattctggaacacggccccacttacacagctccatactggtaagggccgatgtccttccacagtcacctctcccactgcaagacaggagcaagagctacacttaccctggggctgcaacaggatgattatttgcttaccaggacagtgaaaatcctgagggaatttttttttattatactttaagttttagggtacatgtgcacaatgtgcaggttagttacatatgtatacatgtgacatgctggtgcgctgcacccactaactcgtcatctagcattaggtatatctcccaatgctatccctcccccctccccccaccccacaacagtccccagagtatgatgtttcccttcctgtgtccatgtgttctcattgttcaattccctgcacagcaaaagaaactaccatcagagtgaacaggcaacccacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactgctcatcagggaattttttttaaggcggtaagtgtcaaggcatgatctaagcttctttctcatgtagtcagaactggaccaaaattgcctgttgaatgtcaataaacatataaaaactgcacggcggctgggcacggtggttcacgcctgtaatccagcactttgggagactgaggcaggtggatcacctgaggtcatgagttcaagaccagcctggccaacatggtgaaaccccatgtctacaaaaatacaaaaattagccaggcgtggtggcatgtgcctgtaatcccagctactctggaggctgaggcagaagaatcgcttgaacctgggaggcggaggttgcagtgagccaagattgtgccactgcactccagcctgggcaacagagcaagagtccgtctcaaaaaacaaaacaaacaaataaaaaactgcatggcatttgacattcttggtattgggacctgacctgcttattgttcagaaagctatttataaaagttttgtgaaaacctgaagcattatacaaactatatgctatactgtaaagttttaataagtggggatccttttaaatagaaacttctgctaataggcaactcgaaatccccaactacacatcatctttctactttagacatttaaaaatacagcacacaaaaaacttcatcttggccatgtccacgtcaagtaggaaaaagtccaaacagaatgaaagtgtctgaattataaatccttgtgaaaatactattaatcaagagggaattaatgttaacttatctagtgggtactattatctataactctttaatatcaaactcacaaaattagcagcaggaatataattatacttaaaaaaattattttcttagtaaggttggcccatagaagaataaggattagtaagatgcacagtggtcaaacatgaagaaatgagtgaattttagggaaatttgcaagtcggctgcaatcatgaacattgtatcaagccaagtaatgaaagccactcctgcctgggtgggctcggtccagcccagcccctgttgatactctgatgcattctgcagctaaccaagttcttacagcggagaagggaagaaatggcaacaaaatacacattgaaaacaaaataaatatgtttcctgaagccaatatctgaataatccttaggtaatgaccatttatacacttgataagtttcccaagtttttctttcctctttcttaagtaaaagggaaatccaggccaatttttaagccggataatatttagaaactattttttttaggtcatttcatcccatttttggttgactagtgtaaccaaggcagcaactggatttcaaagcagcagaggaagacattctgagctcacctggagcccaacgctgggacgcagcctccaccctcccaggaaactagacacttacattcccttgccctcttgcccttctgcccttcctgccaccaggtagctggtcacaatgggagttttctttctttctgcagtggggtgaatgatcacacacacacacacacacacacacacacacccccacaaccaactcctagtacccacattctgtaaatgtttacttacttggaaaaagggtctttgcagatagaatagaattaaattacaatcttagccaggtgcagtggttcatgcctgtaatctcagcactttgggaggccgaggcgggcagatcacaaggtcaggagatcgagaccatcctggccaacacggtgaaactctgtctctactaaaaatacaaaaattagccgggagaggtgatgggtgcctgcagtcgcagctactcgggaggctgaggcaggagaatgacgtgaacccgggaggcagagcttgcagtgagccaagatcacgccactgcactccagcctgggcgacagagcgagactccgtctcaaaagaaaaaaaaaaaaaaagagagagacagaaaaggagaagacacacacacacacagaggagttcacatgaagacgggggtagagattgcagtgaaatagccacaagccaaggaatgcctaaagccacaagaagctggaaggggcaaggaacggggcctcccctggagcctccagagggagtgtggccctgctgacaccttgatttcagacttgtggcctccagaaccgacagagaattattttcagctgttttaagctgccagtttgcaggaatttgttacagcagcaccaagaaacgtacattccagatacacagatatattactctaatttttggagcagcaaaggagcatcacttaaacagttaacagggaccaacctcccgtctttagagcaatctaagcatttgttctctacaattagattaaatgggattaaacacaggcactgcttcacatatgaaattgctgtgcaaatacacacggctgaaaaatacgagaggtcaatggacagcattagcatgtccacttcatgaaaaaatgacacacttctccgtgttggtttagtggatactggatccagtccaacgtgaatggctcactttcagaaatgaatctgaaactgctgaccatcttctttggagtcacatgctaggaggtagcctgggaagaggcctgactctgaaatgtctcacacacactgtaaccactcactatttttgcaagaacttgcttttctttctagatataaacataagtacgctttgctcactgatggagtgtaattcttgaaagaagggagacgggagaggtggtagcccagggaagaaaggactgagggagagcagatagcagcagatgacctgagaggggaccagatatatgccagaaggaagaacttcaaagccaacacacaaaatacaggcaaaagaaattaacaggcacatcacagaagacatcccaacagtcaaaaagttcttaagaagatggtccagctcactggcaatatcctacacacatgtttctgaaaattccaaaatgtcttcagacagaagaaccttcaaacccaaatatggatccctaagatcattttccaacccaactacattaacacaagtaaaactccagagagccacatgatgctgcctgtgaacttaaatgacaaattctaacgttaacatttatttcgctggaggccaagatgacgtaataacaaaagtgttatgtagcttataaatggcctacttgtaatttgttagcacaattttggaagtgctttccaaggagcaagaaaaacttcaaaacataaacaaactaatcttcactatggctccatcactcataataaaggttaaggatgtaccttaaatagctcacaaacaggaaaagcatgtgtggatttctttgagaagcttgtaacatcttgtaactttacttatcctagtagaagctttattgctaatttttacataatcatagaactacatgaaatagccatattgcctaacatttatacttggctttaaaaaaattactattcctaaatacaaaaataacctatcattagaaaaggtaggtgaatatttaaaaaaatttttttaaaataataattcagtctacctttagtgttgaagtactgccttcataactattgatggggactccaaaaatatcctctatggaaaaatattcaggtatctaaaaaaggattcatctgaagaaattttatagtaatggtttcctttgaaatatttttggacctcttatagtgaaatcatgagccacaaaaataataaatgtctcccatattttaaaactaagtagtgacatatcgtcattataaagattataaagtaatcttcctatatgatgagactaaattacaattttgcttttattttatttcaattaattaatttttttgagatggagttttttgctcttgttgcccaggctggagtgcaatggcgtgatcttggctcacttcaacctccgcctcccaggttcaagagattctgccgcctcagcctcccgaatagctgggattacaggcgcccaccaccacgcctggctaatttttatatttttagtagagatggggtttcaccatgttggccaggctggtcttgaactcttgacctcaggtgatctgcctgccttggcctcccaaagtgctgggattacaggtgtgagccacagcaccaggccacaatattgcttttagattaaatttgtaatcttcagtggaagaaaaatccatgaggatttttgttttttcaaagaggggtgggacaacaatataaagatgaaactgtttggggtgggtattttatagtatataaattatacctcaattaaaaaattaaaatgaccttaaattttaaaacgacagggacttaggcgtgaaaaaaccttttggaagcatttagttcttttccatcttacagccataaattaaaggtatttcttaatttgctaaaaatatttcaaccgaattggcttatatttaagttttaatgggtcaaatatgttaaccaaggatattcttttggcttttcggggaatttgtctgtcttcaaacaaaacaaacaaaactaaaccactgtccgaatagtagagacaatttacaatgtgtgtcaagatccagagttcatgaaatgcgataataaatagcccaaaccacgagtacattatttattattactgctctaagagtaaaatgctatggtcatgtgaggtctgtgtaaaggataggacgatggcctctgccacgtgatctagaagccacataacgcaacttttgtggaaagcaagaggattcaatctgtgtgtgaagatggcaagggctagggctgcacaacgtggtggctaagagcacgggagtcaaaatcctaggctgggaaacagtatcatcttgggcaaaacactatcatcttcaggcaggcttctcatctgtaaaatggggataatgcaacgtacgattcttgtgaactaatcttgtgaaagcagtaggcaaacgcctggcttcacaggcaactaagacgtgagctatgttcctcaactggctgggctctgttctgcagccacagggtaggcctggcatcccagaaatgcttgtcattgataacacggggacatcaagtcagagaattcgaatgtcactcctgaaagtctaatgaccctcagctgtcatccacagctcattggaaaactgctaggtaggacccactaaggctgacatatgcatacctcacaacccagcaattctactcctgggtatacactcaacaaaaatgcttacatatgttcaccaaaagaatcagatggttcataacagcatgattcataatagccccaaaccagaaacaacccaaatgcccgttaatagtagaagataaacaaattgtgggatactcacccaaagaagtattttatggcaatgagaatgaacaaactatagcaacaacacagatgacaagtcagaatgcaagaggccatggtgtatgtttccatcggtataaaatataaaaccaggcaaaactaagatagcgtcagaaatcaggacagtgttccccaaagggaggatgcagatgggaagggacctgaaggtgcctctgactgctggaacccatttcttgatctggctacatgtgagagagtttaggccgtaaaaattcaaatgctgcaccctcaggatgtgtgcacttttctggaggcatattatacttcaataaaacttctaagaaactctctggccaggcacagtggctcatccctataatcccagcacttcgggaggccaaggtgggcagatcacatgaggccaggagttcgagaccagcctggccaacaatgcaaaacctcatttctactaaaaatacaaaagaagttggctgggtgtggtgacgcacgcctgtaatgccagctacttgggaggctgaggcacgagaattgcttgaacccgggaggtggaggttgcagtaagccaagattgtgccactgcactccaccctgggcaacagagcaagactcagtctcaaaaaaacaaacaacaaccaaaaaaactatctttattattgataaaacaattcaaggccacgaatccagggtagcccacaccaccctactctgaggccctgaaaaattctgcagacctacgtcagcctaaccagcaggatgaggggccccgggccagggagcaacatcctctctcaccaatgatctctttacatttctaagcctggcatctctctgttgctttgcacatgtctgaaactgagcagttcttcctgccatgtcttatcttctagactttggtggccatctgtatggaaggaatcttcaggtaaaagacacgccacaggatactaagctgaaatgggacccaacttcttttaattaaacacatcttgcctcaggcaagttatttaaaagaaatatctgttaagatactagaaagaatggtggctcacatctgcaatcctaacactttggaaggccaatgtaggaggatagcttgagtccaggagttcaagaccagcctgggaaacatggcaagaccctgtctccacaaaaaataaaaaattagccaggtgtggtggcatgtccctgtagtcccagctacttgggaggctgaggtagggcgatcacatgagcccaggaagtcgagactccagtgagccatgatcgtgccacagcactctagcctgggcgacagagagagaccctgtcctccccgcccaccccacccccgaaaaaagaaacaaagaaagaaaaagaagtatctgttgagatattaaagatacatcttttaagaaactacaaaagaataatttgtacaaaatttaaatgaacactagtaatgtacagaattttctaattaggcatacatcatatcctactaatcttagtgaattcaaagttactagtgtgcgcaaagttattttaaaatataaagcatgctggaaaacaaaagtttctgaaattctgtacattcacttctaaaatgtcaaactaggctgagtgcagtggctcatgcctgtaatcccaacacttaaggaggtcgagaggtaggaggcctgcttcaagcccaggagttcaagaccagcctgggcaacaaagagagaccccgtcactatgaaatattctaaaaaattacctgggtttggtggcatgcacttgtagtaccagctgttgggaaggctgaggcaggaggatcactagagcccaggagattgaggctgcagtgagccatgatcataccactgcactctagcctgtgtgacagagcaagacactgtctctgaaagataaaatgtcaaaatgactacttatttggatcactatgcatgagaaatagtttcttctcaaagtaaacacatgctcatatgagaatatttcagtcaataatgctccctctctccggtgcagcacagggaatgtttagggcacagaaactataaaatagtgtaaaggtggatacgtatcactatacatttggcaacacccatagaactccgcagcacgaggaatgagccatcgtggaactgatggacttcaacaacaatttatgaatagaagctcgtcaattgtaataaatgtaccacactaatgaaagatgttaataatagggggaaacggagggggattcggcgggcgagacagaaggacagggagggagtatatgggaactctatactctgttcaatttttctgttaaccttaaactgctctaagaagtgaagtctattgattaaaatataaataaataaataaataatgcttcctcccgccttctaagatgcccacattttacctttgatcatttctgcaggaaacacctagtttagaatacacaggccacaggaaagaacaaaagctttcactattttcagggttttgtgcttgtatgtgtgaacatctttgtcactcacggtcagtgatttatacagacatgatcttaacaattcagtatggagaacgactatcttttttttttttttgtacttggctggatactgtcctgtgtaagaaaatatattggaaaatgtattcaaataaaagcaagaataagggtcgactttaataccgtggggagaaatccgatcgattgggtccataaggaaagatgtatgcattcggtgctccctaattacaactgctttggtgggcagcagcagtggtgaaacagatgttggagacctattaaagacggggtttcaaacatctgcttacaattttaaggcaattgtaaatacagcagagaaggtcaattgggccaattaaggccgatgtgcaaatccaccactgcaggtttcttttcaagcttacatggacttgattttttatgctttcattttctacaaccacaatttttttttaaacccaggaaatgggtttaataacttttgtccatttttgattgttattcttcttaaatggaagaaaactttctgttcaaagaagtcactgcacaccttttgcctcacgatgactcattttccttccctcccctcccatgctcacagccggccactcggccccgatcaaagcgggttccatattaccagggaggtgaggaatcccgaatactgggcttcctttctaagccataatgaacatgggcaagtgtcaccttcagaaacttccgtgccgcggcacacaacagtgctcccagctgtacggatgggactgctgggagcatttgctgcttctaccctaggcaccttcaccagcctttattagaaaatcatgagtttcatgaaccgtaaatacaacggcaaactgcactatccctcttctaagtaggtaaaactgaaattctcatggtatgcaaggctcattcatgtcagaggcagtagcagggacacgctcccagttaattccaggccagtgctacaaagtctaaggcccacttgctgctcaaaaattggcccccagtggtggagcgggacttagagactgagggtcggcaaagaggcagagcagtccagctcaacattactaggtcatttctcttaaagctgcacgtgtaatcgttacttgtgctaagtaggtaaaaaaaagtccaagtatcacaggcatcaaaatggcctcctctgggagagtaagaaataagcctggcctatcttccttcctatgagctctgtgatggccaccggagtatattatgccacctcttcttggtggcccagaccactcaactgctctctttatatagagaaaaaaaccaaggttgggcaaacctagattcaaattctgcacttcttagctgagtgacctcgaagcctctgtttcctcatctataaaatgggaatattgccatttctagagctctaaaagttgatacaaagtaggtactcaataaatgttgagttcctaaaggtgatacacagtaggtactccataaatgttggtttcctaaaagtgatacatagtagacactccataaatttagtttcctaaagttgatgtgtggtgggcactcagtaaatgttggctttgtaaagttggtacatagtaggcacataataaatgttgcttcctaaagttgatacctagcggcagtcaataaatgttggtttcctaaagaaaatacacagtaggcactcaataaatgttggtttcctaaagttcctatacattaggcactcaataaatgtcgaggtcctctgtcctcctgagacctttgggacctccaccaagacatttccaaggggcctagactggtgtttccaaccaggcagggcagttcccctgaatgtttctatttgtttattttcggggggaggtatatccagtttttgtgctgttgttgatattgttgttgttattatttgctttgtttttggcgaaacaaagagtggataatgaaactacaaaaaaattctaaaagaagaatccttgaggcagcagaatgggaagaaatagttttcagaacaaagaaaattctgaaggaaagtcaatataccgcacagaaatctaggttgagaaagaactgtttttcccttacatctcctttttacttttcaaccttgaggctcagctcactcaggtctgagcaagaataaagagtcctgcttgtctaaacaactgctaaatctgaaggcaaacagctcaactccatgtggttcttcagcaacattcctgtcaacaaaccccgtcttggctcgattggtccaacaataccagatttagagccatccgctcatccttcttccaggatgcaaggggattttcaaaaggccattccaggaacagctctcacaatttttgtagccttttcaaaaacacaaaaaatctaattcatttgctgcactgcttcagccatccagcttaaactaattttaaaatctctccttttgtaaatagagatgttagaaacgccaccacagccacaatataaaatgatggtatctttctcttttgtaatcaaattaccatcatttattataaagcttcagacagaaacctgagagatgggcaagacgacctggcgttcagaagagagagatggcatttttgacattgaaataaaggcttggagggcataaatccttttttaaaaatcaagtatttagcacaggatttggtataaacactgatcaataaataagagccagcagtcatagcagcacgctagaatcaacatcatctgagttctagcacagactcgtttctatgaatcattgaaaaggaatttcatggtgccagcagcatcagtacagaaagtcagaataagcacttagacagtaataccagcaacttatttactatcctacgttagagtcagtttgctggattttatataaggtaagtaatggatatctaaggtactgtcaattaaaaaaagttctccaaagtaatttttatttaaagttgcatatgataaactgtaaaaccaaaataacatttgggtcaaaactccaaagagttgggctatcactaagctagaaagagaaaaacagcagaaagaggattttcttgctgatatgccaaaaacgtgactctatttctttcaacagggtttattgttttcttcctgttttacaacagcaatacatataagaattttttttaattcagaaaattgcagagataaggggaaatttctcccctaattctattccccaaagagaactgcctttcatgtattctggcaaaattctctcatcttctttcaatgcatgcagaaaccttttgtttatttacttttcgaaaacaaaattgggtcatacaataggtattgttttctgatctgcttttctaatttttaaatgctgtgcaacagttaatcaaacggatatacaattaacctcccattattaaacaccaagaacagcttctatttttctgtattataaatggcaaagcgacgaacatccacatatataaaactttgcatcacttcatctacttgggttaaattcctacaaactgaattgttgggtcaaaatacacgcacattttaaggtatgtgatatacaagacatgccagaaaaattgtgttaattctgcacaatgtatgagagtactcttttctccataactttgcccacataattgttgttttttttttttttttgaaacagagtctagctctgtcacccaggctgaagtgcagtggcataatctcggctcactgcaacctctgcctcccgagttcaagcaattctcctgcctcagcctccggagtagctgggattacaggcacgccccaccacgcccagctaatttttgtattttagtagagaggggattttaccatgttggccaggctgatcttgaactcttgacctcaaacgatctgcctgcctcagcctccaaagtgctgggattacaggcttgagccaccgcgcccagcctcaactgtaaagctttttgtatactgaaaatattaaacttttatgattatattccaactatttttcctccattagtaacctgtttcatagtgctgcttaatgcagagaattttattattgtagaccaatcaatctgcctttttcttttatcattttcccttggatttataagcttagaaaggcctttcctatcctaagagcaaatacaaaatctgctttacatattgaactaatattgggatggtactgatttttattgcaatatttgagaaggcaaaacagagtttaaggaaagaaaaaagaaatcccaaaggatggggaaagaggtgagaaggcttctaaaaataacatttggcagacaccggctcaatgcaagtctaatttgcttcttagttaatgaaggagaaaatggagatggcgaagaaataaaaggtccattctagaatggcaataataaaatcccctgtgaagacaataacaacattcttgttatacatggaaatctaatcctaaaataataacgcatatattgatataacagcactgtgaataaattccatttaagctatgttattttaacaatgacccagaaaatgttaaactaaagaagtttgttacatgcctagtttggcccacttagagagccacaggttctcagaaacatatctggaaaaggcctttttgtctgcaatcaatgcatccatcatggtgcaccaactggctgactacaaagagcttacacataaatatatgtgcatatacatatagattttacttgcatcaaaaggtaaaaatagaatttggtttattttgtaaagccattcaacgtaatcataatctcattaggatccagcagaaaagaatgactctggcagctttttgctgggaccctggtacctccttctgcgggtagaaaaggagcccctgggggcatctgggtggaaggaaggctcggaggctggagacttgcttgcctggatgccagccagtgtggcaaagatgtccagggcagcctagagtttctgctgggggcaggggtaggggtggtcagggcacagccaagtaccgggcagtatccaccccagcccccactgaactgccagcatccggctctgcctgtctttggcttctggcttgctttcctagcctgattctctgaccttcccctcggcattgagagctctccaacattcatccttccagtgcatttcttttctgcttaagtggcccaggtcaatttctgttgtttgcaatcatgaaccttgactggacaaactcttattagcttccggcagatattaaaagatgcatgagctcactttgatgcaaaagggcctcagcatggatgcacgccttatctatgagaaagctcctctgcttcctctcctggcctccttgtacttatctcatggtttatacttgattttgttcctttcaactttcttcttttcatgcccaactcccctccctaaaatgggtctggtggcagaggtgaaggcagagagcagaggtgagaagaaaataggaaagtgagtaacttttggatattacttttcagaaaacattctgtgtggcagtggccactttcctgtcaaaggcttaacatttttttcctataaatacattaaaagtgagtcagacttggatttgcaccttaacattattgccaacactttaaataactatatgttctctacaaatgttctctactaaagaagggactcggagaatggagggagcaaaaaggagaatggggaggcaactccggggcagctcacctgtctggccctgtgtggggtttcctctttagaattcagcaggctgtagggaaggtgaacactgggtactaggtaacccctgacctggtcagggagtctgagaaaatcggagagactgctctctatcctgcacccccaagccccaagctccacaggcttgcagggttgtcttgggaagcccctcccagaggccagccccaattcagcagggtgacggggcatggaccacacacgcatgcctgtccttagcgccttgagtccggagacccctgttcctcccagttcccttccttgtggaatggcgaagggagaggtgtccccagggagggttttggaccgtagccacctcttaagattctggggtcgggggacaagtcctgagtccaagggaatagcagggtgacactggtcaacaggtatgtgagtcctggttgaattcttgccctcaaatgttcatgctacattttctgtgtcccttccaccctcaatctacagcgaggagctcccctatcctgggccagtcggggtctacaagccagccagggaagcaaagggagagagggagaggccttcgaggacactacccctgctggaggggtgaggcgaggatatgccattgttgaggggctgtagcctacggccacaggtgatgggcagggtgggttaggaactgtgtactccaaaactggttgtggtttctctcagcaaaagctttttgtacctcccctccctccatggaaaaacaaaaaggttatgagagagaaagatattaggttaagagccttctacatttcaatagagctaccatacaatccagcaatcccaatcctaggcatatacccaaaagaatggaaaccaggatactgaagagctatctgcactcccatgtttattgcagcctattcacagtagccaagacctgggagcaacctaagcgtccatcaacagatgactggacaaagaaaacgtgctgcagatacacaatggagcactatccagccacaaaaaagaatgcgatattgtcatttgcaacaacatggacggaactggaggtcattatgctcagtgaaataagccagacatcgaaagacaaacattgtatgtccttatttatgtgtgggagctaaaaattaaaacactgaactcatgttgatggatggtcatcagaggctgggaagggtagtggggggcagggaggtaggtggggatggttaatggggacaaaatagtagttagaaagaatggaaaaaacctaatatttgctagcacaacagggtgactacagtaaaaaatattttaattgtacatttttaaataactaaaagaatataattggattgtttgtaacacaaaggataaatgcttgaggtgatggacaccccatttaccctgaggtgattattacacattgcatgtctgtatcaaaatatcccatataccccataaaatatacacatactgtgtacccacaaaaataaaaaataaaaattttaaaaagcttaagagtcctccacatttcagaaacatatatttttaaacattaggaaaaaggtagaaaaacagtagtctatggccgtaagagcccgcaggcaccctgcttgtccgatcacggacgctaagcggggttgggcctggctagtacttgcatgggagaccatgtaggaatgccgggtgctctaggcttaaatttaagtaagtctaagtaatttaaagagatttttttaagacgacagattataagtcaaagtgccaccctgtggcacccatgactgttcctgctgcagagatgctctgaggatgccattcgttctcacatggaattctttcatgaagatcccaaagaaattcctgtctggtctcaccttccagaatacatctacttttttctaagcgtctctctaagtttaatctgtgacttgttgacttctttacatcagctgttagtaaatctaaagacaaattcctaactgatgagataagctggattacctgaacattaccatggagcccctctgggttatctaacacgggaagaccagaggctttctctcctggcagagaggaccatacccagcttcccaggggccctcaagtccatgcacagggcagctggatttcccagacaattctggtcagcagccaacaaacaccccaggtcctgctgcttggtgccaggccagctgctgccccactgacaaggggctctcacaattcctatgccaaatgaaagcagtaaggaaacagagttctttctccaaaacacattcacacttcatggccagcacagagcccagcacacctctcagaggggtaccagaaggatcagaggaccagatccttggtacatctgcctctaaagcctgatcgttaagccatattctaagaccttgaggaccccaccccaagtcctagtgcacaataggtacctcctgcaaagatgcaacctgcctgaaaccatccctcagacacaggaccccgctgaggacatcacttcctcatccctgccagtgcacatctctggtgcagcttctccttttgcccctcccaattttaattcaggacctgacagatttataaattgcctccagtaatttctggaacacagcagcacagaagaaggagaaggagggaaaccaaaagaaaaaacacaaattctctatctttcaatgcaagtataactttttgccatgggttttggcttcctatgactcagtgcacactatcacctcgagattctcatgatgaataggattgaaaatgtcctaaaatagagccaccttcaaactgcagtaaaacaccttcccaagagggcacacaggtacaaatggtcttaagggcaaaaaaatccacagagcctcactctcccatatgtgctttcctaaaacacgttatttcggagcgagcttggagttcaggcacacaaagctctatctttaaacctctccttaaacaactgcctttctcccatgtgacaaagaaagggagagcactcaccctccctgggtgtaactatggaaggaagtatcctggaagcgtaaaaacctccatggggcaacagacaggtcatacaaaattctgatgacagcaaaaaatgtgcagatcaaggtttttataacagtatgtttaaaacatgggataaaatacaagtttttttaagtatgttattgtattgatgaggtagtattaaaattaaccatttcaattttctcaaatagttttaagtacagcagattaaactaaatgtctttaactaaagcactaacaggtataatgataacaatttggtaagtcacagtaaagtctcttaactatccttcagatattaataaagtgaataactctaataaccagtaacagattctttcacaaatcaggtgggttccagttctttgctttcaacaaaactgaaggaggacctaactgagttattaagtcaataaaaataattactgatgagagtgcaatataatttttggcatataacttgtaaacatttcaaaaaaactgagtggcaatgctgtttttaaaaattaattccatccaaatggaattaacatttgtttttgttgtagaaaagcatcctggagtgattaataaaagacttttcaagcataaaaatgggttatattagtatattgttctatggggaagaatggaaatatgagttcaaaaatataaaataacgatgtgaaattttgactattaaaaaagagtctcatataacttttaatggataatggcaggcatcaaataggtatggcatttaaattcattggataaattttagaaagacatgagactctttgaacgtcaatatttgtcatatgttaaaaatcacatcctacaattaagcttttgatgagaactgttagatgtcagcttaaacacgtgtaaggggatttacagattttcaaaattattttaggggtacacaactaagaacactgaacaatcactgctataatggcaccctattactctaccacaggaacaaaagctcccggggttcccaccagagacaggcacatctggggcacggggaaggacgcttagagtgatgctcatttaaaaagctcattttaacagggaacagtaagacaagcatcaaaaggaagtgcagactgtacagatccttggagctctgcagggggagtgacttcttaggcgctggttttcctcctgtttatgagagtaggactaataatttgagcagttcaaggtggggaaaagcttaagtactgagtgcactgaggaagcagaggtcacaggaaggaccccatagcgaggtcctctgtgggtgcaggactgccccctaggggacatttcagaactctatttttctggttgtcataatgaccagaacgtactgctcagaggggccaaggattcacgatgtcttgcaacacacaaggtcagccctggacaacaagattctcccactattaaaacaaatttttaatattccactggacacacatttagatgaaatacttgttcacaatgatctgacttgagaatctgattctatttttgcgggtacacagcaagtactttctgtacagcggtattaaactctaaatattccaaagataggaccaccatgtaaatcaagggggagttgggtaaagtccatacaagcacaatctgtttcgcactctgagaccagatcatctcaggctacactattcatagtgtccaggctgcccaagaccttgcagccatcatattcatgttttttttttgtataggtgcatgtgtctatttcatcacatcttcttaacagtcagatatgagcacatattccgatgcatattattttctttaactttttatttctatattggtttttagaattatctgtatagatcgtttatataatgtataaatccaacttcaagaagttggccacgcatggtggctcacgcctgtaatcccagcactttgggaggccaaagcgggtggattgcctgaggtcaggagttcgagaccagtcttgtcaacatggtgaaaccctgtgtctactaaaaataaaaaaaaaaaaaattagctgggcctgatgatgtgtgcctgtaatcccagctactcgggaagctgaggcaggggaactgcttgaaccagggagatggaggttgcagtgagccgagatcacaccactgcactccagcctgggcaacagagcaagactccatctaaaaaaaaaaaaaaaaaaaaaaaaaaggttaaaggtggcagtacaaaatgtttgtttgtttgtagacaggatctcgctctattgtccaggctggaaatggcacaatcatggctaactgcaacctctgcctcccaggctcaggcgatactcccatctcagtctcccaagtagctgggaccacaggtgcacgccaccacacctggctaatttttgtatttttttgtagagatggggtttttctgtgtttcccaggctggtctcaaactcttgagctcaagtgatctgccctccttggcttcccaaagtgctgggattacaggtgtaagctcacacacctggcccaaaatatttgttataaaaagagatatggacatgctacaacatgggtgaatcttgaaaatattatgctagatcaaagaagccagaggtgaaaggccgcatgttatatgattccatagctatgaaatgtccagaacaggcaaatccatagaaacagaaagtagatggtgacacccagggctggtgggtggggggcagggggaaggggagtgactgctaatgggtacagggtttctttttggggtgattttaaaaagttctaaatttgagtgtggtgatgaccatacaagtgagaatataattttaaaaaccaccgaattaattgtatgctttaagtggttgaattgtatgggatgtggtttatatttcaaaaagcttttttaaagtattggtcaaatttggttgaaaagcgctactccagacttgctcacatggaagagaactggaggggaaaaaggtaggccagaacatctaggtgggacccctacagggttaaaacagctatgaagtatcagaacacttctgctatttagactgcggaaggctttcattttaaaggacatacaaatggcaatgaacataggtgagactttccaaaatagaatctatctcagattgcaaataaataccacggcttctatgggtcgaaaagacataaataacacacaccaccgccaatagtagtcctttgaaaccctccagacccaattaacacactaagaaagcataaaaacataaactgttctaggaagtatatcatcaggtaaggtaacacagtccccccagcaacaaaaagaaaaatagaaggaaggaaaaaaaaatgaatgtccaaatagcacccaccaccaataatcacctagttaagagaaaaccacatctagggatcaagttccctcacctcaagttatgaggcgggtatgagccagtgcatgaaacagctaatgtattctgaaatcagaaaaccagagcaaaggaactaagatttactagcacgtaaaaccacacacacacacagacatacatacaaggtaatttctccaggcagcatcttactttgattaccttaaattagtaatttgctaatgcaggcagttctcactttgcatggtcccacattaactgaaagtcacgcatgtccattgcaaacagtgtaaagtgaggacactgttctgatatgcacaaatttcagtttacatggcgccatgcaaagcaataaatgcctctaccaaaataggtcaaacaacatgtttaaaagtcttctctaatatggaggtctgtttgaaaacccgtatcaggattgcttatctcttgttcaacattgccgtttcaaaacccaagccacaccaggtattcattccagttccaggtcagttgcttcagcgatattcccaaaggagaacatgaacaaaccctcaagatcctttcttcttccctttctttaacctttctgtttgttcgatccgattccaaagctgtaggtggaatggcagaaggcaggagtggggtaggagagatacagagaacctccgtctccttgctagactctcctcactagtcctattccgaagaggttcacaagaattcatgctgtttggtctttcatttgtgtactactggaggaagtccagctaggttaccaatgataccagcagtcttagcaaggcttggtaagaagatgagctgtcatgccaatgtcctcacatcgatcctcctttgttcacccaccccaaacctccagggccctcgctggggctcctgctcagagctcccactcctaggatggcatttcagtggcccaagttctggtggcttcatccaagctcccctcaacaaagcagagtgatcctgttttccccataaaagcccagtttttagctggccatcatttaatttaggatcttggttttttgttttttgttgttgttgttttttgagatggagtctcactctgttacccaggctgaagtgcagtggtgcaatctcggctcaatgcaacctctccctcccaggttcaagtgattctcctgcctcagcctcccgagtagctgggactacagacgtgaggcaccacacccggctaatttttgtatttttaatagagacaaggtttcaccatattggccaggctggtcttgaactcctgacctaatgatccacccgcctcaacctcccaaagtgctgggattacaggtgtgagccactgcgcctggccaggatcttgtttattttttattatattttaaacattttcattagatatttaaagtcatcaagattttataaaaaatttctttcactgcccttaaacttaagaaatcttatctcatcaagagcatgactaaatatccactttatcctctcctcctcattcatattttaatatttaattcactcatttatctggagtcctttttgatacatctctaaaagacagataattccacaatgagttgctagctaaacattacttgaaatttcaggatgggactctgtcctcaccaccaagctttgtttccaagagatgccatgactgataaaactgaggttggaaagatcaatgtcttacagaaaacagaagattggggggaaacgattgaaacagcactgaatatgtttatgaaatgcatccactcactcaacaaatatttaccgtgcctctgtgtcatccaagttccagggatacagcagtgagcaaagttcctgactttgtaaggtttaagtgatagagacagagacagatgttaaataacgcagtacatcaagggctgaggaggccttgaagaatagtggatggagggtgcctgcagtgaggtggtggctgctgttgtcaggctgggagggagcccgccctgccatgaggacctctgggcatctgcaggagacagggagcaggccatgcagctgtgcggggcaagtgccttccaggtgaagaggaagcccatgcacaacgcaccagaggctaaatgacccaaatttgcagagtgagccagttcccaaatgctcctcgtgcatcatcccctccccaggcttgggacatctacaacaggctgggaaccactggggcaggacttcctaccaggtttgtcatctacaggctacacctcttctgaggcccctaagtcacccaatgtttggcttggagttttttgttttttgttttgttttgagatggagtctcactctgtcgcccaggctggattgcagtggtgagatcctggctcactgtaacctccacctcccgagttcaagcgattctcctgcctcagcctcctgagtagctgggattacaggcgtgtgccaccaagcccagctaattgttgtatttttagtagagacggggtttcaccatgttggtcaggctggtctcaaactcctgacctcgtgatctgccccgcttggcctcccaaagtgctgggattacaggcgtgagccaccatgcctggccagcttggagttttttgtcttttgtcctggcattcttcctttcctgacttggttctcctagaacctccctggcttctcacaaatggtttctaagctgaagaatccattgttctgagtctgaccttgcaccctcagctctccccactctgcaaactccactgggacccccacagggtccacaagaggagaggggagcaggacaactgtagtcttgttcttttgcgtaagtggactgagttttgcagaggtaggaagatggaagattttcatcttttagtttcaaaagtctgtctcaaacccacagctggagtggccttgctgcacagagcagtgactttcatacaagttgtcttgtggttaaagggcatccaactccaaacccaggagtatccctcaaccttttgaatttcgtttaaaataaaactgtaggatttcaacaaggaatagaagtggtcccaaggtgggcttcacaaaccaccattcccagacatgtttgtggggaagccttcagcagcaatgctgctcaggtgggcattcaggcacagtgacaaggagatggggaagaagacggtttcgcaataatcaattacaccactggaggctcctggctgcctaagggcacactggccctgaccccatcctgaaattgttccttgcaggtcgcatatttactcaatcaatattcatgcagagtccactctacagcaggctctaggtcagaattagctggatgagaatgctcgggttccctgcatgtgtgcacacacgaaccctatatatagtacattttgcagtgggaggggttacttttaattgagcacctgctttggtgtgtctaatatagtgtttgatttcaaccttattctgagtaggcattactattcctttttttcaaatgaggaaactaagcagagacagatcacataacctcccccaaggtcagccagctagttagtggcggggcgggactcaagccagggtgatcagactccaaagccatgccccctccaggaagtcacacccctccaggaagccacacccctccaggaagccacacccgccaggaagtcaggctaattccccaaactagccactaaaagtggccaggactggtcagatcaacatgcagagaaagctgctgatgttttattgttaataaggtcccaagttcaagttttatttggagatgttcaaattttaattattacttttaattgaaatgcactgtaatttaatattaatttttgtgtaagtcaaatgaattaggctaaattgcaactttcattttattttggaaggaggagaggctgaagaaaaaaagcaataaataaaaaggaaaaattatttctcttagaaattcacctgatagagagggattactgcattttctaaaccatgtctagtttagacacggcacatctggtatgatagatgctgtgtatgaatggaaacaagtttagggtaataaatgtttcccagtgttaaaataaacgcctcagcggttcagattttggccaggcagtttctccacagtaggaggcacttatctactttaacactttgctacttagaaattatcactcaatcaattaccgtccacctgggtttatttttacagagagcttcaataaaatgagtgtgaaaataagttaaacacattctattcattttctcaatttttcacctctcccaatggtggttatgttgacagaaaaattacttcattttatttcaacagacatttatggaatgctgaccaggttctgtgctaagggctgggagacaggatatgaccaagtggaatgaaatgtggtccctctcattacagagcatatataacctaccttttagcacaggcggtgtctctacagcccaaatgaaggcaaccacgagaaaaattctggaccctacaatctccacagccctccccttcctcccctaccacaagagactgccctttgcccaggtaacgtccctgtggtgtttacctatgtggtccgtcaagctctcaggtgcttccagatatggaaatactctttcaccaaaagatgtttgttatactttcttttttctttttaaacttttcttttaggttcaggggtacatgtgcaggtttgtttaatataggcaaactcgtgtcagaggtttggtgtacagaccatcttgtcacccaggtactaagcctagtacccaatagattttttcctgatcctctccctcctttcaccctctaccctccagtaggccacagggcccattgttcccctctttgtgctcattggttctcattatttagctcccacttgtaagtgagaacacacagtatttggttttctgttactgtgttcgtttgcttatactttcttttaaaagagtacctccctcttacatcacttctgacgtaagctttagaatttctgtaccatctgtctttttaaaaataatagctttactgagacataattcaaataccataaatccaccctttcaaagtataagactcaacggtcttgatactttcacaaagttgtataaccatttccactatctaattccagattcatcacccccaaaagaaatccctcacacattagcagccactccccattcctctctcctccacccccctcaaccaatctcctggcaaccactgatctattatacttactatccccatggatttgcctatcctaggcatttcctataaatgaaatcacacaacatgtggtcttcttctgtgtctgacttctttcattttagcataatgttttcaaggttcatccatggtacagcatgcatcagtactgcattcctttttatggctcaataatattccatcatatgactagacattttatttatccattcatccactgatggacatttgggttgttcccaccttttggctatcatgaagcgtgatgccatgaatatccacatgcaagtttttgtgtggacctctgttttcatctctcttgggtaggtgtctaggagcagagttgctgtatcacatggttaactctgtatttaaccttgcaaggcgctgcctgttttccaaagcagctgccccattttacattcccatcaacagtgtggaagagttccagtgtctccacatccttgcgaatacttgttactgccttttttctgacagccccaggtgtgaggtggtatctcattgtggttttgattggcatctccctgatggctactgatgttgggcatcttttcatgtgcttaataataaatctattttcctttacaaaattttcttaggttttttgggtattctttcgaatttcacattttgacctacaagttcagaacctctccgcatccgttcctctcaccctcctgtaatgtggtgtggtcgcctgtctttcagctcctacagtcggggcctgggccaccatcgctgctctcgcatggctgatgagccttatagagcctacatcacatctcttggacctggaaggggaaggaagaggaaaggcctggagactcaccaaaaggaaggaattcagcaatggcagaagtgagccccgaagtcccaaagtctctggattattctttccaccaagccatgttacgcccctaattcaacacttgtcatttctctttctctctttttttttttttttttaaagcgacggggtctcattatgttgctcaggcctcaagcgatcctcccacttcagcttcccgaatagctgggactacatcgcgccactgagcctggcttcaccatttcttaattgctacaaattccccaaatcccatgagacagaaatgtatgttcagtcataaatatgagtgcacattattctcccaggcatgacatggaacaagtaaaacagtaatcctgctttctgggtgcagagtcagtgaagaaacataaaaacagtcgcatagaatgatgcacagagatttagaaatagcaccataaaagctctaaacagggagattccacctggagacatcagcaaggcttgcagaggagagagaactgaccatcgccgatccactgagaaggaatcagatggaaaatgtgggggtggggaataatcagggatgggaacagcacattcaaagatccagtttcaggaaatagcaggtgtttagtgaaactaaaacagaaagcatgagggtcacaggcggggtcacagaaagggtcaaggctggaaagagaggctggggccagtgcttgtcagtcttccctgccatgctcagggttgggattttgtaggttctgaaatgcaaagcctgtgagtttttgagaaaggaaggaacgtgattagatttgcacttaaagacctcactgcagcaaccacatctctggatatcatacagatagatcttttcagcatagtaatgaaaactgaaaattactgcaaaatgcctaaacttgttcaagattctctttgtatcatttcttcttggcaaagttccgctgctcaagacccaacaattcatctcaaccactcaccacaaggttaagaaatgctctgatgctgtggtgttggaactcagctatgttgccacaaagtagtgggcttcaaacctttggcttaaatgtcccctagtagaattacaaaaaaaactatgaaagccctgcatatttttaagttcacataaaagttttccgtctaagctaggacagttgcaaaggatgcaatttctggtttgggatcaatattgacatttaaatgaaactattatatcactcttgtaagtgtgttcaaaggaatcaaattatcataaaaatgtgttatccaccatcatctaaagtgcatgaacaggctgggtttcgtggctcatgcctgtaattccagcactttgggaggctgaggcgggcggatcacttgaggtcaggagtttgagaccagcctggccaacatggtgaaaccttgtctctactaaaaatacaaaaattagctgggcatggtggcgtgtgcctgtaattccagctacttgggaggctgaggcaggagaatcacttgaacctgggagatggaggctgcagtgagccgaggttgtgccactgcactccagcctgggcaacaaagactacgtctcaaaaaaaaaaaaaagtacatgaacaaacatttcctttagtcaaaaatttgcattccctttcctccttcaagaaaattctacttcaccccaattccatcctaatcctgcttaaaagtcttacttctctgttttatctacaataaaaatacacatcaaaaaattgtagtttttatttcctgtaaccattaagctctaagtgttaagttttcatattatgaattgattcagttacaattaccaatagtacagaatggatcaaaatataaatgttttaaattttaataaaagtattatgtataacttgaaatccattggaaatccatcttttaaaaagatgaatgggcctttttatcctttctatagatgaatattacttatggctagaataagacaaggttaacatcaattctatttctactttccattttttatagatgttaacactgagaaaccttgtccatatacctaagtacagggaaataaaggagttttattatagcaatgctgctcaattctttaaactgcttccaacatatttgtcaaaaatcatgccttatctatcattaaaaagtgttttttaaaatcttgtcttttgctttctgacaccaatatttcatgttgccctgtctgccaccctagaggctgctccgtctcagacaggctccatccatagcaagattatggatgggtgagaaaagtcagttgtggggcggggcagggtggggtgcgtggcagtgggtgggagaagaaaacaggctgatacccccaccactgacatctgctcgggcggatcaatctcaggcaagagtccacgtggaggctaagggtctgaaaactccaccactccccacttatgtgccccagaatgcgcgccagtttaaaggaatggctctgaggcaggtttgtagactcctgggtctcctactccggttaaaccttgaaacagaagctctgttcctggggaccccgagaaaggagatgcaagcaggaaagaagcaaagatggaaaaagatgaaaaatgttagaaaatggcataaaaacaaacaataaagtgtttttcagaaaaacagagaaaagctctataaattagaactctgtggcttgccccacacaaagccatcagattagggagcagaccctcttcggctttctcctccccagctcctgcctctcctaaacatacccagagaacctcttcagtctttgtaccgttttgttattgttatttttaagcagagggtcatcatttcaaccctggttgttccaaacgaatagtaaactgtgatagaaaattctgaacattccaccaccagtgacccttactattctgatatggtctaataactcagaattattccctatcatacatactttatataacatcagctaccacacaagtttttaatacacagtaagcaggtggccccagcaatttctcttatatctcacatctggtattgtactccatataaggtgctgagtccgattttttaataaaaacatggcctgagcttgtaaaagctcaagtaaaatatgcctttaaaactgctgtatttaatttccagtcatgaaagtctaaaattattgtaaaataatactcaacttttttcacagatccattcaatgaagcttaaaagtactttcctttcagaaaggtaaagagcttcataactaacagtttcttgaattcacatgtgctgtcttacttttgtgagcgtgaattgtatacattttatacctttcaatctggaccaaattagttggttagtagcaccaaagtaatatacatgtatgtttcggggcagaggtgggggaagggaatggtaagggaagggcagaaatgctggaaattaaaccaataacttgagacttggaggaattcattattttttcaaaaaggaaattgaagacataaactgaagatacacactaggtaggaaacatcaacaaatgtgacatgattatgaatattatcttataattagggaaatagccattttgacggtcattacactttatgtgaggttagtgtacaatgtggcgtaaaagactggtgtaaaaatgagatggatttctgcaagttcaaacttaaaatcgtgcatctgactagatataagctgttgcgagtgcattacatctcccactccagtctaggaaaggtggagtccctttcatttacacgactattttcatgactgggcaaattcacagaggaaacacagggatcacattccttcgatcataaagtcctcaaaagcaatcttgctccatgtcagctggtgctaaatcaaaaggtaactttcatttcctttaaataattcagtttcatctctaactatcatcttcaaccacagattttaaattgatgctaaattgggtaactaagtagaaataaattagtagtagatgatgctggctataaaaccaagccaagaatttgagtagtttttttttttttttttaaaggttctgctctactgaatctatccgataatatttctccaaagaacttttatgctagtgctcattttttcccttttgggggatgatggaaagggggcagttaccctcccttgttatcacaagtaaaatgcaaaaatcagcccacagatggttgcagagaaaaaggtcctctcaaaccccaaaggcccaagtgtaaactgatattaatagatctgctcagtttgtaggcagtttaacaatagctatccagactaaagacacatgcttgatgacccagttcccataaaagagaaacatcacacatgtacatatatctggggggcagagttcctcgatgggcgttgcaacattggttctcagagaaaaacaacagaaatcagctaactatccattaggaaggaaacagctagcagctaaacaaagcgtagcatgctcttattgtggtataatgtacagtagtaaaaaggaatgagatagatcaattggctacaacatagctaaacctccagagtacatggctgaattatagagtaacacagcagcaaacacagatcaaaatccaaccaaatctactttccccttcttggcaacagaattttggctgcaaagtgcatctccctgactcccctcctttcagctaggcaggctaggaccaggttcttgccaatgaagcataccactccagcctcacacgtttaagagaaaatctctacccctctatttccactcctttgtcttatctgctgtgtggaaaagcaatgaccagatgactgacctagaaagtcacatgttaaagacggcagagcccctgtcagcctgggtctctgaatgactgcatggaacactgcagcccaatgacctacatacactacttattatgttctgtcacatgagggagaactacatgcccttcttttaaagccaaattactgtcaagtctcttactatagcaacttaatcttttatcccaacatagaaacatacagtaagatgaccaggtgcggtggctcacgcctgtaatcccaatacttttggaggccaaggtgggaggatctcttacggttgggaggatctcttgaggtcaggagttcgagatcagcctggccaacatggtgaaaccccatctctactaaaaatacaaaaattagccaggtgtggtggcacacgcctgtaatcccagctacttggaggctgaggcaggagaatcgtttgaatggggaggcagaggttgtaatgagccaagatcacaccactgcattccagcctgggccacagagcaagaccccatcacgaaagaaaggaaaaaagggaagggaaaagggaggggaaaaaggaagggaaaagggaagggaagggaaaaaagagagagaaagagaaagagaaagaaagaaagaaagagagaaggaaggaaggaaggaaagaaagaaagaaagaaaaagaaaaacagtaagaccccttctatattaacaccatatcaaaaagacttgaaaaagcagatcaatctcctgacagtgattatagaggtgggaatgagagaaaggaagggcacaggcaaaacaagacagatgggattagggaaaactttagatttcacttttaaatatatgaacagaaaatatatccatgtattactcatacaattgaaagctgataatctatagaacgtaacaattttaatgaccaattctattttttcctctaagtttttcattgaggtggcatttggattctaagtgattccagtcaatatatctttccataaaatataaagaaaatgatgaccaaaataaaaatagtcataaaaaaaaaaggcgtcatgagaacattgtctggcactcacactctggaaaggggaaaaaacaattggctggcacgacgactttgtccccacggagcgttgtaccgtacaagcattcttccaccaggctaccatgtgagtgtgggcagttgtccccatctcagggtctccggaacctgggagaagtccatccaccctagtctgggagacagcacaggctccaggagacgaagtgaaggctctgtcccctgccagccatcaggtatagtacaacctccctctctccaagggacagtttcttccaatgaaaaactgaggcaccgcacaggttgtgtctgagatacgactcctcgcattcaagtctcagctggaaggccctaaggaaacaactgcaactttttttcaatgacctgagtccatgcattaagcaaaagatgtttaatttatttatttatttatttatttatttatttatttatttattttgagacagagtctcgctctgtcacccaggctggagtgcagtggtgcgatctcggctcactgcaagctccgccttccaggttcacgccattctcccgcctcagcctccggagtagctgggactacaggcgcccgccaccacgcccggctaatcttctaatcttttgtatttttcgtagagacagggtttcaccgtgttagccaggatgatctcgatctcctgacctcgtgatccgcccacctcggcctcccaaagtgctggggttacaggcgtgagccaccgtgcccagcccaaacgatgtttaattttagatgagtttctttccccatctcagcatctaccagaaaagagattttcattttcaaacctcatttctttcctaaggattacccatgcaaactgcatttcatactttcaaaatgccctttgcttattaaaaagcactgtgagaacacagacatgcttaagaaatttcatgatacacggagaacaaaaaaattctacttttgatcattctcatctttaccagacttgcttagtacaattaaattatccaccctaaaataaattttcttctagataccatatccttattttgttaatcctccatcttaagtgtattgatgtccttaatcttgtgtttataacatctgggttaaaatcacagactcacagaacaaatccaacccccctacttaaagagaaagaacagaggtcttccacctagaatcattttatgaacaataggggaactttaacttctgggaaaaccctagattcctgctttggaatcctttaggagtgggaacaggaatatgaacaggagaaaaccacctttaaaataaaacccgtgaaccctagttatagcacctttgaattgcaaagaatctgagaagttgtttgccacgattttaaaattaattccacaccaaagcatgcatgtttttcatttaagagacttcagaaattgactctgaaggactgtcagcagcgaaacctggttgcttttgtgtctcgccccagtactgctattaggagtgcagcctctggccaccagtgacctggacacacacccagctacccctctgagaagctgcgtctggaccactgcatctccccgggaacctcattgacaccacaggcttattaccatgaaggggtggggggaggaagaaaagagaatacacctaagttctccttagcaggcctgatacggtcttaacagtcactctcatgattattagctattaattccttatttttcttagttattacttgcatgattttcacttatatgagcatatttcccccaccatttcttaaagtatcttcccatataattattaattttaaaactaggttatcaataaatagacctatatttctacctatgtcatcctccaacggttattgataaatttgctacctttgcagatatgaggattttcatctcagctttccagtgagaagtgattgtttcggaatcatagttacaagtttcccttaaagtaactggaagtcttaaaagggggcttcatgacaaaacatcacatgaggaaaaatatcttaaggactagttagcagtgagaattttcaataaaatcatgagctagagatatcaaggctaaaattcaaatactaagagaagaaaatgttcctaactcccacaggtctggtccaactgttttaaaagacctgggcagaagggtttggaaaatggcatctaagaaggaggaaaatttagcacctacaccccagccctggccccccactccaccttcaactggagccttagagaggctcttttgagcaattatagagtaaaattacatcagaatatacattaatgagagtattttcaataatgcaaacgctgctaattatatcttttctttttaacacgaggtagaacattttacagcaaccctgagaccggccgtgtgcccagcagggagcctcgtattccgcacacacttggaaaggccatgacagcaggctgcatgatatgaggtgtgagaaatgaaaactttatgtgcatacaaatttagatttttaaaatattttcactaggggcataaataaagagaaattagaccactgggatttcagaaaacgagaatacagactgtgatttttgttttaaattttggtacttagagtaccccaatacctaaagaagtaaataattcagcaagttaccaaaagtaacacttcacttttaactttatactttttatataatttgagctattttgttcaaggaaggagagaaaattgcacacatttaaataaaagaaaggagacaaggaaggaaaacaaagggacacaggcaccaccacagacggccctttatcaggctaccatgacacatccatgcaacaagggctaccaaaaacgctacgaaaatacaatttccatcaatttacactgatttttattataccatagcacttgaaaaaactgtccacagttatttgcccccattataaaaatattgacactttaccacaaggttggaatttagcatgaacatccacatacccaccacctagacaagtcacatactgggagttaatattcgcaaaacatatatctgaaaaaggactggtatctgagatatacaaagaacttctacaactcaataataaaatgacaagtaccccaacttcaaaatgggcaaaagatttgaacaacatttcacaaattaagaatgccagcagtgtaataggtacaataagtataatcatcctcaacaatatctgttttcaggaaaatgcagattgaaagcacagtgagatacaactgcacacccaccagaccagttgaaagtaaaagactgaccacaccaaatattggtgaagatgtagaggaccacctaccattaacattttcttatacttgctttagtacatatcaacctatgcatccagccattaattcatcttcttgctttatgcctttcaatgtaaattgcagatataccctttaatacttcagctgggctgggcgcggtggctcacacctgtaatcctagcactttgggaggctgaggcgggcggatcacaaggtcaggagatagagaccatcctggctaacatggtgaaaccccgtctctactaaaaatacaaaaaaattagccaggcgtggtggcgggcgcctgtagtcccagctactcgggaggcggagtttgcagtgagccgagatcgcaccagtgcactccagcctgggtgacagagcgagcctctgtctcaaaaaaaaaaaaaaaacttcagctgcataccattaactagagttcaatattttagtttttatgtaaaattggcctaccttgatatgctaagatctgctgggttttgacaaatgtgtacaccaccgccaatcccagaaacaaccattcttctaattttctcccaccatagattagatgtgtctgttcttcaatttcataaaatggaatagcacactatgtacttgttcatgggatgtttctttcactctgcataatgtttttgagattcgtgcaagctcattcctttttattgctaagtagtgtacctttgtataaatatgctacagtttatccattcatctgtcagtggacatctaggttgcttccaggttttggcaattacaaataagcttctatgaatacgacctacaagtctgcatagacatgtatttttgtttatcttgggtaaatatctagggatggggttacagggtaggcatatgtgtgcttttatttaaaaattgctccactattttttttcaaaatggtcgtatcattttatattcccaccaacgatgttcagaaattgcagttcctctacaacttcaccaatatttggtgtgtcagtcttttcattttcagctgatctgggggatatgcagtggtatctcactgtgcttttaatctgcattttcctgaaaacagatattgttaaggattattacacttattatactgctggcattcttctttttttttgtttgtttgagacagagtctcgctctgtcgccaggctggagtacagtggcacaatctcgactcactgcaacctccacctcccgggttgaagcgattctcctgcctcagcctccccagtagctgggactacaggcgtgtaccaccacaccaagctaatttttgtatttttagtagagacagggtttcaccatgttggccaggatggtctcgatctcttgaccttgtgatccgcctgcctcagcctcccaaagtgctgggatcacaagcgtgagccaccacacccagccattgctggcattcttaatttgtgaagtgttgttcaaatcttttgcccatttttaaattggagtatttgtcattttattactgagttgtagaagttctttgtatatgtcagatacgagtcctttgtcagacatatgttttgcaaatattaactcccagtgtgtgacttatctattcatttcctcatcagtacctcttgatgagcagaatttttctttttagagacagggtgtcactctgtcatccagcctgaagtgcagtggtgcaatcatatctcactgcagccctgaccttttaggttcaggcctcctgggcaactgggaccacaggcatgtgccaccacatccagctaattttaaaaatattttgtagagatggagtttcactatgttgcccaggctggtctcaaactcctaggatcaagctatcctcctgccttgacctctcaaaatgctgagattacaggaatgaaccactgcacctggctagaatttttaaatgaagtctaacatcatttttcttttatagttattgctttctgtcatcagtttaagaaatttcttcttagtcgcaagtcatgaagatattgttttcctttaaaactttacgatttttcacttctgtattaaggtctatgattcatctcaaatcaattttcctgtatgaggtgaagtacagcacaagattcccttcttttcctatatggagcacatatctacttactgtatcaccacttcttgaaaacacatttctttccccatcggattgctttaacacctgtctcaaaaatcaaaggccctaacacagtgaaaccccgtctctactaaaaatacaaaaaattagccaggtgttgtggtgggcgcctgtagtctcagctactcgggaggctgaggcaggagaatggcatgaacccaggaggtggagcttgcagtgagccgagatcgcgccactgcactccagcctgagcgacagagcgagactccgtctcaaaaaaataaaataaaataaaataaaataaaataaataaattaaaaagccaataaggtgcagatctatttccagggtattctgctctattgttctattttcttgttaatgccagtaccatatagctttgattattgtcattttatagtaagtcttaaagttaagtagtatgacttctccaccaactttgttctaaattactttctccattatagaacttttgcatttctatgtacatgttagaattagtgaggacgtggtggcccatctggagcagccactgtggggacaccagctgcaatgggggaggtgtggccagggctgctgcactccatggagctaacacaggccaggaatgggcgggagccctgccccctaccaagtcggctgggcaggagccccatgctcccaggtgcagctgcggccacccagccacggctctggacccaggcatccctgcactctcgggggtccaggaagcacccccggtccctgcaggcttggaagtgcctactcgcactccctggcctctccccgctcccggcacccacttcagtgcaaagttgtagccaagcgcgggtgctgtcatgacccagccaggtgtgcacatatgcagagtagccagcactcccctccccgactggtgcttcagccccctctagactttggtcaccaatgaacgcaggagggagaccagaggactaagcgtgactttgtacaggcctgtgggtgcccctcagcatagacagctgggcaccacggacagcatgttgatggcagcgggaggcagacaggctcctaagcaggaagaagccagttcctggtgaaaccacaccttcaagcctgaagcctgggctccaggctgccagttccaggtgaggtccacggcctggagtgagaatttcattgacaactgtttggccattcggatggtgctttttccaggaccagccagggacacccaaggaccagtcagcacacacttcctccattgtgacaacataaaaaccccagattcagccactcacactctcctctggaagaccccgctgagagctggacacatgtcgggacaacctgtctgcagaaaggagctacccaccatgggtctcctcttcgctgagagccagacagatgttgggataacatgtctgcggaaaggagctacacactacaggtctcctgtccactaagagctggacactcatcgggacgatctgcctgcaggaaggagctacccacttcaagtctcctgagagctgttctgccactcaatgaagcttctctctgccttgctcgccctccaattgtccacatacctccttcttcctggatgcaggacaagaacttgggacctgcccaatggtggaactaagagagctgtaacacaaacaggggcaacgtccccctgctcgccatgttgcaggtgatgaggagagaagagaggcagctcttcggggagccagacctaggggctccccaagccagggctgtgacaccctctttggggctctgcagttcctggtgtctccaagtttctggatgccaccacattccccttgtctaggtgctggtgcctgcagcagaagccacttgtggtacatctgatctagcctcagccttgcacggaggcagcacccgtgccagggcatggagctgcctgccccaccgcagcagccactgtgcactggcctgcctgtgcacagtggccagaccccaagcttgctcgttcacaacccctcgccagtgtgcgcctggctcacccgtggcaggcatgggatccaggctgagagtgcgagccaagtgcagcctgccagggctgaatgagcccagcaggcccgaacaaaactcaggcaaaggtaccaccagccacagaggtttctggctggaaaagcaatactctaaggatcctgtgacattttcgtatacatttccacaaaaatacctgccgtgattttgattgagcttgtaccaaattcgtacatcaacttacagcaaactggcattttaccagtactaactcttccaaaccatgatcatggtttctctacgtaggtcttatgcagtttcaaaacagttcgtactttcccttgtgatttcttgcttgaccaatggactatttagatgtgtgctgtttactttctaaatacttgtgggtttcctagatccatttttgttattgatttctaatttaattccatggtggacagggaatatactctgtgatttcaatcactttaggcttttggagacttgttttatgacccagcacatagtctaccttggtgaacataccaagcacacttgaaacaaggtgagtttggcaaggtatagtgttctggaagtattaggtatcaggaaggtgaaagtggttgagagtgttatccagattatctatgtttttcatgatttttggttagctgttccatcatgggctaagagagcattgctgaaatctccaactatgacggtggacttctctatttcttttattctgtccatttttgcatcatatactttaaagctctgttattaggtaaatacacatccatgagttgttatctgttctctatgaattacccctattgtcactgtgaaatatccctccccatcttttgtacttctttgtcttaaagtgaattttgtctgctgcttaaaaagtcactccaacctccttaggctgttaatgtggtatataatttcctatccttttacttctaacctgtgtctttataattgaagtgtgtcttgaagagaacatatactcaggtcttgctttttaaaaaatccattctaacattttctgccttttaataacagggcttagtctattatcatttaatgtaaatattgataaggttgaattgagttaaaccatttggttaatttttatttttttctctcttttttttgtgtgtgtttctagtcctcttttcctgacttcttttagattttttttttagaatggcattttatctattggcttttgaactgtatcttttgccttatgtgtttagtggttatcctagggattacaatgtacatccttaccttttatatcaacttagcattaatattgtaccatgtcagatcaaatgcagaaatgttacaatcttataggtccatttaccacccctttgttgttcctttttgctagagttgtcatatgtattctaccaatgaatgtaagactatgtaagatgatgctacaattttgctttaggtagatatatgtgtgttgggggagtattttaaatttacccagatatttgtccagagagcattccttcctaaagactcaagtttccctctagtgtttttcctttcaccttttgaaacttcctttggcatttccttccagcagacctgcactatgacacattatcttagtgttcttttacctggacatgtattttgccatcattattgaaacattttgttggatatggaattctgggttgacaagtttatcttccttgagccctctaaaaatattgttccactctcttctggctttaataatttctgagaaaaagtccacagacattcaaatcattgttcctcactgcatgaaatgctgttttcctcagattactttcagtacttgtttttttttttaatctttggtctgcagcagttggactataatatgcctagatgtattttcatcatattcatctggcttggagtttgctgaacttcttgagcctggaaatttatgtcttctgccaaactgagggaacatctggccatcattttttcaaattttttttccatctctcctacacatatattaaacattctgatattatccataggtccctgaggctctgtttattttttaaatctttttctctcttcttcagattagataattattactgtcttattttcaagttcatagaacctgagaacatgaagatgataaaattacattctctgtgggtaatcattgaagggtcattgtgaactagacagaagctagaagaaacatacaattctaattttaaaaggaaattgtactaaccagagatattctatcccaagtgaaattcaagtaaataaacgaaactactactactgagcacctattaaaggtcagaaattgtactggcactttcatacttaccattgtatttaatttagatcacagctcattaataaaggtattactgcccacaatatacacatagtagtacagaggaacaaaaaagtaacttgtcccactaattagctcaagagctgagactttaacttaggactcccgttatagctttaccactcatctcattgaaaaaataaaaaattaagagaattgtcaagagttagacatattagctagcctgattttcttttgtaataagattagtatacaagtagatattggaagtatggggaacatagtacattacgatttcagcaaagcatctgtcagaagtaatatagtattacaaactaacaattagggctcttaacacagataaaactcttaaatgctgcttctatcacttactctttatgtcactctgtccaagcatttaaactctctaagctatagcttcccccttatctctttaaaggggaaccatgatgatactatctcaccaggttttagttaagaccgaatggtaaaaatctacagaatgcatttagcatagtactgtcacatagtaaatggtaaattagtgttaactattattattaaggcatgatatctcttgaacaaaaataattggaatataacataattatgaatattcatgaagtattgtaaacaacagttattaaccccattcctattcaacttctgtcaatgtctgctttgttttataattcaccaagtatcttccagaaaagaaagattgtaatgggttcactacagaattatacagaactgctggctcaaaaagaaatatgattatttataataggaaatcaccagcaatgacaagaatgcattcacagaagattgcttaaataaattatgatagactaatcttgcacatgtagtgtaggaggaaataaaagactagaaggagatacaccagaagattaacatgattcatatctcttcaactaattaacaaacatattaaataccatttgggaaaagattacatttttttcaacagtatttggattcagatttccattttggaatggggtgggtttataaggagccattctgggagacagaactatctccaaggtgactggaaggggatgcctcaagttataagagctcaacagaccaagcacagtggctcacacctatagtcccagaactttgggaggccaggaattcaaaaccagccttgggcaaaaaagtgagaccttgtctctacaaaagctacgaaaagttagccaagcatggtggcacgcgcctgtagtcccagctactcaagaggctgaggtgggaggactgcttgagcccaggagttcgaggctgcagtgagccgagattgcaccactacactccagcctggatgacagagcaagatcccatctcttaaagaaaaaaaaaaaaaaaagagctcagtaaatatttgactgaacaaatggtaggaaattgcccagtatctggtgctcagacacatccacaacactgcagagggcattcaagccctctggcccctgaggtgcctgccagagtttggacagacatttgtttgtctgatttaaggttcagtagaagtcaaatccctcattcgtttccaatgatgacaacatggtgctggaaacatttggtgcacttcatgacaattttccaggtatcaacagtaaaaacagaaactgcctgtaatcttacaacggtgctctatctccactgcctggaacaaaggttccaagaaggcctcttagcagttaggaaacatgctcatattttgcaacagaaagaagggaagaggaggcaggagaaggaagaaaagagaacaagatctgaaacgaagctagagaaggcattttaattgagctaaaaaacaaaacaaaacaaaacaaaaacaaattctaaaagtagctccacatcagagattcacagcccaggtttgcaacatctaagtttcttgtattacctcaatgggcatcacagaatgcaaaaaaaaaaatcatattacatttcatcttgtttccatttataaaagagaagatgccataggttgtttccggaagtggaaagggtattgaaaatgagtagaaaggatgaaaataaaaaccaggaaagcagggagattgccacgacttgcagaatccacctcgaacactccaccaggattccaagcatatcagaccccacactccgattccacggcaggttctatactatgttagtaagtcaaataagctttaacaaaacatcgaaatccaaaatgtcagccacgacctcatccaagaccactccacatctgcccaaactccccttacccctcccagagcactccttagggcgtgggagccgaggggcattttccaccacagctgagttcttcacgccactgtatcatcccctcctgcgttctgggtgtttgggttggaagcgatgccagcagagagtttttgtttgtttgtttgtttgtttgtttgtttgttttgagatagagtctcactgtcacccaggctggagtgcagtggcgtgatctcggctcactgcaacctccacctcccagattcaagcaatctcctgcctcagcccctcaactagctgggactacaggtgtgcaccaccatgcccgactaatttttgtatttttagtagagatggggtttcaccatgttggccaggatggtctcaaactcctgacctcaagtgatccacctacctcggcctcccaaagtgctgggattacagacgtgagccaccacgcctggcccggcagagatttttcttctcggatatcactcagctgtaattggagacatctgaacacccacccggatcatcacccccactcccaccccaggagccactttgtctaacaggggcatggaactcattcgactttccctgggttccagaaggaaactccaattactcagccaccactactgttagcgtgggaagctgggaagcacggaatgaagccgagttatgaatcatgcacacacagacagctgtcgggggatgcatgccaaccagaggggccacacatattccgtgttgatgggacagcacctgcaggaggcagagagaacttgtaacagatcatatgaaatccccattgccgtaattcctttttggaacagggcagggcataaaaagaagtaatccagatgatcagccagacatgaaaagaaaagaactgtcctcaggccagctgggcctcagtgtccgtgttggaaggacacttccagctttggtggtcttgatgtccataccctgaggaacctggcctctgagaaggctcccaggacccatgtggacaggggggctctgcaccattttacttgaaagggggctttacaggcatggtggcacgtgccttaatcccagctactagggaggctgaggcaggaggatcacttgaatctgggaagcagaggttgcagtgaaccaagattgtgccactgcactccagcttgagcaagagtgagactccacgtcggccgggcatggtggctcacgcctgtaatcccagcattttgggaggccgaagcgggcggatcccaaggtcagatcatcgagatcatcctggctaacacggtgaaaccccgtctctactaaaaatacaaaaaattagccgggcgtggtggcaggtgcctgtagtcctagctactcgggaggctgaggcaggagaatggcatgaacccggaaggcggagcttgcagtgagccaggattgtgccactgcactccagcctgggtgacagagcgagacttcgtcttggaaaaaaaaaattaagccacagatctagtataaccctctaatctcacagatgagaaacagacccggagaggctgagtgattcaccaacatcgcacaagctgctgtgtcaaaatggcaggcaagaaagttacagtctgagattttggggtttttttgttttgttttgttttgtttttgaaatagagtctcactctgtcgcccaggctggagtgcagtgccgcaatctcagctcactgcaacctccacctcctgggttcaagcaattctcctgccttagcctcctgagtagctgggactataggtgcgtgtcaccacgcctggctaattttctttctttcttttttttttttttttttttttagtagagatggggtttctccatgttaaccaggatggcctcgatctcctgacctcgtgatccacccacctcggcctcccaaagtgttgggattacaggtgtgagccaccgtgcccggcccagtctgaggtttttgtatttcatttttaggtaaattctgtatgcacatattacccaattttaaactgaaaactctattagcatcaaggtgacctctggaaccaaagggcaaagaaagaggcaggtacagacttccccatcattcctccttctcatctccttgcccttccacaaccagggaaaatccttctccgccaggcaatgacttcatcgtttccttctcactaatttgaatactcttatgggagagccaaacaaaaaatgaaaatgatgaatgactccttgtgcaatgcagaaaaaatgtggcgtttgggatctcacagtgacggaatacccctcatgcagaaacagaacatgcttctctccaaaacaaaaagcagaaacaacaaaggtatttcagagctcagaaggtgttttgccaaatggtaggtgtgtaaaagattttaaaggggcaggtgaaagcaaatcaactctcacctccaaagcaggtaactgttttatttgaaagaaaaacaaaagttccctctaaataagccacaaagctaagtcaggggagaaaaagaaatggaagagagggatgcctaacaagtaggaggaaaaatacctgctgggataactggcacatttattttaaacattgacagattttgactaaaacatatttttaagccggaactcaacctctatctgcacaccccatgtgtccaggtgactggtcagacctcaatcatgaacactaacgtctaagaatatctaaaaaagtttctacttagaaactactgttaaatcataatccaagtttgggcaatgctgctttcttatcatagatttcttactgcatcagaatcttgaaacatatgctcaggttttatttgcagtttccactgtcggtggctatcagcagcgctgtgtggggaaagcacctgtcttccttggtagctgaagaggagattaaaccaactcttggtggccaccccactccgtgtcagagactatgcaatgggctttccacagcaccacctgctctgaccttccccacatgaatggctgccaggtccgacccgcagaccatggctgaacaacggatgaacaaatgcactcagacacaagaatccagtgaaagagcaggctaggggacccggccacccacagacaccaaggagggtgctgtaatgagtcagcagccacagccccgaaaagccggcactgtgggcatttattcagtatagatttaatgacaaaggccttgagtcaacacatttgtgggcaattcacatggtcacccagacccggagagagtagttctgtgcgtggatgcttaagggcgaggttccaaggcctaagtaaactaacttacctagatcagtttatttatatccccttgttatctaacgtaagctttcaggcaccagataaaagaatctggctgccttcagccaaatccttttccgaagcttttgtaaaaccttccagccttccaagaaggtttgcatcttctgcaatttttcccaccacccttaccaatctcctacaaatggcattaccatgagtgggcattattgcagcttgtccattttaagatgagatgtcatggaatttgccccaggccagtagccaatgaagctccagagcctgccctgctttcagcatcccatgcagccttgcccagtgggaaaccagacttctaataaactcaggctggttattccaaggtcatgtctttggcccttctgctaaagaataactcctttacaatctaaagactagagtggaagcagttccaaccctcagcagattcagctcactactaaactaaaatcaacacatttggatttttctctaaggtaaacctgaactggggggaaaagagcatagagaagtccctgtcaccctctttattgattatcttttctaaccctaaaccttgccttattaccttttgtggtcttttattgcttgtttaaataaaacagaggcatttgacaaaatgaatattaaatgtagttacaatcaagcaattctgcagagtaataaacatctggggttttttttagagcttaaagagaatgtagtaatgtcaggtgcacgtgtttctgactgtcatggaaggttcaggggtctcaggaaggtgtgggtgatgcacaaggcatatccaagggactgcgaaaatgttcaaaccactgcagatttggctcttttgaaatgactgtgaattacctgtgaaaatgataactaaagggttaagatttcaaaaaaagagaaggttcaatgaaaaagagacttgcttcacatataagagaaacacaaacatggacaactgactatgttttctcatctttcaaaaaaagttggactaaaatatttttggcacaacagtaaccagcaacaaacaattggttctagtatgagaaaaaaactgtcgaaatcttcaaacaaaaactccattccaagaaaacacctaccacaccaggcacggtggctcatgcctataatcccagcactttgggaggccaaggtgggaggatcgcttaaattcaacagttcaaggccaacctgggtaacatagtgggacccctgtctctacaaaaaatttaaaaattatccaggcatggtggctcacgcctgtggtcccagctactcgggacgctgaggtgggaggatcacttgggcccaggaagttgagactgcagtgagccatgatcagaccactgtactccagcctgggtgacagagcaagatcctgtctcaaaaaaaaaaaaaaaaagatacacatatcacagtcctgaacacagaccacaccaatctgtttcatggacgtccacagcactgctgctgaaggatgcgttataaaggctaaaaagaattgcacacaaagtttaaataataatgagagttccataaatattatctatgtactaagagtctgctgacatattatctcggcgcatcctcaccctatccagtgaggcaccctgaaggagggccccacatcttctctattccccatgggtcccagagcctcacacaggatcttgcacacagctggtgtgccagagaaagtagttaagtaattaaactttttatttttaagtagactattaccagctacatgacacagataaggaaatagaggcataaaaggttactgattttcccaagtttactcgtctaataaattgggattccaaaccagggccagcaggaccccatcccaagatctaagtaatgtaaaatgaatgaaccacgggctgatatgcaatttctgcaaatactttctaccccagcttttctaccatgttatctacttttttttttttcctaaaagtctcatacaccctcaaaagatgaagactgccaccattgagaacattcaaaagataggtgctgttggccaggcaccgtggctcaggcctgtaatcccagcactttgggaggccgagacgggcggatcacgaggtcaggaaatcgagaccatcctggtgaacacggtgaaaccccgtctctactaaaaatacaaaaaaaattagccgggcgtggtagcaggtgtctgtagtctcagctacttgggaggctgaggcagaagaatggcgtgaacccggaaggcagagcttgcagcgagctgatatcgcaccaccgcactccagcctgagcaacagagcgagactccatctcaaaaaaaaaaaaaaaaaaaaaaagatgggtgctatgggtttgaaagagcttcagcagaatccctgccatggctgggcagcttgccctaccctgaaggaggccatgttcgctccactccaggtgacattcactcctgctgttctgcgcagtcaaatttgggatgcttcaagttgtccaatagtaaaatgatactcaactgcaatggattgaatgtttgtgttccctccccaaccctctgtcaaaattcatgtgttgaaatcccagcccccaatgtgatggtaatcacttttgcaggtgattaagtcatgagggtggagccctaactaatgggattaatgcccttctatctgaggaccgttgagagctctctcaccctctttctgccatgtgcggatacaagaagtcagcagtcagcagggtctggtggctcatgcctgtaatcccagcactttgaaaggccgaggcaggaggatcatttgaggtcaggggttcgagaccagactggccaacatggtgaaaccctgtctctactaaaaatacaaaaaaaattagctgggtgtggtggcacatgcctgtaatcccagctgcgcaggaggctggggcaggataattgcttgatccccggagacagaggttgcagtgagccaagatcctgccactgcactccagcctgggccacagagtgagattctgtctcaaaaaaaaaaaaaaaagtcagcagtctacaatctagaagataatttgaccaagccgggtagcaccttgatctcagacttctagcctccagaacggtgagaaacaaatttctgttgtttataggccattcagtggatgccactttgttactgcaccccggaatgatgaagacatcaacatcaacgctgagaggacactgggacggctcagttctaatgaaaatgcacctaaatagaacacattatcactatcacaaaatggtaaacatcaaaataactctaccatacttgaaaaatcggtgacaaaatatgaaaataaacaaccaagaacactaaaaattaatgtagaagcttctctgaaaaataccaggccacagaataattcaacttcaggagcttggcatgtgaaaggttaacttattcaggtgttgaattggaacaacaaaaaaaatttgatggagaatttgccagaataacccttcagtcacaaccgttgccaaagtcaaaggccaaagttatattttaaattttagaagtaaacattaaaatgaaggtttcttaaaattctccaataattttcacttttaaagtaccaaactgacacataaaaaaattcgtgctaattatcccaagcaatcaacttctttaaaaccctttatttcacaattacgctaatatcccattaatttgggacacttaccaatgtatttattctttgctcattacctatgtgcacattaagagtacaccaataacacaatacaggcattaatatgtaaaacatcaacaaaagccatctggaaagctaatgaataatcaagggatttcaaattaaactacagaattttcccttagaatctttaggacaacactgtcaagctcaatctattcacttcgcctccagaatcaatttttcaaactttatgacaggtctaatcgcttccacctgtgtctccagcttgactcttgactggcatgctaccagccagggtggaaatgtagacaaagacccctattaggatccggctgtttctctactgtgaggtcactcagccattaaattagttccagcccaatttctgtcctctcgggcctcgacttcaggggaggagggtgcagagttgagtcagttagcagcacagacccagaagggaagaaaagggggaaaagatgtttgggactgactaggtaggtgtgcacaaagctgaaaagctggagttggtcccaaactctgaaatcgaaatactatctttcttaaatgactgcagctattctccccaatgcgatcctgcccccttcccatttaaaaaaaaaaaaaatatatatatatatatatatatatatatatatatatatatatatatatatatttatttatttattttatgggattgtgtttccttttcttctccttcatttgtagaaagtcaactgtctcccacacaacatttcctcaactcacatgaggctgattcacaaaactagctcagcaacctaaaagcgccagaagtcactgagagataaaaggctggttggtggaggctctggcgtgggcgcatcaccaggtcaaaggaggtgagctgaagatgcctggagagcatctagtgttccaacgcccctgatctcacagctgaagacagtaaggctcagggaggagagactgtcaaggtcacagagctagtgaatgacaaagtcttggttccagcattttccctactagattacgagctctacagcatcagaaacaaggcccaacacacagtaactgcaaaaacaaaaacaaaacaccacacatcgctcctatatcactgtgcccacctcctttctgcccaaagccccaatgatcagaccaagaacggtgtacacaactttacaaactggcacaggcactaggatctccttctgcaaacgcaccgtcaggcatggacgctgcctgagccgccaggacacctctccagtgcctaacacagtgcctggcatacaggagttgctccagaactgcttatcccatgaggcaaagaagtcaaatctaagcctgaaacatcaagggactcaaacggtgacaaatgagaaatcagcttatttaataagaaaatctaaaatattctttacaaatacaaaacgtccaaccttggacaacttattcaggatgcacaagtatacgaaggaaattggcgtaagcaagtttatgcccatctgctcaccacacactgcggtttcacgtcatttcactctctgatggagacttggtataagtcaatcaaaaaagacgctattggccaaataaaagatgattccaaaaatagcacaatgactcagttaccccaagctcctatgtttcacagtctagcctcatgctgtctccagagggttgactatcatttatcaggagattaaatggaatgtgccacacacccactacgtcaaggcagactgaactctgggaggggcttttcctgcagtgacaatggatttgcagtggctggtccacacccacttccctagaccccatcaccaccaatagctcacattttgcaaagggattcctgagctgtagctgtgggatgtgagcctggaacacggagaagttcactgtcccagacacagacacagacacagactggacccatgtccctgggactctacttaactggctgagctaactgctcacagggaaacctactaggaaatagcacagaaaaataaaggtctctggcgtgaaacaaaactggcaatacacacagcatggtgatatggttatgccctgtgcccccacacaaatctcatcttgaattataatccctgtaatccccataatccccaggtgccaagggagagactgggtggaggtaatcggatcatgggggttgtttctcccatgctgtccttgtgatggtgagttctcatgagatctgatggttttgtaagtgtttggtagttcctcctgtgttcattctcctgcctgccgccttgtgaagaaggtgccttgcttcccttcaccttccgccacgattgtaagtctcctgaggcctccccagccgtgctgaactgtgagtcagttaaacctctttcctttgtaaattacccagtcttgggcagtactttatagcaatgtggaaacagactaatacacatggcatccagaaggtgttaccctgacaatagtgtggaaaagcaattcatggtcgggaagacatgtcagagaaaatgactggagcccaggataaaggatgaaatcacgttttctaagcaaatgagttgggtggcacagccaagtcagattcctggggaaagcgcatcactaacggggttttgagtttttactctgggggtggaggggactcagtcatcagcaagcggcacccacattgccctgtgctacttcctctccccagagtgctctcccctctattcaatcacaaacacacttccaaatttgtggggtggagacacaaggtgaaggcggtggggggttcatgctctaagacaagccactcacatgcccagagagatcaaaagaaagctctctacaccagtaccatggtagctcagctggtactgaaataccagccctcaaaaaataccacaccctcaaaaatctgtcagaaatctccaaatcctcctagatgtgtaaacacctaaaaaaaattcctctaattaccttgagtaagcactgaaacaaaagcagtgttataagtcaaataattatcttcacctgtgatcctaaatctggtagaccctggcactatcagaaggtatactactttcagggcctccaagtatttttcttggtagtctgaaaaactgaaagtacatgcctgaggcagaattctaattgtcttccaatgtctaccaatgtctaccctcctttcctccttagtgatagaagcctggtttccagttagatccatggttgcctactataaagaccacatttatttcccagccttgtttgtaggtcacgtgactaggtcctgttcataatacataaacaaaaaggccatgtgcaacttctgtcccttgaagaatggggatgtagcttctttaccccttcctcccacttactggctcaagtaagaacataaacactgggatcaccatcctggacatgtgctgaaggtggccgagcaactcagctgggtccttgacacgtgagccaacgcaccaatgctggacttcccatctcagcctatctcatttgcaggagagaaaagtaaacttccatcctgttcaagccacttctattttcagatatctgttgcacacagtgaaacctaatcttaattgacctaggaaccggtacctgaaccgggggtgctaggtctcagattttatgtatgccccagaaacaaggcctaaaaatgcagcctgatatggaggagatgggcagaggatcactggcaaagacacaggtctcacaggttctcgactgctgactgccgcagcaaaacctttgatcgagtcctgaccttctatatgttgggaggtagacctggtgtctgttagaagctgtatccttacaggaaacagctctgaaaattcaaaatgtcagtgcttgccagtccttgacactctcagcaaggttcaatcaagagaaatgatctccaactaaagctaactagtctcaagaaagtgggaaagaatacagatttgattagaaaggagctctgtgtcagcaaccagcaatctaagtgagcctatggggctgtccctgcagccccagcaggagataagacagatgctttaccacatagagcccagaagccttgtgccaaagatatgattaagggcctggccttccacccaagcccacggtttcatttggcccaagggagttgctattaaattgggagggaaaggaatggcagagcgctgaggcctttaaaagaccagagtttttaggctgaaaaactgtctagacaagatcttgatggttactcacatggaaccaatcagaagcaaacagactagagggctactaaagtcctgagagacttgtatctctacagaaaccttaaggctggcctataaaaagctgtgactattcagtcctcaaaacaacacccagaccccaaatcctcccagcaagcgggttttggaagcccatcctctccagcatccatctccgatgtggtgcagagaagaccctttcagaaggcaaagccatgactccaaaagatcccaggcaagagagttcccggagggcagaacgcgggttgccagacagcgacaaggaaacatagtggccgccagtgcagggggtgcagggagacttgatggtcgtgatttctactacagcagtgtggcacatggtgtgctgggggcagagagctcgtctgtttcagctaacagattgcaagacctcaacaggtacatccggccctaaaagagaaaacggcacatcatccagagatcctgaatctgatcaagtggaaggaaatgaatgtcataccagggccatcttccttgaggaagaggtgagagttttctatggaggggaagacaaatgcatgtggatatctgggacctcagcagaaactgctggctgttccccactgtgtccttccccgtcttccttaggaatacaactcccaattttcagctggtgcaggttccatgatggggaatggtagacggagaaaaagagattttgtaaatcatatgatcaagatctatatctaacataaatttcactcctacttcagcccattaggaaagagctgctcaattgctgaagaaatgatacacacagacgaagagagaaataagcattgagagaacccagtccatagttctgaaaattcttcttgttctatccaatagtttcatcaaagtgatagtctcatcatgttgcccaggctggtctcaaactccagggcttaagcaattctcctgcctcagcctcccaaagtgctgcaattacaggcatgagccacaaaaaaagtatcccacttttttttgagatgggagtcttgttcggtcacccaggctagagtgcaatggcgcgatcttggctcactgcaacctctgcctccaaagttcaagcaattctcctgcctcagcctcttgagtagctgggattacaggagtgcaccacaactgcctggctaatttttgtatttttagtagagacagggtttcactatattggtcaggctggtctcgaactcctgacctcaagtgatccacccacctcggcctcccaaaatgctgggattacaggtgtgagccaccgcgcctggccatatccaacattttttataaatattcagaaacaggaacaattccacacacagtaaattctgttacctagaattctacacactggtataatactagtgtttgacactgttccagtaacaactccaaagcactaaaacaacagtccccaacctttttggcaccagggtccggttttgtggaagacagtttgtccatggacagggggtttcgggatgaaactgctccacctcagatcacgaggcattagtcagattctcataaggagcacgcaatctagatccctcacatgcacagttcacaatagggtttgagctcctatgagaatctaatgctgccgctgatctgacagggggcggggctcagccagtaatgctcacttgcaccactcacctactgctgcgccgccccgttcctaacaggctgcagaccacagcccgggggtcggggatccctgcactaaaaaataatgtatgagattcgtggatttgtttaaagcacacaaaagcagcaactggaagagaacagctgccagtacacataacctattattactatcacaaatagactatgtttccataagtatagctcgttaacatggtttggatttgtgttcctgcccaaatctcatgtcaaattgtaatcagtgttggaggagggcctggtgggaggtgatttgatcgtagaggtggatattccccttgctgttctcatgatagtgagttctcatgagatctggttgtttaaaagtgtgtgacaccaccccctttgctctcttcctcctgctcccatcatgtaggacgtgcctgcttccccttcaccttctgcaacgattgtaagtttcctgcggcctccccagccatgcttcctgtacagcctgcagaactgtgagccaattaaacctcttttctttgtaaactacccagtctcagttctttatagcaatgcgagaacgaactgatacactcatgtaggatcaaatatagttttagaaatattttagtcttattcttagaatgtaacaggccatgtattttgtgcatccatctatctcgtggtccctctgacatcaagatgacctcttcaaatgtcttctccttaaaaaggcaactgcctccccgcgccaggaatttcttcccaggttcactgactcagtaggtttctgtgagtaacctcacttcgtagtgttaggaaggaaccctgggaacagcggatgcagggcatctggtaagctaaggccgccaacaaccattcatccagtatcagctctgcaccaagcaagggattcataattaataatcaaaccaaacaagaagagaaacaaagattcctaaacaccctcagaaaggccaaaatatttttcccctttgtaaaagtaaaaactcttaaccctatgggaggttccacctctagtgttggcaagctcagcttcaatgtctgtcaaacacttttacagacccaagtttcctaaggcagaggtttttttttttttaagtttaatatcaaaagtgaacttcctgatatccaagaatattaaggcaatatatttatacaggttcttttttcacccaaaaacacaggctggacagcgtgtggtgaagcccagccctctgcggatgtgcgggagcctcagcctgtccgcactctcagggcgtgtgctgccctcttggtgacgcgctgccctcttggtgacgcgctgccctcttggtgacacgctgcctggccacgagctccaggaccacacttccaaggttcccaggtggcaatgacacgaaatattcttcagtattctccacagaaacaacaaaaatggcctggaagtacccgtatttttctatctgaacttcacctccccaaatcttttgttcaataacttgtctcatttttttattcagaaaatgtaactatcgcgagttaccccttcgatataatgaagtcttcgcttgagtaacaaaggattattacagagtttgcaacaagcaagtgatgactgttccatctaaaagaacaggctttttccttttctactgggaatcaatggatgtcaggggtgaggtggaaacaggagagttaagaagcgctgaaaaatgaaagtacctatgacatcacaaattaactcagtacacaacaattactaatgaacacggctcacagctcccctcccagcctgcccccattgctctgataatcctcccaaacaactctgccaatgcctcctctaatacaacacacatactaacactgtcattctgatgactctaagtgtgacagtcaagaaaatgctaaagttggctcatcattttatatccatatagcattaaattccagaaactattatcaagaaaaaggccaaaatattcccatacattgaattatacatctgtctaatcatgtggtcccatgagtgaaatgcctagaaactatgaatccagttatttttggaatatttcacgccttaaattttaacaccgcactgagggaaggcacttttgttattccctccctctataaccaaattttttaaactaaaatagtattagtactattggggagttttaaaaaattcctttcatttgttttctatttttttaatctttaatcagagtctatgtaacagaaggaatcaaaaggaaaacctgcagtaagagtaaatttctaatatccaaatggggttatcaactgcttaaaaaaggtatgggggttgggaatgggtggctcacgcctaaaatcccagcactctgggaggctgactcagaaggatcacttgaacccaggagttcgaggccagcctgggcaacatggtgaaaccctgtctctactaaaaatacaaaacttagctgggcatagtggcgtgtgcctatagtcccagctacttgggaggctgaggcaggagcaacccttgagctcagaaggtcgaggctgcagtgagctgtgattgtaccactggactccagcctgggtgacagagcaagatcctatctcaatcaatcaatcaatgaataaatgtattggatagcaatgtaccaaaaacacttttcaaaatacaaagctctgacctttttcaatttacacagcttaggtgtcattcaaacttcctattcaaatgcccctgaaaaacatcctgtattaaatgtctaacactgattgtaactgcacaaaagaagaatgataacctgagcaataatgccaccggttaaacatcttttttcataatattcgtttatcaaagaacattctgagggcctgattcaaagaagcaagacacaaagcacaaccaccttccattcccataaaaaacaaacctgtgatcaaagaacttcaatttcctttcccacgatttaactcttctaggacaagagtacttccaccttgctaataggtctggtcaaacgtattcctctacaactctatcccctccccgtctattggtaagagaggatgatcaatggaacaggactcctctgagcagatgcagacctgctcacaccttacccatccaggagacgcatcgttgtgggggtcacttcggcaaacaaaattactttccccaactgcttggtctgcagattttggcgatagatctctaagttgaaatgttctgatgagaaggcctccatgttggtcaccacaggtatacaagatggggttatttctacttcagacacgtaggatgaaacaaatctaagagagagctggccggattttatttctccctcggagtccacatgtttcccaagccactgcataagaggatccctgatttcctgtgtcataaagaaagaaatgagatggtcgtaatttggcattacattagatcatggtagcttttccttataatgccattttggtaatatgagtacttcctaattcatgaccaagaaaagctagattaacatattccatacatctaaacgattagacaatatgataatcatatacttagtatacttatactataaaataagctcttcagaaaccaggatccaagaaaatcagttcagttcatgattatacttcctatcttacatcttacattctctcatgattttcaagattcccctccagtccagagttcataagtagttctccagtcctccgttcattttacggaaaacttttatctttttgccccacaaagaaattcattatcctatttgcaaaaacaacaacagaaaaccctgggtgaaagaagtcacagaacacaaagcactcaaatacaagaacactcggtctcagcctcacatcttagagaatctccgcttcctcttgtaaagacaaggcaagttgatcaccaacaaagaagacaataatcttcacaaagggaaagtggggtaccccaaagctgctttctgtttgccccaaatggaggtacaaggaggagaaggaaggcaaaacctagaagagacgttgtccaatccaggcacagagctctctactctatccccaaaaccacaaggctggaggaggttcccccacgccagaccttagaggtcccagaggccttcctccagggtggtttatcaggaactgagggctgagggaagtcatcatctcaagaggcctgtacaaaacttactaagatctcagtaaacacagatccaggctcttaggccatcctcctgcaaacaccaggccctttacgtcccaaagctccctgtggctacagagtagtggcatcagagatgaaacttaattcaactaatttcaattgatcaacctttaaaactcacatctagtttgcagataatacagaggagaagagaacgagtcaaatgacttcagaagaaagcattcaggtccgcgcgcagtggttcacacctgtaatcccagcactttgggaggcccaggcgggcagatcacctcaggtcagtagttcaagaccagcctgaccaacatggtgaaactccgtctctactaaaaatacaaaaacttgccaggcatggtggcgggtgcctgtaatcccagctactcaggaggctgagacaggagaatcgcttgaacctgggaggcagaggctgcagtgagccaagatcactccactgcactccagcctggcaacaaagagtgaaactccatctcaaaaaaaaaaaaaaaaaaaagacaagaaaagaaagcattcagaagaaatccaggggataaaacattttacagaacagccgggctggaatcttcaactagtcaatgtcacggtggagatggggtggggacacagaggtggagagggagaccccgtctagattagaaggggcttaaaagacataatgaaacacaatgggtggttctttattggatcccaacttgaacaaactagctggaaaggacaattaggaaatctgaatgtgaacagtatgcattagacagcaaactggaattactgtcagttttaataggtgtgacaagggtactgtgggggccaggcgcagtggctcacacctgtaatcccagcactttgggaggctgaggcaggcgaattgcttgagctcaagagtctgagaccagcctgggcaacatggtgaaaccctgtctctcctaaaaatacaaaaattagccgggcatggtggcgtgcaactgtagtcccagatactcaggtggcagcggtggaaagattgcttgagcccaagaagcagaggctgcagtgagccaagatggcgccactgcactccagcctgagtgacagaaccaaaccctgtctcaagaaaaaaaggaagtactgtggtgacataggaaaagtccttaatttttaaaaatgtatatacgtcatgaaatctgtaaaatttacccccaaaatacataaagtaaggcaaaatgttgataattattcaactatgttgataattattaaatctagatgatgggtatttggggtatgtgttacagtattctctctattcttttccatgtttgagaactgtcataattaagagtaaaaaaaagtggtgaaataaacataagctatttaaaaataataaattcaggccgggcacagtggttcacgcctgtaatcccaacactttgggaggctgaagagggtggatcacttgaggccaggagttcaagactaacctgggcaacatggtgagaccccgtctctaataaaaatacaaaaattaactgggcatggtggcatgcacctataatcccagctactcaggaggctgaggcaggaaaatctcttgaacccaggtggcggaggttgcagtgagccgagatcacgccatcacactccagcctggagacagagcaaaactgcatctcaaataataataataatgaattcaattgaccatacactggcaacctattccctctgtcatccattcaacaaatgttacgggatatctcccatatggcaggcagtctcacaggctctgaggacggagcaatgatcaaaggggtcaaaattcctgtctttggagggttaatgctataatgtgggagtcagaaagttaaaaaagtccgggcgcagtggctcaggcctgtaatcccagcactttgagaggctaaggaaggcggatcactcgaggtcaggagtttgagaccagcctggccaacatgacaaaactccatctctactaaaaatacaaaaaattagccatgcatcgtggtgggtgcctgtaatcccggctacttgggaggctgaggcacaagaatcacttgaacccaggaggcagaggttgcagtgagccaagattgcgccactgcactccagactgggtgatagagtgagactcagtctcgaaaaaaaacaaaaaacaaaaaacaacaaaaaaaacaaagttaaaaaacagtaaacacaatacacagaatgttagagagtaacacgtacaaaggagggacaagaaagcacagaagagagggaggccacttcagaccagacagatggaggacctgctaagaaggcaacgcttaaggaaaggcctggagcaagtgaaggaggatgctgggacaaaatccacagaactatgtttttatatttatttataaagggattccagcaagtgcagaggctcccggagcagggaaagagcctgatcagggcacagcatttgagcagagtgagcctgggcagaaggtggagtgccggggccagaaaggcagagggggtggtgagagccaccgtccacatcgcggagggcctcaaaggccacagtaaggacggggctttcactcgaggagcaacagggagccccagaaggttctggggaaggtcgtgggatgtcctacctctgttggagcaggatcaccccactctgactcctgtgttgagaagagcctgaaggggaacaaacaagcagagaaactagttataaagtcacctaaatgagctaggagtgagactactgcctggaccagcatgcagcagacatggtgagaaaggataggattcacagtagactctgaagtacaggctacaagatttgctaacaagtcatatctgagatgttagagaaaacaggggctcaaaaaagagcccaagatttctggcctaaacatctggaaggacagatctgctgctggaaatactataggaagagcaggtttggagaggaagaggcaggaggtgagccctgggtgtgctaagcttgagatatctattaaaaatcccacgggggctgggcgcggtggctcacacctgtaatcccagcactttgggaggcccaggcagtcaaatcacttgaggtcaggagttcaagaccagcctggccaacatggtgaaaccccacctctactaaaaatacaaaaattagctgggcatggtggtgggcatctgtagtcccagctacctgggaggctgaactcaggaggtggaggttgcagtgagctgagatcatgccactgcattccagcctgagcaacagagaaagactcggtctcaaaattttttttaaaaaaggaaaaaaaaaatcccttgaaaacaatgaattggcagtagaacatgtgagtccagaatccaggggagaggtctgcaccatggatatcaatttgagaattgtcagactatgggtgatcatttaaagccaagaaagaggataagatccatgaaaagagtgactgtagttaaaaagaggatgcaaagtagggctgctgtcacaaaggactacaaaccgggtggcttgagatgccagaaatctattcttacagttttggaggacagaagtcaaaaatgaacacgtcaacggggccgtgcctcctgggaaggctctggggaaactagtgttcacgcctttgcttctggtgccgctggcactccatggtgcccctcggcttgtacacacatcacccccatctctgtggccatcatcacatggcgttctcctctttaagtgtcccgattctgtgtgtcctctagtcttctgaggacagcagtcgtactggattagggatccaccctaatgacctcatcttcacttgattacatctgcaaagacccagcttccaaataaggtcatattcacaggctccagggctggggctttcacatatctttttgggggacacaactcaaccaacaatagcagtccatgcttaggtttcagggagatcaaaaagagtgtgcaaaagagattgagaaagggagagaaaaatcaagtgtgtctgtggacagcagtggggggcggtggttgcgggagtctcctgactccagtttggaaggttggaagacgatgacagtgccgtggggagagggctgagaagtcaccgctggccttggtgccacagagcccagactctgatgagagcagtttgagaggcgtgatggaggccaaagtcagatgggagtagtgaaaagagaaaaactgcagactccaggataaaactctggcaaagggtctcctttaaagggtagagaggaatggggcagtggctagagggaggaatggggtgaaagcaggttttgtttggtttagaggggagaaacagcagcattttcagattgatgtgaaaggtcccctagagaaaagaatccaaagggccaagtggggtgggacctagcacagaagcagaaaggtcagccttgggagcagagacagctcacccatagggatgggggtggctcaggttcccctctgcggacacctggtcttatgaccccactggctgcagaactcccttggcccttgccggttgcacagccatacgggacagcctggtaactgaaattcgctgctcccaccctgctccacagctgcagggaggtgggaatcctggtgctggcagccggtagaagtcatcttatgattgcttctatgttctcaataaataggaagcaagatcatcggctaagagagaaaagaaggaaggaggtgttgaagtttggggagggaggaacgaacatgacaacagggagaatgagaagacgaatgcagtggggagaatcttctgagcagcgccttccccagggcagctggaagcatttgagcaccacggaaggtcagcgactctgaactgagagtgagaagtccgcatgattttgtgtttttatcctgccacagtcagctatccagccatgtgggcttagcagagaggaggcagtgagctgaaggtgtacagaaagcagtaactgagactaaccgaccacaaatgagacactgctggagacaggaagataaatatgagtgatcctgttggggaggagagtgagaggaatgccccaggaccaaaaagcttaggtcagcaccagagagagctcccagagaaggcatgcaaaataaggggtgatcctgcttgcaaagaaaccagaaaagttgttggaagaggtcaagctcaaatgagctaccaaaagctacatttgggtcctatcacagtactaattttcggttttcggactacagaataccaagatatatttcaaatggattattccctgttcatcattctttccttggtatatactctattggaagaagaagaagaaatgaataaataacatacaaaggtgatccccaaacctcaaatctggccattagttataaccaactctgcccctaaaactttggtcaatgcccttaaagcataaaatgcacagatctgaatttccatcactttccccagggcagctggatgtcaccaggtcaccacacaggctagagatacatataggtgaattaggttaaatcacaaaaacagaaagataaaactattatttaactcaagcagagagctaagaggttattcatcagatgatggtaatacaaatatcccattcaaagtcaatgaaaaccaggataaaatgaaaaagaaacaaccagcactaagtagaactttcagaacaggaataatgcaggaattatcctctaaagtgaatcatccagattgactatggtatacatcattcatttaagaaacatgtatggagtacccacggtgtctcaaacacagtaccatggtagaaagagaagaggaaggacagatattgctatagtttgaatctgtcctccaaatttcatgtgttggaaacataatcccccaattatatgttgatggtacttggaggtggggcctttgggaagaaattgagattgaatggggtcatcagggtagggcacctatggtgggattggtggctttataagaagagaaagaaagacctaagctggcacactcctgccctctcaccatgtgattcccttcccatgttataatgcagcaagaaggccctcactagatgctggcaccacactcttggattttccagtctccagaaccaagagctaaataaacgtctattctttctaaattgcccaatctcaggtattctgttatagcaacagaaaacggactaagagagatgcatacacataactacaagacaaaaattcactcaaactattcaaacatacacttctctttggcaaagtaagtcaacctgacttgccaaatttaatcatctattcttatgtgcatgcaagttgagagccatattctcaagaaattacatcatcattgttatgtctactaattactaaagtaacaatctaaattatttgtttttgaaagcaatacttagacacgtacaaatctgcaaaataaaactgataaaagcaaggcatgcaggtttttttcttatacttattttacataatctttcagggcttactcagaaccaagtgaattactcagaacaaagagaatctaaaaggtatcaaatgaaaccagggccctcttatgaaacataactatataccacccataattctcttaaatatttatattcactatagtcaaatacattttaagtaccataggaagcatttagcctcccccaaaactttctccccgctccaccattaaccctggacaacataaaaattctgaataaaattctggttgtaagaaataccaaaattactatctgtttgatataaatctgcctggcatgtcttctcaaatgcactcaaattatgattatgacttgagagttgcatatacagctgctaataatacatgtagggaaaaggaattaattcatgactcttgcctaaactctcctaatgaccatgcaatgtaaaaatgttactgaagaaaaaaggtttggatcatagacatcaagacaagtgggctgacatataagtagcactacccactctgcaatacgcaaatgcacctatttctttgaactcaactatcagaggatagctaaaacgtcacttctatagggaggatgtctctgacccacagccgttcacaaactttcgtaaacccttagttactttatagcacttatcacgactatacataatttgtataagtgcttattcaatgccacactgtcttattagaatataagttccataaagataatatacatatgttcctgttttgctcccaacggtatccatggaacctaggacaaaagtgcatgcttaataagcatttactgtataaatgcacattaaaaccttaccaaggaaaactctccaaataacagatagataggtaatcaagaggtaaaactcaaaaaagacaatgagagagtatggtcttgagatggctacgtaagcatcaaaaataatgcacagtctttgaaatcattacagctagttctattgacaacaaacaaccactatcagattccacttcaagggggtttataaaattctaattaatgttatttttctaacatttaatcttcaagaatttagtatttctcttcttctaggatttcaggttaattaaatatgatttgggtggaaccaacagctgaatgctttatagtcacataaatgtggcccttttaaatcagccacagcaccagtcattctcaagaaaggtgaatatattctttgtcttttattgggtcatgttgcacaggacatgaaaatccaaaggaatcttaaaaaaaaaaatagaactaataagtgagtttagcaaggttgtgggatacaaggtcaatatacaaaaattggctgggcacagtggctcacgtctgtaatcccagccctttgggaggccaaagtgggtggatcacttgaggtcaggagttcaagaccagcctggccaacatggtgaaaccccacttctacaaaaatacaaaattagccgggtgtggtggcacacacctataatctcaggtacttgggaggctgagacacgagaatcacttgaacctgggaggcagaggttgcagtgacctaagattgtaccattgcactccaggctgggcaacagagtgagactccatctcaaaaaaaaaaaaaaacaaaacaaaaattgggtgcatttccatatactaacaataaatatttggagcctgaacttctttaaaatatcattttaatggcatcaatagatctgaaatatttagggacatatttaacaaaatatgtgccagacctgtttactgaaaactacaaaacactcctgaattaaaaattaaagatgtctgagcatcataactcatactcgtaatcccagcactttggaaggctgagtatggaggatcacttgagcccaggaatttgacaccagcttgggcaacatggaaagacctcatgtctaaaaaaaagagtttttctttaattagctgggtgtggtggcatgcacctgtagtcccagctagtcaggaggctgaggtgagaggatcacttgagcccaggagctaggctgcaacaagccatgatggcaccactgcactccagtctaagcgacagagcgagaccccatctcaaaaacacaaaaagaaaattaaagaggctgtaaataactgaaaagatacaccatgttcatggatcagaagactaacactgttaagatgtcaattcttcaaattaatctatgggttcaatgtaatcccagtcaaaatcccagaaggctttttttttttttttttgtagaaattaacaagctgaaaatagaaactattttaaatggtcaaaacaattttgggaaggaacaaaaagttggaaaacctacattatctgctttcaagacttactataaagttgcagtatatcaagacggtgtggtattggcacacagagataggtatagattactggcacagaatagggtacagaaatagggccaaacatataagtgtgattgattttttttaatttttttgagacagcgtcttgcgctaccacccagtggggagtgcagtggtgtgattacagctcactgcagcctcaaattcctgagctcaagccaacctcccaccttggcctgtttgattgatttttgacaacagtgcccaagataactgacttgaaaaatgataatctttgcaatacatggtgctgaaacaaacattcatatgcaagaatatgaaaccttgatctctatctcacatgtatataaaaattaacttgaaataaatcatagacctaaatgtaaaactacaaaccttctaaaataaaatacaggagaaaacctttctgactttgggtaggtaaagtttttttcagatggaacaaaataagcatgaaccataaaaggaaaaaagtgataagctggactttataaaaattaagaatattaacaactgctgttcttgaagagataatgctggccagacatggtagcccacacctgtaatcccagaactttgggaggctgaggtgggtggatcacctgaggtcagcagtttgagaccagcctggccaacatggtgaaaccccatctctactaaaaatacaaaaattagccaggcatggtggcatgaacctgtaatcccagctacttaggaggctgaggcagcagaattgcttcaacccaggaggcggaggttgcagtaagttgagatcatgcgcactccagcctgggcgacagagcgagactccatctcaaaaaaaaagagagagaaagggaaagagagataatgctaagaacagtgaaaagacaaacaacaaactgggagaaattattctcaatacttatatcagacaaaggacttgtatccggaatataaaaaagaagtcttaaaattgtaagaaaacaaacaattcaacttaaagcctgagcaaaagagctgaatagacactgcccaaaagaaaatatcggatcgccaataagcacatgaagaaatgcttggcaccatttggcaacaggaaaatgcaaattaaaaccacaattagataccactatacatccacctgaatggttaaaattaaaaaactattttaagcccaggaatttgggcctgcaatgagctgtgagcacaccactgcattctagcctgaacaacagagcaagaccctgtctccaaaaaaaaagaaaaagaaaaaaaaaaacattctggccggccacagtggctcatatctgtaatcccagcattctgggaggctgaggcaagaggattgcttgagcccaggaatctgagaccagcctaagcaacacagtgacacccagtctctacaaaaaataaaaaaacaaaactagtcaagagtggtcgtacacacctatatcccagctattcaggaggttgaggtggcaggatcacttgagcccaggaattcaaggctgcagtgagccatgactgtgccactgcactgacagcctgggcaacagagcaagatcctgtctcttaaaaaaaaaaaaaaagaatctgacactttacaatggttggcaaagatgtggagtaactagaactctcatgccctactggtgggaatgtaaaatggtacaatggttttgaaaaacagttggcagtttcttgtaaagttaaacacacacttctcatatgaccgagaaattctactcctaggtatttacccaaaagaaatgaaaacacatgtccacacaaagacctgtatgtggatgttcatagcagctttactcaaaacagccataaatgacagcatatccatacaatggaatactactcaggaataaaaagtaatgggctacccacacatgcaataaggacaagtctcaaaaacataacactgatcaaaaaaaagaagggtatccagtacactatatgattccacttagatgacgtttcagaaaaggccaatctaatcatctagtgatagacagtatatcagtgatctcctgaggctccaggcttaggggtggatgagcgcatgagaactgattaagaaaagtaacaaaggcagtggctcacgcctgtaatcctagcactttgggaggctgaggcgggcggatcacaaggtcaggagatcgagaccatcctggctaacacggtgaaactccacctctaccaaaaaaagacaaaaaattagccgggcgtggtggcaggtgcctgtagtcccagctactgagggagactgaggcagcagaatggcatgaacctcggaagcggagtttgcagtgagcctagatcgcgccactgcactccagcctgggcaacagagcgagactccatctcaaaaaaaagaaaggtaacaaaggaatctttcggaatactggaaatgttctgtgtcttgattgtaaaggtagttacatgtaaaacatttatcaaactgtacactaaaatgggtgcattttcttgaatataaatcataactaaataaagttgattttttaaaaaagcaaacagcaacaaacctatgcaacattaaacaatactaaggcccaggagactccatattcactaacgtccaaataacaccaatatctccacttctaaagagagtgaatgcttgaatctgtatctagtgcaaattcacagaagtgactactctatggtgggtaaacatattgcagcatctgctacagacagagtgcaattaagatcagaaacccatgttatactgtgtctcgccactttatttattgattggaggcagcgtcttgctttgttgcccaggctggagtgcaatgacgtgatcatagatcactgtaaccttgaactcctgggctcaagcaatcctcccacctcagactcccaaagtgctgggtttacaggtgtgggccacatcactttagagcggttccacccctgttacttgtcttatctgctaaatttacccagctaacaagattcagtgttgaattcaaaatatttcttatgatctccatgtatgttttggagcttcttttcccaagaaacaccaaataattgatcttaacccataaaggttttctatctcagagacacatttgcctcattgcaaataataagattagttgtgcttcagtcataacatcgtaagttgctaggcagccagaagtgagttaatcagaaaatgaatcatcaaagacatggtacgcaatctccttttatgggtgtctcattcttaaaacactttcaaggaagcagaagcaaatatttgtctactcgtatggaatttatatgacgcaatccaattcttactattggtatttgacacgcaaaatactcacacgcaatttcatgttcgcttggtgtcttcactcacaggacaaagccagatggcacagcaaatctttataatcaaaagatggcactcctgggccgggcgcagtggctaatgcctgtaatcccggcactttgggaggctgaggtgggtggatcacctgaggtcaggagtttgagaccagcctggccaacatggtgaaaccccatctctactaaaaaatacaaaaattagccaggcgtggtgatggacacctgtagtcccagctacgtgggaggctgaggcaagagaatcgcttgaactccggaggtggagggtgcagtgagcagagatcgcgccactgcactccagcatgggggacagggcaagactctgtatggaaaaaaaaaaaaatggcgctcctgaaataggactatttttttttcctgacttcatctaaggcagggattgatcatctgacaacccttggggtgggcgtttattcagcgtgccagtaccaagcaaagcaaggctccatgcaggtttgcgaaatgcctgtctgggtgtctgcgtgtgtgcacctcctcaccagcctggtcccttatgcggcagcttctgtctagccacactggtcccctgtggtctaaccaacccctgcctgacctgtccaggttccacgctgcacggcactgcaccctggcatgagttcccaaaactgctgcttcctgcttcccaccctgtgttctgccactagccccaagcaccggcacacaaaagcgaacggctctgaagggcttccaccttccagtggcttactttgctgaaaccagtccattttcacaaacatccaggctgaccgtcacttagggacaccctcgggccaaaatgaatctggagatgtggtttatttagcccacattttgaaccagctgcaacacttaaaaattgagatatttcatatcaaatttcctgcctcttttgaagcagcagcaactctttccacacagcagtaatgggctacagccaagtagccaccctcatcccgtggagaacgcgctccagctggccctgtgtgtccccagcagccagctgcactctgcgctgcctctcctgccccctcccctggcctctgggttagagaccactcgtctcagccccagcagcaagcctggaacccatccagccatccttctctggggccctgatgatgcgtccttccagttaggtccattttaactccccagactgagtctagtgacactgactctcagaacagaaggggactattttggtagttcctcaaaaagttaaacaagaggccaggcacagtggctcatgcccgtaatctcagcactttgggaggctgaggcgggcggatcacaaggtaaggagatcgagaccatcctggctaacacggtgaaaccccgtatctactaaaaatacaaaaaaaaaaattaaccgggtgttgtggcaggtgcctgtagtcccagctacttgggaggctgaggcaggagaatggtgtggactcgggaggcggagcttgcagtgagccgagatcgcgccactgcactccagcctgggcgatagagcgagactccgtctcaaaaaaaaaaaaaaaaaaaaaaaacattaaacagagagggccgggcgcggtggctctcacctgtactcccaacactttgggaggggccgaggtgggtggatcacctgaggtcagaagtttgagaccagcctgaccaacatggtgaaaccctgtctctaccaaaaatacaaaaattagccaggcgtggtggtgagcacctgtaatctcagctacttgggaggcggagacagaagaatcgcttgaacccaggaggcggaggctatagtgagccaagatcatgccattgcactccagcctgggcaacaagagcaaaactccgtctcaaaaaaaaaaaaaaaaaattaaacagagaattaatacatgatccagcaattccactcccaggtataaacccaaaagaactgacagcagggacccagatatgtgtgtgccaatgatcatggcagcattattcacaacagccaaggctggaaataacccaggtgtccctcaatagacaaatggataaacaaaatgtggcatatacaattaaggggatattattcagccaaaaaaaaaaaacaaggtatgaagttctgatacatgttataacatggatggaccttgaaaacattacactaagttaaataaaagccagacacaaaaggacaaatattgtatgatgtcacttgtatgaaatatccagaataggaaaattcataaaaatggaaagtagaacagaggttaccaggagccacagggagaggggaaggggaattatttattcactgttacagagtttctatttaggacgcttaaaaaaaaagttttggaaatatagagtgaaaatggttgtaaaatagtgtgggtgtaatttacaccactgaatcggagacttaaaggtggttctaacagtaaacttattttatatatattttatcacattaaagagagaaagggagagagagaaggagtcaggatctcagttcctttactctcacaaagctccctgtcctctatgcaattagccaccccccccaacccctgccatcaattagccctgcagaccagggggagcaaagggacagcttgcacaggcaaccgaggggtctcgctgtgctctcctctgggtccctccttgctgtccctgagtatcactaagagaggccactcaaaggacctctcagaacaaaagtcatttccaaggtgactttccacccacttctccagctaaatgattttaagttctgcttaggcacccacttagctacaacaagagtatgaaagccaccactttctgcacatccatccactgccaagcactgctgggtgctgtggacccaagatccccagtcctttccaggcgacacctctgcatcattagcaccgtccacagcagaagaaatgggaccccagacagcattaacgactgcccaaaccacacaggcagtataccgcagagctggaatttgaacccatgaaaccaaatctgtctggctcccaaatccttgctctaattcctatcccacggtcctcacaaagagacctacctaacccaaaatgcagcaaattaggaaatgcctattttctataatcaaaatgctgatggtatcacaaagatataaactcaatatgcaactatgaataaacataaaatggatgtgtatggctcagagctgggggtggggtaggagggagaagggcagtgggcaggggtgggagcagagtgtttgataagaaaaacttcaatttggcggggtgtggtggctcacgctgtaatcccagcaatttgggaggcccaggcaggcagatcacctgaggccaggagtttgagaccagcctggccaacatcgtgaaactccgtctctactaaaaatacaaaaattagcagggcatggtggtgggtgcctgtagtcccagctacttgggaagctgaggcagaagattcacttaaacccaggaagtgaaggttgcagtgagccgagatggtgggccactgcaacactccagcctgggcaacaaagactccatcttaaaaaaaaagaaacttgaatgtgaaccttgaagctaccacccactagctgtgcctacttagacaaggctgtgagaggacactttcacaaagaaataaaggttttatcatgtaagtgagctactgctgacctcacccctatctggtttctgcaggaaagaggtgtcatattcacaagggttctgtaatggaaggactgtgggcagaggtaagagaacccaagaacaaggaaggggtgccaaagcacttggaaccagcaagggactgaaggagcaagagggggagctgctaatgggaaataatattaataccttgacctctctcaaatcctgcccatcaatctcctgccagtgcagccagtgatgagaaacatccagagttaggagcacgggagcccagggatgggccgacaggtgaacggtccaggggccagcacatctggctgggtgggcttgctggttatgcgtcccctctcacatccagccctgcacaactctgacttagtcccagcaacaacatgaacttctacacagcctgatctagcgatgagcccaaatcgattcagcaactccaaaggacttaggattgatgtcattggctatctaacccccaggaatatgagttcctccagggctgaacttgccacagggctttctagatccccaatgcctgggacacagtaggcactcaataaatgtctgttaagcggtcttccttttataatgtaaagtgatagctcaggctcagacgctgaaaggcccaggatttactgcatttttttgttacctgccaactagcgaagaccacaaaaggcttgagtagaacagtaaaagcagggagtgaataagtcatttctaataaggctggttttataggcatcacacctccaccaagccaaacaggctcactgtagaagcggaatctattctgcaagtgcagagaccaaagagaaagccagggttggctctaacggcgagggcggctctatggggcagctcagccactgcctccacaatgagagacgcgaacttccactcactggtctcgtgggtgcgggaccgacacccacaggagtctctggggccttcattaagcctgcccaaggaaaacgcccgccatttgtctcagcccaacacaaacaggcttctgacagagcaggcagcgtgggggtggagggcatggaaaacgctggggctgagccctgggggcccataggcagccctgcctggtgcacccagaggtgcccatcctagccgacatgcacaccaacgtgaccattcacacgttcccttccttctgatgctgacatgtccccccgccccaccatcctcagctatttgcctgttacctgccagccccacctgggcttcttgtgggggcaggggactctggcatgggatcctgccctcagctctgccaccatcagctgtgaggccgcaagaggcactccctgggctgaccgcagcttcttcatttttctaacgagaaaacgagaacatctctctctggtaaaacggagcttcaagattcaatgtttagcctccactgtttaattctcagttgaaattttaacatcatgttatgttaaaatatatgttacctggaaagagagaagcggccccatatcaagaggccaagagctttctgctccaggaccttatcttagcaaaggttcactggtccaactggctgtcaccatgacacttgggaacattcagagaatcccagggaataacacctggccaggcctggcaggagagaggggagcggcgtccaacactgccctacgtgtgcaaggagagggcgggtctaaccccacacactcaaggccacggtctaagaagctccggctcagaaggtgcattcgttcataggagaaaagcagagtttctactgaaaagtgtttttaataacacacaaaacaattccaacttttccctgaaactccatctggccagtttcctccggcatgcccacagctgattcttctagaaactgtttaacatgattgttaagaataacctaacaacctgttaggttatttatcctgctttcccagaatacagagctggactgtgcgggcagccgctcgggcagagagggctgtgcactgccggcctgtccctggggtctctgggggctctcggtgcacaggagccaaggaagcagctcccaatccattagggggaaaaaccaaaacactttgcaagtgtccaaataaaatgtgcttactaaatgtctactataagcaaaatactgggaaagggatacaaagattaacaacatatggtccttgctttcaaatcagcttgcatgacagtttaatggggaaaacagatatttatacaaataatacaacaatagcacttatacaaaccacctaaaaaaaatcttatggaagtgactagatctaaggttccaagtcacgatacttgggttaggaaattgcaagaaaaaattcaaatcctatacccgtgacatgatcatcagtggaattttcctagatcagaggggtagaatccctttgttgagtataaaagatcaactatctgtcctcatagcatccggctgtaagatttttttatgttctgtaatttaagacttttcttttaagagatagggtcttgcttgctcaacatgttcctcaggctggagtgcagtggcgcgatcacaaactcaactcccgggctcaagagaacctctcatctcagcctcccaagtagctgggattataggtgcacaccatcatgcctagctaatttttttttttttttttttttttttttatcttttgtagaggtggagtctcgctgtgttgcccaacctggtcttcaacacctggactcaagcgatcctcccacctcagcctcccgaagtgctgagattacgggcatgagccgctgcacctgaccaatttaaaacttaaaatcttactactctaagaactttatacacatgtgctttataaatgctggttcatatgaagatggaatatccccctcaaccctgtagggtgatacacagccatacggaaccatcacaaactagtaggctactgcttttacttcaaataaaacaaatactccccgggccaagtagaaactagagccgttctcctggaagcaaagatgtcaaagcctctcactcttagaaacaacccacaatagggtctgggctttgtggtttacttaaaggaagtaacatttgcatcttcaaaacaaaaacaaaaggccctctttatcaggaaaatgtggcaaaaggttcaccagtggtaaatctgggtgaaggctccacagggcttatagggttggtgtatgactcttttaccttttcttcagttccaattttttttaacaaaaaattgggggagaaataaaggattttccccagaagcttgaaaggccctgccagctcctacatgatctgtagatttttgttctgctgttaatcgtggaatcatcaaagaaacagccttcataaagaatcaaaaagcaaaacagcaatgaagaacaccttttagcttttgatctgaacaagccttcatgctgcctttgccggggaagggctgctgaaccattctgaggcaagaacacctccctgaaaaaccacagatttccatcctcatggagccatccctccacagacccagatcttgtacagcccaaatgcagggcgcactttccccgagtacaaaccccagtgcgtttcatgaagctgttcagtatatgcagaatcagtgcattaataacagcttattggcaccgaatgaaaaacacacaagtcttaatcttaggtcttgaattttgtccagttcctacgtcatacctggctgtaagggctacagccgtaagcatgcttggtgactggaggctgtgtagtgagacctgagttttgaaaccaggattggtagcttaacaaaatttactggttgtagaaaaagtaaacttgcctccggggaggtgagctcagcctcaccattctgacagcagcctctggtggccagtttagtaaaaagtgttggctctcatgctgaaagctcggaccttcccttcttaatgaaggtcgctgcaagcagacaggccattctaggtaacagctggaggtgactggggaagctgcagaaatccaaacgaaggtgtgactttggaccacgtaaatcaccaagtcattggatgatctgtctcttgcattaaaaaaaaaaaaaaatgaagtactctctttcaaaagtagaaaaataaataaagagaactgttttaaaagggctcaagtcacaaggcagataatacatactcagtttgaaagtaatctcattccttacttgcatagaaagcctttaaatattcaaggagcacagattcctgaacaaaataaagcccagcctgtctgctttcttacatagcaccccatggtacactaactcctatgtactgagtgccggaaattcttcctgcaaagtaaggaattgctccatatggcagaaacttctagaaaatgctgcaaccattcattcagagaacaaaattaaatattcaggattgtaggtgaggcctgatttctagtgccacagattcacaccatttcactggatataaatagaggaatgatcagaggctgacagttggcttcaaaggcagagagggtaagaaggagacgccatcagcttcaagccaacttcttcgtaaggtgcactctgtcctcagctgtcagagaacaatctggaaacaatctgctgagcagctgctctcatcaacaaactgtttattgtaagaaagtggctgggtcaaaggctaaacatcaacccgagctgaaagcatacagaacaaaaatcaataccgtccctgctaaagagacccaggacttagcatgcagaaaagagagggtgaggaactcatgtttagttctgaaagagtaagagttggaacaaaacccccatatttcaacattcagggttcttctgcatattattccaattggcgacttgctgctatttgcagaatggccttgtaatgggggctaaaatgtggcattcaacaaggacacagaaatcaactttgccctaaaagttacaggggttaacatcagttgtttctctctcacatttgttttgcaacaggaccaacgtgctcatcatacacatgtgcttattatacacaatgcacagatactacagtccatctttaaatatgtctaattggaaactggaaggctgactggacatgagattatatgaagagattgtttcattttaggtatgacggtggaattgtgattatgtttttaaacagagctcgcatctttcagagacacatactaaaatatttgcagatgagaaaactgaaacagtatctgggaattccttccaaataatactggcagagaagtgggtagaaagaagtgaaataagattggccataaatggataactgtgaaagagagtgatgagtacagaagaattcactcattatttatatttacttttgcatatttgaaattttctatgaaatgtttgcttttacttgtgtgtaaagttcaacagttactttgaaagaaaaaaagttttcttaaatataagagaagtattaacctaccgaggcaaattaattaagtcatatgccatggtattgctaggtatccaatttaacgtttttgagcaatgtccgagatatggttgttatgtcctgagttgaacgatggagaagtagaaagagatgctcaaagtgttcccactgcatacgtgctccagcaagccagaatgtgacacagaaacagataagacggtttcccatggtttaattgcagtatggggcaagaggacatacgtgagatgctaggaaaacccaactgtcataaataatggggaccaaattgttaaaagacaagttagcacacaaattttgaaaacacaatttctttgtaaatctgaggctgctatatagtgtattgataattcttaaattaacagtaaaattagagaattagcctgaaataaataaaaataaagcagatagcaaaacattatttcattgtgctgaaattaactgtgaagatgtatctatgattttaacttgttccaatataaagatgaaaatggtaataatcacaaattcttagaaaagaatgcattcaaaggaactgcttaaaaagttaaaaaaaattttttttagtctacttgctttgccaagaccagcataaatactgcagagagtcctgcaaaggatgagaaaggtcatcttgtctaccctccctcccaacagaacagagaagggtttggtcatgagaatttggtgacgcaccaggcacggtagctcatacctgtgaggccaagtactttgggaagctgaggcggaagaattgtctgagcccagaaatttgagaccagtttgggcaaaaagtaagactccatctctacaaaacacaaaagtaaaatagccaggtatggcgatatgtgcctgtagtccccgctgcttgggaggctgaggtgggagattacctgagctcaggagttcaaggctgcagtgagccatgatcatgccactgcactccaacctgagtgacagaacgagaccctgtctcaagaaaaaagaaaaaaaaaaaaagacacccaccctagtgggaaggtggggcagagatgggaatggttaatggatgcaaaaaataaaaataaataaaaagaacgaataagacctagtatttgatagcacaacagggtgactacagttaataataatttaactgtacatgctcaaataactaaaataatataatttgtttgtaatataaaggataaatgcttgagaagataggtaccccattttatatgatgtgattattatgcacagcacgcctgtatcaaagcatctcatgcatcccataaatgtatacacctactatgtacctattaaattaaaattaaaaaaaatttttaaagccgtctaccaagaaaaactcatttggccaatctgagacactacacctaaccccaacatcacagaaggaaaaaatacacagagcaaaaccttcaaaattatagacctttgacctttaaagcattttattaactaaaaagctacagaaaaacttaaatcctgaaatgcatcaaggttgcctatgaaaagtaatctagacaatcctaggcagagtctggctatccccccacccccaaattaaccatcattttttaatttatgaaactactgtttgatgtttcttttaaaaggtgtattttcttatttacggaaattaaaaacaggaagagggatcagtggtgccatcattcaatcactcttcagtgaactactctacgtaggattcatttttgttcagagaagagagcaacttaccaaatgtttacctagggcatacaaaagcaaactcagtaagttttctgagaagaatattcactttcagccgggcacagtggctcacgcctgtaatcccagcactttggggagccgaggcaggcggatcacaaggtcaggagtccaagaccagcctgaccaacatggtgaaaccccgtctctactaaaaatacaaaaactagctgggcgtggtggtgtgtgcctataattccagctactcaggaggctgaggcaggagaatcgcttgaacccgggaggtggaggttgcagtgagccgagatcgtgccactgcactccagcctgggtaagagtgagactctgtctcaaagaaaaagaaaaaagaatattcactttcaactttaattttaattttctaaacttttccttaatgcatgtaggaggcaggttgaattaaactaaaagtttttatagaccagtggctcaggaaagcctcatggtgggtgaaactgacaatggtcctatgatacgcatgttcaggacccagcgatctagctgactgctgatgggcaacgctgttctcctttcgctcacacctagaatctgaatctcagcctcggaggcgcagcagcacagtgccaaagcagccctcctcttcacccagagcccctgtcccctgcactcagacacacatgccagagacccaccagagacacaaacacctacacaacaaaattgtgctgtgaacctcgtgtcaagggaaagtgcatttcccttttaccagaaatctccagacccgctactctaagtcttctctcactctctgggagaaatgaccactccacaaaggcacgttctatctcagcaatcttaagtttttctgtagttctggttaaaacagacatatgcacttaaataaataaatatataaatgtatatgcatatatattatcataatatgtattcatatggttgaaattttaaaaactcaaatacccttaaaagtatcgattaaaagactctgtttttttaaattaaagccacgttcctcaattcacgaaataaaatttgagttatagaatttttttgtaaaggacagtagctccaatgatcaatgagaattgaaatcatagtctttaactccaatatctcctttttagaaaaaaatatttattttaattgacaagtaaaaagtatgtacatttctggtataccacatgatgctttgatatatgtgtatgttacggaacagaaactccaatattccttccactgattctattattaaaccaaagcctaaaaacattttaagaaagaaaagacccacgacaccagcagagggataatgtagaattgtactggaaacatggtagtacctggatagctgtgtggccaaactcggcatgctgtacctggggagacgcagccatacacaggcagctacaacaaaacaaacaaattaggaagatctctcagaaaaaaggagtcttcccttcttatctccaggagaaagtgcctgagggaccgacagacggactaaccttggctgagtcttcctgctttcacgaggaagcccgcaaaatcctcctggtgctgcccagcatcggccgagctccagcacaggagcgctctccttgcaccccaagttgtttctccccttaccactcaggtgggggaaatgggggattaaacaccactcaggtccacaaactgcctgtcagttttgaaacccccgaaacactataaacatttttccaagacagtcagtgcaaatctccaggcggcattctcaaatcattagcatgcatggaaacaaaatgtgctccccagctataattcacatcccaagaactgaaggagaacatttatcaaatgggattcgggtctcagaccccgacattcctgagctgacaccaccagctccgcggcccgggagcgccagactcaacggttccgtcatcgccgggcgccccaccgccgcacccaccgccagctctggtccttggccctgcacctgaccacaggagccctttgatcatgctctctaacccggcaccagtatgggcttattcctgggatgtgttttttgaactgggagacaaaaatccgcgtgtgagaatgttctaagcccttctggagacagcctccaccgacttccctgggaggtgaggccagaatccatacccgctcacacatggcagctattaggaagcccgggtaggagacaaaaagcatgtggtcttggaggattttttttattccaaaagaggccgtttcccatccacaagtttgtgactgcataaacggtggatataaatagacggaggaaagaaaaccacgcttcttagacgggatgctatcccaagaaggaaagtgctgagcgggaatgttccctcggcctcagagaccttatcaccccttcaccaggccagacagcaaagaccgcaacgcacagaagccagaatcatcacaaaactaattaaacgtggaaaacaacaaaagcgtttgtgcagatttcccacaagcacacatctctgccccgggtatttactctgcaggcgctgctttgaggcacacttgtggaaacaagattcaagtaaaaagacaggacacacagtagctgaaaagccttcttcccacaaaaataaaacattctaaagggagcacaggaaaaccccccaagtatgatttcttttgcaattcaacatcaaaacccatcatgtcaccttttgccatgggtattatgtttgataacaggaagtcagtcaaaatgaacaaaaaatttccagcgtaggtgaagggcgaaggaagaaagaaacgagagaaagaggtatatgaaagacccttaaaagcattcatagctataaaagcttttaaatgtttgctttaatctgctagctgcctttagccggtgccgtattgtaaaacagccgcacaagaccacagcagccacatgtcaaaagctattcaaggtgcacctggaattctgacttcctctctaatttggatctctaaaaattatttttaagctgtattttaaagttatgcccaaagcttcgccctatctatacattcgagactcagaactaggattaaaaataggagaaggggaggactccacatcaagtactatgttaaaaaatggcaggcaaagattttttttagtggagaattctaattaactcattagaaaaatacattaagccaggtgcagtggctcatgcctgtaatcccagcactttgcggggctgaggcaggtggatgacctgaggtcaggagtttgagaccagcctgactaacatggtgaaaccctgtctctactaaaaatacaaaaattagccaggcatggtgatgggcacctgtaaccccagctacttgggaggctgaggcaggagaatcgcttgaacccaggaagcagaggctgcagtgagcagagattgcaccactgcactccagcctaggcgacaagagcaagactccatctcaaaaagaaaaacaacagaaacgaaaaatacataagcctcttcactgtcctgtacgccagcttcctctcccgggggcaaggactccttccccgccctgccctacttatcagggtcactatgagacccaaatgagatggcgacacaggtaaaaaagcttggttaactagaacgcatgccacaaagacgaggaattatccctcgttttccagaaacttctgcagcaagggcttgtacttagtaggcacacagatgtttgctacatgaaggggccagttagagaaggaggaacaactgtgtggtatgtatgactgagtctaagtttcttcataaagctatcaacgtctgaaaagcagctccatctcagtatgttcatgtatatcaaatcatcatgctgcataccttaaatatatacaatttaaaaaaaagtaacataaaggacttcccggagtagaagggcctgtacccgttttttgatatgtttacaagtatctaaactatccttaccaacaaaacctgctttttatggggggaaaaagtttcacagtaaaaatttggggttaaatcaaaatgaaatgtcataactagtttctgtttttaagtacgtattacccattccataactccccactaccaaaatcacacaaacacacctcatggtgattttgcccgatcatttcagtaacaaacccagttgtcacttcttgtgacagctacatcttgatcccagctggacacaggacccctgctaagagtccagccggcttgtgtttctcaggtcacctacacactgttagccaccgttggccacgatgaacacccacaaggttcccaagctttttcattttggaaaaattcttgtgctccccagatcctaagcagatgtcccaggctacgggagcaatgcacaagctctctagttccccaaggtaaaggtgccgaccttcctgggggcagcacgtccagttccccaaggtaaaggtgccgaccttcctaggggtggcacatcccaccttcttctgcttcctctggactcactggggggaccaaaaggggtccactggcaggcaactctgcaggggtggagggtggggggctggctctgccccacacacagattcaggtcccagccggtcctaacccgccagctgcccctcccagtgagaccctgcagagcgtggcagcctgtgctttctttctgccattgctctggcagagataaaaaggaaaatggaacccagagaaacagaaacaaggcagctagcttctcaactgggaaagaattacattttctctagaacatcagattcgatagaaaataaaatctattaaaatgtttctataaaatataaaagaattatgttttttctggtgttctgtaagggaaaggattatgtttcttctataaaatcagtgtttctcaaaaacattcatgtcccagcacagtaaagatgtattgctgctgactgcctgtcacccactggtggcgggaagatgtggtggccaccaggtgatcgcaccccggacaccccacagtgagccatgtggtgtatcagtctctcacccaccaacatctgcagagaggaagccatggagaggtccccatatatatggtcttggagaaacagttcaaagggctctgccaagaaactggaacatccaagcaggggtagggcacccaggggtaccttccacccacagaagcaaagggacagcttcagctcggaggcccccacacaccaactcagagctcacagttaaccctggaagtcacagctgccacaggccatgaacaagagtcacgtgttttactatcagagcgaaccctttctaaataatatgtcaaatattaatattaaccaaagtatcaacacctatgagattccctgccttttaacattcaagtgtgaccatgtgtgagatgccttcaaagtccaatgacacgcagtcatttgtttttagtttttaataactaatttggctcattataaaataactcataacaaataaccaatttggctcattataaaataactaataactaatttggcttattatatatataatcattatagaaaatttggaaaatacagagaaagttttaaaagattattaaaatcacccttaagcactccaccacaaataagtcccatatataccagatttccttccagtcttgtttcctttttttttttttttttttgagacagggtctcactctgttgcccaggctggagtgcagtggcacaatcatagctcactacagcctcaacctccctggctcaggcaatcctcctgcctcagcctcccgagtagctaggactacaggtatgcgccaccatgcctggctaatttttgtatcttctgtaaagaatacgaaattctgccaggttgcccaggctggtctcgaattcctgggcttgagcgatccacctgcctcagcctcccaaggcattgggattacaggcttgagccactgcacctggcccagtcttctttctacggagataggtgtgtggtaaacgtgtgtttgtgtgtttgttttatggtttaactttttgtcattttgctgagacccaaatttcaatcctgctcctgggaggttcaattaaacgtgaaagccttggtcggaggaagcccagctcagccgcccacagcctgcatctcagccaagccctgcttcctcttggtatcgtgcacagtgacactgatggagccacacatgactgggttttatagtgggaatcacacgctaccatggtgtctgggtgtcgatgaaggtctccgagcacatccttcccaaatgccaagggctgaccgtcgctgaggcgagtgttttttctctttgggtcttgctactattctttccagttatatcacagtaacggagaagcacataaatcttctgcgctattcgtcataaagagcaagtgtcaaggcaccaaactgtgtaaacacagctggtacgcagtaaaactatttagataactagcatatttattttgttctttcatatcccatactataatagtacctaggacacagtaaacgttgaatgaaagatgaatattattaactgggacattgaaataatttctgcagacccaaaagaaagtgccaccaatataatggaaaactataaaattatactatgtgaaactgatatagacagaaaaaaattaaatctctgaagaacaactttatagttctagggtcctgtatgcgaggcagcctagctcagcagcgacaccctgtggtgagagatctttgactcccagcaacagagtgtcttgcagggcacaggaagcagaaagccagcccaggcatccaatccctaaggcaggcgatgagccaaatggacaggcaggatttagcagatgactgggtgccaagatcctctccatggaacttaattccgtgaggatgactgagatctgttaagtagggatgccagaaagaaaaccaaatacaaagcacaaacccaattccattcccagtctctgtggtccagatctataaatactgacccatagcacagtgactagatgcaggaggaattcagctgcctccggaaagaccacctcaggcagtgcatatccaccttcaaattcatttgcactataatcctttagagaacttgtattccaagaaaacatcatataaaaccttgacttctgccatttccttctacagcagattcaaggacacctaagcagagttaataaacattaagaggccgggagcgccatgcctgtaatcccaacactttggaaagccaaggcaggcagattgcttgaactcgggagttcaagaccagcctgggcaacatggcgaaaccctgtctctacaaaaagtattaaaaattagccaggcatggtgatgcacacctgtagtcccagctactcggggggctgaggtgggaggatcgcttgagcttgggaggtggaggctgcagtgagccatgattgcaccactacactccagcctgggcaacagagcaagaccctgcctcaaaaactaaaaataaacattaagaaatgaggatatgtacaacatacacgtactcattccattccttgggctcccaaagtaaagcagaattcagtcagaaataagcagctgagaggaaagtagtccacagcacagatatccaagaaaatcaacaaggccaagtggagggcccgcaatgggaagtgaacatttctgaaaataattattttccaaagttattatgtaataaggggcttagtagggagtgtccatgtatgtgtatacagagcaaatatttgctttaatcatgttcaagcatttcattcccaaagtttgtgaaaggggaaatcaatactccctcaattgatcaatgaacaggtgaaaaagtatcacctcccactgccccaggctgtttaaaaaactggaaggacaaaaatgtgaagcatctgttgtgtgcttgaatataagcagacacatgatacaaagccctgacatgggtatttcaggttatactcatcctaaatacaccagaaatgccaagagttccaaacttccactcacaagagaataacctggggcagggccactcttcctatccactactctgtccaagagtccggaggtcaagtccgaagaccagcatgatcagaactccgagaaagggcagggagctctgccaagggcaaggccaggccacctcactcccggacttccccagctgggagcctcagagcaggcactggctaaggtagccagccccagccctccatccccaggaaaaggcgacagagaaggtctaggggactggcagtgctctcagattttctatctgtcttctccaagtgagcccatcacacccagatagctcatagctctgctctcctccaaaaactaagggacacagtgtaacacaaaagaaagtgcctcctttttaaaaaatgttgggatgagaggtataatttgtttgtttcaagagaaagtaggtaagtttagtgtttaaagtcacctagactattgggtgtttgcagaaactacatggttatgtcattcaactcacaaatttgtctgttcagagaagacaacagaaatagacaaaataatttgtcacaatgactatgaaactgatagtatggccaagcagggggattagcaagaacctacacctggagaatctggcgacctgcccaaaaccaggtatcaatcacaggcagcaagtgcaggcatgggccaagagaattcccgaacacattcccagctccgtgggcattttcctgtcagacacgactcacagacgtgaaacccagagcgctgttgccacaagatggcagacattagcacaaatgtgattgttccaaagatttgctgaaagtggctcaagtcaaaacaaatgttttcaatcccaaatgaataaagttacagtctgaatatactcttgacacagggaccctcttccccctaacgtggaaagggccacacctgcagacttaacacctttctaaactctactagttggccctctcttatatataatcctcccccaacaaaatgaatatttgcacatcttgaagatgatttccaaacccgaagtcaaaacagaaatggaaaatcaaaaccaaccaaaataaaacaattaaagcaacgggtcgccactgtgaagagggccacgtcacagcgcgctctgcccagctgagcccacaactcacctccgcagctgacagcaagtaaagaggagttaaggcaggaacttgtttcatgtcacagctgaggccaagggttgtcagaatctctctaaggacttcgtatcttctaaaattgcttgacttgagcaagttaaaatcttctggagtttgcactatgttggagctgggaggtagttctaagtgcacctgaaggggaaagatagcactatgtaaactgagggcactcacaggcaatgagaaaaacagtttcttttttctttttctttttttttttaaatttagagacaggatctcattatgttgcccaggctggtcttgaactcctgggctcaaacgatcctcccacctcagcctcccaaagtgctgggattacatgtatgagccaccacatctggccaaaaaatttctttaccagttttcttctccaagtgagcacatcacacccagatagctcatagctttgctctcctctgaaaattaagggacacagtataacccacaagagaaaacttgaacatgaatttttctaattatcaatagcatataaactctgaagctgtatatctggaaagtcatggccaacaaaagaacgattccaaagagcctactcaaattttggttgtcaggctgagaggccacggtggaaatgaccctggacagtcatcatctctctccaggtactgatgttccacactcatcagtcatatgaccttccgcaagttacttaacttgattataggaacaaaatatctagggccgggagcggtggctcacgcctgtaatcccagcactttgggaagccaaggcgggcagatcacctgaggtcgggagttcaagaccagcctgaccaacatggagaaaccctgtctctactaaaaatacaaaattagccaggcgtggttgcatgagcctgtaatcccagctactcgggaagttgaggcaggagaatcgcttgaacccaggaggcggaagttgcggtgagctgagatagctccattgcactccaacctgggcaacaagagtgaaactccatcgcaaaaaaaaaaaaaaaaaaaaaaaaagacctagaaagacagttatgctgaaaacctaattgctagtgagttcagggaggcaaatgggtcatgctggaaacttccattttgcctattagccataactggaaaacaatacctaggaagagagcagcgttattcatcattttaagagcgtttgcaggaggctgggtataaaggctcacacctgtaatcccaacactttggaagaccaagatgggaggattgcttgagcctaggagtttcagaccagcctggacaacatagtgaaaccctgtctctacaaaaaatacaaaaattagccaggcgtgggtggtgcggctgtagtcccaactacttgggaggctgagctgggaggatcccttgaacccaggaggttgaggctgcagtcagccatgatcgtgccactgcactccagcctgggcaacaaagtgcgaccatttaaaaagaaaaaaaaaagagagagagagtttgcaggaattcaaaacagcaggtccttgaataatgttgtttcactcaaagtcattttgttatgatgttgatgaggggaaaaagaaatcacttcccagccggggccactgtctgtgggtccgtacgctctccccatgtctgcacgggttttctctgtttctccgttttccccccacatccccaagctgtgcacattaggtgaaccgatgcgtctacatggtcctgatctgagcaagtgtgagtacgggtgtgagtgtgccctgtgatgggagggcatcctggccagggctgactcccccaccagtagtaccctgagcttcctggatgagttccagccacgcggccacccaccatgctgaactgaaataatcaggtaaataattatctttgtttttattaatctttcttaaatgtacatataattcatatttatttcagtgtttcagtgttttggcctttatttagaagtctggtgatgtctttgtgaccagaaatacactatgggaactgacttcttgtttatatcaattagcctatggtaacattggtttcattgtttgtcatttcacttaagggtgcagtttccaagaatctatcaacaactttaagtgaggacttactgaggaaggcatacgatttcttggacaccagaaaggcctttcctcccaccctccttcccctgattgaattttaagatttggaacttcacctagttacttcaggctttgttgtctagttaaaattaaaatatctccacctatcagcagcctttgtctgggtatgaaggaacttactggaacctctagctcccctgagatcagattttaaatgagcattgaagcctggaggttgccagaacactgagtacccagaaaagcaaactgagctcgtctgccttattttgtttcagctttgcctactgtatgcaaagcttctagcctgatattatagaagtattatgaaaataaaaagcataatgccagctttcaggcgacttagaatctctcaattcctaccttaaccaagccaaatatactaaccaaatgttagaagttgaggcttagctgggtgtggtggctcacgcctataatcccagcactttggcaggccgaggcgggaggatcatttgaggccaggagtttgagaccagcctggacaacatggtgaaaccccactgccactaaaaatacaaaaatcagccaggcatggtggcgcacgcctgtaatcccagttacttgagaggctgaggcacaagaatcacttgaacctgggaggcagaggttgcagtgagctgagatggtgccagtgcactccagcctgggtgacagagtgagactccggctcaaaaaaataaaggttgaggccaatcagaaaaggtctgcagggcaccgtccaacatggtccccaaaccacagctgattggctgcaggctggctgcttcctccaagactgaggatgccaatcatgggacaacaggtcaggtgggcctgtttgtagacagccctggagaggggaagaggcagaaaagcaaaaccctctaaagaatccatatcctcacctgatgtcaggagttcgaaaccagcctgaccaacatggtgaaaccgtctctactaaaaatacaaaaaaaattagccgggcctgatagcgcatgcttgtaatcccagttacttgggaggctgaggcaggagaatcacttgaacccgggaagcagaggttgcagtgagccgagatcgtaccactgcactccatcctaggcagtaagaatgaaactccgtctcaaaaaaaaaaaaaaaaaaaaacaatctgtatcctactcagtgcacttctaccctaaatgtgtacctctcctctccggtggacaaagccatgccagtatagacaaacagcatagcggcgagacccgtttaattcacttgagcacacggctatcccggagattaacccttacaggtggcagaaatgaaataagtcaagttctgttcccactagagccgaagggatgagaggggtgctcgactgaatgcatgtggactcactggtcagggtgaatacacagagtagccaagatgcacacgcagtgaattgtatgaactcgttttcacatgagaacgatgccaggacggaaaacaggatggcgctacaagcgggcggagttcctggagacaagggggaagatggccgctgaaaccccgagaactgcttggcttcactgtcttagggtttcaagatgtaggtgcttctacaatggaaacaagaaaagaggccacctctggttctacgctcccaattagcagggagaaatggcacaccggagtgtgtgggtggtagatttgtactcctcgtccacagaggtactggactagaatctcattctctgagtgtaaccctgttaccataatgacaggtctatttctgtaacttggcttcttgtaaaaataagactttttagttggaccgaaaaccggaactaaaaaaatgtctccagccacaaatgcgtggagagggtgatactggcatccagtggggagagaccagggatgctattccgcagccgaaaatgcacaagactgttgttgccacgaagaattctctgacccaaaatgtcaatagtgccatggttgagaaactctgtcatcaaaggcgacccactgctgccatgtgctaagctaaacaagaaaacaaaatcttttaaaatcccttttaaagattttctgtggacaacttcatggcaaattcctggtccatttgacagtcaaatgtcagcattaatccacagccttaagttttccctgcaaacttgatcagtacagcgagcatacaaacatttcctctctttctttattattatgaatggcaaaggcatcaaatctgcagcttactcggctgggacaccagtgcctagggtgcagctgtgttctgcccttgaaatactttacctcctcttattgggttacatcattactagatttattacaaaggtgaagactatgaaattgaacagggaaagaggaaactaaccagcctgtgataatatttattttttgatctcagtaaggtatcacagagacacaggcctgtggagaaaacagtgaccctgtcacacagaagactggaagtcatttaaaatcaaaaatgacattctaatcctctgaatctgatttgtgaagctgcatcatattgccttttttttctagggcaatgcactgcagtatcaaattttatgatagtaatggggtcaatttaaatggtgcagcaagcagatttgctatgtaactcggagaaatggatcacaacagtgccaaatcaattttctagtacaagtctgtgctcaggggtggtaaaattcactcttcaaaactgaaatatggctctaggaagtcgggtttttaagtggattttctgagaatatgcagttactatagttacaatatttgcagagaaaaagataagaggaacatttattacgcctccaaaagctaattcatgtggcctgcagcactgcaggaaacctgcttgggctgtacgtgttcatctgtcctaatgtccaaattccttaattttaagcatctctgcttgagtattatcttaagaacaagtgagtcggctttagaatagtaaagaaacaaatatatactctggaaaaaaatgtttggccagaaaattcaagaaacttagcttccaggagaactggaaaaagacaaggcattacaaaatgaaaacaaaacaaaaaaggaaacaattctctatctcaataaaaagatccctataataaaacaaaatcgattacacttatcttgggaactcttctggacaaaatatctacatctgcgtagttttctcattagagcatcaaatcctttagggcaagtgaatgttcatctaactctaatgaaaaccttttcccctaaggattaaaagatttggagtcaatgacaaggaattctgaaatagtttatccgctaccgtttgcttaaacaaacaaaaagctaaaaggaaaaagaagatgagccaaaggatctcctacgcaagaaaaagaaactagcattttcctttcatcctctttccattttccccctacctatgtattagtatgccacaaatctaagtagcttcaatattctcttatttgaagtttttcttttcagcacttggaagagtgacaaaacataagaaaggaattgggaacctgaagatgttttcaacaccaactaccttggcaatcaactgcagtatttcatcgcagtggtcactgacgtctagaatcactaccctgatggtttcaacttcctaccttaaataaagactcaattatattaaccaaggggtgctctaaggcaagaaagcagaccgatgaatttgagaaagatcattactagtaaagaacaaaacgagaattttctgactaagcctcagttaaccagcaagctcatttaaccctgacagctgccttgttcctccctcacaagtcttttggttaaccagggtattcaagaaagccctgaactaaactaaactttctgctcactatcagcaaaagctcccagccaatagtcaaaaacagcccgcagcacacgaactcctgaaacttttaagcgtgtacctttaaaagacatattccctcgcaaaaatacccacagatacccaaagatcaccaaatccatgctgccctgagtacctggcaaagaacagcttctcccccgcgagttccaaaaggcacatgcacaatcatcctgtccttgtcctcattctccaggtggccctggagcctgccggggctgagccggacggggccttcctggtacctgcagccactgctcaagacgctgagcttcacctcgctctggtcagccttggagaaaaccaagttctggactgtcttgtgcagtgcacccttgcttgtcacctgaaagccaccaaaggtgaaggatgaagacaggcccaacaccttccctccctgagaaagataggccatgaacttctggtacaggtcttcgggaatggactccctggtagcaatgaccaacagcagacagttgtccgtccacgggtctctgagagcactgtcctccagcaggtggtagagaatataactgtcaatgtccacacagtcggccagcacagaccggacctcgtggaaccggccgagggcttcctgggagtcggagcccacatagaggaggatgttgggtgcctttcccgtgaggttgactctcctcccttctctttcgggggaggtctcatcagcaacactctccaaactgctgctataatcgtagggaaggtctggaatgttctcggcagacgcaaacttgactgactcaatggtgctgttctcaagttccagacactcgtggcaactagacagatggaggtgataatgctcaacggggccccctcccctgtcactgtccccagcaggctcactcccagaggcactgcctctcctttgtttgggttcttcaccaagagcctttgggtcatctctgccaacatgctccataccgtcctgctcaggcttaatctcaagagaaggttcaggcttcggctctaggatctgggcttgcttgtttgagacctgatccttaacttccttcagagtggagtcctgcaagtgcaccgctaaggcatgaataggagagagagacagaaaattaatcaacacttcttgtatgacacatagctcatctcaagaatctcatcaccctctctgcattctgggacttacattccaggacagcctctggcacggctcccacctgcatcccccctcaactcgggggcatcctttggaaacactaattgttcccacctgaagaccccaagtgaaatcagcagtttgcccaacatcttttatacctattggagaacctaagaccctcttacggaatggtgaagaaagtgagattcagagaggtgcctttgcctccttacttacagattctatttcttgggtgttattctccttcacaataatgaaactgagcaataaaaaggacacatatctagagtctaccccagcacgccccagtgaaatgtcactctcaagacatgccataggatcaatgggagaagattcttcccagtatcttgtctcaggactggaacataagttgacaatcactaattcaaaaacatttattgagcacttgctacatgtcggacatggtattagagacatgtacgaggtgattctggatattaagggatttacataaacttccaaagctgataagggacatttatttgcccatcagatgaaagaagacattcatagacataaaaagcctgcttttaagtctaattaaggaagaacagtttgtgtgtttcctgaaaaacgatttgtcccaagaaattgtgatacatatattttaagtaaaaagcggtttgatttagaacttcatagtaacactagctatgcttcccactcaatcagaactgtagtctagacactagttatactgtattaaactatgtgaaataaatattatatgggttctgaatttgaatgccacctcatgagcaatgcagtcatgaaaacttcttgtttaagaaatttaataagcactgaaaatgtaccctgcagccccccaaaaaaatcttgacacatgcatgaattgtatattattacagtaaaatcaaacctgtggactgaattaaactgaaaccaagcatagcctttatgtcataccagtaagagtgctcaacagtccttaagctaataacttatagtgtcccactatgataaaaacagggtctcactttgtcacccacatgggaatgcagtggcgtgatcatggctcactgtggcctcaacctcccagctcaagtgatcctcccatctcagcctcccaagtagccgggaccacaggcatgcaccaccacacccagctaatttttttgtttgtttgtttttttggagataggggtctatgctgctcaggctggtctcgaactcctgggctccaagcgatcctcctgcctcggccttccaaagtgctgggattacaggcatgagccactatgcctggccaataaaaacattttctaaagttacttacacacaatcttttggggtaccagtccattatccatgtggagtctatcttccatgaacgccacccccagcttgctgaagttgtccacacttgcttcagcaattagccgataaggatccccaggtctgcaagctaatggcaaacaacagtctgaccacttgacaatctgagaaaaagcaggagagggaggaggtgggaaaagacaggttgagatttttcttctctaaaataaccacatactttatttttcccttgaggctcctaccactaaattacagtcattaataacaaattactggatattacattttactaatatcagagttgttttgaattcagcattctcatctctacctgacaacagtgcttacgaaacactaaatataactctctcatttaaaagtaactgaagtctccacctttttaaggaattaaaagataaagggacattccccagacactggaaaaacaccatgctgccctttaaaaacagagaagaggagagaacaagaagtccacaatacccagttactttcaatgtaacctgtggacccgcttttctcaaagtgtggtccgagaccaagtgcaactgacctcccagggagcacatgagaccttcagagtcccgagcacaactccctccctatctggtgcactggactttctggagttgaagtccaggaatcaggatttaaaacatgcttcccctggggttcctgcactcgaactgtgagaacaatccaaaaagactctccagacagttcctccctgtaaggaggttcacgttcctaccacaagggggacagggagaaagagagcaggcaaaacacccggcttagccttccagttcttactacagaagaccgtgacactggggcctggaacacccatgctctctctgagggttcccatggagaagacagcctgtgaggtgaagagcccggcgctgcagtcaggggtctgaggccgagtcaaaggcaactaatcatcactgtctgtcctcgggcaagcttccgaccctcacagcatcctaatttgtaaaacaagaatactctactaaaaatacaaaaattagccgggcgtggtgtcgcacacctgtagtcccagctactcggggggctgaggcaggagaatcgcttgaacccaagaggcagaggttgcagtgagctgagatcgtgccactgcactccagcctgggtgacagagcaagactccatctcaaaaacataaataaataaatataatttaaaggttggttgtgttcatgagatcaaagagtatacgtaatgcccccagtaaaaagcttagattgactggaataaagtactcaattaccgacagctgcttttattagctgtcacaaatgtggctttaaaagcagcagtgagcagcacagtctttttctaagatgccatgaacgattgctctacttcctaaagataccttctcagggacacactgccccgaatttcataattatagataaataattttttattccatttttatttatttgtatttatttattttttgagatgagtactcgctctatcacccaggctggtcttgaactcctggccttgagtaattctcccgcctcagcctcccgagtagctgggacaacaggctcgggccaccacactgggcttgaattctattttagatattggtgggctaggattttagaactaactcctcctaaaaactattttttaaatgctagataaaataaatgaataaagcattaccttaaaagtctggaagaacagactagataatagtgaacttccaggccaagtgtgggataaatcctgaacctacagaggaaaggggtattcctgcaagacacgccacttctgcccccagggtccttgctcatccaagcaacttgggtttcaaaagtcatcgtccaactggcataagcatagacatatagagatatggtttggctgggtccccacccaaatttcatctcgaactgtaatccccatgtgtcaagggacggacctggtgggaggtgacaggatcctgggggcagtttcccccatgctgttctcgtgatagtgagttctcatgagatctgatacttttgaagtgtttgggctgggcgcggtggttcatacctgtaatcccagcattttgggaggccaaggtgggcaaatcacctgagctcaggagttcatgactagcctgggcaacatggtaaaaccccgtctctactaaaaacacaaaaattagccaggcgttgttgtgggtgcctataatcccagctattcaggaggctgaggcaggagaatcgcttaaacccaggagttggaggttgcagtaagccgagatcatgccattgcactccagcctgggtgaaagagcaagactctgtctcaatcaatcaatcaataaagtgtttggtagtttcctctctgtctctgtctctcacctgccaccatgtaagacataccttgcttccccctttgccttctgccatgatggtaaatttcctgaggcttctccagccatgaagaactgtgagtcaattaaacctctttcctttaaaaattacccagtcttgggcagttctttctagcagtgtgaaaacagactaacacatatagaccaagagaacagagctgacagtatagaaataaacagattcatggacaactgaatttggacaagggtgccaagacaactcaataaggaaataatagtcttttcaacgaatggtactggtacaactacatactgacgtgtaaaagaatgaacataggctgggcatggtggctcatgcctgtaatcccaacactttgggaggccgaggcaggtagaccaccaggagtttgagaccagcctgaccaacatggtgaaaccccatctctactaaaaatacaaaaattggctgggcgcggtgtctcacgcctgtaaccacagccctttgggaggccaaggcaggtggactgcctgaggtcaggagctcgagaccagcttggccaacatagtgaaaccttgtctctactaaaaaatacaaaaaattagctgggcgtgctggcgggtgcctgtaatcccagctactcaggaggctaaggcagaagaaccacttgaacccgggaggcagaggttgcagtgagccgagatcgcaccattgcactccagcctgggcaatgagagcgaaactgtctcaaaaaaaaaaatacaaaatttagctaggtgggagcaggcacctgtaatcccagctactcaggaggctgaagctaggagaattgcttcaactcaggaggcagaggttgcagtgagccaacactccagcctggcactccagcctgggcactccagcctggcgacagtctcaaaaaaaacctattaaactttaaaagactcagatttgcattaaattgatacagaaaaagaaaaaaaccacagatagagaagcgttaaagacctcttttagaaaaaggagaaactggccaggctcggaggctcacgcctgcaatcccacctgagaggtggaggttgtggtgagctgagattgcgccattgcagtccagcctgggcgacagagcaagactccgtctcaaaaaaaaaaaaaaaaaaaaaaaaaaaaagaatgaggataaacctcttcctcacatcatgcaaaccacgtacaaaaattaactcaaactggatcaaagacctcaatataagagctaaaactacaaaattcagagaaggaaaacacaggcataaattgtcatgacttttgatcaaccaatgacttcttagataagacaccaaaaacagaagcaacaaaagaagaaatagataaattgaacttcatcaaacattcttgtgcttcaaaagatatcaagaaaatgcaaagacaacacagaaaaataggagaaagtattggcaaatcatataagaactcctacaactcaacaataaaaagacaatccaatttaaaaatgggcaaaggatgtaaggcacccggcaaaggcacctgtagtcccagctactagggaggctgaggcaggagaatggcgtgaaccccggaggcagagcttgcagtgagccaagattgcaccactgcacgccagcctgggcgacagagcgagactccatcttaaaaaaaaaaagaaagaaaagaaaatatacaaacgcccaataagcacaagaaacactgctcaacatcagtcacgaaggaaatgcatctcaaaaccacagtgagacacaaagtcatacccactaggatggctggaatcaaaaaagataccaacaaggacaaggaaaaactggaactctaatacactgctggtagaaattaaggtgctgcagctgccttggaagactttgggagttcctcaaagagttaaacatagagttaccatatgatctagtaattctactccccagtatatacctaagataactggacctgaacatacgaacacatctagattaggctcagaggatcttcccaaaggcaagccccagaggccttcacaaaagaaacaaactacgttcactgagaaacaactggaagatctgaacttgttcaataagaacgtatacccaaaccccagccttcagaaagatatggtctccaaaatggaaatagatccaaaagtactgtaggtttggctcaaaaaccttggagcaaaactcaagaaagccaaatgcaagcatatttggcaaaaacaagaagctcaacaacagcaaatatctgagaatgaggctgggtgcggtggctcactcctgtaaatcccagcactttgcggggctgaggcagaaggatcaggaattcaagaccaacctgggcaacatggcaaaaccctgtctctatgaaaaactacaaaaaatagccaggagccaggtgtgttgatgggcacctgtagtccccgctactcaggaggctgaggtgggatgatcgcttgagcctgggaagttgaggctgcagtgagctgtgatcatgccactacactccagcctgggcaacagagtgagaccctgtctaaaaaaaaaaaaaaaatctgagggtagactcaagaccaatccttctcagggaaatatggacacactacccacatccccaaatgaggcccatcctagagtttacacagatcatcaggcaccctcattccaactaaacttaggccccagtggtagggaccctatagaccaccccagtggccccaaaatagttcattttggctgctgccaagatctgaacatatacggcttctagacacttcagaatcccaagttcattctccaagcttccattttaattcttttggttcctcatctctacaaaatagagacatcagacacaaaaggtcacatattgtaatggtttatgatgattctcatacaaaagaatacttttcagcaggaagaaacaaacttgagatatgcacaacatggatggatttcaaaaacattatgttgagtggagaaaaaagatgccaaaggatacatgctgtataattccatttctatgaattcctagaacaggagaaactaatttaccatgtcaaaaagattcgtggcccaagtagaaagaattgaatagaaagaggcgcaagacaaatgcattggggtgatggtaatgtttcatgtcttaatgacctaggcagttacctaggtgtataaattcatcaaaacacacagaactgtgcatctaaaatctgtgcattttattttatataaattatacctcaattaaaaattaatatacaacaaaactagtaaggacaatttctttattttttttcctgcttctttgttttgattttggttttggttttttaattgttgttgttgttccatttgttcagctaatgagatttagtcagcatcactaagtggacagttggcttatgtttctaaatcctgtttttgggtcacctccctccatcatcatacttgaatgacctcgtcaagctcccttcattcattttggctctccccaagacgttcttcacgtagtcaccagggtaatgttattattcctttaaaaatgttgcactattccttggcctggcacggtggctcacgcctgtaatcctaacactttgggaggctgaggcgggtggatcacgaggtcaggagatcgagaccatcctagttaacggtgaaaccctgtctctactaaaaatacaaaaaattagccaggcatggtgacaggcgcctgtagtcccaactactcaggaggctgaggcaggagaatggcgtgaacccaggaagcggaacttgcagtgagccaagatcacaccactgcactccagcctgggcaacagagcgagactctatctcaaaaaaataaaaatgttgcactattcctctgcttaaaatccttccatgaataagttctgaagatctactgtacgtcatggtgactacaggtttttttttggtttttttttgtctcaaagaaaaaaccacatcatatgttgtaccccataaatatatacaactaaaaaaatactttcatggccatttttcatcattcaggaaaaaaaaatatgcccacatataaagcttgtatgcagatgttcacagcagcattattcacaatagccaaaaggtagaaacaacccaaatgtccatcaacagatgaacagataaataaaatgtatatagctatacagaggactattattcaaccataaaaaggaatgagaatgaactactgatgcatgttacaacgtggacgaatctcgaatacattacattaagtgaaagaagccaacaactaaaggtcccatattctatgaggctatttacatgaagtatctaaaatagacaaatctagagtcagaaagtagattcgcggttgccaggagctgaggtgtcagggagcagacagtgaatgctgacaagtgtgtggtttctttctggtgtgctgaaaatgttttagaattagataatgctaatgattgcacaactttgtgaatatactaaaaactactgaattgtttttcaagggtgagtttcatgtgaattatatctcaattttttaaaacaaaaagaaaagagtccaggcagtttgtttgtctctacactcttccagcacagcctagtcagcccaacttcccaaacttcaatcctggctcccctggttaagagcgtgtgacctgagcaagctactcaaattccccatgcttcaatgtcctgtctgtaaggtagagataagagcacctaccttggaaggttactgggagcactaaaagggatcatccataaagtgcctgggccacaagggtgctcttatggttccaaaatataaagtcctttagagcaagtaacctcatgagaaaccacatcatccctagtgggcaaaaaccgaacctggcagggaatggggaggtgaaaaaaatcttagacattacaacagtttgtggccctccaaggctcaatcctatccctcaacttttttattttttatttttattttttttgagacagggtcttactttatcacccaggctggagtggtgcagtcatggctcattgcagcctcgacttcctgggctccagcaatcctcccaactcagcctcccgagtagctgggacgacaggcatgcaccactatgacgggctaatttttgtattttttgtagagacgagaattcgctatgttgcccaagctggtctcaaactcctgagctcaagcgaccctcctgcctcaacctcccaaagtgctgggattacaggtgtgagccaccatgtccggccccccacaacaaaatcttattccttagtagctcatttctcttctcagagtgaacgtgaatttaattattctcctcggaaaaacaatcatgaaaaaaaaaaacttgagaaacattgcgtttgaggggaaaagaataaacgcaggcctttatggccaactcactaacctgtgtagaatatttggacaaagagaaactccagaattttcatttagctctacttgtatctttccttccactttaccacctacttctcccacctcctcgcagacacacagccaagggaagcagaattcacctagagggtcaggcccacccaatgtttcagcagagttctacatttcagaaatgacatctttgattcaggacagagagttcgttgatttcagctttgggaatgggggaaaggacgtcagttcaggaagatgagaagataaactaacaccgtggcagggcagacttctgggatgaaggtgcgtgggaaacagggaaacgaacagggcaacctcccgcgggaagctaaaggcaccattgtcctcagagcaatcaaaggaggaggagaaccgctcagccaatggagactcaacccggaatttagctgtaaaaacattgatttagccccctgcggtagcaggcactggcagtgtaaaaggagccaatgatgaaattcccacacacctctgaagaggaatgaggcaggagataaacaaaggaagaggaaggaccggaagagcccaaagaatacatccacacatcccggatcaagtttctccactctgccaactgtttcctcacctaagtgcatttccgttttctaggagcgtggtccatgagccatggaccatgcaaacgccttcaagcagcgctgggtgctccgatcaaagcagaaccgcgctgtcactgatacgtcgtccagggtgtttgccttccagtggataaaggcaaacaggacactttaaatttgcacttcgagatggaaacaaaggcatggaaaagagaagggaagtcaagcaaaaggctcactcccaaagatcaaagctaaggaagccctggctgtccctaaacaaaggagtttcctcctataatagcagccagcagaaatctgttaagtaactaaagctcttgacttgatgttacaatgtatggcagcaggcaaggcatatcttctctgctcaacttaaaactcacatccaagaagcagtccgggagtgaaagaccccaggttaaactagcacaggtggccctgcccaacagggggcattggcaggcagcagctctgcagtgagtggggaacagaaatctcaacaacccactggtacccagagtcagatcacggatgctgctaatttttctgactcttgtttctcctcttccaaatcatcttaattcaacgtgaaattgttaaaaagctctagtaacaaattggatggagcaaggctggaaacgcagaggtaaagaatttgaaaatacagggccaggcgcggtggctcacacctgtaatcccagcactttgggaggccgagacaggtggatcacgaggtcaggagttcgaaaccagcctggatggcatggtgaaacccccgcctctactaaaaatacaaaaattagccgggcatggtagcgtgcacctgtagtcccagctactcgggatgctgaggcaggagaatcactggaacccagtaggcagaggttgtggtgagccgagaccacaccactgcactccagcctggacgacagaacgacactccgtctagaaaaaaaaaaaaaaaaaagaatttgaaaatacaagactaaagggaaaaagttatttttaacttttggctatccttgctgtcttttgtgtttggaaatagagaggataaaggagagctacaaaattgactttcacttgatattatgtaaaaagacaggccagatgcagtggctcatgcctgtaatcccagcacttggggaggccgaggcaggaaggatcgcttaagcccaggagttcaagaccagcctgggcaacaaggtgaaaccccatctctactaaaaacaaaagactagctgggtgtggtggcacacgcctgtattcccagctacttgggaagattaggtgggaggatggattgagcccaggaagtaaaggctgcagtgagccatgatcatgccactgcactccagcctggatgacagaatgagaccctgtctcaaaaaaaaaaaaaaaaaaaaaaaaaagacaatataccctatggcacttttaagggtattggaaaatcaagtaacagcgtaagagttatcacaaagtcactgcaagcaggagctgaaatagtcaactaacccagatggagctgaaaagaggaattgcgaaaccatgactgacaagatgctcagggaaagggcaggtctcgctgaataactgagaaaataatacaaatattatgagaataaatatctttgttgccacacagaagaatgttattattgtgttctgtagacagccgatacaccgccgaggcctgctaaggtgtgctgcattcacatccacagttacctcccacctcatccccccattccactgatgtaagctgaggaagaagaggagttttaagaggtatcccaagtggtttagttacccactcatgtgtaacaaaccaccccaaaattcagtggcttaaaactaatcatttattttgctcacaaatctcaatttggacaggactgggcaggaacagcttaactctgctccatgtggcatcaggtagagtgactaaaccagggctggatgacctactttcaagatgcctctgtcactgagctggagctgcctgtcagctgggagctcagccagggctgtccacgaagagccacatgtccttctacttcatgtggatctcgccacagggcagcttgagcttcctcacagtatgggagctggactcccagatggcatgttccaaaagcccagatggaggctccaaggtttctcatgatctggcctgagaattttcagaatgtcacttctaccatatcccaatggacacacaaatcactaaggtcagttcagattcaagggagggggaagtgactccacctctcaataggaggaaagaatttgcagccatcttcaatgcgctgcaacaagtttgtgccagcaattagtcttccccttctgcatgagaatgacatgtccctaaatgggcatgctcctttggcccaggaccctgcacaagagagatgtagagagcagagagctcaaagcagagtcacagctggaaacagcgcagcgaacctgctgagcatgagtaacatacccaagaaactaggattcactgttagaagccactgggattctaagcttatctgttacttcagcaatctgattaacacaatgtgcaaaactgcattcctgacaacagccttctaagcccttcctgctacattccccatctgcacaagtgacccaccatccacccacaggccatcacctcctaaccagtatggacatgtctctatctcagcgttcctactcccaacactcatcaagcccattatcttttcccatgtggccacaatctgttccaggtttgctcccctccaatcccttctgcaatctgcctgaattgtgaccttcctaaagtgcaaatctgatcattctgctttaaaaaaaaaaatagttttagcctactgtccctgggatcaagtccaaattcctggttaacacatataagccttgtttgatgtatatattatgtccaatttgagtatattcaattctgctacatagaaaacaagaaaaccaatagcatggatgaaactcatagtgagtcaaaagcttgtaagacacgctcaagacagacaaaataagtggaacatacgtgcattgaacatagataaaaaggacaaaaccagagtgttagtcctaggcagaaagtcacgggagaaccaatcttttttttttttagaggaagacagggtctcacagctttgtcacccagcctagagttcaatagcgcaatcaggactcattgcagcctcgacctcctgggctcaagcaatcctcccacctcagcctcccaagtagatgggaccaaaggcatacgctaccatgcctggctaaattttttttttttaatttcttgtagagacagcatcttgctatgctgcccaggctgaccagggccaatcttatcaaatcttaaatattagtaagacacaaactatgccacttgacagttatatcatccttaatttggccacccattttgaccccatttatatactgtctagaaacacatgaaaaaacacacacagcatcccagcaggtctctggtaagccacagctattgcagacatatatatccaaatatctccaacaaagcaccttccaccttctgggcccttgtgtaacttcagctctagtccttgtgctgacaccattggcagggaaggctgatgcagcagagagacaggactccatgtatgaacattgcatggcccaggattcaggttgtgctgcttccattccataggcacctgatcctaagtgttaaccaatcccagaactctccccttatttcttgctgcatgttttgaattgatgtgataaacaatgtgattcgagcgtcttaactcagcctatgagcctctctattctgtgactgctggaataggctgcttggccatgttcttggaagctaccaccatatcagggtaatttcccacacaacattccagcccctgctttcccctctggccttatctagggccattccccaactcaggtgaatgcagactccaaatgtactgagctgtgtgcaggggccaggtgcaaatgctttctgtgcatctgcacatgctgttctacctgggaagtcctttcctcctttcacctatttttaccttaaacctcagacatcatctaccctggaaagtccttcctgacctcacgcatctaagtaggtcccccccataatccctatccatgccttctatagtacttaacatggtgacctttaattgttcatttacttagctctctgctctcccacactgtgaactccttacaaacagggaatgtcatctctgaatgaatctttcatctccatgtaacacatgcctccaaccctacctagcacacaatctggcatataacaggcactcaataaaccttcaatgaatgccttgatcaagtacaaggaacataagcaaatttcctgtggaaaaaaagaattgtattaagttctttgggtcaacaattcttactaaatgcaattgctaatataagtatagaaaatattgaaaactgagctgaatctgccatcacttgttggtattactgcatcaagcaaaataagtgaaacgtagctgttcaataaatgttaatgaatgaataagcgaaaatatgagtatgtgaatgctacattttttaaaactgaattttaagatccatttatctgttgttggtaatctgtagaattaccacagatcaaagccatttgaaatatccaaaattcaaaaagatattttaaatatctttaagagttgtatagtcttaaagatgtgaaaaaatataagatcccatcaattcaaatgtccttcttccataatatatttttctatttaataccttaggaccctgttaaattcaaatggctgtgaagtcaggtagaacatacacacacagattcataagaaccccccaaaatgcaaaatcccatcaagcagtcaacccaaatgggaactgtcaacttggctagaagacagtgagctatgagatcaatccctttttaagttttgaatcctaatttataaaatggagctcggggtaacagccagagtggtcaacatgaatggctctggacgtctctagctcctggttgcaagacccactgatgtctctgatcataagtgaaattagttaactggactgtggcaatcctccttgttgggaaggcattctcctaccccagaaaattaagaattaagtaaccacggccgagcgcggtggctcacgcccgtaatcccagcactttgggaggccaaggcgggcagatcatgaggtcaggagatggagaccatcctggccaacatggtgaaactccgtctctactaaaaataaaaaattagctggttgtggtggtgcaggcctgcaactccaactacccgggaggctgaggcaggagaattgcttgaaccaggaagtcggaggttgcagtgagctgagatcgtgccactgcactccagcctggtgacagagtgagactccgtctcaaaaaaaaaaaaaaaaaaaaaaagaattaagtaaccaccattcagcaagaaggtcttaattaaatcttccttggaaagtcagttaactgaaatgatagctgtgacagagatgctaattatctcccaaaatctagcctttctttctcccttacaagaacagaactcccagtttctgctgaatccatgactgtccagctagggaatgcattttgcagactaccctgcacctaagtgaccaagggggctatgtgacaaagttctgtacaatgaaatgggagcagaagtcgccacgtgaaatttctgaatcacaacagtattttttttaatttactaattttttagagatgaggtttcactctaatacaatggcaatcaaagctcactgcaacctcaaacttctggcctaaagtgatcctcccaccccagcctctcaagtagctgggaccacaggcgggagccaccatgccaagatggatcacagttttaaagaggaaactggttgtctcccaaccttctctcttcccccactctgaaggctagatgaagctgacactggtggagtagcacgggagccagactctagcaagagagaaccactacctaggatagaggagggaagacaggagaaggaaccaaggaagaagatgaggaaaaaaatgggtccctggatggacttccaaagcaaaaccactgcccagagagagaaatttaacttctagcttgtttgagcccctgtagctctgggtcccactgttatacaacttagcctgtatcctacataatatagtaactatgttccttaagacgctgtacatcttttagccccataaagacatataattaacaatttaggaaattaaaagcacggcagtcattattttatgctaaaaaggaacctgaacatatttgatattttatataattgcaatattttggaaagtctgatcttggctttaagttgaaatcttactaaatttatatataatattagaatatataagaaaacttcaagcttaccatatttgtaaatttaatacagtcatgtaccacataatgtctcgcccaacgatggaccatatatatgatggctgtccctcataagattacaatggaggtaaaaaattcccatggtctaatgacattgtagtacagcacagtactcacgtatttctggtgatgccggtgtacacaaacctactgggctgtcagtcatataaaagtatagcacagacaaggccagacgcagtggctgatgcctgtaatcccagcactttgggaggccgaggagggtggatcacctgaggtcaagagatcgagaccatcctaggcaacatggtgaaaccccgcctctactaaaaatacaaaaattagccgggcatggtggctcgcgcctgtattcccagctactagggaggctgaggcaggagaatcacttgaacccgggaggcagaggttgcagtgagctatcacaccactgcactccagcctggcgacagagcgagattccatctcaaaaataaaataaaataaaataaaaagtataggccaggtgcagtggctcacacccataatctcagcactttgggaggctgaggcaggcagatcacgaggtcaggagatcgagaccatcctggctaacatggtgaaaccctgtctctactaaaaaaatacaaaaaattaaccaggcgtggtggcgggcgcctgtagtcccagctacttgggaggctgaggcaggagaatggcgtgaacctgggaggtggagcttgcagcgagccgagatgcgccactgcactccagcctgggcgacagagcaagactcagtctcaaaaaaagaaaaaaaagtatagcacagacaattacatacagtacacagtacctgataataaacaactgttactggtttatgtgttttctatgttttctattattttagagtgtactccttctacttattaaaaaaacaaaacaaaacaaaacaaaacaaaaaaaacagctgggtgtggtgcctcatgcctgtaatcccagcactttgggaggccgaggcggggggatcacttgaggtcaagggtttgagaccagtctggccaccatgtgaaacctcatctctgctaaaaatataaaaattagccaggtgtggtggcaggcacctgtaatcccagctacttgggaggctgaggcaggagaattgctggaacctggggccggaggttgcaatgagccaagatagtgccattgaactctagcctgggcagcagagtgagattctgtctcaaaaaaaacccaacaaaacagttaactgtaacagcctgaggcaggtccttcaggagctactgtgggggaaggcattgttatcacaggagttcactgctccatgcacgttactgcccgtgaagaccttccaggaggacacatgtgcagtgaaagtcagtgatactgatgatcctgaccctgggcagcctagactaatgtgtgtgtttctacgttagtttttagcaaaaaaagtttaaaaagtaagaaacaggctggacatggtggctcacaactataattccagtgcttggtgagggctgaggtgagaggactgcttgaagccaggagttggagatcagtctaggaaacatagcaatttgtatgttcacaaatttgtagagataaataaatgaaaataagaataaaattttaaaaacaaaatttttttttaaatatataaaatcttagaaaaaagcttttagaataaggatagaaagaaaatattttttacagctgtacaatgtgtttgttttaagctgttattacgaaagaatcaaaaattttaaaaaatcaagtttataaagtaaaaatatgatagtaagctaagattaatttattatcgaagaagaaggctgttataaattcagtgtagcctaagtgtacagtgtttataaagtctaaagtagtgactgttgtgtcctaggctttcacattcacacgccactcactcactgactcgccctgagccactttcagtcctgtaagctccattcatagcaagtgccctagacaggtgtactgttttttatcttttatactgtatctttactgtgccttttctatgtttagatacacaaatacttaccactgtgttacagctgcctacagtatccaatgcagtaacatgctgtacaggtttatagcctaggagcaataggctaccccataaatcccaggtgtaaagtaggctacagcatctagacttgtataagtacactctatgatgtttgcatgatgaaatcacctaaggacgcatttctcacaatgtgtatctgtcgtgaagcaacacattaactataatgtatacgaattatgtaagtgttcaaaaacgtggtgtctgttaatccagacaacttaaaaatctaaaaagaaactgggaggaggggtagggggagtcatgaggaaggagcaggagcaagtagatggactcagggggtggggaggcacgtgtagttctagcggtgagttcatgggtatttattgtattatttcaaatccacaggtgaatgagatccatgcataaaccaacgatgagagtacatttggaacaaggagtatggttaacccaattctgtgtacctagagtcctaaaatgaaatgaaatattttaagatatttgagtttgtaggccaggtgtggtggctcacacttgtaatcccagcactttgggaggccgaggtgggcaaatcacaaggtcaggagatcaagaccattctggctaacacggtgaaaccccatctctactaaacatacaaaaaaaattagccgggtgtggtggtgggcgcctgtagtcccagctactcgggaggctgaggcaggagaatggcatgaacccgggaggcagggttggcagtgagccgagatcgtgccactgcactctagcctaggcaacagagcgagactccgtctcaaaaataaataaataaataaaaaataaataaaagtccaaggagccagaatggtggctcatggctgtatcacagcacttcgggaggctgaggcgggcagatcacctgaggtcaggagttcaagacccaccctggccaacatggtaaaaccccgtctctactaaaaatacaaaaaattagccgggtatggtggcaggtgcctgtaattccagctacttgggaggctgaggcagaagaatcgcttgaacccaggaggtagatgttgcagtgagccaagattgcaccactgcagtccagcctggacaacagagccagactccgtctcaaaaaaaaaaaaaaaaaaagcccaaggaattggttactgatagaatctggaagtttgtcccctccaaatctcacgttgaaatgtaatccccagtggttgaggtggggcctgtgggggaagtgtttgggtaatgggaacagatccctcatgaatagtgtggtgctgtcctccctatagtgagtgagttctcacaagacctggttgtttaaaaatgtgtggcacctcccccagctcagtctcactctcattcttgccatgtgacacacctgcacctctgtcactttctgccatgactgttcctcaaggccctcaccagaagcacatgctggcaccactcttcctgtatggctcgcagaacctcttctttataaattatccagctccaggtatttctttatagcaatgcaagaactgcctaatacagttaccatatgacaaggcctctttgtagttcaaaaagaaaagccagatattagcaatttcatgtgatttgacctacttgattatttaatttatattttcaataaattcaaaatcatttttaaaataaaaataaagtttatgaatcgtcttttctgcatatgaaaattagccctgaattggctgggcgcagtggctcatgcctgtaatcccagcattttgggaggcagaggcaggcggatcacgaggtcaggaaatcatcccgactaacatggtgaaaccccgtctccactaaaaatacaaaaaattacctgggcgttgtggcacgcgcctgcagtcccagctactcgggaggctgaggaaggagaatggcatgaacccgggaggcagagcttgcagtgagccgagatcgcgccactgcacttcggcctgggcaactgagcaagactgcgtctcgaaaaaaaaaaaaaagaggccgggcgcggtggctcacgcctgtaatcccagcactttgggaggccgaggcaggtggatcccaaggtcaggagatcgaaaccatcctggctaacatggtgaaacaccgtctctactaaaaatacaataaataaataaataaataaattagccggatgtggcagcatgtgcctgtagtcccagctactcgggtggctgaggcaggaggatggcgtcaacctgggaggcggagcttgcagtgagccgagatcgcgccactgcactccagcctgggcgacagagtgagactgtctcaaaaaaaaaaaaaaaagaaagaaagaaagaaagaaaattagccctgagttcaccaaaaccgtcgtatcaacagctggtcgtcttctaccaaacataagagacacaagtactgtttgactggacctaggttaataaaagctttattttggaatctcaatgatctagatctctttaaaaccattaattcgttctctagttactagaaaggatagaagcattggttaaaatcttatctctcacttagcagctggttaaaaccttgtctaggccgggaacagtggctcacgcctgtaatcctagcactttgggagcctgaggcaggcagattgcctgagctcaggagttcgagaccagcctgggcaacacggtgaaacccggtctctgctaaaatacaaacaattagctgggcgtggcagcgtgcgcctgtagtcccagctacttgggagggtgaggcaggagaattgcttgaacccgggaggtggaggttgcagtgagctgagatcgcaccactgcactccagcctgggcaacacagcaagactccatctccaaaaaaaaaagaaagaaaactttgtctgtcacttagcaatgatattcctatcactttaggaatgtcatttaatcttataacctaagttttcttatcttcaaaatggcaataataataatgataatactttgtagagccgttaagtattagtgatgacagctgcagccagtctggagcagggtaggcgcggccagggatacgcgctctgtggaaccagggggagctgggagcaggcaggagcccttcccgcttctgagttggcagggcaggagcccagtgctcccaggcataactgcagcctcccagccacagctgcggacctgggcatccctgcactctcaggggtcccagaggcccccgcttccccacaggcttggaagtgcctgatcccgctgcctggcctcttcctgctccctgtgcccgctctgattctggagcaaaattgaagctgagcctgggcggtgtcgcaacccggccaggtgggtgctgctcaggatggcgctgacacaccagccccctgccacctcagcccccctctagactttaggagccactctggaccacgaggatgggagggaggccgaggaggggctgaggacggctggttgcaggcctgtaggcacccctcagcacaaacagcctgggcaccttggacaacatgactgacagcagaaggcagacaggctcataggtagaaaggggcgggtccctggtgacgccctgccttcaagccaagaccagcccaaaacctggggacctggctgtcagttccaggtgaagcctgtggcccagagtgagaacttagagtgctttttctggcccgcccatggctgcccatggaccaatcagcacgcgcttcctcccttctgagcccatgaaaacctcagacccagccagactcacacagaggctgggactaccagctgcagaaaggagctacccacttcaggtctcctgagagctgttctgccactcagtgaagttcctctctgccttgctcaccctccacatacctcattcttcctggatgcaggacaataactcaggacccaccgaatggcagtactaaaagagctgtaagacaaaccagggctgaaacatgtccccgtactcactacattgcaggcaacaagaaggagagaagaactgtggccctttaagaagccaagatctaggggctccccaagccaaggctgtaaacaccctctttggggctctgcggttcccagcgtctccatgcttccaggtgccaccatgttccccttgtccagacacaggtgcccacagcaaaagcctcattcagtacacctggtccagccacagccttgcatggagccacccaccccccccccccccgaccctgcacttctcacccacacaccccttgccgctctgcacccagcttgcccctggtaggtgtgcaatctgagctggtagaatgagctgagtgcagcctgccaggccaagtgggtggaataagaccagtgggcacaagcaatacttaggcagaaggcaccgctagccacagaggtttctgtctggtgaaacgacaccccaaggatcctgtgacattaggggtaacgtttataaaatacctagcaagggctcaataaatggcttattattatcataagtgtctacagggctaaacgaaacattacaaaccttcaggagagaacgtactgtcttaacacactgcactgctccaggcccatctgcctgatgctctgcccgctccagggcccccatcagaaagtctctcgctatcctatactatctgcacctgcctccccttattttggttcaccctgaattccagtcaattacttcttgtttacttccccatttttcttcttctctcaatacagcatcttacagataatcttcatgaaatgggaatccagtaaacatggctagcatcagcaaaatccccactggatgatctacatagcagggaacaatggcgggtgaggacccacaagtgaggggaaggaagctgcaagggtacactggggtcagacctccaggagcctcagggcatggactgcacctggagggatgacatccaccaaaagcttatgcaacactgtcccaactggatgtgggtccagaatgactaactctggccatcaagaggaatgcccaaagaagggacatgagacagggtattttcacagctcagacaaaagataatgaacatgaggatggaatgaggagcagtggagatgaaggagaggagctaacaatttagggagtgctgttacaactcataacttcacggaagcgaggaggaggtgcgaggaaaagccggctggcgtgttaatttgggattttctctctttgaagcagaagaatacaaacacaactcattttggacatgtggctgaggttgaagtattttcagaatactcaaggaaagacgtttaggacgtaggtggtgatataccccagccactcaggttgatttaggaagcaagaaattgtaggaatggatgagatgacctgagagagagtgctgctcaataaaaatataacgtgagccacaaatacaagccacacacgtggttttaactttcctagcagtgaccaggcgtggtggctaacatctctaatccaagtattttgggaggctgaggaggtaggatccctggagccctgagtttgaggcttcagtgagctataatgaccactgtactccagcctaggtgacacaataagaccctgtctgaaaaataataacaataaatttttctagcagccacattaaaaacataaaaagaaacaggtgaaaataattttactaatatatttaacccaaaatatccaaagagaaagggagccacaaaggctaggaaagagcactcataaaaagacaaatttgaggccgggcgtggtggctcacacctgtaatcccagcactttgggaggccgaggcaggtggatcacttgaggtcaggagttcaagaccagcctagccaacatggcaaaaccctgactctactaaaaatacaaaaattagcctggtgtggtggcacacgcctgtagtcctagctactctggaggctgaggcatgagaatcacttgaacccaggaggcggaggtcccagtgagccgagatcacaccactgcactccagcctgggtgacagagcaagactctgtctcaggaaaaaaaaaaaaaaagcaaatttggttttgactaagacacatcagttccttatgggacacaagtaaacatggtactcactgtttctgaagaggatgatctctgtaaattctcactttgtacccaaatgctctccgtcacaaatgctatgtgttctgcttcaagtataaaaggagacacaagaaatagggcccacttgttcaagtcttcaatggactgtatagagggaaagaaatataatgagattgtcacttcataccacaactgccataaatttcaaccccctctgaaacataccctcccctataattccaagtgacatggaaataagcttatctgatgctcctctgcaggccgcaggaaccgtgtgtttcttgtttagctgtgactgtttaagcacctgcaaaagcccatcgatgactcaggacagctttaatatctctagaccactgttttcaagccatgaattctgaaacggggcctatccccgccattcctcactgcttagcacacagtagctaaccgggaagtacatttaaagatgaggaggctggccggcacagtggctcacgcctgtaatcctagcactttgggaggccaaggtgggcagatcgcttgagcccaggagttcaagaccaccctggccaacatggtgaaaccttatctctacaaaaaacataccaaaaaaatgagttgggcatgggggtgggtgcctgtagtcccagctactcaggaggctgaggtgggaggatcactcgagcctgggagcccgaggttgcagtgagatgagatcatgccactgcactccagccttgggtgacagagtgagaccctatctcaaaaaaaaaaaaaaaaaaaaaagatgaggaggcctagaagtacgtacccaccaacagaagctccttactcacagaagcctgaagggctgttccttcattccctacagccatcacagcacagggcaccaggcagtttttctttacaccttccttatagtgaaatcaaccctgctcctctcccggagatctgggaagtgtgcaagtctctggatgctcacacagcagttaaatccagagagaaaagctatttcagggaaaggcatttaccatatgcagacgcaatcagacatactttaatggaatgtaaactccagtcaggagtgattgtagtttttcaaaaagaagattagaatcaagattggttagcaaatcagaaatacccagttatctctcgttttctttcctgaaatctctctaagaaaaacagcaaattgatttgaaaaggctttcacatacaggatatagccagagaagaaaaagatgaaatctgagcggggtatgcaggaggctttcaccatcacccagaacgaaggtaactaggcaggctccactgtgctgcatatcagttcaaatctgcttgataaaaacctattgaactaaataatgaatgaaaatttaggggagaatttgcccctccctcagtaaacataattatcaatatagtggttaaaaagtatgtccacttaggccgggcgcggtggctcacgcctgtaatcccagcactttgggaggctgaggcacctaaggttgggaattggagaccagcctgaccaacatgaagaaaccctgtctctactaaaaatacaaaattagccgggcatggtggtgcatgcctgtaatcccagctactcgggaggctaaggcaggagaatcatttgaacccgggaggcagaagttgcggggagccgagatcgtgccattgcactctagcctgggcaacaagagcaaaactccatctcaaaaaaaaagtatgtccactttatccaagcatagaatgtgtacattaaacagacaaaaagcttgatactgccaatttgtataaactgtctttggttaaacttatcaattgattgtagggcattcaattataaacacacatattcagtattcatgcatttgattttaagtgtataacatatgagaacacgccaggcttggtggctcacacctgtaatcccagcactttgggaggccaaggtgggcggatcacctgaggtcaggagtttgagaccagcctggccaacactttggtgaaaccctgtctctactaaaaatacaaaaattagccaggcgtggtggctcatgcctgtaatcccagctactcaggacgccaaaggaggagaatcacttgaacctgggaggtggagattgcagtgagcggagatcgcgccactgcactccagcctgggtgacagaatgagatccatctcaacatatgggcatgagattcaggtgtgtccttatttcagcccaagtagactgaggtatccctcaaaagtagacccaagcagactgagatatccaccaaatcatcaacctgatcatattttaaatctcaaaataacagtagccaaccacaaataaatggtcaagctttccacctgtagaccttcaacatcacagcttaaacccaacaactattaaatttactatttcaggtcaagctgctatgctaaacagtctcatttcctaataagaaaaagatacgaactagaataggaactgtgatttaaaggctacagggatgcagagcatggccatcccatctagtctggaaaactaggaaatgacgcagcaatatctaaccaaatctgtaggcaaagcttactgtgcagagtgacagagcagagttacagaatccatgaaagcaccaggccactcctactccggcctgcacaggtaggcaagggctgaaaatcactagttatggttagtgtagttaacagaaggccagcggagtcatgaaaatgttcaaaagtaaaactgtccaagaaaatcagacattcccatctccatgtttttatatgtccaaaatttctattctgacttaaatcctaaatgtaattgatccaatttggaaactactacaaaaagctcacccctcaattttttgccattttattgagttatctttctcaatcaggttaattcccaacgctctaagccatacattgtatgtaatgcatgaacttcttccccttttgtctgggtagtgtcagttatgtggaggtggtactagttatttgcataactagtaccttgggggacctgagaaaacagtcattcatattcagtgtgacataatacatatatggtactaacaagaaagagtattttttatttgctagtggcacaatttcaacccatatctaagcacagcctccaggcaatgttcaaacctgagataagattcaattccccacaggggctttacggtgtgacatatgcagaaaacgtcattttagtgctaaaagtgaggcaatattccagaaaacagaggaaagggacaagaaacagattaaaagcaaaacacgtttaaatattaatgagaacaatgctaccgatgtccatgaaattttgtgcagtactgcactgtgaagctaagcccatttccaaaaacagctgaatggaaagatctattgttccctttacagcaaggcagcagactttttacagagattaattgactggcccaagtcacaaggtaggtgacagagtgggctgaacacgtaaccaccatcctaagcactgggtcaaaaaaaacaaaggctgactgtcaactgaaatttaaaagacgcaaagaccatcagtcgggtgcccaagttggtgaatgatgcaaccaactgacagaagatggagagggaaaagggcagtttttgtaaatttggggacatctgacaaaaagctgatgacacaggtgggagttttttgtttgggatttttttttttttttcttaagacagggtcttgctttgtcacccagactggagtgcaatggctcaatcatagctcactgtagcttcaaactccggggctcaagtgaacctcccgggatcaagtgaccctcccgcctcaccctccagagtagctgggactacaggcgcgtgccaccacgccgacctaagtgttttttttgttttgttttttgtagagaggggtctagctatgttgcccaggctggtctccatctcctgggctcaaagctgtccttcctcctaggcctcccagagtgcagggattacaggcataagccaccgctcccggcccgccacagctgtctctcctggttcacggtcacccaaacgccggctcgaagtgtgggagaggaggttgggggcgaccccaggtgggcactgctggcgtccggctgtcaatccacagctcacgtcctcacaggtgcgcgcctagagtcacgcgtccagcaccgcccggctggccgggaagaggcgaccgggtccgtggtccgagtcccgcacctccggcctctctctgggccccggggcaacagcccctcccgggccgcacaggccgcactgagggcgccactccggggctcccgaactcccgggctcccggcggggacgaggcgcagggacgggggcacttccggctcgcggggcccgggtcgcccgcccgcccgacccgcccacctggctgtcgctgacgcagaagacgcggccgccacggctcaggcacacgcgggcgcccgggggctgcgcggccgcgccgcagaaggtgaaggaacagcgcgaggcacgcagccgccgcaccgtggcgcgcacgagctcagccggccggcgaccccagcgcgcccacaggtacaggtagcacagcgtgatgagcatggccgcgccgccggcagggcgagcccgccttgcccgcccgccccagcgccccaggcccggccccgccccggccggaagggccgcgccgcccccccgggccaggcggcgcgggggtggggacggcgggggaggcggggacccggaaggtgacgcgggcaactggaggctgcggcgggaggggcgggggggggtgaggccgcgcccggctgtgtgatggggagctccggaggccgcgcccagggctggtggcggcggcgaggggcagcgctggggcggggggtgtgcaccggggtcaggggacgccggggctgcacccggagagggggctcgagggagtggaggccggggtgcggggccgcgccagggctgaggagtgggatgggtatgttgtggatgcgggggaggggaggctccagtggctgcccgacctgtttaagccaagtccggcctcccttccttggaggggtgggaggcggattgaggagggggctctgcctatgttcatagctgccaaggccaacctttactaaccagcagcacaccgggagtcccagagcgctccacagccgctacccagtcgacttgggaaaataagataaggccgtttttattaaattatactaagccttcatgcaaaagattttaaggtcaatcacatacattcacgggatgcaataatgtttttttaaataaggacaggaaacagaaattgaagacagataagcaccaagaaggctgcctctaaaaaggctgtgccaggaaggctccctatggtgttcttgctacatgtgggtcaacagtttgactgtaagcatcctaacaccagtgggaaaaggaaaacatcaccatgatttggtgttcttgtctccaagggaagcataattagtcctgacacagaggcttctcccatagaacctcatttctttaaaaggcattatgtaaagaacgtgttctgaacagctgcgaagcacagcaaagaattccatccagtggcttcctattctggccctcgctgaaaataggtggcaagatgcagcaaaagcaatcatgtacaccacgtccatgtcttaatctaaggatagtttttgtttgtttgtttttgagacagtctctctctgtcacccaggctggagtgcagtggtgcaatctcggctcactgcaagctctgcctcctgggttcaagcgattctcctgcctcagcctcccgagtagctgggattacaggtgcccgtcaccatgcctggctaacttttgtatttttagtagagacagggtttcaccacgttggccagggtggtctcgaactcctgacctcaggtgatccacccgcctctgcctcccaaagtgctgggattacaggcgtgaaccaccgcgcccagctaggatagattttttttaagagacaaggtttcgttctgtcgcccaggctggagtgccgtggcataatcacagctctctgcagcttcgaactctgagctgaagtgatcttcctggccaccatgcccagctaattttttagaaattatttttcatagagacagggtctcgctgtgtcgcccaggctggtctcaaactcctggtctcgagcagtcaaactcctgcctggatctcccaaagtgctgggattacaagtttgagccatggcgcctagccataaagatagatttttaaagtaccttggccatttgttcatctgctttaatatagctgcatagaacacccactcccagaacttcagacttttggttagataacatagtatattttcccccttgcatatagcgatagatttttaaaagagagaaaatccaaaaagaaataactgggcttaaaagcaagcatctctgtggaccagaaatagaagaaaaacaaagtgataaacaggactaaagccatatcctacacttctctacaggacagtggcagccggaaagtgggttcctgcatggtaacaagaccttaaaattgtgtcactggagaaggacgtgcagttcccgctgaggagagacttggccactccaggacaacacaggactacaagtcaggaatttgaagatgaaaagtgctcaacagtgataaatcctaaatgtttcactgaacaacctttcagatagccttcttgaagtttgctgaattatggctataaggaccactccccacccctgctaggtatggagaggtcatctcctctatctgaaggtgaccaacatctccagtttttccaaattccctaagggttttgagaccacaccttcccacaggtactctaactccacctggccaataggaattttctaggtttacccttaggtgtttcgagatatggtctcagaatacatcatgggaaaattacattttggggtcaatcctgtataccaattctaggttaaaagcatggggaccaccatggttcaacatgagctgacccttgcattgaagagtactgataccattcatgcctggggaaggaatagagggaggaagatatgaagggcacagtgagaagtgaaacagtcacataacaagctctgtttatgatcccgccctaaaatgatttcattttgcaaaggtcaaggatagagttgagtttcatcacccctatataacaaaggaataggggaaggatgcaaaaataatacaccaagggatattaatgtgtatgcacctgatcctcatcctgtagtccctcactgctcaaagtgtggtccttagagcagcagcagcagcatcacttggaagctcgcaagaaaagcggaatcctaggccccacccaaccccaaatcagcgtctgcattttgacaaaatcccaggagactcacaaacacattaaagttagagaagcactgctaacatcttcctctgtcattccctgggtctgggctactctagactctaataagacatttccaaaatgatgtggaaaataagaccacagactagggatttttttttttttttttagatgaagtctcacttgcccaggttggagtgcagcgcgatctcagctcactgcaacgtccgcctcccaagttcaagtgattctcctgcctcagcctcccgagtagctgggattacaagcacatgccaccacacctggctaatttgtgtatttttagtagagatggggtttcaccatgttggccaggctggtctcaaactcctaacctcaggtgatcgtcccacctcagcctcccaacgtgctgggattacaggcgtgagccaccgcgcccggtcagactagggatttagaagcaagactttgtcatttataagaacactgcagaaaggaacaagaatgacccagctagccactgaagaccacctctgaaacccatcaacatgaccggctttctataggaaaagtctccacagactcaaaaagtctctagtttcttgcccttaggaaggcatgccctgggaataatagtttggggacaagagagagtagagtgtttactgtcctatcccccattaaatacatggcagaacttccccagggaaagcctatcatactgacattaactcagtacctgtttgaacttggagagcattcagaattctcatcagtcaaatggccagagctgagaaggatagcttgttttgtttgtttttgagacagggtcttgctatgtcacccaggctggagggcagtggtgcaatcccgactcactgcagcctcgacctcgtgggctcaagcaatcctccctcctcagtttcccaaagtgttgggattacaggcatgagccaccacacctggctaatttttgtattttttgtagagacaaggttttaccctgttgcccaggctggtttccaactcctgagctcaagccatctgcccaccttagcctcccaaagttgtgggattacaggcacatgccaccacacctggctaatttttatatttttttgtagagacaggattttgccatgttgcccaggcttgtctcgaactcctggattcaagcaatctacccgcctcggcctcccaaagtaccgggattacaagcgtgagccaccgtgcccagcctgggatactttctaagaaccaaggaactatgtagaaaatcttcgccgggcacagtggctcacgcctataatcccagcactttgggaggccaagatgggcagatcacgaggtcaggagatcgagaccatcctggctaacacagtgaaaccccgtctctattaaaaaatacaaaaaagttagccaggcgtggtggcgggcgcctgtaatcccagctactgaggaggctgaggcaggagaatggcgtgaacccaggaggcggagcttgtagtgagccaagattgcgccactgcactccagcctgggcgacagagcaagactccatctcaaaaaaaaaaaaagaaagaaaagaaaatcttgatctctattcagtaactttaatacgtatattaacatgttcttgtttttggaacaatcgtcaaatcaagcaaaaagtaattttattttgttaatcaaaataaagagaaaagtagacaatatttagagcatcaaaagaatttaaattagaacatctttaactattggaaatatgcatttgaactcatgtctttaagaggaaaataattatctttcctagctctttcactgagatggcctcagagtagccttaccccaagatgcacctgagtgctcagattcttgaatgggtgctcttctcctcattacaaggaactagaaatccttggagaaatcactgattctggtgttcaagagataccagataagctggaacatcttatgctaggaagcaggagaagcttcaaagaaaaataggtccaggcagaaggatgcaggagacaagctagaagtgccaaatcaggacgatttgagtatcaaattgaaatacacccaattatgaaggtacccaattttcaagagccggctgggcgcggtggctcacacctgtaatcctaccactctgggagactgaggcgggcagatcacctgaaatcaagagttcaagaccagcctgggcaacatggcgaaaccccatctctactaaaaatacaaaacttagccaggcgcagtggcatacacctgcagtcccacctactcaggaggctgagccaggagaatcacttgaacccaggagacagaggttgcagtgagccgagattgcaccactgcactcaagcctgggtgacagaaaaagactccatctcaaaaaaaaaaaaaaaaatgaagagccatgaaatccatggttatcctcaataaaatttaaatattcgaaaagaatgtaggataaaatgtgttactgctgagtctcgttatttggttatgtttgtattgattcatttgttgtattgataaagattagtaggtggcaaattcttcctttagaaggttgtttgtgacccaagagggcatcaatacaaagaccctaaagctgggattccgaagcacagagtcgcgggagagaaccaaagctcatcgcatctggtttaagactccttcagagttggatcagcctaaaaacaggacatggtacaagattttattcattccaaagattgtaaaaattaaattcatcctgagaatttatcagtctatgtgggagctacagacttctatgagcaagcagaggtaagtaatgttctaacttcaactaaaagaggctaagagatcatcttccttcttttgaatttaatttttttattattattttaaaagacagggtcttgccctaccacccaggctgctcttgaacccctaacctcaagctgtcctcctgcctcagcctcccaaagcattgggattacaggcatgtgtcgtgcctggcctcaccctccttgagatttcagaattgttgacagaatgacaataagtaggattcactgtctccttaaagactgaggaaagaaacccagtgaaacctctgatggacaatggcctcagttaactaggacagtaactgtacagtatccatctcctaatccagtaaaactgagttacatatagaaaggcttgaaagaagcaaagccatagatttatatttctgtattaataaggaatctatgcatatttttggtcttatatatacttgaagtgtgttagagtatgtggctgttttaagtacattcttataactaatttgaaatgggtacttctatattgaaatcttactgagtttatgaatagtattgaaacatctaagggaatattattaggtttgccatattaatatactgaatctgctagattgataagaattacataatcaggccactgaaatgtataaaaaggaaatttaatttaaaaaggacttgggggcagacacagtggctcatgcctgtaatcccaacagtttgggaggccaaagtgggaggatcatttgagtccagaagttcatgaccagcgtgggcaacacagggaaaccccatctctatgaaaaaaaaaacaaaacatttttttaaattagccaagcatggtggtgcatgcctgtggtgacagcttctcgggaggctgaggtaggaggatcacttgagcccagaaggtcaaggcttcagtgagctgtgatcgcaccactggtctccagcctcagcgacagagaaagaccctgtctttttttttttttttttttttttttagcagctctggaatgagaataggtatttgtaacacacataactgataaaggattcatatctagaatatacaaagaactccaaatcaatgaggaaaagtcagaaaaccaaaaaaggaggacagctaaagctgaaaaagcacttcaaaaacagactgtacccagctgtctgataaatatgaaaaagtatgcagtctcaaagtaggtccaaattaagaccttcatgagaattggtatacacccatcggtttggcagaaatccccttctcaagccctggaattctgggctctacccccattgctcaaagatctgaccattttccatttccatcccttccatctttctgcagtacctggcattcctgaccatgctatttctaccaatcaacaaaaactactagatactcagaggggatttaatacagagagctggctacaacatgacaaaacaccagacaagggagggcactgtggctcatgcctgtaatcccggcacttcgggaggccaaggcgggtggatcacctgaggtcaggagtttgagatcagctagccaacatggtgaaaccccgtctctactaaaaatacaaaaaattagccgggcatggtggcaggcacctgtaatcccagctacttgggaggctgaggcaggagaatcgcttgaacctgggaggcggaggttgcagtgagccaagatcatgcccttgcactccagcctgggcaacaagagtgaaactccgtctgaaataaataaataaataaacaaacggacacacaccacagaagggacagtgaggcaacccagggaatagaaagagcagaagccgcgaccctctgtagggctgagggcacacaacacaggtcaagttaccgtcgcccgggatccagggtcccctggtggaagctggaacccacagatcagtgctgtgggagatggagccacagagaaacaactgctgctggagacatcagcaggggaagaaggcggaaaaatactgtagccgctccacacctccagcccaacgccccatggcggaacttcactagaggccccacggcagaagagcctccaggaacctccttgtggaccagaggagagagatagagaggcggcaggaggcaagggtgtgtctaagacaaacaggccacagccagcccctggccttcctgaaactcctcccttgggttcttttaaaattcaatattctgcttctgttccagggttaatgggctgaactgtgtccccccaaattctaatgttgaagttctaacccccagtacctcagaatgggactgcatcaggagacaggtactttaaaatagtcattaaggtaaaatgaggtcaccacctaatctgttatgactggtatccttataaggataaaatagtcattaaggtgaaatgaggtcatcacctaatctgttatgactggtatccttataaggagaggagactagacacagacatgcacagggggacaatcctgtaaggacaaagggagaagacagccatctccaagccaaggagagaggcctcaggagaaaccaaccccgcccacaccttcatcttggacttctagcttccagaactggggaaatgaatttctgttgttgaagccccagtctgcaatacttagttatagcagcccttgcgaaccagcacatccaagttctccgtctctgtctctaacccctctctcaactgtcggccataagtgagcctctgcccccaacttctggcctcctctatgttctcttccttggtgacctctggcagtgacgctcagtcctcatggccagctctggcctctcccaggctctggcgccgcaatcatctcttccacttgtctctgcttggatagtctgtcagcatctcaaaggcaacatgaataaaaccaaatgcattttttcctcccacaaattatctctttatcctgatttctcttatctctgttcatgacttgttcaccttttcactaggacccagaattcatgcatcttggagtcccaacttctccagcccctgtgtcttgtttatttccatagcagttggtaggcgggacctctgcacagtctcacatggtcccttctttctagtccaggcccagctcagccctcaccagaacaggcactagcacgacagcctgctggatgattcccggtgcccgtcccctgtttcccacggttctgcctcatccagcacactctgcacttgactgcctaaagcacagcgctcatcccatcactcctgcttctcaaactcctgcagtgcctgcccccaccccagaaagtgcaggcagtcttgcctggcattcaagaccttccactgagcctaagcaacatagtgagaccccatctctacaaaaaatttaaaaattagccaggcatggtggcacgtgcctatagccccagctacttgggaggctgaggcgggagaactgctggagcccgggagttccaggatgtagtgatccatgttcataccactgcactccagcctgggcaacagaagagaccccatctctaaaaagaaaagaaaaagaccttccattggacccacctaaccgggtctccctcattggcagccattcacttattccacgttcattctgcacctcctgcacacgaggtgctatgccaattactggatacatttaatccctcaacaactctgcatggtgaccattattgtccccatcttgcaaaggaagaaactgaattttagaacagttgaattttagaacttgagctcccataattaggtggggaaactgatgtttgaatttgtgtccttttggccccaaagtccttctctggataaactaggcaaccaagagcaaagaatgctctatacccgacaaaaatagaaatgaaactcaagatccaagacgcaagagtggcagaaggttcaaggtgcaccactgccagccctgacagcctttgtatccaggtcagttgaacaggccgggattgtccccaacttggacacatctaaaaagctgcaggtgggatgtcatcaaaatcacctgggaaaacaacctgctctgaaaacagaggcatgatccaaaagacaaagaggtttgtgataccctttctgtacaatagctgactatcagtaagtcattactgttttaaggaagtcagtcacacacacacacacacgcatacacacacagaaaaatacaagttagctgggcgtggtggtgtgcacctgcaatcccagctactcgggaggctgaggcagcagaatcatttgaacccgggaggcagaggttgcagtgatccaagattgcatcactacactccagcctgggcaacagagccagactgtctcaaaaaataaataacaataataataataatgttgcaccaatgtcagttttggtaaatccatggttgtgtaagatgttagcattagaggaagctgggtgaagtttcaaagaactctctgtactatttctcttttgtaagcctaaaattatttcaaaataataggtgataaaaattagaaggtgacattccactgaatttcatcagcactccttttttcccctcttccgaaccagccatgtgatcttaagcaaattatctcatctctctaggtcacagtttttcaacttaggaaaaaaaaagagggacacaagccagatcatctctaacttcccctccatctctcaaattctgtggtcctcgtacatttacaatatgatgcaatctacaaacatttgatattggtgctctcttattcaccttcatatccctggtatttagcattgtgcctatacatagtaggtgctcactgaaagtttttgcaactacctcaaaaactgaggttcatacctcagtttgtaaagtgacgtagaactgctagctcttttacctagttgaccactagagagcgaagcggtcacaaattttttctctgttaaaagcaaatttatcttcgtccagcagaggggagtggtcctttatatttcaggcatgtaaaaatcaggtcctggttgggcgaagggagaaatctgtgagcagtttcctgcctatcagacaggccctccagaggggtgatcagtaccataagcttccaggtaagcacatggggccactgcccccaccctccaaaacaccctcaaaagtctaaaccacctcaatggatgggagattgctctgcaaatgggggagccccactcctaatatgttcatcattgtcttcctaacaatcgtgactcatttcttgaacaaatgtttcacttttaaagggtttgcacagaggcagctttaagaggtcaaataaatgaatgtggaaagaaattaaaacttttacaaccacatgaaaaaggcattagccagtcatcctgcccagcagcccaatattgagcctgtgtgagttgccgtttgtgtagtgaagcaatagaggccatggtctggaatcagaaaccctgggttcagatactgcctctgaccccccaactccccaacaaaatgcacacattcagtggccatgtgaccagggcaaatgcctctcgttccacagctccaatgcaggaataataatagcatccacctggtgtgggtgggcgggttcacagagaacagccacacaggctaagagtgcagactattgtgacccagcaactgcccacctgggcagagtgaacaggaagggaatagaagggcaacgcgctttcacttcatcctcatgagcgctcttcgtggggaaactattacacaaagtcggggtggggagttccttcccagtaaatcgagttgcctttttcaggcacggaaaagcccatctgcctgaattttcctcaactggtcaatcatggtgccagaaatcccaaccacttgaagtgctccttcaggttaagttactttatctgccaactgtgttagtttaaacaagtcagtttccaagtcctacgctgctgcttttatcatcccattaatttataaaactaagaataggggccaaacgcggtggttcatgcctgtaatcccagcactttgggagatcaaggcgggtggatcacctgaggtcaggagttcgagaccagcctggccaacatggtgaaaccccatctctactaaaaatacaaaaaattagccaggcatggtggtgcaacgtagtcccagctgctcaggaggctgaggcaagagaatcacttgaatccaggaaacagaggttgcagtgagccaagattgtgccactgcactccagcctgggcgacagagcaagactcccacctcaaacaaaaaaaaaaaaagaaaattaagaataggaccccacagtgtgggaaggaggctggaagcgtcctgattaaactgcagcctgaggactgctgggtgggatcctgtagagcacactgagccctgagaagggggcaagaagagccccagggtgcaaggccagagactagctggggcagagaagagtgcgaagctggcaggactgaagggtcgggagacccttaaagagaccctgtagcagacgccttgggaatgtacgtgtcaccgagcaaagcacatgaagagaactgttcaacagcggactcagctgggaactccagacactgcggcaaaaccagcacagatgcatcctctcctgtggctaaaagctccatgaggggccagtgagtcacatgacaaccgaatttctcctctgccaatctgaacatattctgggactgagacttccgtactcagggaaaaccaatcacactgcttaaaagaaaaaaaaattggccaggtgcggtggctcacgcctgtaatcccagcactttgggaggctgaggcgggcagatcatgaggtcaggagattgagaccatcctggctaacacagtgaaaccccgtctctactaaaaattcaaaaaaaaattagccgggcatgatggcgggcgcctgtagtcccagctactggggaggctgaggcaggagaatagcatgaacccaggaggcggagcttgcagtgagccaagatcgcgccactgccctccaggcctgggtgacagagcaagactcagtctcaaaaaaaaaaaaaaaagaaagaaagaaaaaaactacctattataaacccttgatgctataaatttaatggagctggaaataaattccctggaaagactatggtgggagaaggggggcattaccttcatccgtttacattctccagccatgggaactagctcctttgttttcactgaatttatgtttctatagaggcacccaggattgagtctcctataggggggtcccatgaagctgccatgcccctctgttgatacaccttgctttgcaggtcaatttgtgatttttaaaatggttttatgcaaacgacatgtttagcccaaatgcactgcaggtagctggtgataaaacagcaatacggaccaggcacagtggctcacacctataatgccagcactttgagaggccaaagcagaaggatcacttcaggccaggagtttgagaccggtctttgcaacatagggagactccatctgtacagaaaattaaaaattagccaggcggccaggtgtggtggctcacgcctgtaatcctaacactttgggaggcaaaagcgggcaaatcacttgaactcaagttcaagaccagcctgggcaacatggtgaaaccacatctctacaaaagtaaagaaaattagccaggcatggtgctgtgtgcctgtagttccagctactcctggggaggtcgaggctgcagtgagccgcaatcacgccacttgtactccagcctgggcgacagagcaagtccccatctcaaaaaaaaaaaaaaaaaaaaaaaaaaaaggctgggtgtggtggtcccagatactcagaggctgaaaagggaggattgcttgagcccaggagttcaaggctgcagtgagctgcgatcacatcaatgcactccatccagcctgagcaatggagtgagaccctgactatatttaaaaaaaaaaaaaataggaagaaacaactcaaccacagggctagtatgttactcggttataaaatgataaagccctaaacagagaattagcccgtttccagaagaggccaagaacagatgatacagctgaactgaactcctgcctgtacagctcgttttctacaagattccagacctggaagatgatggcatccagcccccattgaagcacctcgaacaagaaaaacgccgagtccgaagagccaggccttgaacacacgattcctgtctataaataactccccctggggaataaaaagcaggatccaaggcaggaaacccgagccgtggaatctggtaagttcttaggaaacccactcacgggcctgagtcccccgtggaagcggcgacttcggcacctggacacccgagtccccagagccccgggcggccgcgcgtccctacctgcaggcctgataccggccgcggagcgctcctggccccgctcccgccaggctccgggaccgctgaaacgcacccaggggggtgaaggcgtagtcgccaaggacagcgcagatggcagcggaggcatgggagccggaacctaccgtggcaaagggccaggtcgggacgcccctcggcgcagccccaaatcctgcccgcgccccagccccgctcaggccgcgcccctgccacctctggccacacgggctgagacgtctggctcctgcacagcgcacttcccgctgcccttctccactggctgctcaggccctgcctcgccagcac

SEQ ID NO: 680 - DNA, 239357 bp, Homo sapiens
tgttgttacattaaatttatttctcacctccattaaaagggtttttgctttggagttttgttaactttcgttctttggagtaataatatttctcttgtgtatggcgctgaatacatttgtcaataatacgtcaaaaaaaaaaacacttggcttcttaatacttggaaatacgtacatattccttactatgtaaaacactttatttattttgtaaaaatgtttaaatatgaataaaaatactgtaacccaaagtagttgcctacttttaaaaatgaaacttgtaaaaataagagggagcccaaaccacatagaaagtcttagtttattttggtagacttgctttttataggcattggtttaaagtgattcttttcagagacatcctttgagaagttaaaattgcagaggcttacgctttcttttatttcaaatatgcatagtgattaaccaggaataaggattctcccatgttctgcctgttaagagcaaacagatctggagaacggaagcccaccctgcctcccttttccatctgaagcagtgcggggaggctggctcctctctttgttcccagactccagggcaaggggcgaccatgctgtatatgctgtgccttgggggacccccagaggctgcgctctgtggcctgtgctcccccgacctgtgcacccgcaccccagtcggccacttgctctcacatcaggcaacgtcagcctgctgcagtgaaactcaaccacgattttcctttgcacacaaatccttcctacttccaccactccctagcagagttcccagtgccagagagcactgctggggtgggggtggggacaggaagcccagttattgctgtgttctattttagggggcacttcctcaagagtccccttgaaacccgttaccagcctggaagggaggatatcttgccttttacaaaatacggtcgatactcaatgcacagcctctaaaacaagggctactccagtgttctaaaagcacacgccaatcctgagtttagtgaccacattttaaagatcatcaggaaaatgccaagttcccattaagactttaaagctccttgagatcccaggttgcggggtgcataaatggcccaaatcggagagtgtgctatagcaggtagacaggtttcgctaacacgaacagctatcagtaaaatgcctttattcagctaattctatagaagcggagttttgagagtctttggttcatgtgaggcaaaatcaggtttatggaaaacgcagcatctgcttcaaggctgcttcatctctctcaggacaactgagtctcctgcgtgagggaggagcgcctgctggaaagcacagagcacagcagtatgcccggaacatctccatagcctttgacaaggccacacttcattagttttaatttgcagaaaggaaattaaatgataacattttttcccaaagcagagtgtccagaataggacttcagcttaaaacaaaacatagcatgtttttcattaaataacccccaaagaaattcaaaaagtgatgatggcagctctgagagagggcttgccttatattacaaagtctgagaaatgaaacctacatcgttagcctcgagatctttgtccctgatgatattctgcagatgccctctcaagggtaagtccattttgtaatttggggatggtgtggacttgtattttacttaagtttctaactaattttgaaagaaggcttgggcatttggagaagagtggttttttttgtgttttttgtttgtttgttttttgagaaaaataattctaattgaagcctcatttccaaaaattactttttaagttcttttaatgtttcatttccaaaaaatatatattgggtattttttcatagggctgtcctgtgcctggctaaaggtagacagactatactaaaaaccacaagtttctggaattagcctgactgggtaagacctggataaagatggtgctagtttacaatgaagggattttgttcaaagctgaaagctccatcaaactttctttccactaatttcagctgggactggaagagagaaaactggacaaaaattggccttttaaaaagctgaaaagtaatgagtatgattcataagttcaacagagataggagggacatggaaaaggcatggcgtacatctgggaatagcgaatgcatatcaaaaggcttcatttcttttgttctttcatgaggcttgtagcacatcaaattttgaatgtcttcttttaaagctatgtgcgcacacacgcacgcacacacatatgcgggcacacacacacatcctccctctgaactgatggtgtttagtatcgataacattttctttcttggtaatacgaggtaaatgaggggggcaaaaacttatgacttctgagtaaaatgccatgtcttctatattccgtgagctgcacagtcttgcaggaatgctccacatttcagagtaaatctgaaactggcttaaaagctccaaatcctcccttgtatgtggtatgagtgtgccttcatctccagctgtcagagccaaatcgcccacctcctcatccaagtgatgcctaatcagacatttaaggattctgaacttgatcctgtctcttcacaatatgtagtaaatttaaacttacttaagaaagtcagtccctaactaaggacatttaaacttccttaggaaaggagagctcactgaatgatgtcaaagtaatgaactgatttcctctacaaggtcactgcaaccacaccagctagctctatctctacaggcatttagacttcgctatggggccacaccaccgggtggacagtaactcttggaagtctgtcttcccttttcttcattaataaaaacacagaacaatgactaagtgtccaagcatgttcttacagttcagtacctccccagatgcttacaaacagtgatagcatacctctaactcaccactggcctgggcgcaagagcatattttggtttgttttttcatagactaggggtaaaggtctgcactactaagaaaatatctgaattttcccattgtcatttccatgtaaaaactccccttgacaataaacgtaagtccaagccacagaggggagagcaatttcccacctgtgggagggctttccctaaactaaattttctacttcttaaccatctatcccagagcctcttcaaacaccaaagaaaacgacaacaaaacaaacctaaaaacaaacagaaacacagaaaaagaacaaagacttaacaaatgaattggaggaaaagaaaattcacctacaactctaaattagatttccagatgcatgggcacggacaggcagccgcgtctcggggacgcccggcattaccgccgtttggggaggatgaggtttctcagcatgtcgaaggagttgccgtccgggtgcacagtcacaacctcgccgccctcctggtgaacctggaggaagccagaatcgtccaggccaacgatggacacctttggtccctctgcgctgcccagatggacttgctgaccactgaaaaggaagaacagcgtgcggtcactgggaggtgtcacaggacgacttaagacaatgagctgaagaataatccatgatgagagagctgggcgtgctggggagagggctgaggctcgctgcagggaaaaggcagcctgggctgagctctgactttcttccaccctggtgaatggttttaagaactgctcaaataaccagcaggatgcaagttcaacaaggagtcgaaatttcttcacacaacgtcactcctcctaattctggtcatctgcggtgatggctggaaccacttcctcacctcccagcgcttttaagaaacactgtgcaactctaggttttttggctgagattggaggaaaataggccgagttggcaaacaatgttttatcttataaaacaaagttggctcatatcagccacaagtgaaactcatcctgatcctacttcttttgaatattttccaaatgtactcaagtcacgtccttcttaacagctttcgaagtatagaattttctcaagtttttattttgaagaattttaaatctaaagaaaagctgaaagaatagtgcaacaaacctcatattctcttccattctcacaccaaatgaaaatattttctgtatttgctttctttcttcacacataaacacacacaagcacacatttttttttcctgcaacatataaagataagttgcagctgggtgtggtagctcatgtttgtaaccttagcactttgggaggccaaggtgggaggattgcttgaggccaggagttcaagaccagcctgggcaatatagtgagaccctgcctctacaaaaaaatttttttttaaattagcgggccgtgtggcacactcctattgtctcagctacttgggaggctgaggcaggaggatcatttgagcccgggagttcaaggtttcagtagtgagctatgatggcaccactgcactccagtgacagagcaagaccctctctaaaaaaaaaaaaagtgaaaataaaaaaagttttttaaaagctgcaggcattgtgacactttctgcttaaatactttatctcctgagaacaagaacctcccataaaattataatagcattaactatgaccactcaagaaagtctggatacaaacggtccatgttcacgtcattcccactgtccttttaatatcctttgtggctatttccctccatccaggatcacacacattacatttagatgtcatgcctctttcgtcttctctaatcccaaacaattctgccaccttcttttggtctaattgtttgtgcgcagacctgacatttttgcagggcacaggcctgttgttgtggaatcagtgagcggtcctcggacttcagctgcatgagaatccctggagtatctgttatgacacagggtgctgggcccagcccaggggtttctgatgcagtagcccctggttgaggctgaggctgcttcctgggatctcactttgagaaccactgttacctggaaggtttgacaatttagatgcgtctattgtttcctcacaattagaatcagattaaaccaatgttaaactctctcactatttcggttcttcccatcgcatcccaccaggaggcataagatgcccgtttgctccattacttgtgatgctaacttggtcaaggtggtgtccctgcagtttctctaacagagacacagaaaataatcattcagaccagtgctcggtccctcattttaagatactgaactacggccgggcgcggtggctcacacctgtaatcccagcactttgggaggccaaggcgggcagatcacaaggtcaggagatcgagaccatcctggctaacacggtgaaaccccacctccactaaaaatacaaaaaattagccgggtgtggcggcgggcacctgtagtcccagctactcaggtgactgagacgagagactgaggcaggagaatggcgtgaacccgggaggcggagcttgcagtgagccaagatcgtgccactgcactccagcctgggcgacagagtgagactccgtctcaaaaaaaaaaaaaaaaaaaaaaaaaaaagatacagaactactaagatactaataaaggagttgaaaagaatgaagatgagccagcactgacctgtggacccagtatcggtaataaaggggaaggacgctgttgggccctttgtcctgaaactctttgatcagtttctccagcacagtcacgactctggcgatgagataatcggctcttaagggcttcagttctgccttgtgttgtttattgtattctgtgatgaggtcgttgatgcagatggtagggttactgttagtcacattaaatccacagcctggacaaaaacaaacaattgagcagctcagcctgttgatggcatcacacattcctctctgccacatggaaaaagttacagtcttgactgtcaacttcctccttccttgtcctcatttcagatttcgtgtctctaaccacttgaagagtgacatgtatttctgtccatcttcctttttgtccttcttttattattcttgttcaagctaaaaccatctcaaccttactgcaaataaaaaggtgggaaaaaagaaagccacatttgattcaatttaattcaatagaagctattaaatatgggacaaaacgtatcagtgttgcctctgaaataagtggtctaccaagcattgtagctctgcactgagtccaggagagaataaaatctctggtttcttctcctgcttgaataacagatcccacgcttgaaaatagagttttattcaggacttgggaagtaaactctggactcagagatttcaaaccttggtcatggcataaccctagaaatgcatcttttaatactttattcttggaagtctttggtgctaaggttacgctgttggcaagacgccgactcatgttcagtggctttttgcagggtcctaaaccaaggcttcatgagagttaccagggatggtgtctgaataggcttatctgtgcagttacttaacaccactatcctctccaggcagagggcggtgtcttcagaaaagctggacttcagtgttcagcagggccctgaatcggcctgcgagaggtcttcagtaagaaatgaaatactgcaaaaactaagcagtaagaaaactaccatgttttcagtgactttaagaaaaaaaatccccaaaacattcgccacaggcagaacaatgccatttgtaacaacagccttcccggcaagtgtcctgccgtttccagtgtgaagggaaggattgactggtctcagattttaaaacaatatactggctattaaaatacaaagcaattgtcaattacctctggaaaaaaaacaagtaactacagcaacaggggcaggacttgcagttgctcacgtattcattcattcaatacatacaggatctgaagcacctactgaacgttcgtaaggcattaaatcaagtgctgtacagcactgaaaattctcccgtgttcagaaaactggaattcctaggaggagtagcaacactcactactggccacttaggctatgtccttctaaggaccggtgagcaccctgctggctgctctgaatccccaaagtcagagaccccatcctatggccttcagaattcaataaaagctatgggttctcaccataggaaaatgtttcattcccctactttattttttatttttatttatttattttttggagacggggtctcactccagttgcccagactggagtgcagtggagccctcatagcgcactgcagcctcaacctcctgagctcaggtgattttcccatctcagcctcctgagtagctaggactacaggcaggcaccaccacgcccagctaattttttgtatttttagtggagacagggtttcgccatgtcactcaggctggtctcgatctcctggactcaagcaatccacccacctcaggctcctgaagtgctgggattacaggcattgagccaccacacctggcctattttttatgttttatttttgaaacagggtctcactctgtcatccagaatggagtggagtggctcgatcaaagctcactgtagccttgaactcctgggctcaagtgatctacctgcctcagtctcgcaagtagctgggattatgagctcaagccactacgcctggccttcgcttaccccacgctgataacatttgttagctccctgaagccatccatgagcctgcttgtggcccctacctaggaatctctgcatcaactgcaattactcacttaaagataggaaatgggggagactgggcaagtggctcacgtctgtaatgccagcactctgggaggccgaggcgggcggatcatgagttcaggagtttgataccagcctggccaacatagtgaaaccctgtgtctactaaaaatacaaaaaaattagctgggtgtggtggcgggcacctgttctcccagctacttgggaggctgaggcaaggagaatcacttgaacctgggaggcggaggctgcagtgagccgagattgcaccactgcattccagcccgggcaacagtgctggactccatttcaaaaaaaaaaaaagataggaaatggagctttaagggtatgaagtagcttgcctagaataatattgccccttggtggcagagctggtaacacaggccttgtattccctggctggcacttgaaacacatggttacatgttttttgaccattgctggtttctgaacacagattaggttctactgccacagagtgaggctgatgactggacggccaggaacctaaggacttctgagattgcctctgaatccatcttcttgcctgatttggatgtgctaaggtgaaacagggattctttaccccgccttgaccagcatggagcttcttctgaaggttaaaatgatgccagctctttcatggcccaggaaggtcacgataagaatgcaagacaccaggagaactatttaggaaattaacttttctttttcttattacagaatagaacgttaaatgtttattttcaccatttcaaattcaatgagtagcaggagtgtggaaggatgtaggaacatacctgtttgatgtgataccactttggtggttcccgtggtcacacacagaaaatgctaaaccctgtgaagtgctttcgaccaatctctctgcatctataccctgctccaaaactacaagactcaaagtaacctcatatgataatctgctcctgccaatgtaggcatgcataaaccgtctttatttttattgttttattaatctaaaaatgctgggggaaaggtttttgaaacttaccaataagtatataaaatgtttctcccatgagtgttgagttaaccagaactccgccgatcttcatgaggtcactgtaataaatatcgttgggccacttcactcgtaagttgatatcctaaagggaaatctgcacattaattaagccgtcacaggacacaaggggcccaggcaagtcactgagctaagggaagataagcagaaaccaaggtaacatgggcctcgtcctctcctctttttcaggcagctaatcacttctttgggacaatccgatattgaagtgcctcttggggccaggaggtaaaagccctgaagaacacagttgacataaaccccagcattcttccccatcccccagcactgtttctcatcatccaaaaccctttctgaagatgcttaccttgtaaatgaagttcattatgtcagtatccaccaccaccaccaccatggagtagctaactaacgtgctagggccagagggtggggagagaatagtaatctcagggggcgtctcccttcaggaacccatgcttgagagacaaagatggccctgaattaaccaaggtcacaaaaggcaggtagaaatgtcttgagtagcaggcagtggccaggcgcgctggctcacacctgtaatcccagcactttgggaggctgaggcgggcggatcacaaggtcaggagttcgagaccagtctggccaacatagtgaaaccccatctctgctaaaaatacaaaaaattagctgggtgtggtggtgtgcatctgtaatcccagctacttgagaggctgaggcaggagaattgtgcgaacccgggaggcggaggttgcagcgagccgagatcgtgccactgcactccagcccaggtgacagggcgagactctgtctcaaaaaaaaaaaaaaaagaatgctgtgaagatgcagaggagaaattcaccttagcgaaagcctcgcagaactgctaatggtcatcttgggtaatggaactggacttgtcatgtggcctattgcctctgcgtcttgaatggtgtggcctgggggtgggggggctctccctgtcatcagcttacagaatggaccaacactggacagtgtctcgaacaaggccacccaggcctctgcctatccactgtgactctgaagttgggacacagagacggggctagccgagtgggtgtcagaaccaccaggtcttttagacctcgggctggcagccaggctgtgccatgtgtgggtaaaggaagcctgtctggagatgcaaggctggaagagaacattcagcaaaataaagctaagggagcagagagtagctgatggcctccaagggccacggggctggtcttcccacgttgcaggccgggcatggcaccaagcaccttctcagcattagtctacgtgttactcacacccagcctatgtgttggtgctagcgcatccccagggaacagagggagaaacggaagcttagagaaattatgtggcttgcctgaggttatagcacttgaaagccacggagctaaaattcaaacctttctgccaccaggcctgggtgaggaatcctatgctacgcggcctgttgcttccatgaaatcccttcctccttccaacaggccttcttttgacttcggcccgttagagcatattggaagctcatctgccctaaaacagtagtttaggctgagagaaaaaatacaggaataggagcacaggagaacaaaaagtctaagtaaaccaagcatggggggtgcgcaatgacccagaactgatcaacagcttcacgtttcttttctctctagaacgggggttctcagtgggagaggggtggatttggcgatactgggagacttccctggttgtcacagcctgagggagtgctaccggcgtctagagagtagaggccgcaatgctgacacacatcctttaaggcacaggacatccccacgacaaacatgccagggcccacatatcaatagcactgggctgagaaagtctcctctaggaaacctgtgtctaggaggctctgctcttcatcactgcccccagttccctttccttcccctctctcgccttcccacatccccctgtgcccaccacatggccaggggaatgagcccctgcctcgccggcgggaggacacctgcagagttcccagagctgtcaagctcctccgccacgtgcgtggcagctggtgcctgggcgggccctgcacttgggctccagctcgccttcatggcttcagatctcctcggctcatgaagcagctcatgaaactctgggttctcacgcaggtaaacaggaccagcatttccacatgaagaggaggactgtgtgctcatttttcattttctcaatcatttattccaacagctgctgtgatcctcccacataaaaaaagaccaaaatgaaacaaatcctgcttttgaagagctgctaacatcatgggagacggaacaggtgcacacatcactcctcttcaaagccacacgtggtggataccctaaaagaggcttcaacatggcaagtgctggacagtgctggaggaaagagctggaagtagctggagggtctgagaatggcactggagctgggccttaaggatgaacagaattttaagaagcagagaagagagcaggggtaggggtgtgtgggtggagggagggtgcggggcccggggggacttcatggacagaagaaagagcaggagtgagaatgggcggcccaaggcgagttccggaaggaatgcctgcatcccagcgaggccgccttgggtctggggagggtggtcatgatttgtgtgctgacggtgacatctggttagggaccagttggggtcctagtgaaggccacacaaaaagtgaaatccaaacaacaggggcctatttcaatcaaagtagctgcactgtgtcagctaacttgactatgttaaaaaagaaacccaattcaaaatcaaatgtcccatcacacaggtgaggctgggtagctgactgcagaagagggaaagaacattggtacaagcttcttaaggagaacgggaacacaaattcccccgaccccgttcaccgctgaaggcaagcttcccacttccatcctggcctccagcgcctggcgcacgcagcctctgagcacagcaggccctcaaagaatgctcgctaagggaactagtggggctccaaggtcaaagtcagagccatgaaaaagctaaacagaccaaacagactcatttaatgttctcggcttagtgtttgttttagttattttcctaagactaacttgttgctagagttaatttctcccatgacaggactttctttcttcctttttttgatacgagtctcactctgtcgtccaggctggagtgcaatggcacaatctcggctcaccgcaacctctgcctcccgagttcaagcgattcttgtgcctcagcctcccgagtagctgagattacaggcacccatcaccatgtctggctactttttgtgtttttagtagagatggggtttcaccatgttggccaggctggtctcaaactcctgccctcctcaacctcccaaagtgctgggattacaggcatgagccaccgcgcctggccaggactttctattttgattgcttcctgctagacagaatgcacagctcaggtgctcaaggccgggcacctgaagccctgtaatggtgtgatgcccccaaaccatcagatatgcaaggatgctgggtgcctggtagtaagcgtccgtttcagcgatgtgatgtaatacaggaaacagagacgtcagcattaactacatctgtggaataccaaaaattcatacacagcaaatacatcacagagggatttaaggggcagtgagaaggaccttttcttcaatgaaatgatgacaggacctccaagtctcctttgagagtcacgctcttaacatcttgcttcaggaatcaatccaatcatttctctttagcctgacataggagctgctgggggagggaggcaggaatctcctatttatacccatatgaaattcttccaggaacatttgggagggggctatgggaagtgaagcccaagtagggaagaaaatgcttcggtcactgagctaattgttccctgttgcttgtctttttaataactgacaacaaaacatccaacagtaataaggaagcaggcacacgggtcctaatagctgggggaagatggccccaagtggatctgcacattgtatgtggtcaacagtggataaaggatagttctgttagagcacagagtctggtaaacagaagtaggaaatgagaaaggtttttaggtccccaaataacccttttcaacagaaaatgcagatgaacaacttcaatccagtccaacaatcaaatctcatccagtgcttcaaacaaaaaacaaacatgcagctgggcgtggtggctcacgcctgtaatcccaacactttgggaggctgaggcgggcggatcacaaggtcaagagattgagaccatcctggccaacatggtgaaactccatctctactaacaacacaaaaactagctgtgtgtgatggtgcacacctgtagtcccagctactcaggaggctgaggcaggggaattgcttgaaccctggaggcggagattgcagtgagccgagatggcgccactgcactccagcttggtgacaaagtgagactctgtctcaaaaaaataaatacataagtaaacatgaccaggtgcagtggctcatgcctataatcccagaactttgggaagctgaagcaggcagactgcttgagctcaggacttcaagaccagcctgggccacatggtgaaaccccatctctactaaaaatacaacaaaagagccaggggtggtggtgtgtacctatggtcccagctactcgggaggctgaggtgtgaggattgcttaagactggaaggtggaggttgcagtgagccgagatagtgccactgcactccagcgtgggtgacagagtgagaccctgtctcaattaaaataaataaataaacaacaacaaaaaccaaaaactaaagcgttgccctcatcaggctgtttgagaaatctgaaaaactgggtagaaagggagttctggggaatgaatgcattcaggcaagcctgaagcagcattagcacctggtggtgctctgaaaactccgagagcactttgctgccagctgtgcaaagggtaggctgaggttctacagccaccaattatgcaagcacatgctataaacaagaataagccagattctgcatgcatcccagggacatagaaggagactgaactgtacctacctgatactcgggaatggacctcactgcttccacgacagccacggacatcagatgctggacaaacgggatcctctgtcccagctgggatctcagtggaatggagatgagcagagtagaaagagcacatcccacagggctcagccacacattccctccccgtcctggaacacaggccacagtgggaaacatgctaccttgccacgtggacagacgcagacacacgtcatgccagggccacacactcaaataaatctgaacttattacaatgcttattgtattacaacgcttattatattctgggcttaataaaagaaaagctttttaaaatctgaagctctgttgctgaaaaagtttccaataattagcataatgttctgcttctgtgagcatatcatttgtgccttgatgactcagagtcttacagcgtctgaacatgactatatgactataggtttaattcccagcatatggtcatgaaggcaaacacagacattgggaaactgaactgaatctatactgatccatgagaggtcctggaagccactgtttagaagcaattcctattgtggcgatggttgctcagcccagcaaatatgccattaaataagagccacagaactgtgtactttatttatttttattattattttttaagatggagtctcactatgccacccaggttggagtgcagtgcgtgtgatctcagctcactgcaacctctgcctcctgggttcaagtgattctcctgcctcagcctcccaagtaactgggattaaggtgcccgccaccattcccaggtaagttttgtatttttagtagagacagggtttcaccatgttggtcaggctggtcttgaactcctgacttcaagttatctgcccgcctcggcctcccaaagtgttgggattacaggcatgagccaccacgcccagccacactttaaatggaggaattatatttcaataaagctgtttaaaaagggattcctgatattaactgagttgttatttttctttacttcctttctttcttcctttttatttttgagacagggtcttgctctgttgcctaggctggaatgcagtggcgtgattacagctcactgggctcaagtgatgctcccacctcaggctcccaagtagttgggactacaggtgagtaccaccatgcccggctgatttttgtattttttttaagagatgggtcttgctaagttgtcccagctggtcttgaactcctgggctcaagtgatcttctgccttggcctctcaaagtggtgggattataggcatgagccactatgcctggcctacttttcttaaaattgaagttagaaaaatagaagaatccaaatgagaggtagagttcatcaaagttcttcttgaatgtctttttcaaaaaacaaaaaaaaaatccacatattgagatccatagcttttgacaaaaacattttttttttccatttgaattatatttgaaagacatggttcaggagaaagaagtggagaacagcagatttcttatttctttggttcttatgaaaaagtcataagaggctgtgagagtgagaagcacatgtgggtgagcctggcactggctggagcagggaggggccaagccccgtggagcagcccctgtacagggtcagaccccagatgggtctgggaggatgtgggctctcgtctccgggatctgcaggtggtggagccctgggcagcgctctgcttctctgtggtcactgtgtgaatgggcactgatgcagagcccaccatgtacatgcaagcccagcccagggccagctggggtgagaactggcatgcaaaaggcctcccacatgacgctcagtacagacacagaaggctccttatggagaaccttcaggaaaataaacgtctctagagcacagtgacgatccccaaattggaaagcccggaattcatgtaggtcacatttgccatcacaggcaaatgtccagtgattcataagcattatgatttgacagaatgctttagttctactaagggtgaaccttctgatcactgcttccctcttcctcttcctccattccaggcggttatgaaaacagaatctactaacttgagtcccccagatgatcagcacacacattcaatgggctcctgggccacaagagttgcagagtttagaaaacagaagtaacagcaatgatcacaaaagatgactgacctttgccctcggtctgccgggccgcgatcactattaagcccatttcctgcggtgtctgaaacatcagcctgccgaagagggggaaagaccggttaggccagacatggacacgcccgcggcaccaatggctcacacaggagggacagggtttgcatgcatctgggggtgtgtggccatggaagggccaactttggttccactggccttcaggaatgtggagccatgagggatatcaccctcctttctaacctgggtcgtgagaatgaaagagatgaagaaagcaccttttaacatcaaaaaaagagcatgcgagggggcgtgtgtacctgcctgagccgttactccatttattaaagacttggttagattctatttcatcagaatatcctgccaagttctttctccccccacccccaatgtatgtaccttcttcaagtgacaactagcaattcctgacatttgttcctacttagggtgcacttctgtttgaacactagaacacaatcataacagaagtttctgattattcagaaaaccaatatggtggcaataaagccgtttaaaagacacactatcccctgagaactaattatgatttaactatggtaaataaatccacaccttctgaggacgcaggagaactctgcatcgttttcggcttcagtcctgcttttaaaatggtttcattgaaaagaatacaaactttcctttgggggataggtagaaaagggcattacatccccaccaaatgagtcgatattaactttttttcaaaaaaaggaaagaaaaaaaaatcacacaaaaactcccactctgagaatttcctgcaagctgcgctctccctattttaaccccgtggtaggacagttcctctctacgtgcccaggaattgccgatcaggtgctgcgcaggcgcggttcgaggtaggattcatcaacagagcaaagatcaggtttggccactttgtcagtgcagatgagggggcctctttgatttttttcttttcttttctttcttggaaggaggggagcagccaggacagggatgcggaagggatggcattttgtaataacataaagtttctaataataagtctccaggcttccacagtggtcctgctgaggacaaaggagcgctagagaaagaccacgctgagaagcttatcatcctcccctcccagctacagaaactgggtggaactttacaaatggctggaactcggtaagagaagaaaaatacttaaaagcagagagaaacaacactgtgtccactgtgcacccatggctcacagagctccgtctgacggcgcatgcaggcctcagttgggacagaaggagcccagaagacccttcacgtgttaaaaagacctcaggacacacagggcaggggctcagctgctgagatagctgtcttcccacacggctgctggaacaggcacaggacgctttcggcgagcaggctggcctcgccgcccatgtgccaggcccactccatctcacatgaaatacagctcagaagtatttctcttggacgccatgaataactcattgagatcgagtgtgctgtatgccactgggtccaagaagaaagcgtccttttcttgtgttggaccagcagaaaatctaagaaggagtctttgtctgtgcagggagttaacattgtctttcaggcacctctgttttctagagggtccagcaaccctccacctggcttcctaaggcccagggctctcgaggtgatggggcaggggccgaggggatgatttagcgtgttgtgagcagatcgcaaaagcaatctaggatgttctgtaaataaacatgtagacggtagacagtcatgggctatagccagggacagtgatgggaggggcaggaaaaaggttggttcagaaaccaaacacagacttctagaacaaagagaaatgattaagggaacatatgcactaaactgctagaggtttggcagcagttaacagggcatattaatgagaagagggagtctgtgctgaaggccaagaggaaattctgcaaggagggagacaaccggggaaggagctaatgctcagtttgagacaactggaggccgccagatttatttgtgctatctgagataactctggggccaaaccgcatggctcacagtcaacaaagcagcatttataaaccttgtcaattctgcatttctgaaaatgaagctgcttgagtttgctttagcagaaaggagaaaccataaatgcatttccatccttagcggatgatgtccttacaaaaagaaaaaggaaaaacaaaaaggaggggggttccataatgattacctccctgcttctgtatattttccttccttgctggcaaaggttgtggaataaaagctttctgtgagtggcagccgagtgcattcactgtggaaccaaagcggcactcaggaaaagcgctctgttttgtactcttgtgttgagtctgaaacatttggagcctcctaagggtcactctgcaaatgagacagcctcctgaccactttggttactaaggacagcccagtagccacggaggctctgccaatggaactgtcctgattgtcacatggtcctttaagattaagctttaatgattgggaataacctaagacaggccagcatgaattaatgaaaaatccgaatgaacaaaaacgtaaattcagaccaagtccatccacttcggggatctgaacctaagaaaatagtccacattcacaacagtgttataaaggtaaaaatatggaaacaacctcactgttaataaacaaatggttaaataaattctgataaattaagtcaatggaataatttgtaatcaaatcattatagttctgaagactatatagcaacgtggaagaaaggcttgcattggtatgtcaaattaaaaagcagcatacaaaactatagatgcttttttttttttttttttttttgagatgcagtctcactctgtcgcccaggctagagtgcagtggcatgaatctcgggtcactgcaacctccatctccaaggtttaagcaattctcctgcctcagcctcccgaatagctgggattacaggtgtgcaccaccatgcccaacaaatttttgtatttttagtagagacgaggtttcatcatgttggccaggctggtcttgaactcctggcctcaagcgatcctcctgcttcagcctcccaaagtgctgggattacaggtgtaagccaccacgcctggccaaaaactacatatacttttattccaagtatgtaaaattcaaaaagggcaggaaggagattagacaaaatgttaatgatggctatattaagattttttttcttttattttaaaactttaatatgatgggtaacctttctttttttttttcgtttgagatggggtcttattctgtcatctcagctagagtgcagtgactcactatagcctggacctccagggctcaagggatcctcccacctcaacttcctgaatagctgggaccactatgggttcataccaccacacctggctaatttttgtattttttggtagagacagggtttggtagagcccaggctgggtaaccttttgatttaaaatttattttgaattttttttggaaaaaagcatatttttacatttagatataatattgtaattgactattcataaatacagaacttctaagtataagaccaaaaggtccgttttaaaaagaaataagacaattggccgggcgtggtggttcccgcctgtaatcccagcactttgcgaggccgaggcaggcggatcacgaggtcaggagatcaagaccatcctggctaacacggtgaaaccccgtctctactaaaaatacaaaaaaattagctgggcatggtggcgggtgcctgtaatcccagctactcgggaggctgaggcaggagaatggcgtgaacccgggaggcagagattgcagtgagccaaggttgcaccactgcactccagcctgggcgacagagcgagactccgtctcaaataaataaataaataaataaataaatataaaataaaataaaaagaaacaagacaatcaacaatagttatttgcagtacccatttcattataactagtgagcagcttatctgatactaacaagtgagcagaaattcttgaaaccagtctgttcagacccagtgatagccttaaacatggtttacttcctgacccggggactgtatttctacagaattgaagcctgaggaggactcagacagggacacaaaataattcaggggctcaactgttcaccacagcattactgatgcagtgtgaaaaatcagaaataatccaaacagcccactgttgaagaattaaaaaacccacagcagtcccacatgaaagcccatcatgtggtcatcagtaatgtgggcagatgaccaccggacacttttaggtgatttaatcaggatgcaaaatcctacagacagcgtgagtccaatcatgttttgaagtatgcttttaaaaattatggccgggcgcggtggctcacgcctataatcccagcactttgggaggccgagacgggcagatcacttgaggtcaggagttcgggaccagctggccaacatggtgaaaccccatctctattaaaaatacaaaaaattagccgggtgtggtggcgggtgcctgtaatcccagctatgtgggagattgaggcaggagaatcacttgaacccagggggcggaggctgcagtcagctgagatcacaccactgcactccagcctaggcaacatagagactccaactcaaaaaaaaaaaacaaaaattattaggaaatataccaaaataatagctgcagttaccttggggagtgaacatatttgaaaaatatagaaaaatattaagtagaacataagtcatctaggtaagtcccacttctcattaaaagtgtatattcttttagaatttctctctttttagaaaacacagatatattttacaaagtatttttctgataattaaaaattttttattttggagctcttacaatgatgtagatatataattatagacattatattgttaaaaagtgaaaaagaaggttaaaaacagtatcgtagaatgattctctttatatacgatatgtatttatagaaaaatacaggggccaggctcagtggctcatgcttgtaatcccagcactttgggaggctgaggtgggtggatcacttgagcccaggagttcaagagcagcttaggccacatggcaaaaccccatgtctatcaaaaaatacaaaaatttagccaggcatggaggtacatgcctgtggttccagctacttgggaggctgagatgggaggatcacttgaggcagggagttcaaggctgcagtgagcaaagatcatgccactgcactccagcctgggcaacagagcaagacactgtctcaaaaaaaaaaaaaaaaaaaaagaaggacacatattaacagtggttatctcaagaaggtggaagaggccgggcgtgttggttcacgcctgtaatcccaacactttgggaggccaaggcgggcagatcacgaggtcaagagatcgagaccatcctggccaacagagtgaaacctgtctcactaaaaatacagaaattagctgggcatggtggcgcgcacctgtagtcccagctactcgagaggctgaggcaggaaaatggcttgaacctgggaggcagaggttgcagtgagccaagattgtcccactgcactccagccaggtgacagaacaagactccatctcaaaaaaaaaaaaaaaaaggtggaagtgtggaagtagaattatatgatgatttaaatgtctcctttatgttgttctatataatctctgggtggtaagatttcaagtgatttttatttctctcttatactttactgaattttccaatatttttataattgtagtgcattcattttataaatcctattaaaaaaagatttatttaagcccaacctatcagtggattaagcttgcagctgccagttcactagttggtggagcaatctcctttccagcacagattggcaaagaaagggcggccaagtgcaggcagctttcccaggctgccatacctgtcccgtggctcattccctgccgcacaggccaaggccacggagggctggcagtctgccactgggagcagctggcctctggaagctgggctgtacctcagactggcctccctttctaaaagatgttgtaaagtctttctctggaaaacacaccccaaaccctcctaagtctgaggcatcgtgccctgcagcagtctggcatggggtgggtgtgaggcgacctcgaagtctccctcgggcctggagggcttcctcagctcatggtcctggcctgacaccagtctgtgcttctctttgctatcttctttaccccccagttttctcagctctgaccctgttcttagcttacagagagacacacactctcatgagtgaaaaagaaagccaatgggaggtggcgaggaagagggagaagggggccccaggcagtcacacattgaaggttcataagttatttttcattttaaaaaagctgactggaagatgaattcccactgttcataaccctgctgccctctgcttagttcaaaggaagcagtgccgaacttcatttcagaactacttttaacacatattacattgtaaaaaccaaccattacatctgagtagcactttctaaaaagttaaaacgctaaaatatcaagatatttcatttttgttaaagtcacactttaacaatacgattgattttttttaagctactttctaggcaggaatgcacaagattgttttttgaaaggaaatgaacagtggtttctgctaaaaaacgcctccaccgtaaaatggagtgaggcccatgagacagctgtgcaacgcatggggacacagtcaggggcagaagaggcccgacttctgacaggtgacttctgaactggcggcagggtccacggcacaaagctgaggtggctgccccaggacactgcagggtcctagccagggaccctggggatattattcctggcagctacaggaaggttcccaaggaactttagaaacatcacagcagagtggagactcagacagggaacgggacagatctggactcgaatcccagtgttgatatgaacatggagtaagggaatccatctctctcagtctctccagtcacctataaaatggaacattttgtgcagtgtcagtaaaaatgaaatatgatggaatttgcaaagtggtccctgtcatgtcgatcctagaacttcttgctgccagaagacaagcagcgcctccccttacctcctcctcttggggataaggagggaagtcagggagacagagggaaggaatggaatggtggggacaaatgtgtgtgttttacgactcctcaaaaattctatacgtgatgcctctcctctctgtacccatccctcatcacttctacctacacacactaaggtgatctctatctgggctaaaaaccttgtaagtgacactagcaatgggggatgcagaatcttcacttccagttctagggtctctgaacctactcagcaaagctacacatagttggttgaactggctcttcggctgactttgtttaggtgactgcttagaaacactgttggtcagaggtgtgcccaggcagataatagaacagttttattgatatattcttccattctattctggatttgacactacggcctgccctttcctcaatgcactctgttggtatgctttaaatcatatcccctttccgctcttggtgtagaacaggatgaatgtttcagtaggaggcaacacgggaatcgggactgttcaaagagcagagccatcacaatcctcccactggagctccccagaagcagagagatgcctgtgggtcaggccctctgttagagacacccgcttcatttccgtagctcctggcatacctgcccttcttacgtttttggctaatcttccccacgtccagcataagagcgtccacattgctgctaaataaatcatttcatggctcccaaggagcccagtggattcagctttcagaatgaggctcctttttggtaagtcaagcatttactaatgttggtctgtattatccaatcaaagtgaatacaagccactgtttcttaccctgacacttcaccataaatactagatgcctgcgcatccactgccttctatcttaaactggtgctattacagaatttacagatgagcaaagaagcttgcatagagagaaatattcatggtgcccacagccacctctgtggctgtacctcagcggtagccctgatggcagatccctgcctctgacggcgagccttcactgcgccactgcacaccagtactcagactatctgtccccactcctccgccaggagtctccggatcctccacaagatcttctcaccccccttttcaggctgttcagatctcataaatatgtccatttttctacaactgggtgtggagcggctcttggtggagagtgtccacagccttgaccataagtcacctgcccctaaagagggtctgctactgggaagtgctgccgctatttcagaggatggacaccgactcacgtggacgacacagcaagcagatgtctgcgaacagtgtttctgcaggcaccaggtagatgtttcaactggtcacctggaattcacaccaattttttgtgctatgagtggcattttaggttcgtgatctcatccaagccttccaaagctgagaagaagtccttcctcacagacaagaggacacagtctcagaaaggcaaaaccactgctataaagccacatagcaagcaaaccagaaattcaaatcatgttctggttggttgtaaggtctataatacttttttctttttaaccttttacttcgaaataatatcagacttaaagaaaagttacaggaagagtacaaagcattcctacatgcccttcacacagcacccagatttcctaaaggttcactttttaccatatatgttttgtccatctgtctatccatcattattttctgaaccagttgagagtgagctgcagccctaatgtctctgtattcctatatgcgtctgtgtagcttcctaaaacccagggtttatcttacctgattatagtacaatcacggaaatcaacagccttgttacaacactattttatgcttttttttttcttttgagatggagtttcactctgtcacccaggttagagtgcagtggcacaatctaagctcactgcaacctccgcctcccaggtttaagcgattctcctgcctcagcctcctgagtagctgggattacaggcgtgcaccaccatgcccggctaatttttgtatttttagtagagatggggtttcaccacgttggttgggctggtctcgaactcctgaccttgtgatccacccatctcagccccccaaagtgctgggattacaggcgtgagccaccgcacccggctgatatggcactattatctaatccagaggtcagcagaattctctataaaaggtcagagagtaaatactgtaggctctgcagccgtatggtttctgtgctcaattgctcaaacctgccgtccgagggcaaaggcagccatgcctgtgtctcaacatttacggacataaaaatttgaattttacataatgtttgtgtatcacaatatattccttttaactaataggcttttttattttttttagagcaactttaggtttacagaaaaattgtgcagaaagagttcccatatgtccccttccccaacagtttccttatcattcacatcttgctgtggtgtggtcatttgttacgatttctgaagcagtcttggtataggactattaaccacagctcactgcttctgttagggttcgtgctttgtgctgtacattctgtgggttttgataaatgcatcgcatcttgtggccaccatgtcagcattacacagaacagtttccctgccctaaaaattcccctgtgcttcacttattcatccctcatcccttcccctccccgaaccctttggcaaccaccggtatttttactctctctatagttttgcctttcccaaagtgtcatataaattttattctttaaaattttttctgaccctttaaaatgtaaaaaaacatgcttagctctcatgcggcacgaaaactggcagcaggccagactcggcccaagggccaaactttgccaaccccagatctcatctatagagtgtattcaaattgtgtccattgtcctagtaataatgctctttttttctggtctaagatcaaatccaggatcatctgatgcattgagctgtcacggcttcttcgtctcctttaatctggttcagtttcttagtctttttgtttttcatgatccagacatttttggaagagcaggggcagttattttgtcctatgtccctcaatttagataatcagatacccccgttataagactcaggggtgcatttctagcaggaatacatggaagcgatattgtgacctcagggcctgacatcgggaggcaggcagtgctgtctcctgacatcagggatgttaactttgacccacagggttatgtggtttgtgctgggttttcccactaaattgcctttgtaattaataagcacttatggggagataaatctatttctcatgaaatttaatctattagttttagtatccatgaatgattcttgcttgaatcaattattatttttatttattttttatttttttggagacacagtctcgctctgtcgcccaggctggagtgcagtggcacgatctcagctcactgcaagctccacctcccgggttcacaccattctcctgcctcagcctcccaagtagctgggactacaggcgcccgccaccacgcccggctaatttttttgtatttttagtagagatggggtttcaccatgttagccaggatggtcttgatctcctgcccttgtgatccgcccacctctgcctcccaaagtgctgggattacaggcgtgagccactgtgcctggctgcttgaatcaattattattattattttttgagacagagtctcactctatcacccaggctggaatgcagtggtgcagcctccactcactgcaacccctgcctcctgggttcaggcgattctcctgccacagcctcccgagtagctgggattacaggtgtgcaccaccatacccagctaatttttgtattttagtacagacagggtttctccatgttgaccaggctggtctctaactcccgacctcaggcgattcacccgcctcggcctcccaaagtgctgagattacaggtgtgagccaccgtgcctggccttgaatcaattatttacttgatggttgccaaacagatttttctgaaccatcatttcttccatattcacttgtgaggttctactgtaaggagtaactttttcttctcccctccacttattatttatcttttaatttatttatatcagagtagacttatagattcttattatttcagtagattgtatgccttcctatcattttttattttgatactcaaatagccacatatctggcaagtgaatgctccttcagtctggctcctgggtcttactggtgtgtcccagtcatctttcagcataagaggtctctactttcaggcataagaggttctaggctcatcttgaactttctcagcccctgccctggaatcagcgatttctccaaggagctctggttccttttggtgaaaaacggtcttttaaaaaaactggggctaagaaagagatagaaaatgtgtgcatgtgtgtctagggtgtatatatgcattacaattgtcccttggtattcatggaggatttgttccagactgcctcccaagtcccacagtgagctctgtggaacctgagtacacaaaaaattggcctccatatacatgggtttcacatcccatgaataatctgctttggttgaaaaaattccatgtgtagtagacccctgcagttcatacccctgatgaatcaaaggtcaactgtatttccttccgtccatccatccctccctccttccttccttccctccttccttctttctttcttccttcctctagattctcatcttctttctctatctaatctatccatctaccacccatccatccatccagtttgaaaaccataagttcatcataaactccaatccaatccaataccacaaggttcattctagcccctccttttctatattcataaattctttctccaatagtgggaaatctggcttgcattatctacactatttattcatttgctcaatgccataatacacagggggaagtggtctcagcagtgctgatccatattactgcgaaatcacacttactaactagagttcaatatttgtttacagttttttttgcccttagcctgagggtatagattcaaatattgtattgaacatttccttggatttgttcttttttttttcccctttactttagtgtggttattttatttgtctgaaatcaggttaggtttaactgtacttctatattacattttacccccacacccaaaccccaccaatccttctttctttttcattgtttaacctggttcagagtcggaactgtacacagacaagtatactccgagaagtgtcacactcccctacccattccttctacctaggtctcccactccacctcctttctgtaaaccacaaatcaaaatctcattcatttctggtttattcttcctgtgttcctttttgcacaaatgaatggatacatgcatattttcttatttccttgtcttccttacagaaagttaccattttgtagatgctcttttgtctcccccatccacctaccccacacaattaatatacccgggaaccactaggttgcatactccttatgagaatctaaggcctgatgatctgaggtggagctgaggcggtgttgctagtgctggggagcagctgcaaataagttcatagagcttttcctcattttttctttttttcagacggagtctcactctgttgcccaggctggagtgcagtggcgcgatcccaggttcacaccattctcctgcctcagcctcccaagtagctggaactacaggtgcccaccaccacgcctggctttttttttgtatttttagtagagatggggtttcaccatgttagccaggatggtctcgatctcctgacctcgtgatccgcctgcctcagcctcccaaagtgctgggattacaggcataagccaccgcacccggctcctcatttcttcttaaagctgagcagactccattctgtggatgtagcacagcctcttcaaccactcttttatgtataggcatttaggtagttcctaaaaggacagtataatgaacactcttattcgcatggatttttatattgctggaggtatatcttcagggtaaattgctggaagtgggatgctgagccagaaggtaaacacactggtagctttatcagattctgccagaacccccactactgcacacagccgcgcagagatacctgtttccctacagcctaaccaatggacagtggcgtgtgtctgtgcatgtgcgtgtgtatacacagtcaatgaccagttaatgtcttttgagttaactcaaaagttaagagtttcttatatattagggcagagtccccagctctgccccacccccccaccccccaggctgcacagcaggaggtgagaagcaggcaggcaggtgagtaagaaagctagaaaagcttcctctgtatttacagccgctccccacagctcacgttaccacctgagctccacttcctgtcagatcagcggcagcattagattctcataggagccctactgtgaactgcgcatgcaagggatctaggttgcatactccttatgagaatctaaggcctgatgatctgaggtggagctgaggcggaggttgcagtgagctgagatcatgccattgcactccagcctagacaacaggagcgtgaaactctgtctcaaaaaaaaaaaaaaaaaagccttgatggtatttttagtctaagtgcattaaatgtataaattaacttggggagaactgaccatctttgtgattttgagttgtcctacctatgagcaaaggatgacttacatttgttcaaatatacttttgtgtctttcagattgttttaaagtgatcttgtgttgattgtgcatatttcttatgcactatcttacgtattttatcttatttgttgctattatgaatatatcccataatttcctttaactagttattgcttgttgtatataaaaactattgatttctgtataataattttatatcctgctctattactgaattctcttattgtttgagttagagaatcactgattctttaaggtttctcatttcctctgcaaacagatagttttacttctttttcaatgatacctttaattgacttctcttgtctgtttggattggctaatacctttagtacaatgccaaacagaggtggagacagtgggcctccttgccatgtttcttagtgtttccctgctatataagatgctatctaggactcacagacacttacaagtcagtaaattatccactaagtcctatttttggaatttttaaaaatcaggacagggtgttgaattttataaagtgttttctcagtatctatggaaataatcatacatttttcttttttgatctattaacatattaatgagttaagagatctattaatttttttaatattaaaccaatcttgcattcctagaaaaaaaaatcacatttgtcttaatgttagattctgttagttaatatttatttagaatttctgcattgatgctcattagtgatactggcctgtaatttttatactgtctttaacagatttaagtatcaatattatttacttcattgaaatgaatttgaaaattttccttcatttttgatgagcccatcctttttccactgaagtactccttctgaggaagactaaaaaaaaatttctgccaatgatcctgtaggaaaattccaaaagaaacctttttgatttcttcttgaaatagctttcagaactcctgttctcaatcaaatatctttgcacctacaggtctatgtgaggtacttgcagcacatgggtagtaagacaatgagtttatattaatgtggactacatttaagaatctacatataagaaccttaactgaggctttaccttaatactccagacaaacaggctggagacctgacctccttaagaggtctggaccagttctggtagagatcagcccagaatgaccaggcctctgaacattccacaaaacgtgttccatggagagggtgtagaggagaatagggagcattaccgaacagcaaaggaaaacactttaagactctcctcaaccatttccattaaaatttcagaaacaggccaggtgcagtggctcatgcctgtaatcccagcacttttggaggccgaggcaggtggatcacctgaggtcaggagtttgagaccaacgtggccaacatagtgaaaccccatctctactaaaaatactactaaaatactactaaaaattagctgagcatagtggcaggcacctgtagtcctagatactcacgaggctgaggcacaagaatcacttgaacttgggaggcagagactgccgagatcacaccactgcactccagcctgggcgacagagtgagactctgtctccgaaaaaaaccaaaaccaaaacaaagaaaacctccagaaacagatgagaacatatttagatgttttgtattgtattaatactttttgctcaattttaacaaatgcctcagtctttgctaggagctacccacctcaacaagcatgggttcctggccataccatcaaggtcacagaggcaaagctgcctccagagctaggctctcaaacaatgctgcccatcagaatcgcctgcagttttaaaacacaaagcaaaaacaaactgatgctaagaccccagataccctctgaatcccaacctccagagccagagcttgggtgtgtcccagatgattagaatgcagctggtccaaagactggggttctaaaaccactgttcccaaagctatttttcaatgacttttttaaaactacatttcttttaaaaaatttccagagctacaacatcaaagaggcagtaattctcttctggttccttcaatgattgaaatgaagcatcgcattattttgatatttactaggacggcacaacaacagtcccacagatggagagatttcattttctagagccagagggtggtaggtagtcgaggaaaaggaaaaaggggaaaggaacaaagaactggcattcggacacaaagtgtgcaccacaaagtgccattacgtgcaagacagccacttagtgtgtctgaatccctgttggtgttctgtctccctacagtggcttcattcgcgatcaccagatgtcaggtctgccagatgtcgtttttagcaccatgaagcatagcaagggctggtgtctcgcacacacacaagcatgtgtgcacatgcacacacacacatgcacatacacacacacacatacatgcacaaatccacacacacacacacttgattgccacctcaatatggcaggcttccaacagtgagcacaccagccaacatggcaccatctttccactcactgtaagatttctccaaggtcttataaatgaatgaatgaacgggccatggggaaggggtatcttcagctatagatctcaagattctacactgcaagcaagccagtggttcctttgactgagcacccatccacatgctgggcccttggtatgagccatgttctcatttaaatgtcccagtgactctcaagacatcatcattgccaagtagtctcattttactgctgataagtggaagctacaccgcagaagtggcctggtgagatcagagaacagtcaaccaggtttgcctggctcagaggcccatcttctgactcactaggaaagaatcttttgcttttatcaaaacagaatttcaaggtagaaataccacctcttttttttttttttttttttaatgagacagagtcttgctcttcacccagcctggagtgcagcggcactatctcagctcactgaaccctctacctcccaggttcgagcaattctcgtgcctcagccacctaagtagctgggactacaggcatgtgccaccatgcttggctaatttttgtatttttagtagagatcgggttttgccatgttggccaggctggtcttgaactcctgacctcaggtgatccacccacctcagcttccgaaagtgctaggattacaggcgtgagccaccatgcccggccggccagcctcttaaaatgcatttgtgtaagtttaacagtcctggaggctataaggctttctagaaagatctggaaattgacttccaaataataacatcaaaatggggttcttgctttatctttttttctgagaactgaaacagagtcaccttacattttctaaaagtaaatactaccagcttggtggccaagttcatcagttctgtgctatgtgtctgaacagttattttcccagctctgtacgtattctgcttcaaatacttcattttcccttatgaaatttacataaattataatactaataagaagtttctttacctacagagtgaaggggcatctgaaacacctgggcaaacaaaggaacctgaaggtaacgaattccttcctacagaagggcagctccacccggccacttgggcccttgattttaccccaggtaccgtcgccttcggggtaatgacaaggaagaatgccctgccctgccagctggcctgaaaaccagtgtgcctttcaccaccctgacgccctgtgtgtcaccttcctctttccctctctcggctcccacctctcttcagagccttccctgcaccccgccctgccagagatcaaccaacacgccagagctcgtttgccgggatgcttagcaccagcttaactcttcactcagtgggacaaggggcctctttctttcaggcagggctttgctccatgacacgctgggtttatggcccccgtgaacgaaacctggttcggaatccaattctacaacagattttcgttcaaatggttattttccatcccttgcccccaattccattttctacccatctctcccggctctctgcctgtgggggctgaccccttgagacctgggtggattcgtgcttctgggtgggttctgtgctggcaagacattttatatcctgttctcttactgaatccttgtactgtttgtttagtttgatcgtttattctcaaggtttcccagatatactacaatatcatccacagatagagttttacttcttttctgattcttaggtctccagttggcttccgtgtccacttggattgggtaatacctccaggatgatgctaagtattatagaagtggaggcagtgggtgtatcctggccttgttcctcctgatctctgtggaaatgctcttaggtttccccaagaagcaggatgctagctttaggactctggatctcacccactccctcccacctatgagtctttggaaaatactatttcctcccttgctatttcaggcccaggtggcagaactcctctctctggggacccctccattgtgtgttttcccttccacaggattctgagttggatcctgtgtctgtctgtggccctgagagctgcaggtatcgactacaggctcagcatggtgggatgggctgtatcctcaaccctgtttcaacagggacacttctgctaggagaggagaatgggcccagatgtaaagctgcccttctccagggtttcctgaaccttctggtctctttgccttcatcttgcctcttcctgctccgttaaaaagaaaatgcttcccatttgttaattgttgagagtgtatgctgctgttttattttgcttgacatcttacaatcaatcttctgtatatgtttatatatgcttttctatttaagctttttttttttttaaatctaaaaaacacagtaccataccgccaaaggtgtcaggaaacacgctcaaataaggaagggctccaaagactgctttgccaacaaaatgccagtaaaatctgaaacccaggttcagacacactgggaacgttccaaaatttaaaacttaaagaacttctttattccagtaaatcagcttccctgtgaataccatcaaaatcctgggctttaatgagtaagggaatatcagaggaaggggtggagaaggaaaggatttggacgagcacaaaatttaatttaaaaactattatgagaagtttaatttcccctcccccaaccaaacacataaatcttttccatgcattttctttgtttcggtttttcctaaaaaatctggagagggaaaggcatcttgaaccatctgaaatgacagagtcagtggagtctttaataataaatatgtgtttattggattcctatgaattaaatgacatattagctatatgggaggatccaaggaaatcgtaagcaaaattgcattctcaccgaatgtgtaatcaaccagggagaaaagacattgatgggaaggataacgagtgatatgaggccttgggcctcttaaggagtagggacaacagaggtgtcagagtccaggcggggatggctcacttcggcaggggtggtcggggcccagcacacccccaagtgcactgaaagatgcgaccatgtagggagaatgaagctggccttcacagttcataattccatccacaggcagcactgagtgcagccacatttcaacattggaactttccagggcgaagaagcactgaacacgtcgcaagagcatggacttcctaggttttcaccaggccacgcgtgagcatggggctgtgggtgtcggtgtgcctcagcactgccacgtccactctgagtgcaggtccggctcagttttggatgttcctccgagagcagtcctccagggccaccgtgggacgaggcacctctttggtaggccatttgcactccagcacggcctctgttcctaaccacaatgggctgctggttcaaggactccctgccacagccaggaggcacagaagaccccatggaggcacttggctggttaagacccgcaggggtcacctgcctaggcttagcctcaatctccttgtagataaaactggaccctaacccttcactgcccagggcccctagggaataaatgtgccatgctgcgtgggatgcccaaggagagttctgtggcatttatttagccacactggttcctctcccctggtttcttttcatcatcaaatggacatgatggaaagctcctttgcggtctttctaggagaggaggcggcacctatattccagatgcagccatttcacaaccaggcgctgcttcctggtcagagccgctcgaccatgaggatattctacagaaagagaactcagctctctccttcctacctcacatgaccctaaggaaagttaagaaaagaggaaaagacctgtgaagatgcctgatcagctgtcagggttacgtagacactggctgctgttatttactgttccctggctgataaaatagccaggtcacctgtgccgatgaccagacccaccccctacccaccagcagggctgccagggctttctggggagacgctgcagcttggttcttatttcctttgctctgcatccctctgggttgacttgagtctgatcatgggtttattccatttccattttgctagattccctccactccctcaagcttctacaaaactgtggggccaccactccccacaaaagattaaaaccaagatgtttcctagaggtggcattttgtcttcctgaagctgttctgtgcacaggtcctctccacactcatgccaaatgctcggtgaagcgtcttcctgaatgtccctaaggggcacgtgccactggcagagctgatgggcacacctcactcccacacatgctgtgccgagctcatgactcagctgtgcagggcccgcccaagagtgaggcaaacaccaacaccgcacagcgaccctttgtcaatggtggggacctcagtggcttctccatcggaacttagggctgacgggcctccagacctactgttacacactggcccacggaatgaccctcataaacccaagaacagtaaacagagcttaacattctaacgaaatcaagattgctgtgtgtgctttcacaaaatgaaactgcctggaacttctcataacgttttttatgataagcattaaaatgcaaagaggaagattaaagttcctgctacagaccagagcagtaatgagtgtgggaggaggagctctgggtagggtctgggagagaggtttatgtactgcattacagttggatattattatataaaatgagtgtgttattaaaaggatcctgaagttataaaaactcaaaggaacttttactgaggatgaataacttctttggtaaagatgaatgactctcacgtcctagacactgaggtgcagtcacgtgccagagctctttaattgctagtagttggatttcgttgtttttgtggggcacttttttgcgggggaaggggcagaaagattaggaatacattctttgattaggaaagttctagtgggtaagagaaagtccctctagttagtaactgagaatcttgattatcctactagaaaaaggcaataagaagacgcatctcctatggccataacagccacctgattttttttgctctacttcttttaattttgtttgtttgtttgttttcagacagactctcattctgttgcccaggctaaagtgcagtggtgcaatcatagctcactgcaggcttgacctcccgggctcaagccatcctcccacctcagcctcccaagtaactgggaccacaggtgtgtgccaccatgcctggctaatttttaaattttttctagagacagggtcttgctatgttgcccaggctggttgttcgacttcttaaacagtacataccacctcatccatttaatgttacaaacacaatgaaatcagtaagtcagaaaactgtagagtgatgtggtgaaaaacattctttttaaatgtagttctacttattttaaatacatttaattaactaaaattataccagaatatggctttgggcttgatctactcaagtaatttatacattttccctataattttgtttgtgtccataaactaggaaatttccatgtaatctgtatcaagacaatcacaaattctaaattagtgaagaccaaagtaatgtttccctttaccatggttggaagtgtacaggatatttggtttattaattttaaaaattatgagagtaatcccgacagtctggaaaacagaaacaaaagatttcatcacacatactaacacaacgattgccaccttacgcattttctagtcctttctcaaagatgcatgttttaagattttaatctacgaattaataatttattgaaacctgctttttactttaagtggtctgagcatttctgtatcttgccatagtctttctgctgatggacaatattccattgagtgagtgtgtacagagtacttaactatacatctttgtgagtatgaactttccgatgtatctgatcatttcttaagggtagattactagaagtggtatcaatgggtcaaggatattaactttttacaactcctgatgcctactgccacactgcttttcaagaggttgctctaatgtacactcccactggggtttgaacaaggcttaaaagtacctgtttcattatatccttgcccaccctgggtattatcattaaaaaccgttttgggcctggcgcagtggctcatgcctataatcccagcactttgggaggccaaggtgggcccatcacgaggtcaggagatcaagaccatcctagccaacatggtgaaaccctgtctctactaaaaatacaaaaattagctgggtgtggtggggtgcacctgtaatcccagctactcaggaggctgaggcaggagaattgcttgaacccaggaggtgaaggttacagtgagctgagatcgtgcgactgcactccagcctggcgatggagtgggaccccatctcaaaacaaacaaacaaacaaacaaaaaaacattttggtgtgtgtgtttgttggctgatgtagagggtgaaaacagccaacaaacacaccaaaatcatggaggattaggaagtgggacctatggtgtttccttggctcttcattcagattgaagacaggaaacaaccacatagacatattctgtatctggctgcctttcccatgatcttacgcttccgtggctcaatggctgcctttcccacgatcttatgcttttgatcatccatggagaaaaacgcaaacggacgcaggaatgctccaatctgggctgtgaaggctcagacaggcaggaggctgtctgcccaggaaggcaggtcagaagctgctattaaccactctggcagggcagtgtttctgtcagcctgcagagcacttcaggttctgggagcagctgatggcagaactgtggtgttctctccgtggaaaaaaaatgaggaagtcagcaaaatgttcttaagccattccgtccaccattttgtccatctgtgttgatttggcagtggtgttggcaaagaacctgggtgtaggacaatgtgctttgtaaacagaagaaaatgaaatgatagatgcaggggtgcctttgtttgagcttgcttgtatttaaagttggctaaatatgcctcagcagagatctttggggacatgaatcataatagaaaaaaacagcaacatataggcttgtccaaaataaaacctgctcaccgtgcctcaggtaaccctaagaagcgtcctctgttgtaaaaacaattcaaatacataccaagtagcaagaatcgcataaggaaaccccacataggatgtccggggcaacaacatgcagacccccacccctgccggagccgagtacacaccaacccacacatccagggctctgggcagcggtgactgttcagtgagaccgctttcagcatttgcgagaagctgctcaccaactgccaagttcctgctgggtcggccaagaggtatgaaccaaaaatgaaaaaacatgaaaggtttgttttttaaaggcaatacatcaaacataaaaagagcccttttgtatgaattttcagtgtgggagccagagaggagaaaaaatcattttccctcctgggaggaagcagtttgacctcacctgcgacttttctcttacggtgtggatttttctcaccccattaaatgtaacctactctaggtgggttagtaccatgtgagagaaatagggggtgatggggaatatggcagacaggcaggctggggctcagacagaatgccgagcaccctcgagggtgggccctcgagggccacggaagcgggtgccacggggctgcatggaatgcggctgctccaaggggcctgtttgctggacacacaaggattaagtttccatggctccaaaacccttgcagcctcccaccccacccccggcaaaagcactctttgcaaaaggaaaggaaaaaagaacaaccaagttagaatggggttatcttcttaccactttcacaaagaaagggctggctgggatggacacagcaggtttcccactgtgaagccatcagaaaggcagcggaaaaaaacctcatggcagttaggtgtgggccagccacacagacaggaacaagcgagctttcaaacctagaaggtgagtgcgctacctgtcagcgttcacaggactttgctctgaagaacagtaaaagaccatctcagcaccgggtccctaaatccccttcccattaaccaggtgccaatagtgaaacctagaaggggaccctggtaaatcacccggcggctaccccgcaggctcccagcgctacgctctggggaccgtcagccttttcttctgtcacacagcaggagaatgagctcactttggcatctgtgtgaccagggacggctgccatctgtgtgtcactgttatcagtggtcagagcagaagtagcaggtggaaccatgtgaaatccctaacattcaaccgtttagacctgcaaaaatggctctttccttcgatttaccctgatgatgacaagaaaaggagaagggggggagggaagggagagggggagggaagggatggaagggaagggagcggggggaggaggaggacgaccatgatcatcagccaattgtgctacgtcagtccagagtgagctgctacttatgatttcatttcctccttagactgatgggagcaatgacaatccccatttgtagatgaggcacctgctcagagaactgaagttactcatccagggtcacatggctgtcaagaggcatgcccagtacctatgacaaacattcatccccaagtaacgaagccaacaacctgtgtctcactccagaaccacagagctgttacaacacgtggtgcctcctgagccagcagccaggggcaagaacgagaggatgcagggagaggctctggggaaagggctgtgtcccctcagtcatgtgacccccaggctttctagagtgactcatggtgaggacagcaaagatctcaaaatgctgtctagaccttaactctgcccatcaccccatccatttggttttgtttccctttcatttgcatgtgtagtcacatgctcagcatccttgggggcagctgcatctgtggtcctccagaaccccaagctttgcagttggacttgaacccctcatgcgcttttgattcctgattaaataacctgattcgagttgttgagatctttagtttacatcaaataattcttctttctattgctccattcacttctgcacattgccttaggtaccgattcattttctctacgacccccgctgcttacatgagttctaagatcatccacaggtgtgtgcctgtcggagggctcggagaacacgggacagcaggaagcagtcttttttttttttttttttgagatagagtctcgctctgttgcccaggctggagtgcagtggcgcaatcttggctcacttctacctctgcctcctgggccccagttcaagcaattctccttcctcagcctcccaagtagctgggattacaggcatgcaccaccatgcccaaataatttttgtatttttagtagagacagagtttctccatgttggccaggctggtcttgaactccggaccttgtgatccacccgcctcggcctcccaaagtgctggggttacaggtgtgagccaccgcgcccagccaggatgcaatcttattggtgtgtcacttttagcccaagaagcaaaaaagtggagtgagtaagctggtaggatcaactgttatttttatattaaaacaaacatgtaccagaattatggagtaaaaattatgcaaaatttacaagcatgttagagataaatcagaccttaaagaaatttagtgctagtcagaagctacataaatggtcaggcatgtggctgctggtgcaatattgtccctttacggccaagagacctcagacaagttacttaacctctcccatcgaaagcatctctcatgaagatgctgcttcagtcatagggttgtcaggaggatataccaagttagtgcctatgtggacagctgtttagaagcctcagagcaccctgtgaatgtgctttcagacctgccctggattcttagcttctactaaggacgagctacgggtgtgactgggttacgcttggctcattctggcctccctgccgcaacttttccaaagaggcgatctctgagctcctgggagcaaacccatgaggatacagatgattcggcaactttgtgccaggccctctccaggctctggggttgtttctgtgaacaaatgctctgtctctgcacccagggagctggcattctagtatgtgtgtgcaaggcggtgggagagagacataaatgcataatgtgtcaatgcagtgaaaacaaaatacagcagataaggggtacaaggaaggacaaaggatggggtgttcaagtggtccctgaaggctgctgcaataaggcatttgttcagaaagaagatagtgagagcataccatgaagacatgtgacagaggactattccaggcagaggcagcggcaaggccaaaggccctcagtgggattggagaggaacaaaaaggtgaccgacgtggctgaagcacactctgtgcgtatggggttggggggaataggaataagggttatgctggttgggggacagatttggaagtgtgcaggtcatagtaagaactctggattttttactgaatgaagtaggaagcaacactgagcctttctaagctaacagggatgagataactaagttacattttaaaggaattcacctggctgccacatggaaaacagcctggtggaaggaagaaagagatgtgttctgcacattttgaaagtggaacaaagaggacctgatgatgaactgagctcctgaaaggaagatggagtcaagggtgagttcacgacttctggcacacacaactcaaggaaaaagcgatgtgccgtttcccaaaagcaggaggcaagggctgagcaggctggagggtggaatctggtgctggacttagatgtagcaagcataagatgcctatgagacagcccacggaatccaagcagaagtctggagtgggagggagaggtctgggctaggatattcatttgggaatcattatcgtggagatggttcttagaaccatgggaccaggagaggtcagccagcgaatgagttgggctggagaggggaagacgtctgattaacctgactttgttctctggcaaaggcaccaggttgagaattcagaaactcatatccctggtttctttttagcaaacacgaagcatggtgaccaagccatgtcatcacactggaaccgcaaaaaagagaagaaaggaaatgcgcttcgtcttctgcgaggacacattgacggtgctcagctagccagcatctaggtcccacagagggcaggagggatccggaaacactgaggtcccctcctgagaggctcatgccctcacatactttcttaatataatcaaaatgggagtaaatgatgacaatatgcaactttccaaatactgagggttctggaccaagctactgaaacagatttcatagttgctatgctccatactctgcctagcatacggtagtcattttataaacatttgacaaatagttatatttctaacagaaaccagaaatttggggccatgactcctttacagctcaagaaatatgcaaaattagtattccctgagagacagatgtctgaaggccccaagcagtccaaccctgtcctgtcatagcctgagacatcctgccttagggagtaagttattactaactgtggacaagctctgtttcccttttggaggaactgagggcagagatcctgccattaattcctcccccagtgcctgggatagtgccctgtgcacagcaaatgcccaatacatctaaataaatgtcaaatgaatgagcgaataaatattcattaaaaattaaccaaacagttaatttaggtcattcagtggaaaaaagaaaaacagtgaaactagaaaagcatctttttaatttaaaaggttaattaaggacaaggttttaaaaaaatattttggtggatttagtaaaccaagcacacctgggactcaaaatagttgcaatctgtaactctaaacacagcccattatgtcccacgaattagaaaatgagggaaagttgcctgactcgcttcatgattctagtataatctcaattcttcaaccagatagtggacaagaaaataaaaaaccccaaacacttaaacacacagatgtgaaaatcatgaataaaatgctagttaactgaattcaatgctacatcttatgtgtattataatcagatattgtttatcctagaaatgcaaggatggtttaacatcagaaaaatgtatcaacataatacataacatatgggtgggcaaaatgaggaaaatcacatgattttctgaatagatgcagaacagacatttggtaatttcagtagccctaggtcagtccaaatgatctattagtctgatcaatttaatgattttattagattctctaattcccaaaagcatatttctttttactatttaagcattttacagcaatctgttttagatgtataagcagggcccacgagagctgtgaggaaccaggactcggataatccagggcgttgggagacttccccaaaccaggaaatgatcccatgcaccatctgagccttccagtcttcccacagactctaccaaacattatcggggccactaacaaagaaggaagaaaaactactttcaatgttagctctccctttgactcttctactgagggatatgtgggggacccatgtttatgaataataacttccagaaataaaaattcaggagagacaagcaatgcagcacctacagaaacaaaaataatcagacctaaatccacaagtttattaaagtgactttttatcatgatctttttttttttttcctgcaatggagtctcactctattgcccaggctagagtacagtggagtgatctcggctcactgcaacctccacctcccaggttcaagcaattctccagcctcagcctcccaagtagctgggactataggtgcacacaaccacacccggctaatttttgtatttttagtagagacggggttttaccatgttggccaggcgtatctcaaactcctgacctcaagtgatccacccgcctcggcctctcaaagtgctgggattacaggggtgagccacagctcccagcctatcacgatctctcttaacactgccctgacataactcatggctgtaccatccaaagacagtattttgtgctatgtctgaaaaccttccaatctggccttaaaacaaatattcagcaacataatagagtgataatgtcagaaaagagtattggctcccatatccacagttgttttaatagcatttaagaccaacattttataaatattattagaaataatatttattttttattaacattaaaattaatataataaaaatataatttttctcctagctttgcttatgtttgtgttttcataaatagtagaggggagaactaatgattaatcaatgggctgtgcatcacttgggaagttccctgtgtaaaaagctctaagttaacatctttgcaaaaccattaggaagaatttcccaataatccatttaaacatatcagattaatgaggaattaaatgcatctgcacttattcttggtgtggatttcaactgtttctcaaagctgaactgagccagagcctgctcagcagaagaaaaattgagaaggctaatggagagagccgttagcgtaggatgcaatggtttgcaacttggtgggcacacacggtctgaagcctcaccctgccctgacgcctgcattcctaattctgtgcattcacatgttgacttaacactggtttattgagcatttactatgtaacactgttctagagaccgagaaatacagcagtagaccaagtaggcttacgttctggcaggaggagtcagacactcaacaaatatgcaaatacagacacaaatattgggttgtggggttagagaagaagtagtgagagctaaggatggtggggagaagccctctctgataagctaacacgtgagcagagacttgaaggaagtgagagactcgggaagctaccttggcaaggaacgatccgggcagggagaagagtaaacacaaaggatggaggtagtagcgtgtgcttgacctgaggcccaacgaggaggcccagaccactggatgaagtgtgtgcacagtgtgtgtatgtgtgtgtgcaggtatttgggggaggaagggaggcaatcacacagggcttccagggaggtgaggactatgaattttcacttagcataatattttcaagattcacccatgctgtcacacaaattaatattttgttcttttatattgcttggattcctagttgtattctagtaatttgtttatccgttcaccaaatgatgactatttatgttgtttccagtttggggttattcaaataaagctgctatgaatatctacatacagtctttgtatggacaaatgttttcatttatcttggaaaggcatccatctatcaactgattgactgactgattgatctgctcactatgtatcatccagtaatgccattcctagggatttacccaagataaattccagactgttttcaaaagtggctgttatcattctgcattcccaccagtaacacatgagagttccagtttctccacattcttgtcaacatttggtattgtcagtcttttttaagttcagccctactaatgcatgtgaagtggtatcttatcatagtgttaatttgcatttctctgaagactggtgacactgagcattttctcatgtgcctttaggaatttataaattttctttgctgaagtgtcttttcaaatttttgccttttaaaaaaattgagttgtcttaatattgagtcgtaaggttctttatatattctggctatatgtcctttgtcagatatatgtcttgcaaatattttctcccagtctgtggcttaccttttccatttttaaactgtgttttataaaaaaaagaagtttttttagatcaaagtccattttaatcattttttcttttatagttcatgctttttgtgtctcatttaagaaatctttccctactccaatgtcacaaatatattctctgagaagcttaacagtttttgcaactaaatttaggtctatgatccgttttgacttaatttttccatatggtgtcatgtaacagttgagatttttttcctatgcaggcagatattcaatggttcaagtaccatttattgaaatggctatcttttctccactgaatgaccttggcacttttatcaaacatcaactggccacacacaggtgagtctacttctggacacttaccctgttccattcatctgtatatctctatccttacaccaacacgcatagtcttgaatactagggcaagttaattttaagatgtctcctggatatgtaaaaattatatctgagttgaactacagtttatttatatatccaggcagcaaataaatgtgagaatctggaggtgagggaagagatcagagataccaccttggaaaccatcaatttagagatgattcttaaggcaggggactaagggacactctgtaggacacagacatagagaagggaaggggctgcggcctgaacaccccacctgcatgctcactcacatactttcgtcggcctgtgttaacgaagtgctgggtctccccagcctctctcatctgtaagcagtgccaacaacgtccaacacagttccatccaatttggatctgccagatttccaaggagccgaaaacttgaccctacaaatcagagtcccgaattcagcccagaggctcagaaagttgctccagttttctaagcctcagttctcaaatttggaaaaatagaaattcagtaactagccaaaatcatagggttgtttgtggacaactaataagaataaaatgtaaacatttagacacgcaagccccgtgaggaaaatccagccgtccctctttctaatcagggtggtgtgagtttcctatgacccatttccaccatttccacatttatgaaccgtgatcaacattagacactgaaaacacaggaaaacaacttctggacaaatcactgtgagctcaaatgaccccgcagactctgtggccagcttgaccccaccactccatcatcaaagaggaccatggtgagagcctgagggatgaggcactacttgttgatgctggcagggatcagcagaaacatatgttttcatgctgaaaacagaagacacagatgtgggcacacttagaatgcactcctggcacacagtgggtactccgtaactacttggtgaacaaagagacacaaagaaacagcagtcatttgaacaatcagctgagaaaacagagactctgtgaccaagctctccatcaggtatggaacagatgcagtcacaggaatgataacagtcacaaggaaagctgagggtggctccctgccggtaccgctcttggcagtttatgggaaattattcatcctatggagcagcactattattaaccccgttgtaccagtgaggaaacagaggcaggaaggtactagaattactcccacttcataggttaaggaaactaaaacccaccaaaatggcagggctgggacttgaacctaggtcatcaggctatggggttccacggactatggctcagctataatactacgcgatattctctcccatcttcagaatgtttgcttcacttcaagtaaaagacagtaactaaaaattctctttccatcatctgttaccttaaaacagcctaactcacaaaacttcacaacgcaagcccaggtattatggaacccaccaagaatagcaagttcagtgttggctgccatttctaagtggacagtgttaattccctccacttagttgaggggcggagagaggtgttgaaggaaagagatgagatgacaagtctgaagtggcttcatcacaaagcatccatggctgtgatatgtagctgtgtcatccatggcaacattcgcctgaatggagattgtattatggacattgttctgggatgcctgaggctgatgacatgggacatgccggaaatttatgtatttcctacataaatatgcagctgaacatatttatgtaggaaaattaaagaccagactggtcaatcactggtaagccgtcaatgccccctcaatgattacccttgtcattcgtgccagccaaaacacacccagttcacaatagagacgcaagtaacttttcaacctgcaactgaccgctagaaattgattttagtagttgcctctatcctgtgatattttagaaatcaggttatcatgcataattagctctccagcccaaatcatctgtgccacattctattataacaatcggagaggttatgacaatcaagaaaaggaaaaaaacacaggcatctgtctcatagttcaattttaacaggaataaaaataatttgaaagaaagaacaaatacatagatcaaggccacatctgccatctcattgcaaggcacatgcccatcctgtctacaaagcttttggcatagcatgtctggtgcacagtaagtacttaatcagtggcagttcatctttttattattattaatgtttctagcatgaatggatctcagagagtctattaactttccttcctagtcaagggatgcacaaaaatttagcaaaacttcagatattaatttgcttcactgtgagtagttatgttctatttataaaaattgcaaacagattgatttcctttcttttttttttttaaattttttaatttcttttatagagacagttatctaactatgttgcccaagctggtctcaaactcctggtctcaagcaatcctcatgccttggcctcccaaagtattgggactacaggtgtgagccactgcattcagcattgatcttattttcatttgcaattttagcagcaatatgatatatataatattctttaataacaatattcataatgtatatgacataaggtatacaagaatacaactattttatacactaacagtagcaaataatattctctttcaaaattgtgattcatcgaggcaggctaacattagctgaaacaagtccaactgcagtggcccaagtccagggctagtcaggcagctctcctccaagcagtgactgagggccacaggcctcttgcaacttgggatgccgccattttcccacaaggcctccaagattgcagcataaggggaaagggacagtgggagaatctcatgggccaggcctggaagaagcgtacttcatgtccatctgtctgttggttgtccaggcaacgccagcccaactgaaaggggactatgcgcccaggagaaaaatgaaatagggttgggaatcactgttttctgtgtcataaacattctctccgtggacaattaacatctgccttgtactttacagatgtttacacggcacttttcactatgtcttatttattcattcagaaaatttagtcaataaaaaaagttgaaaagttgctattgttattgccattttccaggtgaagaaactgcggcttggagaagtcatttagcatccaagcagatgagtggcacagccaaggcttcattccctgacctccgcatccaaatctcaagccctttccacttttctttgcgtcgtactgaacttcaagaagaacagagatcctgtgataaaacagatttatgacagaagtagggttaccttttcactcccaatgggatccagtgttgtgtagttccataaaaaaggcacgatccccacacaattcaacggaacagcctgagagcaggctttcaccagtccatagtcatatatgagccagtacagggagtgtttcaaaactgaaatagaagttaatatcctgataatctcaaaataagacttctaattcttattttagaggtcaaagagatgggtgtagatatgggtgaacatgattaaatcaaaattatggatgtgaagaaaaactctgggcgatcagggtccagttcctaaccctgtccccttaactagacatgaaacccatgtggaatactcattgtcatggtgacaaccgggtggatggagtttgaagacaggtcagaacacactactaggtccacaaagcccaaggcgtcactgagctgggtgtgaagtggctgtctggcacatcttcttccattgacaagccggcctttgtgatgagaaggaggctcatggcacagtctcagctgagtccactcctgcaggcaggcagcagggaggacaaaacgtccccagcttccttctccatggtctctgcctagagagcatcagtatttcgatgttcagcatggaatagacttccataacattgaaagcagtgatcttctcttttcaaaacaaggtgttgtatgcagtattaaatctggattccagaaacgctcgcacagggcgaccttgtgtgcagaagtttattgccaaggttccagtttatgcccacgaggcgcacagcgaggcttctggaggcagcagcttgcttttggcattcccttacagagctcagagccccgacaggttttggctgtaagaagtatcccgcaactgatttattcctcaatttcaattatttttttctctacatgaatcatttccatgtttccaaagcagaagtagaaagaaagaaaaaaaaactcataaggtgaaaaaaacttccaaagtgttttgttttgttttgtttgtttttttattgaaaaaaaaaaaaagcctgcaatacaggaatggatttgctatcaaacatccatttcaggaaaccaccaggtagaatcgggcaatttgatgggcaattgggtctcaatttccccatcaggaacaacgtctgtgcacacacacatacacacattcactcccaagccatccacctcaccagaccatgagcttttagggagaccgaattccagccaggaaggcagtttccttttcactgtaccaacataatgcttcattacaccaagacacagcactctcccatctgccaggtcaataaagaatgaagcttaaaattcacagtcacctttacaatgctaagcatttcaaccttaaatgaatgtgcagtccaccaatccgcttccccggcctgcatccagctcttcccgtagctgaggctcaaatgatcttccacggggtccattagttcctcttggctggtccctgggttcaatgcaacgctcccagcaggtacggtaactgccactcatctgaaactcccaagttacactctgcctcactgacaagggcatggggcgctgcctcctattctgttttgtgggttctttgatcaccagaaggaatttcgagccactgtgctaagtaactcgaattactcataggctgggatcccagaagccgctgggttcctccatataccatcagaagctgagcttctccagaggacactgaagaggctgctcaagaaccctacagcaggttgtcccagaattacccaccatgacctaggtagctgactaaatgccacagcccacctgaagtttccccaggcaaacacctggagtgtctcatgactaagcaagatgtcctatggagctaaaaataaccctcctatcccttcctcctcctgccatccccatctctctgaccctctgtggtcctcaaagggcatttaagatttgagtttcctggccagaacgtgggcaagtgcttgtatttatttgctatttactaactgctgccatagtagatggcgtttctaaaacggtataaaacatctaccaacaacatcaggtttttggtattctatatgtgactgttaaaataaaaatggaccttggctacctataatgaatgagccaagtaaaagcactccaatcctggcgtccaattctatcagctgatatttgacacagggtttgacagttgacaaactgtctctccatggttccctcttaacagctccatgaggtggcagggccagtacaatcatccttgttttgtatctgagcaaaggacattgtggagagattaagcaaggctacaaaatcggtgaaggattccgactttccactacagcaagaggtctcagtgcatggctagccctaggcgatgccagaaacatgacgacataagtaatactttttttaatagcaaagaaagcaagccagtaagatgtccagcttgggaaatatgaagttggcaaggacaaaagatgcctccaaattttaaagaaaaaaaaatttctctctcggttaaccctcactactccatcaagagtaacagcagagtccaggtatcccctggaagtgggtcaggttcgggtctgcactgtcttccttgcttccaggtaccttcctcctcccaggccgcacggagtcccgggcccggctccgggcgctgtgtttacaggcagggcggcaggaaggacatgacctccccagctctgcggcaggttaagcagcctgattgaacgtggctgctaattaagggcccctcttgtctggcagggccaccagggtaccttctgcacttgttcatgaccactgcacctcgctcagaaattaactcttgatgagtgcagacaggggcccagctggtcctcccgagtcctcccaagtagataaatgaagtgtaataagaatgccgctgactgccaagggaagaggggctctccgtgacctcttggtaaaatccagagtatacttttactatgacttaattctctgcactggggacacctaacgtagccaggaatggtgtgaacagaccactagccacagggacagcatagaggcgtccatcactagacgtccacttcatgaagtaggagttaaaagaataaagaggtaatttatgagaaactaattttcaattgacaaatattttcaggaggtgtgatgacctacttttctccataactcttcatgggcccagggacaatggtggctcctattacagtttgcaaatggtacaatcattccgctcaggtttaaaatattaaatgctcatcttctatcacttacagagggattctttccctgaagctctatttaaggagagggaaattgcggccgtcattgtccaggcctcccacatacagaaacttggtagacagacatgttctgggtcacatggctaagctgtactgacatgctgctcgagtccagaggtatcgccattgagttcagcacagtcaggaccagagccttttccaccattcatctcaggaagccaacacacacagctggtaagggggagggcttggagctaggagactgggaactgtgtgtggtcagaagccacctcactgccctggcccacagtgtggttccctgtgtgacatcatctttgagatatgacagagacaaaaagcaggctgagagtccctgctctggactctagatcacaatgaagccacatctttctacaacttttgaaagaagcaggtgaggtttccgaaaaaaaaaccaagtgaaatgaaaggtgacggtcagtgtgctatcttttgaccgcacagcaaaaaagtggttgccgggctagaagcaagatggaaagatgaagaaatgggcagaaaaggcatttggtgccttgatgaaaaatttcaaaaataaaagggtcccatggtgaaactagagcaattcccagaagactaaatgtgggaggaatgggacgaggtaggggaagtcagcagagactctaagttgtttaagagagcgtattacttatctattgctgtgtaacaaatgaacgcaaaactaagcagcccgagacaacttaagaaacccacgatttccgtgtgcctggagtctgggttggctcagcaggatgcctttagctcagggtctctcacaaggctgcactcaaggtgtcagcgggcactgtggtcatctcaaggcttgcctgggggggtggctccgcctccactttgtcccttcccaacctcatctgtagtctgccacaggcctcggtgccccagtagctgctaatcttttgccatggggctactcatagcacgtcagcttgcttccctcagagctgggggtagggagaagaggaaaagcaagcaagacagaagtcacccagaagtgcaaaaaaggagttgccatcccattacttttgccatatttgatttgttagaagtgatccagtaggtccgacccacctgcaaggggagaggcttacgcaagagcatgaaaacctgaggacagagaccaccaggaccaacaaaggctgtggaccacagagacactctttattcatggaataaacctggagcccgattctcccaaggcgagcctcctgaaatgatagaagctacggagggaggccacatgctaggccacatgtcagcattattactgttcatcattcattcagggcccacaaaagcgagagcatctccatacgggtgtggattttaaaatcaggaaagcaggccagatagaattcatgcttaggcacagctgctcagaactgaccaccctaaggggcccactgttaataactcatcctttctgatgatccgcccactgcctggtgtggctgctgccactgttcagctctgtcccctgccctgagaaacatgtgctgccagaggttcgtcctcacaataataaccgctaacactgagtgacagcatgtgatggtcaagtacagagtctggcactttatgttcatcaccgcgtttcatcctcaccacgaccctgttctgtggatccggctggacgcatccagaggtgggagtccctgtggtctgggcactgatcagtgcctgaatgttctcagggacactccccttcattaaagcagacagttagacattaacaggtctcatgactcaatatataactgaattgttatattatgggcacattgcacaactgttcacttagaaaatctaaaagaatcagctaaaaactattagaaaaacttagtgaagtgtataaaatgaaacactaccgtgccactttaggactctggcaatagctaaaaagtaagttttgtgataactcatgttcattgtagaaaatctagaaaataaaaaaaaaaaaaagtaagactaaggcattaagtcactcatgactttaccaaaagacattttggtatattttctttgatgcatttttctatgttacatgggtgactatatcattgtattttaaaaaattgttgtcatactacactagctgagcatcttgcttttttcacttaatgtaacattgggagcattttcccatgctcatgttcttcaaaaacccaaggttaaatggttactgaatagctcatcatattattacaacctaattttaaaaaactatttccttttactcatttagtcaaaaaaatcaaatttttttcctctgttccccatttcctgtctttaaaaaattatttgaatatccatttcagttcttctattggcttaacacatatttatttacatttttaagttggctgcaagttagaaatataagttttcacagtctgcctacagtcagtactgtacaacctctataataaagaactcttctcaccatcgaggtccgtatctacccctggtctttaccttacagctgttacatgtatctcatctatagatgttataagcctcgcaagacagtgttataatttttgcttaaaattcttatatgattaacaatgaaattaagaagaaaaaagcagaaagaaaactagtattttgtgttgatccaaatatttaccagtccagtagtctttactcttttccaaggacctgagttcccaactggtattatttccctttaactgaaagaagttcctgcagcatttcttacagtgcaggtctgctggtgataaattcttttttcttttatcgaaaaatgcctttatttcccttcaatcttagaaggatatttctacaagatataaaattctgggttagggcaggcgtggtggctcacacctgtaatcccagcactttgggaggctgaggcaagcggatcacttgagggcaggagctcaagactagcttggaccacatggtgagaccctgtctctactaaaaagacaaaaaatagctgggtgtggtggttcgcacctgtagtcccagctactcaggaggctgaggcaggagaactgctcaaacccaggaggcagagattgcagtgagccgacatcatgccactgcactccaacctgggcaacagagcgagacctcaacttaaaaaaaaaaaaattctgggttagaattttctgattctctttcagtaccttgaaaatgttattccatgccgttctggtctgcaaggtttccagtgagaagtcagccattaactggattattactgtatggcttttctcttgttgctttcaagatttgctcttcaactttggttttcaaaagtttgcaagaaccagcgtgggatttttaaatatttattcttattggtgtttcttgagcatatgatcttatatctgtaaatttctacttgtcactgaattctgaaattttttagctattatttcttctactatttttttctgctccattttctctttttcctctgtcattttccccctctctgccttcagctgttaagtccactcagtaaatttttatttgagataactattttcagttctagaatttccatttggttcttctttttatcattctatttctctgctgagctatcttatcttttcattcatagtgagcatatatcatgttatttcatttaggatagttttgttttgctttgctttgagacaaggtcttactctgtcacccaggctggagtgcagtggtgtgatcatggctcactgcagccatgacctcctgggcccaagcaatcctcccacctgagcctccccagtagctgggactacaagggcacactaccatgcccagctaatttttgtattttttgtagacatggggtttccctgtgttgcccaggctggtctcagactctgaggtgggctcaagcaatatgcccaccccagcttcccaaagtgtcgggattacaggcgtgagccgtggcacccagccatttagtatagttataacagccactggaaaaccttgtgtgactctccatatctgcttccccttggggttgaacttcatttgatttctctttttcttgatttgagacagtattctatttccttggttcttcaaatgttggttattttagctttgtatcccagatgtgaggaaggttaaactgtagaggtttgggattttgcgatttttcttggatgactgttagttcttttggttggcaattagctgaacctgaactgcaaactctgaccctttcggcagcaagcacagatttttttgtcattattgtgatctgagtctattctatgcatgtatggttcagcgatcaaagatgtatataaacagaatttggggatcccctctccagcccttttcttctaggagtccctctcactgcaccacctgcccttggccctgagcttacttggtgcagctcaagagtgcagctcaagacccaccttgtcccaacgaggttctcccaccataaacttgcctgcttctgctcactctcaatggcttcaggcagctgctttctgaattatacccagttttcatagttattttctgtatgtgggggtgggagggatggaggtgggagatctgtctggtaagatcttgatctgccattctcagaagaagaagttcccagacctttgtatctaaataccattccccactaaaaggaaccagagttccttctaaaaatgtagaaagtaaaatataaaaacagctcattccagagctgggtacaaggttacgcctggaataccttattatgccagagagtgaggaagtgatcaaagatccaagaggccctgtcaaaaggagatgggagcctacttttcaaaccaaatctgggataatttgagcaaagagaataaggatcataattaataataaaattctgaagaaaagagagacttaatagtccacagtgctgattgagaggaaaaggaagagaagcatattactcatttaattggcagataaaactgaatgtatttgtcatgtacaacacgttttgaagtacctacacattatgaaattactaaatctagctaattaacatatgtattacctcacactgttaccatttgttacatttttaactgatgacgtatctctcatttattggactgataacgtatctattcctcattcactggattctacccagaaacagcacactttcaccctttcatggtacagctgccatgctcttcacaatgttattattctagactattacagtacaagctagcagtgacctatttatcttttaggatcatgaacaatatatatcacttcatttctagaaactgatcttcaaaaactataacctactgcaggacaggtgaggccagggaggcggacacctctgcctccaggaggctactctgtgcctcaagaaccaaagaacgaggggagttcgaccactgcctgtacagagcccgaatgccctccctgctgctgttctaatgcatgtcccatctgcaatgttagaaaacaagcttcagcttgatacagtggaacttggcagatggcacagtttgcttgttacagaactaagtatgaaaataaattcatttagtagtgctccttggagaaatgtggttcagaagtcaaataattttaaaagacctctttcccatgtaagacacccatgaaacaatgctctggtcataattagtctctaacctttcaaaatgcctgcttcagtgacctcacctgctattgaacacgatgcctgcagatggtgtgaggtggccaaagggtggaggactggcagcgggggctgcagcggctgctgtgaccagccactcacttgctgaaggatcagggagagacactgtgtctctctgggtctcggcttcttaacctgtgaaacccaggggttggggaaaagctcgccaagcccccctcctgctttggcatcctgtgagtctttattgtcctgggctagctgggacccctaggacactgggtggctccttccaccccacatgatcattctgctcaacaagaacttgcaggagccacagacctgcctcacaaacatgaggaagcgcatccttctacaaagcgagaggcttgaggtgtgtgtatagccaggtcaaggtgaaagctactgaggttttgcggaatcaactctgtatcaaatcttctctctctatccttctcagagtctgatcaaactgggaggtaacagattctcaacaaatctcaaggagagggaggaaaatatctacctactatggaattatctgtaatttttctaacacacagagtatgttagctaaagctttaatgccccctatcctttctgtcacttacggtacgctttatcctttgatttttgatcaactgttagtcgcagaatgaatatgcctaaattatcactgaaatctagcaaattatgtcttagaatgttagttttaaaaataagtttgaaaatcatttttatgagtctttgtaagctcaaaaatatagctctcattattttgacttagtttgtttaaattgctaagaaaattatttcctcaaaaaacagacactgtactcttcaccaaatttagtatgttgaaaactgaaaataagaaattacatatgaaagagcaagccagagacaacataccaatatacagaaaaaatagaggaaaaaaatactaaatttttcacctctgacttttcctccttttaaaaagaaaaaaatcagggctggcgcggtggctcccacctgtaatcccagcactttgggaggccgaggtgcgaggatggcttgagtccaggatttcaagaccaacctgggcaacaaagtgagaccctgcctctattaaaaataaaaaaattagccgggcatggtgctacatgcctatggtcccagctacttgggaagctgaggtggaaggattgcctgagcctaggagttcaaggttgcagtgagctgtgatcatgccactacacttcatcctgagcaacagagcgagattctgtctcaaaaagagaagaaaagaaaagatctaccagaagccttgggtccctgttttctggcaatatgctatgcatatttgcaaatatgtaaactgcatggataattttgctgtaacgaggaatgtcactttaccagactacaactttaatcagcattcctctgaacaaacttgctcatgatactaagcaacgcaaacatgcagccaaacaactggtgttttaatattctagcttctatttcttccacgtcataatttcctgtaataatctcactcatgcctgaactccacagacattcttatttatgtttttcaggtcagtatgccaatagcaagaagacttgttcttgaaaggttgagtttttcaaatgagtcctgaaagaattctaccacactgcctatttcccaagcagggatcatgggagaaaggaaattttgaagaaaatggttctaatgccattttgttaaaagtactgagagatttacaatgatcaagtaatatgccagttctttcaaaggatgccaacatctgatgccaacataattacaagttggaaaaatgtgtaatgaatcaggcggctcataatttcccttagaatatgtatgcacaacttattaaatgacataaaaagcaaagagtcacggcaaatgttgaaaccttaaatctgagtttcattgctttggggcattttcgtcaaactccatcatctggaagtacctaacaataagaaatattaggtcacaagctgttttagaaacacctgtaataccttcacctaatgaggccaataaacgagagcttcgtgttcctcatcaaataagaaaacttaatagtcaaatctgacataataagcccaaactcaaaccctgtagaaatggaaacactcacatggagagcattttctcctccaaattttcgattctgccaggtccctcccctaaagccacctggtggaaaaatgtgcccccagtgctaggtcagtgtgggtttcccagagtagggcttaattcatgtggtggtctttggaggctcagaaagaatagaatagagttttctcttgatggtcactgtcctcacctcctcctgctctcccccaaacacactacaacctaggtaaggagaaagaccctactgacatcttattcaaaacccccaatcccacccctttcaaggtacttgccagggaggtaaatggtggactctgcaggtttcctcctccaaaatcatttgtatactttgtctatggtcactgtctccccaaaagggctatactatcattttcttccaactagggctgtcagatttcacaaagaaaaatacagaatgcccatttaaatgtgaatttcagataaacaacagataatttcttagtatgtctcaaatcatgcatgggatatacttacactaaaaagctatctgttgtttatctgaaactcaaaatgaacagggcatcccggattttatctggcaaatttatgcaaaacattcataatatggggaatgagaaattaacacagttacctctttctggtagtccaggaagtagagaaaaggcagctctaagaaggggtagaggtgagaaaagggaaaatgtaaagagaaaataaagccttccttattttggtagaattccatgtggtcctttacaaactttaacgtgcatacaaatcacccagggacattgttaatttaacatgtgggttctgattggatagggtcgtggagtctggaattctccatttctaatccctctccaggcaatgctgatactgctggttcaaaattcgtttcactggtaacagaattccagcctcctttattccaggaattgcatggggtcaaaggcaagaagacccggtgcaatgggtggagaagcaggtggaggagtgggggccctgtgagggccagggaaggccatgtgagtgtgtggatgtgtggctgagggaaaggaggccagggatcaatgaagctttgctttttttttttttttttttgatggagtctcactctgtcacccaggctgggatgcagtggtgcaatctcggctctctgcaacctccgcctcctgggttcaagcaattctcctgcttcaggctcctgagtagctgggattacaggcatatgccaccacatcccactaatttttttgtatttttagtagagacggggtttcaccatgttggtcatgctggtctcgaactccagacctcaaatgatccacctgccttggccccccaaagtgctgggattgcaggcgtgagccactgcacctggcctcaatgaagcttttctaacagtgaaggtgaaatacaaagatttggtctcttctgaggtttcttctaattctgcactgtgagaaataaccactactgtcatccacactaagacatgagttttgagcaacaatagcaacaacaaaaaatgcacacacagcaaaagcagcaaacagttttagacattcatgcttctcatattattactgagaaacagagcagtacgcttaagaatccaacacaaatgccttgtcacatttggacaaatgagtaaagacgggggataggttgtgtagaattcatcaaattggtgcccctaaaaagtgaattgagatttcgggacctggccatggtttgacccttagtgatgtgtgtacctatatacacaccaaaacaggcactcgcttcactttccaaaagttatctggagaaaagttgttctagttcagagtgtttacatagaccaaggatggtcaactgagactccagggcaaatacatgagatttttaccggttcctggatacctttgactcaagacagaaaaaaagtcattaggaaaatggtaattattcttgtcattcatagaagcctacaattctcccacccaggaaattccactactcaattaattgattacatggaataggatgcctccactagtcatctagtcaaatgtggacactggtctgggttttaacttgtgggaaactgtttttctttaactcaggggactctaaagtacaatggctaagagtaccagagtcagactacttgtgctgaattctggctccaacactgtctccctgggttccatactactcttagcctcagtttttacatccataaaaagggatcaataaaagaatgtctgactggggcaacatagtgagaccccatctctataaaaaattttaaaaattagccaggccagacatggtgcatgcctgtagtcccagctcctcaggaggctggggtgggaggatcacttgagcctgggaggtcaaggctgcagtgagctgtgatcacaccactgcactccagcctgggtgacaaaggaagaccctatctcaaaaaaaaaaaaaatgtgactgtcactaggctgctgtaggggataaacttaataacgtatgtctaggaaatacacaggaggagttcagtaacgttgcctgttaataccttgtcactgtagttactgtttctttgctactttgcatgaagctctgaattgctcagtgttaccctgaagctggggactaaccatccttctctggattgccttctgccactcagccattctagtaatcaagctaagcctctactgaggtcccaggacacacagttgtatgggtaagccaatgcagccaatgaaatgtgttgtagatatagaaaatgagctatcggaaacgctgacttcaggaagtggagatacatggcacagctccaaaggcaagaagctcatagccaccacgaatctagtaagtcctccctgcttcttgccttacatccacaggtgtgagggaaattggtggtaaaaatttcctttcccatgactcgtaagcttctgagaaaagccttgtgatgatatactaagtacttcagcaaaggatcagaggagtcagctgtgagcactgctcagatcccagtaagactttcagtggccaagattaaagctggcttccctctgccacgccaagcaacccagcctggctacagtacagcaggctgctgcaggaacttttcagagcgaagagtaagcgttcgatgaagatgtagactcgattagagtggaagatggaagcagcagataacggatgcattacataccatactcttttcaaaatgaaaaagcaactaacatgcaatccttcaatataaaggtagattataaacatcggtattttttctttttactcgcacttggaattactttggttgtaaccatttacgtctttgctcagtctggatttaatcggtttctctgttcttccctgtaaaactgagtctttccaccaaatgaccctgcattcaccttaatttgattttctgggttttcgtcttttaaaagtcatcacagatcttatgccatagttgtgatcagttctccaacatttgtctgactatggctcaagattaaaaaacattttcttctaagatgtgagatctcctaattctccaacactcacctatcctccacccaccggcatttctctccctcaccctgctcctccgcctgcttcttcacccactgcactggggcttcttgcctttgacatcatgcaattcctggaataaaggagactggagttctgttaccagtgaaacgaactttacgttagagacatccaaactgtgtggatttggtataagcttctttcaaaaagtactactccattattgggaatgtttatgcctaaaaaagaagattctgtgttctattgtgtcagacgctttcaaagtgcaattgttcaatttgcaaactgcaattggttaaccaagctaaacttaattagtccaacgatcctacacatcaaaccctactgtttgatgtattctgcgagatgtccaagccgcctacagctggctaagggtcacaatgaaaaggcagccaggcttaggtctgggaactgaaatgagctgttctaagtggagcttttcttccattttctgaggctgcactgctctgaccttctccaaatcaatcctttgcggattaacatgtaaagcagtgtcgaattaatttcagaaagggaatatgagatcagcctaggatcatacaaaacatctaactcctaaatacactaatgcttctagccattcaatgagaagctgtcaataaagggaaaaaagtcggtgaggggggcggccagaaggatttgaaggttggagcaatctatcagactagttagcacattgcctacttctgtggcatggctaatgcattcctctagaagttaatcctatttctaaagaccctcccgcgaggagcacataggccgtgatgaatgagaactaaaatgcattaaaattctcaacaacttcaccaaaaggcacactattagattctgagtgtctaaaataagacggttcattaaaagtgcaggtcttaaagaacccgcttttgtccctacacactggggagagaggggccagtgtgtcacttgtgacacctgcagccaaaatatttttacattaggttgtccaagtaatcacatgagaaacactacatgaaacggcaagggaaggcctttttcacaagcgagcttaaatagcgttattatgtgcctacgctgggggaggatgtgtttccccagcattagccacacaacggtgtcattaaacccacttttaaaaaacagacatgaaagagcacttaatttcccttggaggagcggcggtatttgaacacttctctttttctctcattgtattttgcttgtactcaattaagagataatttagccatttatcaagatggagtcggggctgagcatttatacaggcatttactgcagctatccttacaggcgaaaatctgaaaccatctccagaagacagttcatagcggtgggcctaatattgactggaaattacaccttgacgagttagttttgagtctctgttaacagcacagggtatggctggatggccctcaagactgactgcgacaaattataaagcaacgtcgatgctaacgccagaaacaccaaggacgaaatgcttgagcccctacagaactggcaggaagcagcagcttaggaggctccgaaagatgaaaacacaaagacagaagcacacctagaaactggagggaatccacatggtgtgtttgttaaatgaatgaattaaagagagaataagtagactcagattgccacctggactcaggacatttatagcaacttaatgggctgaagttttgcaaaagttgatcctcagtgctaaacatcaggtccagcagaagggttccccagaggggtgtgggcatgggaggatgagagaggagcacgagggatgtatgatcctgcccactttgtttccacgcttcataatgaacacctgtgctgcatttactcttctgtatgaatcgaatattacactgaaaaaatctgaaagtaatacttcctctgacctttcgttttcacatcagcatctaccacttctttgtagggtcatcaatcctactataaacagtgttatcagtctaaactctgctatatctgaacattgtaataatcaagctatgatacggacagtatcatttacggaaagcttctaatacagcatctgttttacacacacactatctctaatcctcacaatcctttgggcaggtggcatctttgttttacagacagaacaactgaggctcagagagggcgagtcaggtgttaaaggccacacagctagcagccaccactgagaggattaaattgaggtctgctgggctcccaaatccatactctttccactttcccataaagaaacagtgcaggggaaaacataataccatgtatctaaaagaaagaaaaataactaagaagttgcacatctgaaagattgcaagttccctcaagcttaaagtaaaaatgcttgttaaatgatagggtcaaggattttatgaataaataaaaaagagccatcctacctaagccagataaagtgcactcacagggcagcaaaaataaaccagactcacgccatgtcagggtcccaccaaaagccaggctgtgcgacccatggagatgaccaccaaccagcacccctccctcagtgagaaggtgggtccttggccatcgggaatgaggcaaaggaaggggcagggcccagggagcagtggcctggcagccccttcccatgagttggggactagggggcaggtagtgatagtgaggccccgtgccagctgcagcggaggaggcatggttgaggctgcacctctacagagctggcaggaactgggaacaggtgagagccacgcccccttccgagttgaaggggctggagccccactctcccaggcgcagctgctgctgcccagccacggccgggccgccgactgggattcctcgcgctgtcagaggccccaggaagcccccctcccccacaggctcagaagtgcctgctcctgctgcagggcctgtccctgctcccggcacccactctgatttcagagcaaagttgtggccaagcccaggcactgtcatgacccagccaggtgtgcacatgctcagggcggcgctgacatgccagccccctgctgcctcagtccccactggactttgggcaccaacaagcacaggcttctgggatgccaagggggcgctgagggcagtttggcacaggcctgtacgcgcccttcagcatgaacagcctgggtgctgtgggcaccgtggatgtcaggttgatggctgcagaaggcagacaggctcctgggcagaaagtgggacgtccctggtgaagctccatcttcaagtcaaggacaacctgaagcatttcttggggctggatagcttttgtcttttcgatgaccccaaaagcacggaaaaaccagaagtcagctccgtgggtggtgaccccgtggaggggaaatataaaccagaaagtaggatgctgagtgcagactgggaggcgacttcatggtctggactagtgccagccctagcgcctgggacgtgagggtgcccggcaagagggtgtaaaaagacaaaccaatgagtgcgtgggaggcctgattctcatgtcaaaaagggtggaaggaaccacgtgttcatctgacagcatcgtcctcctgtttatttcctcagccaaggactggggactgggagacagtccacttgggtgacggcgaatttctttcaccccgagctgacaccaccttgggcagggggccacagtgagggctgagctggccactgtgtccaggggatcgtgccttgggcagatctgccttcatctccctgctcttcccctctgttttttgtgtatagtaggagcacacgagaattaggaagaacagaaaaaacaagcatctttcaaggttttattgaaccactgccaagaagatgtggaagagtgggttgactacaattgctagacatccgttcattcacttattcattcagttcactggcatccccagctaacacggccaccgtgtcacacttaccaaaaaatggttgggagatttatccttggccaactctgcagaaccctcctccccaaacctcctgctctgcgctttgctccggcagtgatctcaatgacaggattttaaaacgaggtttcagtacttctgcaacccaaatgttcacatcgttaccgcttaggaatctcagttatgtctatatgatatttaagcatgtgtttaaagacacaaaacactttccgcattttgtctgaatagactgaagacttgttgctgagttttcagtacaaaaaaacaccagcgattatcctgaaactgacaagtttgaagatgcaaagtctaggctgtaagaggaattttaaacgcacgcctttaaaatgagacttgtggctaaaatggagaaagggaagggagggaaggaaagagaagaagacgggaggggagaggaaagagggaagaagaggagaaactgacagctgacaggagggtcccatcacaggtacaggagacatcaggtggcctctgatgggaataggagagctgcagccagtcatcctcaccctcccacagctgctaatgagccattgtcaggccttgtaaaagtaagttaaattattgctgatatatcttccttgtaagtaagataaggtgacaaaaggtcactcctcggcgaggtgcagtggctcacacctgtaatcccagtactttgggaggctgaggcaggcgaatcacgaggtcaggagttcgaaaccagcctggccaacatggcaaaaccccgtctctactaaaaatacaaaaattagccaggcatggtggcgtgcacctgtaatcccagctacttgggaggctgaggcagaagaattgcttgaacccgggaggcagaggttgcagtgagccaagattgcagcactgtgtgacgcagtgacggagcctgggtgacggagcaagactctgtcttggaaaagaaaaaaaaagcatcaatcctctaatctaatggatgacacacagacttcataaagcatatttatctgacctgatgggttttttaaataaacttttattttggaataatttttcatttacattatttttaatgatagtaatcacggctctttcatgatgggcttagcacatgtgatgggcaccagcacatatacatatgccctttcaaatcaatcaacagcttgttcagggatgtatggagacagacagaaatgtagtatctggatcattactattaatgctaactattaattttacctctcctagtatttcaaaatatggttatgcaggccaattatccatgcatggaaaaattcccagaaaagggaagaacaagaacaagacaagatctagctagagcaggacagtgatttttaaagcaagataactaatttttaaaacctaccaataaatacagcatttaattcagagtagggttaaaagaaataaaaacaacaaagtaaaacttaaatgtatcactcactaaaattacctgttatattgattagggcataaccactcgggttttcttgacctgtgagcctggacttctcgtgtgtgttaaagcaccgccaaatacaacaatgactaatagcctttttaaatgaatctaagaccccgctgatggtagtatacatcccaatttcagaagtgttaaaatgtgtattttagaactgatcaaacagtaatacattaagctgaacccaatcaaaagtacatttcctgcttatttggataatgatgcacaatgcctggaagagaatgagaaccaggcaaatatttactgaatcaatggatagtctaagaggtgacagtcatctgtgaaatatggaattactcgcagtttgccgacacaccatcttctttcctctctacacttgcctgggacacccctctcttagcctttcattataaggaacagtcagttcaataatacaaataatacgaatctctcttcactatgcatgaagtgatcattccttgcaaactagaaacacgaacttgttaacctccttcaaggatgcaagacgactcaggaatccttccatgtactctgcattcacaaatacgtgtatgtgtgaacttagtctacgaggagactaacaacagcccatttaccagcttcaaacgtgcagggtgtgtgtgtgtgtgtgtgtgtgtgtgtgtgtgtgtgtacacatgtgcttcagggcaaggcatgtgctatataatttattttataagtttactaccaccagatgtacagtgtcagtatcacctgtgtaaattagacacaactgggttttgtattttgcattacctagataagtatttctctgcattagagctacatggaccaggcctatttagctacttccccctcccattcttggaggataaaaacaatttgttgtcctcataggttctctgagcatctaaccctatatatagcaccaagagaaaccaaacagagcactgatgccatgtttgctggaataccaacaaggagagtagaggacaatgagtagaattagtacaaaaataagccaggcatggtggctcacgcctgtaatcccagcactttgggaggccgaggcaggcggatcacctgaggtcaggagtttgagaccagcctggccaacatggtgaaaccctgtctctactaaaaatacaaaaaaagtgcacacatatgtttattgcaccactattcacaatggcaaagacatggaatcaatccaaatgcccattaatgatagactggataaagaaaatgtggcatatatacaccatgtaatactatgcggccataaaaaggaatgagttcatgtcctttgcaggcacatggatgaagctggacaccatcatcctcagcaaactaacacagaaagagaaaaccaaacaccacaagttctcactcacaagtaggagctcaacaatgagaacacatggacacagggaggggaataacacacactggggcctgtcagagaagggaaaaggggagggagagcatcagaacaaacagctaatgcatgtagggcttaatacccaagtgacggattaataggtgcagcaaaccaccatgacacacatttacctaacctgcacattctgcacatgtatcccagaacttaaagcaaaaaacaaacaaacaaacaaaactctgatgccatctctggcatctcaggcaatttctgctttttctaggttttgttttgtccatacacggtacagacttcctccacagagggattttacgagaactagaaccaacaggaaaaacttgggtgagaggtactaacataattaacaaaatgaagaacacgccaactttcctaaccagggaagaaacacaaaacaataaaggaagtcacatttccctccttttcccatcactgaagagacggcagccaaatggtcatgctcacatttggtgcatgaaagtgctctggcagtaatgatctacaggcagtcattggcatgcttatggtcactcacttgcgaccttgtttcttgagtttgtcctaaaacttctttttgaaagaaagaaagactttgacataaaaatgttcaatgtagcttcagaatcacaagaattagaaattacctcaatatctaatagcagggagaccactaaggaaattatagtatgaggccaggtgcagtggatcacaccctagaactttgggaaactgaggcaagaggactgcttgaggccaggaatttggaaccagcctggacaacatagtgagaggtcctgtctctataaaaaataaatacgaaactgatccaggtgtggtaggatgtgtctctggtcctggctacttgagcggctgaggcgggaggatcacttgagcctagaaggtcacagctgcagtaagtcaagatcacaccactgcactccagcctggacaacagagtgagactctatctcaattaaaataataataattgttattattattgtctttgtgttaacctattcttgagactggtttggttctggtgtgtgtgtgtatgtgtgtgtgtgtacacgtaaatatacatatatattgttctacgtgattaaaaaaatacacttcattcatcttccaagtaagttagccttcttgtttccattaaaatgcaggaggtgggtctggttctaccaaccttgctcgagatttatccccaggtcacccccgccccaggactctggcagagctagcgtaaggcagagcactggtggctgatcctgatgtcacctgcaggccacatatgcatctccaccatctccagacgtcggcaatgccacagcatgactctggggatacagcttctagacaataagcagcaagttagagactagaacaatttcacggataaaagacacctgctggtgatatatgacttcaaacaatgaagaggggactagaaggctggcattctgccaaccaacacctaagagggcaggggagccatagagtggggacagtaaagggcgggacactctctcccaacaaccaaggaatagacccacctggaaggcagagggagtttcttcactgggtacaaggaattagagtaagaagttattttttttttttaattagaaacaaatgaaagaatcccaccaacttcactctgtgaactatgattttaacgttaagagtaacaaagatgggaaatctatcaaaatcctcaattttgtattacactgcacactcgtgaaacagttcctaacaagcctagatgaatttcagttcttttaagccaacatttgaaatacaggtccccagtcccaccccttcctcagcagtggcccacttcggtggctgttttctaggagttgttcctggagttggtctggagtcagcacctccagccctcatactgatctcccagtgagatacgtggatctccagagttcagtactcgctacactgatggcactcagaagtttgtggaatgaatggacaaatgaatggatcgttatgcttcactggagcaggcaggatcaaccccctggaagggttaaagaaggtgctgaacgaaactctgcttttcttgccttcatgcttccttttttccaaaagggtaaaaagtagctgcattaaatccctttctgttcagatgtcctagaactgctacaaggcccaccacatatccccctcatctccaactagcacagggtaaatagtaacattctactgtaccacattttctagaatggctgtatatatgaagttacaattcacgctatgcactgctaatgaactttccacaatgccataaatgaaatatgtaatatcatgactcccattttacaaatgaggaagcttgtccaagtttacacagttaacagcggaactgggactccattctgctatactgcctcccagtaaaagtttacatggtgaatacagaacaaatattcaaaagagagaaagaggggaaacagaggtgacagaggatccagtgttggcttaataggtataaacatggtctgagcctgattataggcaaaagaaacaaagaagagcagaaaaaaaggagtcacatgcatggatagcagggtgctacaaggatgtctaataacacagacctgtggcggggagggtcacaggataatggcatgcttaaggcggcccaatagacacaggagaacactgatgcttgctggcaggctgggaaatagaggtgccttgaagaatccatggggagcttatactggaagtctgttttgggagtaaaaaaggatgaggagtgtaaagttaaagaaaaggactgaaggccattagatgttcttcagcgagcatactcagctgttaagtcaaaaatactgctgagctgaggccgggcacggtggctcacacttgtaatcccagcactttgggatgccaaggcgagcggatcacctgaggtcaggagttcaagaccagcctggccaacatggtgaaaccccgtctctactaaaaatacaaaaaaaaaattagccaggcatggtggcagatgcctgtaatcccagctactcgggaggctgaggcaggagaatcacttgaacctgggaggtggaggttgcagtgaaccaagatcgcgccactgcactccagcctgggcaagaaggtgagactccatctcaaaaaaaaaaaaaaaccaacaaaaaacaaaaacaataaaataaccaccgagctgaaagagatgggcatacaattcctacagcagaaggaaactcagttctccgggggcaatacttctcacttacaacttgagtgtgctcattgaagaaaccttggtgacctttagggattttctttaaattataccccctatccttttcgtacccccaaactcagtggtaagtatttttctttttctttctttcttttttttttttttgagacagagtctcactgggtcatccaggctggagtgcagtggcgtgatcttggctcactgcaagctccacctcccgggttcacaccattctcctgcctcagcctcccaagtagctgggactacaggctcccgccaccacacccagctaattttttgtatctttagtagagatggggtttcaccgtgttagccaggatggtcttgatctcctgacctcgtgatctgcctgccttggccccccaaagtgctgggattacaggtgtgagccaccatacctggcctcagtggcgagtatttttctacagttgtttcatgttctgagaaccaggagaaggatatttaatgttgttgggtgtgcaagttcaggtctgattcagcgggttcagaagtaactgaataacagcagggaaccagtatagggaatatcaacaagggagctgagctttgctaataggccataatttatttaaaaaaatttagtctcataactctagagttcagtacttggttcactgatggcattcagaagtgtgtggaatgaatgaatgaatgaatgaatgaatgaatgaatgagtgaataaatggttatacttcactggagtcggcaggatcaacaccctggaaacgttaataaggtgctgaacaaaactctttttttcctttattcttccttttttccaaaagaagaatagcctatgaagtaattcttcttttccctctaactgcaatagatacataataccatattttcactaacagcaaaaacaattcacattagaaggggttcttccattcaccagagttaattttttaagtggataagcaattaaagatgccaagtagattaaaattgatccctagcataaaagttgtgatcaataaaaaaacaatctgtaaatttgattgcataaatcctttttacttaagtccaccataagcataattttcaggatcactactttgatctcacttactggaaaataaaatgcaataaaaatattgctgcaaaacctagtttctagaaaataataaataaaacatccattttaaaatttttgaaccacccatgggagacaaatgcacaatgattagactatgctactactaatcaaggaaaatgcaggattaaaaagtcccttgggatctagccaagttcctaaactaacaggagaaatgctttctgaaatgcagcttgttttatttaactggttccaacggccccttactggttttcatggtttggcaactttacacattgtctttggattcttgctgttaggatctagctcacacatcatccatctctcctcctgctcacttacgcatctgttgtcagttctactggattcctgtgaaactccaaatagcgtacttcactgttttacctatgagatgtatgtcttgctgctcagtttgtatgagaagcacaaccacactcagcttttcagtccctttcccctcctctgcttccccgcccacctctgtcaccctttaccttgtcaaatgtagtaacattcacactctgttcagtagcaactgttatctttcatgatttgtctccagattcattaagttgacacattccaattttgtgtgtcatgacatataaacataatttacagtattaactatacagatgatacttattacaagagaatgcataatatacaggtattactataaatattgtcatattactagatattactgaatattaatatactatacagatatttgtaactatgcagacatttataatcctagtttgttaggattacatttccttctcaatgggttcacggtgccatccaatggaagatgtttctagtatcaaaataaaaaagaccctgtctcctccctcatgtaatttgcttttatttcaagatactaaaaaacctgagagatctccccactctattcccttcccagagaggacttacttaagttccagagtgaagccagcccctctccccggccctctcccgcagagggaaggaggggcaggcacgcagctacactatatgagctcacgtctgatggtttagggaccctctcctgtagtacaacccggctgcacatgcacagggttagaggctgaactgtgtccccctaaaaattcagatattgaagtcctcaacctcagcacctcaaaatggaactgtatttagagacagggtctttccagaggcgattaagttaacatgaggtaattcaggtgggtcctaatccagtatgactcgtgtccttgtaagaagaggacatttgaacacagacacacacacaggagaggtgacaggaacacacagggagacgacagcctctacaagccagagagaggggcccggaacagagcctctctcacggcctcagaaggagccagccctgctgacaccttatcctggacttctggccttcagagctgggagaaatgaatgtctgttgttgaagctaccccaggctgtggtactttgtcccagcagccctcgcaagataacacacagagtaacatcagccttttcccatccagtcctgtggtaacgggagcattaaaaagctctgcgaggaatgcgtgctttgttcttagactcagagatcccgtgtttcttgtcagaatatatctttctctgtatctgtagctacagacttagcagcagggagctctgtgtagcacatagggcttgtcaatagacaggtttcactttagtaaaagtggagacaggggccaggtgcggtggttcatgcctgtaatcccagcattttgggagactgaggtgggctgatcgcttgagcctaggggttcgagaccagcctgggcaacatgatgaaacccgaaaccttgtctctaaaaaaagtttaaaaaattagcagggcatggtggcacacatctgtagtctcaacaactctggacaagcccctggaagttgaggctgcagtgagccatgatgatgccactgtactccagcctgggcaacagagtgagaccctctctcaaaaaaaaaaaaaaaaaaaaaaaagggtagacacaggtgatccctacatccaggatgaggaggcttttactctgaggtatctaccctagttatccccagaaagccattccatttctttaaagggaggaatcaccctaaggcagcttcatcattgtcatcctccacctgcttttcatctccccaaattcggtttaaatcttatctgctgataaccacctttatttcctttgatgttgtagatgtttaactattagttttgtataatcttttcggagggttttaagaaggggagaagataaactcaacacgtgatcccatggccttattcaagtagaagctccaatctattttttttaacattgtttcctgatattaaatcaaataagagatgtagggttctcctgattacaattaactctctcatatggctaaataaggacatgacaagttatgcaaaacgtttctttaaagctctcttgaaagtgttcaaggaagtgggaagacatagaaatctttgagggtagccaaagggaaggaaataaattacatgtctcagaatatagaaataaagttactgggccggcatggtggctcacacctgtaatctcagcactttgggagggcgaggtgggcagatcactacaggtcaggagttcgagaccagcctggccaacatggtgaaaccctgtctctactaaaaatacaaaaaacattagccaggtgtggtggcatgcacctgtagtcccagctactcaggaggctgaggtaggagaatcacttgaacctgggaggtggaggttgcagtgagccaagatcatgccactgcacttcagcctgggcaacagagcaagactccaactctaaaacaataaatcaatcaaaataaagttattgtatcacagcagctatgtcatctggaaacaaaatattctatttaggtatggagtggtttagggttaggtctcctttatgagtagaagggaatatatttaaaattttttttaaatacaatttcctatatttcagtttcagaactggttctaaatcactggctctgagcaatttcgctagaaatgctccctaatgacctgccctgagctaatagcatcgagatcattgattagacacaagacaaggagcccaggacacagggcacagctaagctttcacagctcagattttcagcctttccatcaccacggtggaaggggaaaaaaaatcctttcagttccctgaaggatgtgttcttgcacataaattggcatttaggttcaattagatactgaaggcctggtcctttaaggccagccgggtgggttgcggctagatatgcctcggcgcctctcctctgtcctattactgggcaagtgtcctctggctgtatgtgctccaagttataacctaacgaaagggcaaaaaggtagaagagatggctgatgaggaggaagaggatggaaagaaaaggaagacaaagatttccctgactatgcacatagccagaatctcagcaggtgaaattacacagcacagagaatctcgatgaagattctaatatagatcacacaactctgaagcttttctctttaacatgagactcagttaagggttggaagggagctggtgagcaatgaaacagtaaagtacaagagggctccagcttcccgacctcactcacagtctaggctagattagcacatgccagacacagttctgttcactttacagccattgctcatttaatactcacaacaatgacactcacagtatcttcactttacagatagggaaaataaggcatagaaaggttaagtgacttgcccaaagtcacacagctagtccaaggcaaagcctcagctctgacatgggaggccattccctaactctttgttcactgttttctttaaaacatgatcttggaattactttctctcatttagcaatatcatgctaattcaagagtcagtaaaatgtgtccttgaaggtaggtacaaaaaaggatgttccctccaaaggcagccctcatcacagcctgaaccttcaaagggttgtaaggagcctcagatgcacagctgccttctctagcaccacacttttggttccactgcttagacaactaaggagaatgaagagcttgttccttattttccagcttctagaagggcaaaggaagggaataccatgagacagaggccacacagcacccaaaaatagaagaccattttttttttttaggcaaggtcacccaggctggtgtacagtggcacaatcagtccatagcagccttgacttcccaggctcaagtgatcctcccagctcagcttcccaacctgctgggactacaggcacatgccaccatgcctagctaaatttttttttttttaattttagtagagatgaggtctcactttgttgcccaggctggttcttgaactcctgggctcaagtgatcctcctacctaggcctcccaaagtgctaggattggccgggtgcaatggctcacacctgtaatctcagcactttgggaggccaaggtgggtggatcacttgaggtcaggagttcaagaccagcctggccaacatggtgaagccctgccactaataaaaatacaaaaataagccagatgtagtggcatgcacctgtaatcccagctactcgggaagctgaagcaggagaattgcttgaacctgggaggtggaggttgcagtgagccaagatcatgccactgcactccagcctgagggagagagttggagactgtctaaaaaaaaattatatatatatatatatatatttgatttggacactgactctgtatggagattttaatattcagtaaaggcagaataagttgtggaaatacctcaaataaacagaagaggataaggcatcagtcaaaccagggagggataaatcagataaaatgaagaagttcaaacataagcaagtggtaaaggagccaaagattcccaactaaaatgactactggaacaactgcagcttgaaaatatttcctgcgatcaaaatttgctcacgagctatggacgtgagttttgggaagagatgattctcctttacacaactgcccggattgaagaggatttgctagaatttagtacagtggacctgtgaatgacacaggttggaactgcatgggtccacttatacgtggattcttttccaaccaaacgcagactgaaaatatagtattggtgggacgcaaaacctgtaatgtacagagggctgacttttcctaggcgagggttccacagggctcactgccagacttgagtacgcacggactttggcgtacgccggggtcctggaaccaatccctcacagatactgaaggatagctgtatttatcccctgacacactgcagctcttcatgaatactgggagtcactatactcacctaagttctacacactgaggtaatgaggttccagattccaaatgtggaagtgaacttccttcttttctccttgtgagtgtgtgggagtctgtgggagtgtgcatgaggggagaaaagggaatgtcactgagcaccagcatgagcatgtccaagtgtgaccaagatgggccaagcattgaaagtagccaggtgggcgagtggccaagcgccagagaggccaatcccaagagtgactgagcccaggggtggccgagcctgacactgtctggctgctttcagtggtcccacagattgaggctgtgtatgaagagactcttccagcaaacacttttttttttgagacggagtctcactctgtcgccaggctggagtgcagtggcacgatcttggctcactgcaacctctgcctcctgggttcaagcgagtctcctgcctcagcctcctgtgtagctgggactacaggcacatgccagcatgcccagctaatttttgtatttttagtagagatggggtttcaccatgttggccaggatggtctcaatctcttgacctcgtgatccgcctgcctcggcctcccatagtgctgggattacaggcatgagccaccacacctggccccagcagacacttctaaggcatcctattctgaggtcaaaaatacatttttaggctgaaagatgagaataacttctttggagaaagcaatgagcagcaggaagtgtggggggtcaggagttaggctaagcactctgacacctgttagaagccttctcgagaacagaagattctcgagattcccaggtgagggtcttcagcctcatctcacccattccccaatgtcctggccggacaaaagccacaggctgggggaagagccatttctagcagagcaggcaactgcttctaagatttaaagtaaatgggggattccaagacgtctgattcagatgatcagtaaagtcactgatggtttagtctttcctaaatacagtcataaagattttaatttcacattatgtcaagagttttatggagccaaggatcttttcagtacgaatatgcctatacaaaccccacagaaatcaggcggcaaaagcaataatcataactatcaccttttgggtcaaaaacttgattaaagccaaatgacaactaaaatgtattttattagcagtaagatgaaatccagagcatatgtcaaagctggactatgaagtcataatttctctagatcacagttggaagcagtaattttatcactctgtccctccctagcctgtaaatccaaatatagttcagacagcagctctgggctgcagggtagtatcctactcactgtgagactctggggaggagctccactctcactggcccaggcaggccacacccagcctccctgctctcccgagtttatggccctgggcacctctcccaatccagggcagaatcagctgtcacaggagtaagatgctgccacacaccctggatcagctgtccccagtaggcatgccatggagtagtctaattagcctctgtgaagatgtcatgttttgtgagcaatgaggaggacctagacaattttagacatgagaacattccttcgggcatgtcagaggtgatgctctttccatgggcccttttgtgtgttcttaatacccacaaagacctgattcccatttttaaaatcaaaccaggagtcccctggcttagagtggccttctacaccccaccaccaccctgcccacaactaacacatcaccttacccaagaatgtcatgcaaatctgctcatggtctctccccactcctatccccagtgccacgtccgaaccttcattcttattacggtttgcttgtattcgtagcagagtcccacaaaagtcccccgagaaaatctcctagtcactgtgacaaaactattctggaacacggccccacttacacagctccatactggtaagggccgatgtccttccacagtcacctctcccactgcaagacaggagcaagagctacacttaccctggggctgcaacaggatgattatttgcttaccaggacagtgaaaatcctgagggaatttttttttattatactttaagttttagggtacatgtgcacaatgtgcaggttagttacatatgtatacatgtgacatgctggtgcgctgcacccactaactcgtcatctagcattaggtatatctcccaatgctatccctcccccctccccccaccccacaacagtccccagagtatgatgtttcccttcctgtgtccatgtgttctcattgttcaattccctgcacagcaaaagaaactaccatcagagtgaacaggcaacccacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactgctcatcagggaattttttttaaggcggtaagtgtcaaggcatgatctaagcttctttctcatgtagtcagaactggaccaaaattgcctgttgaatgtcaataaacatataaaaactgcacggcggctgggcacggtggttcacgcctgtaatccagcactttgggagactgaggcaggtggatcacctgaggtcatgagttcaagaccagcctggccaacatggtgaaaccccatgtctacaaaaatacaaaaattagccaggcgtggtggcatgtgcctgtaatcccagctactctggaggctgaggcagaagaatcgcttgaacctgggaggcggaggttgcagtgagccaagattgtgccactgcactccagcctgggcaacagagcaagagtccgtctcaaaaaacaaaacaaacaaataaaaaactgcatggcatttgacattcttggtattgggacctgacctgcttattgttcagaaagctatttataaaagttttgtgaaaacctgaagcattatacaaactatatgctatactgtaaagttttaataagtggggatccttttaaatagaaacttctgctaataggcaactcgaaatccccaactacacatcatctttctactttagacatttaaaaatacagcacacaaaaaacttcatcttggccatgtccacgtcaagtaggaaaaagtccaaacagaatgaaagtgtctgaattataaatccttgtgaaaatactattaatcaagagggaattaatgttaacttatctagtgggtactattatctataactctttaatatcaaactcacaaaattagcagcaggaatataattatacttaaaaaaattattttcttagtaaggttggcccatagaagaataaggattagtaagatgcacagtggtcaaacatgaagaaatgagtgaattttagggaaatttgcaagtcggctgcaatcatgaacattgtatcaagccaagtaatgaaagccactcctgcctgggtgggctcggtccagcccagcccctgttgatactctgatgcattctgcagctaaccaagttcttacagcggagaagggaagaaatggcaacaaaatacacattgaaaacaaaataaatatgtttcctgaagccaatatctgaataatccttaggtaatgaccatttatacacttgataagtttcccaagtttttctttcctctttcttaagtaaaagggaaatccaggccaatttttaagccggataatatttagaaactattttttttaggtcatttcatcccatttttggttgactagtgtaaccaaggcagcaactggatttcaaagcagcagaggaagacattctgagctcacctggagcccaacgctgggacgcagcctccaccctcccaggaaactagacacttacattcccttgccctcttgcccttctgcccttcctgccaccaggtagctggtcacaatgggagttttctttctttctgcagtggggtgaatgatcacacacacacacacacacacacacacacacccccacaaccaactcctagtacccacattctgtaaatgtttacttacttggaaaaagggtctttgcagatagaatagaattaaattacaatcttagccaggtgcagtggttcatgcctgtaatctcagcactttgggaggccgaggcgggcagatcacaaggtcaggagatcgagaccatcctggccaacacggtgaaactctgtctctactaaaaatacaaaaattagccgggagaggtgatgggtgcctgcagtcgcagctactcgggaggctgaggcaggagaatgacgtgaacccgggaggcagagcttgcagtgagccaagatcacgccactgcactccagcctgggcgacagagcgagactccgtctcaaaagaaaaaaaaaaaaaaagagagagacagaaaaggagaagacacacacacacacagaggagttcacatgaagacgggggtagagattgcagtgaaatagccacaagccaaggaatgcctaaagccacaagaagctggaaggggcaaggaacggggcctcccctggagcctccagagggagtgtggccctgctgacaccttgatttcagacttgtggcctccagaaccgacagagaattattttcagctgttttaagctgccagtttgcaggaatttgttacagcagcaccaagaaacgtacattccagatacacagatatattactctaatttttggagcagcaaaggagcatcacttaaacagttaacagggaccaacctcccgtctttagagcaatctaagcatttgttctctacaattagattaaatgggattaaacacaggcactgcttcacatatgaaattgctgtgcaaatacacacggctgaaaaatacgagaggtcaatggacagcattagcatgtccacttcatgaaaaaatgacacacttctccgtgttggtttagtggatactggatccagtccaacgtgaatggctcactttcagaaatgaatctgaaactgctgaccatcttctttggagtcacatgctaggaggtagcctgggaagaggcctgactctgaaatgtctcacacacactgtaaccactcactatttttgcaagaacttgcttttctttctagatataaacataagtacgctttgctcactgatggagtgtaattcttgaaagaagggagacgggagaggtggtagcccagggaagaaaggactgagggagagcagatagcagcagatgacctgagaggggaccagatatatgccagaaggaagaacttcaaagccaacacacaaaatacaggcaaaagaaattaacaggcacatcacagaagacatcccaacagtcaaaaagttcttaagaagatggtccagctcactggcaatatcctacacacatgtttctgaaaattccaaaatgtcttcagacagaagaaccttcaaacccaaatatggatccctaagatcattttccaacccaactacattaacacaagtaaaactccagagagccacatgatgctgcctgtgaacttaaatgacaaattctaacgttaacatttatttcgctggaggccaagatgacgtaataacaaaagtgttatgtagcttataaatggcctacttgtaatttgttagcacaattttggaagtgctttccaaggagcaagaaaaacttcaaaacataaacaaactaatcttcactatggctccatcactcataataaaggttaaggatgtaccttaaatagctcacaaacaggaaaagcatgtgtggatttctttgagaagcttgtaacatcttgtaactttacttatcctagtagaagctttattgctaatttttacataatcatagaactacatgaaatagccatattgcctaacatttatacttggctttaaaaaaattactattcctaaatacaaaaataacctatcattagaaaaggtaggtgaatatttaaaaaaatttttttaaaataataattcagtctacctttagtgttgaagtactgccttcataactattgatggggactccaaaaatatcctctatggaaaaatattcaggtatctaaaaaaggattcatctgaagaaattttatagtaatggtttcctttgaaatatttttggacctcttatagtgaaatcatgagccacaaaaataataaatgtctcccatattttaaaactaagtagtgacatatcgtcattataaagattataaagtaatcttcctatatgatgagactaaattacaattttgcttttattttatttcaattaattaatttttttgagatggagttttttgctcttgttgcccaggctggagtgcaatggcgtgatcttggctcacttcaacctccgcctcccaggttcaagagattctgccgcctcagcctcccgaatagctgggattacaggcgcccaccaccacgcctggctaatttttatatttttagtagagatggggtttcaccatgttggccaggctggtcttgaactcttgacctcaggtgatctgcctgccttggcctcccaaagtgctgggattacaggtgtgagccacagcaccaggccacaatattgcttttagattaaatttgtaatcttcagtggaagaaaaatccatgaggatttttgttttttcaaagaggggtgggacaacaatataaagatgaaactgtttggggtgggtattttatagtatataaattatacctcaattaaaaaattaaaatgaccttaaattttaaaacgacagggacttaggcgtgaaaaaaccttttggaagcatttagttcttttccatcttacagccataaattaaaggtatttcttaatttgctaaaaatatttcaaccgaattggcttatatttaagttttaatgggtcaaatatgttaaccaaggatattcttttggcttttcggggaatttgtctgtcttcaaacaaaacaaacaaaactaaaccactgtccgaatagtagagacaatttacaatgtgtgtcaagatccagagttcatgaaatgcgataataaatagcccaaaccacgagtacattatttattattactgctctaagagtaaaatgctatggtcatgtgaggtctgtgtaaaggataggacgatggcctctgccacgtgatctagaagccacataacgcaacttttgtggaaagcaagaggattcaatctgtgtgtgaagatggcaagggctagggctgcacaacgtggtggctaagagcacgggagtcaaaatcctaggctgggaaacagtatcatcttgggcaaaacactatcatcttcaggcaggcttctcatctgtaaaatggggataatgcaacgtacgattcttgtgaactaatcttgtgaaagcagtaggcaaacgcctggcttcacaggcaactaagacgtgagctatgttcctcaactggctgggctctgttctgcagccacagggtaggcctggcatcccagaaatgcttgtcattgataacacggggacatcaagtcagagaattcgaatgtcactcctgaaagtctaatgaccctcagctgtcatccacagctcattggaaaactgctaggtaggacccactaaggctgacatatgcatacctcacaacccagcaattctactcctgggtatacactcaacaaaaatgcttacatatgttcaccaaaagaatcagatggttcataacagcatgattcataatagccccaaaccagaaacaacccaaatgcccgttaatagtagaagataaacaaattgtgggatactcacccaaagaagtattttatggcaatgagaatgaacaaactatagcaacaacacagatgacaagtcagaatgcaagaggccatggtgtatgtttccatcggtataaaatataaaaccaggcaaaactaagatagcgtcagaaatcaggacagtgttccccaaagggaggatgcagatgggaagggacctgaaggtgcctctgactgctggaacccatttcttgatctggctacatgtgagagagtttaggccgtaaaaattcaaatgctgcaccctcaggatgtgtgcacttttctggaggcatattatacttcaataaaacttctaagaaactctctggccaggcacagtggctcatccctataatcccagcacttcgggaggccaaggtgggcagatcacatgaggccaggagttcgagaccagcctggccaacaatgcaaaacctcatttctactaaaaatacaaaagaagttggctgggtgtggtgacgcacgcctgtaatgccagctacttgggaggctgaggcacgagaattgcttgaacccgggaggtggaggttgcagtaagccaagattgtgccactgcactccaccctgggcaacagagcaagactcagtctcaaaaaaacaaacaacaaccaaaaaaactatctttattattgataaaacaattcaaggccacgaatccagggtagcccacaccaccctactctgaggccctgaaaaattctgcagacctacgtcagcctaaccagcaggatgaggggccccgggccagggagcaacatcctctctcaccaatgatctctttacatttctaagcctggcatctctctgttgctttgcacatgtctgaaactgagcagttcttcctgccatgtcttatcttctagactttggtggccatctgtatggaaggaatcttcaggtaaaagacacgccacaggatactaagctgaaatgggacccaacttcttttaattaaacacatcttgcctcaggcaagttatttaaaagaaatatctgttaagatactagaaagaatggtggctcacatctgcaatcctaacactttggaaggccaatgtaggaggatagcttgagtccaggagttcaagaccagcctgggaaacatggcaagaccctgtctccacaaaaaataaaaaattagccaggtgtggtggcatgtccctgtagtcccagctacttgggaggctgaggtagggcgatcacatgagcccaggaagtcgagactccagtgagccatgatcgtgccacagcactctagcctgggcgacagagagagaccctgtcctccccgcccaccccacccccgaaaaaagaaacaaagaaagaaaaagaagtatctgttgagatattaaagatacatcttttaagaaactacaaaagaataatttgtacaaaatttaaatgaacactagtaatgtacagaattttctaattaggcatacatcatatcctactaatcttagtgaattcaaagttactagtgtgcgcaaagttattttaaaatataaagcatgctggaaaacaaaagtttctgaaattctgtacattcacttctaaaatgtcaaactaggctgagtgcagtggctcatgcctgtaatcccaacacttaaggaggtcgagaggtaggaggcctgcttcaagcccaggagttcaagaccagcctgggcaacaaagagagaccccgtcactatgaaatattctaaaaaattacctgggtttggtggcatgcacttgtagtaccagctgttgggaaggctgaggcaggaggatcactagagcccaggagattgaggctgcagtgagccatgatcataccactgcactctagcctgtgtgacagagcaagacactgtctctgaaagataaaatgtcaaaatgactacttatttggatcactatgcatgagaaatagtttcttctcaaagtaaacacatgctcatatgagaatatttcagtcaataatgctccctctctccggtgcagcacagggaatgtttagggcacagaaactataaaatagtgtaaaggtggatacgtatcactatacatttggcaacacccatagaactccgcagcacgaggaatgagccatcgtggaactgatggacttcaacaacaatttatgaatagaagctcgtcaattgtaataaatgtaccacactaatgaaagatgttaataatagggggaaacggagggggattcggcgggcgagacagaaggacagggagggagtatatgggaactctatactctgttcaatttttctgttaaccttaaactgctctaagaagtgaagtctattgattaaaatataaataaataaataaataatgcttcctcccgccttctaagatgcccacattttacctttgatcatttctgcaggaaacacctagtttagaatacacaggccacaggaaagaacaaaagctttcactattttcagggttttgtgcttgtatgtgtgaacatctttgtcactcacggtcagtgatttatacagacatgatcttaacaattcagtatggagaacgactatcttttttttttttttgtacttggctggatactgtcctgtgtaagaaaatatattggaaaatgtattcaaataaaagcaagaataagggtcgactttaataccgtggggagaaatccgatcgattgggtccataaggaaagatgtatgcattcggtgctccctaattacaactgctttggtgggcagcagcagtggtgaaacagatgttggagacctattaaagacggggtttcaaacatctgcttacaattttaaggcaattgtaaatacagcagagaaggtcaattgggccaattaaggccgatgtgcaaatccaccactgcaggtttcttttcaagcttacatggacttgattttttatgctttcattttctacaaccacaatttttttttaaacccaggaaatgggtttaataacttttgtccatttttgattgttattcttcttaaatggaagaaaactttctgttcaaagaagtcactgcacaccttttgcctcacgatgactcattttccttccctcccctcccatgctcacagccggccactcggccccgatcaaagcgggttccatattaccagggaggtgaggaatcccgaatactgggcttcctttctaagccataatgaacatgggcaagtgtcaccttcagaaacttccgtgccgcggcacacaacagtgctcccagctgtacggatgggactgctgggagcatttgctgcttctaccctaggcaccttcaccagcctttattagaaaatcatgagtttcatgaaccgtaaatacaacggcaaactgcactatccctcttctaagtaggtaaaactgaaattctcatggtatgcaaggctcattcatgtcagaggcagtagcagggacacgctcccagttaattccaggccagtgctacaaagtctaaggcccacttgctgctcaaaaattggcccccagtggtggagcgggacttagagactgagggtcggcaaagaggcagagcagtccagctcaacattactaggtcatttctcttaaagctgcacgtgtaatcgttacttgtgctaagtaggtaaaaaaaagtccaagtatcacaggcatcaaaatggcctcctctgggagagtaagaaataagcctggcctatcttccttcctatgagctctgtgatggccaccggagtatattatgccacctcttcttggtggcccagaccactcaactgctctctttatatagagaaaaaaaccaaggttgggcaaacctagattcaaattctgcacttcttagctgagtgacctcgaagcctctgtttcctcatctataaaatgggaatattgccatttctagagctctaaaagttgatacaaagtaggtactcaataaatgttgagttcctaaaggtgatacacagtaggtactccataaatgttggtttcctaaaagtgatacatagtagacactccataaatttagtttcctaaagttgatgtgtggtgggcactcagtaaatgttggctttgtaaagttggtacatagtaggcacataataaatgttgcttcctaaagttgatacctagcggcagtcaataaatgttggtttcctaaagaaaatacacagtaggcactcaataaatgttggtttcctaaagttcctatacattaggcactcaataaatgtcgaggtcctctgtcctcctgagacctttgggacctccaccaagacatttccaaggggcctagactggtgtttccaaccaggcagggcagttcccctgaatgtttctatttgtttattttcggggggaggtatatccagtttttgtgctgttgttgatattgttgttgttattatttgctttgtttttggcgaaacaaagagtggataatgaaactacaaaaaaattctaaaagaagaatccttgaggcagcagaatgggaagaaatagttttcagaacaaagaaaattctgaaggaaagtcaatataccgcacagaaatctaggttgagaaagaactgtttttcccttacatctcctttttacttttcaaccttgaggctcagctcactcaggtctgagcaagaataaagagtcctgcttgtctaaacaactgctaaatctgaaggcaaacagctcaactccatgtggttcttcagcaacattcctgtcaacaaaccccgtcttggctcgattggtccaacaataccagatttagagccatccgctcatccttcttccaggatgcaaggggattttcaaaaggccattccaggaacagctctcacaatttttgtagccttttcaaaaacacaaaaaatctaattcatttgctgcactgcttcagccatccagcttaaactaattttaaaatctctccttttgtaaatagagatgttagaaacgccaccacagccacaatataaaatgatggtatctttctcttttgtaatcaaattaccatcatttattataaagcttcagacagaaacctgagagatgggcaagacgacctggcgttcagaagagagagatggcatttttgacattgaaataaaggcttggagggcataaatccttttttaaaaatcaagtatttagcacaggatttggtataaacactgatcaataaataagagccagcagtcatagcagcacgctagaatcaacatcatctgagttctagcacagactcgtttctatgaatcattgaaaaggaatttcatggtgccagcagcatcagtacagaaagtcagaataagcacttagacagtaataccagcaacttatttactatcctacgttagagtcagtttgctggattttatataaggtaagtaatggatatctaaggtactgtcaattaaaaaaagttctccaaagtaatttttatttaaagttgcatatgataaactgtaaaaccaaaataacatttgggtcaaaactccaaagagttgggctatcactaagctagaaagagaaaaacagcagaaagaggattttcttgctgatatgccaaaaacgtgactctatttctttcaacagggtttattgttttcttcctgttttacaacagcaatacatataagaattttttttaattcagaaaattgcagagataaggggaaatttctcccctaattctattccccaaagagaactgcctttcatgtattctggcaaaattctctcatcttctttcaatgcatgcagaaaccttttgtttatttacttttcgaaaacaaaattgggtcatacaataggtattgttttctgatctgcttttctaatttttaaatgctgtgcaacagttaatcaaacggatatacaattaacctcccattattaaacaccaagaacagcttctatttttctgtattataaatggcaaagcgacgaacatccacatatataaaactttgcatcacttcatctacttgggttaaattcctacaaactgaattgttgggtcaaaatacacgcacattttaaggtatgtgatatacaagacatgccagaaaaattgtgttaattctgcacaatgtatgagagtactcttttctccataactttgcccacataattgttgttttttttttttttttgaaacagagtctagctctgtcacccaggctgaagtgcagtggcataatctcggctcactgcaacctctgcctcccgagttcaagcaattctcctgcctcagcctccggagtagctgggattacaggcacgccccaccacgcccagctaatttttgtattttagtagagaggggattttaccatgttggccaggctgatcttgaactcttgacctcaaacgatctgcctgcctcagcctccaaagtgctgggattacaggcttgagccaccgcgcccagcctcaactgtaaagctttttgtatactgaaaatattaaacttttatgattatattccaactatttttcctccattagtaacctgtttcatagtgctgcttaatgcagagaattttattattgtagaccaatcaatctgcctttttcttttatcattttcccttggatttataagcttagaaaggcctttcctatcctaagagcaaatacaaaatctgctttacatattgaactaatattgggatggtactgatttttattgcaatatttgagaaggcaaaacagagtttaaggaaagaaaaaagaaatcccaaaggatggggaaagaggtgagaaggcttctaaaaataacatttggcagacaccggctcaatgcaagtctaatttgcttcttagttaatgaaggagaaaatggagatggcgaagaaataaaaggtccattctagaatggcaataataaaatcccctgtgaagacaataacaacattcttgttatacatggaaatctaatcctaaaataataacgcatatattgatataacagcactgtgaataaattccatttaagctatgttattttaacaatgacccagaaaatgttaaactaaagaagtttgttacatgcctagtttggcccacttagagagccacaggttctcagaaacatatctggaaaaggcctttttgtctgcaatcaatgcatccatcatggtgcaccaactggctgactacaaagagcttacacataaatatatgtgcatatacatatagattttacttgcatcaaaaggtaaaaatagaatttggtttattttgtaaagccattcaacgtaatcataatctcattaggatccagcagaaaagaatgactctggcagctttttgctgggaccctggtacctccttctgcgggtagaaaaggagcccctgggggcatctgggtggaaggaaggctcggaggctggagacttgcttgcctggatgccagccagtgtggcaaagatgtccagggcagcctagagtttctgctgggggcaggggtaggggtggtcagggcacagccaagtaccgggcagtatccaccccagcccccactgaactgccagcatccggctctgcctgtctttggcttctggcttgctttcctagcctgattctctgaccttcccctcggcattgagagctctccaacattcatccttccagtgcatttcttttctgcttaagtggcccaggtcaatttctgttgtttgcaatcatgaaccttgactggacaaactcttattagcttccggcagatattaaaagatgcatgagctcactttgatgcaaaagggcctcagcatggatgcacgccttatctatgagaaagctcctctgcttcctctcctggcctccttgtacttatctcatggtttatacttgattttgttcctttcaactttcttcttttcatgcccaactcccctccctaaaatgggtctggtggcagaggtgaaggcagagagcagaggtgagaagaaaataggaaagtgagtaacttttggatattacttttcagaaaacattctgtgtggcagtggccactttcctgtcaaaggcttaacatttttttcctataaatacattaaaagtgagtcagacttggatttgcaccttaacattattgccaacactttaaataactatatgttctctacaaatgttctctactaaagaagggactcggagaatggagggagcaaaaaggagaatggggaggcaactccggggcagctcacctgtctggccctgtgtggggtttcctctttagaattcagcaggctgtagggaaggtgaacactgggtactaggtaacccctgacctggtcagggagtctgagaaaatcggagagactgctctctatcctgcacccccaagccccaagctccacaggcttgcagggttgtcttgggaagcccctcccagaggccagccccaattcagcagggtgacggggcatggaccacacacgcatgcctgtccttagcgccttgagtccggagacccctgttcctcccagttcccttccttgtggaatggcgaagggagaggtgtccccagggagggttttggaccgtagccacctcttaagattctggggtcgggggacaagtcctgagtccaagggaatagcagggtgacactggtcaacaggtatgtgagtcctggttgaattcttgccctcaaatgttcatgctacattttctgtgtcccttccaccctcaatctacagcgaggagctcccctatcctgggccagtcggggtctacaagccagccagggaagcaaagggagagagggagaggccttcgaggacactacccctgctggaggggtgaggcgaggatatgccattgttgaggggctgtagcctacggccacaggtgatgggcagggtgggttaggaactgtgtactccaaaactggttgtggtttctctcagcaaaagctttttgtacctcccctccctccatggaaaaacaaaaaggttatgagagagaaagatattaggttaagagccttctacatttcaatagagctaccatacaatccagcaatcccaatcctaggcatatacccaaaagaatggaaaccaggatactgaagagctatctgcactcccatgtttattgcagcctattcacagtagccaagacctgggagcaacctaagcgtccatcaacagatgactggacaaagaaaacgtgctgcagatacacaatggagcactatccagccacaaaaaagaatgcgatattgtcatttgcaacaacatggacggaactggaggtcattatgctcagtgaaataagccagacatcgaaagacaaacattgtatgtccttatttatgtgtgggagctaaaaattaaaacactgaactcatgttgatggatggtcatcagaggctgggaagggtagtggggggcagggaggtaggtggggatggttaatggggacaaaatagtagttagaaagaatggaaaaaacctaatatttgctagcacaacagggtgactacagtaaaaaatattttaattgtacatttttaaataactaaaagaatataattggattgtttgtaacacaaaggataaatgcttgaggtgatggacaccccatttaccctgaggtgattattacacattgcatgtctgtatcaaaatatcccatataccccataaaatatacacatactgtgtacccacaaaaataaaaaataaaaattttaaaaagcttaagagtcctccacatttcagaaacatatatttttaaacattaggaaaaaggtagaaaaacagtagtctatggccgtaagagcccgcaggcaccctgcttgtccgatcacggacgctaagcggggttgggcctggctagtacttgcatgggagaccatgtaggaatgccgggtgctctaggcttaaatttaagtaagtctaagtaatttaaagagatttttttaagacgacagattataagtcaaagtgccaccctgtggcacccatgactgttcctgctgcagagatgctctgaggatgccattcgttctcacatggaattctttcatgaagatcccaaagaaattcctgtctggtctcaccttccagaatacatctacttttttctaagcgtctctctaagtttaatctgtgacttgttgacttctttacatcagctgttagtaaatctaaagacaaattcctaactgatgagataagctggattacctgaacattaccatggagcccctctgggttatctaacacgggaagaccagaggctttctctcctggcagagaggaccatacccagcttcccaggggccctcaagtccatgcacagggcagctggatttcccagacaattctggtcagcagccaacaaacaccccaggtcctgctgcttggtgccaggccagctgctgccccactgacaaggggctctcacaattcctatgccaaatgaaagcagtaaggaaacagagttctttctccaaaacacattcacacttcatggccagcacagagcccagcacacctctcagaggggtaccagaaggatcagaggaccagatccttggtacatctgcctctaaagcctgatcgttaagccatattctaagaccttgaggaccccaccccaagtcctagtgcacaataggtacctcctgcaaagatgcaacctgcctgaaaccatccctcagacacaggaccccgctgaggacatcacttcctcatccctgccagtgcacatctctggtgcagcttctccttttgcccctcccaattttaattcaggacctgacagatttataaattgcctccagtaatttctggaacacagcagcacagaagaaggagaaggagggaaaccaaaagaaaaaacacaaattctctatctttcaatgcaagtataactttttgccatgggttttggcttcctatgactcagtgcacactatcacctcgagattctcatgatgaataggattgaaaatgtcctaaaatagagccaccttcaaactgcagtaaaacaccttcccaagagggcacacaggtacaaatggtcttaagggcaaaaaaatccacagagcctcactctcccatatgtgctttcctaaaacacgttatttcggagcgagcttggagttcaggcacacaaagctctatctttaaacctctccttaaacaactgcctttctcccatgtgacaaagaaagggagagcactcaccctccctgggtgtaactatggaaggaagtatcctggaagcgtaaaaacctccatggggcaacagacaggtcatacaaaattctgatgacagcaaaaaatgtgcagatcaaggtttttataacagtatgtttaaaacatgggataaaatacaagtttttttaagtatgttattgtattgatgaggtagtattaaaattaaccatttcaattttctcaaatagttttaagtacagcagattaaactaaatgtctttaactaaagcactaacaggtataatgataacaatttggtaagtcacagtaaagtctcttaactatccttcagatattaataaagtgaataactctaataaccagtaacagattctttcacaaatcaggtgggttccagttctttgctttcaacaaaactgaaggaggacctaactgagttattaagtcaataaaaataattactgatgagagtgcaatataatttttggcatataacttgtaaacatttcaaaaaaactgagtggcaatgctgtttttaaaaattaattccatccaaatggaattaacatttgtttttgttgtagaaaagcatcctggagtgattaataaaagacttttcaagcataaaaatgggttatattagtatattgttctatggggaagaatggaaatatgagttcaaaaatataaaataacgatgtgaaattttgactattaaaaaagagtctcatataacttttaatggataatggcaggcatcaaataggtatggcatttaaattcattggataaattttagaaagacatgagactctttgaacgtcaatatttgtcatatgttaaaaatcacatcctacaattaagcttttgatgagaactgttagatgtcagcttaaacacgtgtaaggggatttacagattttcaaaattattttaggggtacacaactaagaacactgaacaatcactgctataatggcaccctattactctaccacaggaacaaaagctcccggggttcccaccagagacaggcacatctggggcacggggaaggacgcttagagtgatgctcatttaaaaagctcattttaacagggaacagtaagacaagcatcaaaaggaagtgcagactgtacagatccttggagctctgcagggggagtgacttcttaggcgctggttttcctcctgtttatgagagtaggactaataatttgagcagttcaaggtggggaaaagcttaagtactgagtgcactgaggaagcagaggtcacaggaaggaccccatagcgaggtcctctgtgggtgcaggactgccccctaggggacatttcagaactctatttttctggttgtcataatgaccagaacgtactgctcagaggggccaaggattcacgatgtcttgcaacacacaaggtcagccctggacaacaagattctcccactattaaaacaaatttttaatattccactggacacacatttagatgaaatacttgttcacaatgatctgacttgagaatctgattctatttttgcgggtacacagcaagtactttctgtacagcggtattaaactctaaatattccaaagataggaccaccatgtaaatcaagggggagttgggtaaagtccatacaagcacaatctgtttcgcactctgagaccagatcatctcaggctacactattcatagtgtccaggctgcccaagaccttgcagccatcatattcatgttttttttttgtataggtgcatgtgtctatttcatcacatcttcttaacagtcagatatgagcacatattccgatgcatattattttctttaactttttatttctatattggtttttagaattatctgtatagatcgtttatataatgtataaatccaacttcaagaagttggccacgcatggtggctcacgcctgtaatcccagcactttgggaggccaaagcgggtggattgcctgaggtcaggagttcgagaccagtcttgtcaacatggtgaaaccctgtgtctactaaaaataaaaaaaaaaaaaattagctgggcctgatgatgtgtgcctgtaatcccagctactcgggaagctgaggcaggggaactgcttgaaccagggagatggaggttgcagtgagccgagatcacaccactgcactccagcctgggcaacagagcaagactccatctaaaaaaaaaaaaaaaaaaaaaaaaaaggttaaaggtggcagtacaaaatgtttgtttgtttgtagacaggatctcgctctattgtccaggctggaaatggcacaatcatggctaactgcaacctctgcctcccaggctcaggcgatactcccatctcagtctcccaagtagctgggaccacaggtgcacgccaccacacctggctaatttttgtatttttttgtagagatggggtttttctgtgtttcccaggctggtctcaaactcttgagctcaagtgatctgccctccttggcttcccaaagtgctgggattacaggtgtaagctcacacacctggcccaaaatatttgttataaaaagagatatggacatgctacaacatgggtgaatcttgaaaatattatgctagatcaaagaagccagaggtgaaaggccgcatgttatatgattccatagctatgaaatgtccagaacaggcaaatccatagaaacagaaagtagatggtgacacccagggctggtgggtggggggcagggggaaggggagtgactgctaatgggtacagggtttctttttggggtgattttaaaaagttctaaatttgagtgtggtgatgaccatacaagtgagaatataattttaaaaaccaccgaattaattgtatgctttaagtggttgaattgtatgggatgtggtttatatttcaaaaagcttttttaaagtattggtcaaatttggttgaaaagcgctactccagacttgctcacatggaagagaactggaggggaaaaaggtaggccagaacatctaggtgggacccctacagggttaaaacagctatgaagtatcagaacacttctgctatttagactgcggaaggctttcattttaaaggacatacaaatggcaatgaacataggtgagactttccaaaatagaatctatctcagattgcaaataaataccacggcttctatgggtcgaaaagacataaataacacacaccaccgccaatagtagtcctttgaaaccctccagacccaattaacacactaagaaagcataaaaacataaactgttctaggaagtatatcatcaggtaaggtaacacagtccccccagcaacaaaaagaaaaatagaaggaaggaaaaaaaaatgaatgtccaaatagcacccaccaccaataatcacctagttaagagaaaaccacatctagggatcaagttccctcacctcaagttatgaggcgggtatgagccagtgcatgaaacagctaatgtattctgaaatcagaaaaccagagcaaaggaactaagatttactagcacgtaaaaccacacacacacacagacatacatacaaggtaatttctccaggcagcatcttactttgattaccttaaattagtaatttgctaatgcaggcagttctcactttgcatggtcccacattaactgaaagtcacgcatgtccattgcaaacagtgtaaagtgaggacactgttctgatatgcacaaatttcagtttacatggcgccatgcaaagcaataaatgcctctaccaaaataggtcaaacaacatgtttaaaagtcttctctaatatggaggtctgtttgaaaacccgtatcaggattgcttatctcttgttcaacattgccgtttcaaaacccaagccacaccaggtattcattccagttccaggtcagttgcttcagcgatattcccaaaggagaacatgaacaaaccctcaagatcctttcttcttccctttctttaacctttctgtttgttcgatccgattccaaagctgtaggtggaatggcagaaggcaggagtggggtaggagagatacagagaacctccgtctccttgctagactctcctcactagtcctattccgaagaggttcacaagaattcatgctgtttggtctttcatttgtgtactactggaggaagtccagctaggttaccaatgataccagcagtcttagcaaggcttggtaagaagatgagctgtcatgccaatgtcctcacatcgatcctcctttgttcacccaccccaaacctccagggccctcgctggggctcctgctcagagctcccactcctaggatggcatttcagtggcccaagttctggtggcttcatccaagctcccctcaacaaagcagagtgatcctgttttccccataaaagcccagtttttagctggccatcatttaatttaggatcttggttttttgttttttgttgttgttgttttttgagatggagtctcactctgttacccaggctgaagtgcagtggtgcaatctcggctcaatgcaacctctccctcccaggttcaagtgattctcctgcctcagcctcccgagtagctgggactacagacgtgaggcaccacacccggctaatttttgtatttttaatagagacaaggtttcaccatattggccaggctggtcttgaactcctgacctaatgatccacccgcctcaacctcccaaagtgctgggattacaggtgtgagccactgcgcctggccaggatcttgtttattttttattatattttaaacattttcattagatatttaaagtcatcaagattttataaaaaatttctttcactgcccttaaacttaagaaatcttatctcatcaagagcatgactaaatatccactttatcctctcctcctcattcatattttaatatttaattcactcatttatctggagtcctttttgatacatctctaaaagacagataattccacaatgagttgctagctaaacattacttgaaatttcaggatgggactctgtcctcaccaccaagctttgtttccaagagatgccatgactgataaaactgaggttggaaagatcaatgtcttacagaaaacagaagattggggggaaacgattgaaacagcactgaatatgtttatgaaatgcatccactcactcaacaaatatttaccgtgcctctgtgtcatccaagttccagggatacagcagtgagcaaagttcctgactttgtaaggtttaagtgatagagacagagacagatgttaaataacgcagtacatcaagggctgaggaggccttgaagaatagtggatggagggtgcctgcagtgaggtggtggctgctgttgtcaggctgggagggagcccgccctgccatgaggacctctgggcatctgcaggagacagggagcaggccatgcagctgtgcggggcaagtgccttccaggtgaagaggaagcccatgcacaacgcaccagaggctaaatgacccaaatttgcagagtgagccagttcccaaatgctcctcgtgcatcatcccctccccaggcttgggacatctacaacaggctgggaaccactggggcaggacttcctaccaggtttgtcatctacaggctacacctcttctgaggcccctaagtcacccaatgtttggcttggagttttttgttttttgttttgttttgagatggagtctcactctgtcgcccaggctggattgcagtggtgagatcctggctcactgtaacctccacctcccgagttcaagcgattctcctgcctcagcctcctgagtagctgggattacaggcgtgtgccaccaagcccagctaattgttgtatttttagtagagacggggtttcaccatgttggtcaggctggtctcaaactcctgacctcgtgatctgccccgcttggcctcccaaagtgctgggattacaggcgtgagccaccatgcctggccagcttggagttttttgtcttttgtcctggcattcttcctttcctgacttggttctcctagaacctccctggcttctcacaaatggtttctaagctgaagaatccattgttctgagtctgaccttgcaccctcagctctccccactctgcaaactccactgggacccccacagggtccacaagaggagaggggagcaggacaactgtagtcttgttcttttgcgtaagtggactgagttttgcagaggtaggaagatggaagattttcatcttttagtttcaaaagtctgtctcaaacccacagctggagtggccttgctgcacagagcagtgactttcatacaagttgtcttgtggttaaagggcatccaactccaaacccaggagtatccctcaaccttttgaatttcgtttaaaataaaactgtaggatttcaacaaggaatagaagtggtcccaaggtgggcttcacaaaccaccattcccagacatgtttgtggggaagccttcagcagcaatgctgctcaggtgggcattcaggcacagtgacaaggagatggggaagaagacggtttcgcaataatcaattacaccactggaggctcctggctgcctaagggcacactggccctgaccccatcctgaaattgttccttgcaggtcgcatatttactcaatcaatattcatgcagagtccactctacagcaggctctaggtcagaattagctggatgagaatgctcgggttccctgcatgtgtgcacacacgaaccctatatatagtacattttgcagtgggaggggttacttttaattgagcacctgctttggtgtgtctaatatagtgtttgatttcaaccttattctgagtaggcattactattcctttttttcaaatgaggaaactaagcagagacagatcacataacctcccccaaggtcagccagctagttagtggcggggcgggactcaagccagggtgatcagactccaaagccatgccccctccaggaagtcacacccctccaggaagccacacccctccaggaagccacacccgccaggaagtcaggctaattccccaaactagccactaaaagtggccaggactggtcagatcaacatgcagagaaagctgctgatgttttattgttaataaggtcccaagttcaagttttatttggagatgttcaaattttaattattacttttaattgaaatgcactgtaatttaatattaatttttgtgtaagtcaaatgaattaggctaaattgcaactttcattttattttggaaggaggagaggctgaagaaaaaaagcaataaataaaaaggaaaaattatttctcttagaaattcacctgatagagagggattactgcattttctaaaccatgtctagtttagacacggcacatctggtatgatagatgctgtgtatgaatggaaacaagtttagggtaataaatgtttcccagtgttaaaataaacgcctcagcggttcagattttggccaggcagtttctccacagtaggaggcacttatctactttaacactttgctacttagaaattatcactcaatcaattaccgtccacctgggtttatttttacagagagcttcaataaaatgagtgtgaaaataagttaaacacattctattcattttctcaatttttcacctctcccaatggtggttatgttgacagaaaaattacttcattttatttcaacagacatttatggaatgctgaccaggttctgtgctaagggctgggagacaggatatgaccaagtggaatgaaatgtggtccctctcattacagagcatatataacctaccttttagcacaggcggtgtctctacagcccaaatgaaggcaaccacgagaaaaattctggaccctacaatctccacagccctccccttcctcccctaccacaagagactgccctttgcccaggtaacgtccctgtggtgtttacctatgtggtccgtcaagctctcaggtgcttccagatatggaaatactctttcaccaaaagatgtttgttatactttcttttttctttttaaacttttcttttaggttcaggggtacatgtgcaggtttgtttaatataggcaaactcgtgtcagaggtttggtgtacagaccatcttgtcacccaggtactaagcctagtacccaatagattttttcctgatcctctccctcctttcaccctctaccctccagtaggccacagggcccattgttcccctctttgtgctcattggttctcattatttagctcccacttgtaagtgagaacacacagtatttggttttctgttactgtgttcgtttgcttatactttcttttaaaagagtacctccctcttacatcacttctgacgtaagctttagaatttctgtaccatctgtctttttaaaaataatagctttactgagacataattcaaataccataaatccaccctttcaaagtataagactcaacggtcttgatactttcacaaagttgtataaccatttccactatctaattccagattcatcacccccaaaagaaatccctcacacattagcagccactccccattcctctctcctccacccccctcaaccaatctcctggcaaccactgatctattatacttactatccccatggatttgcctatcctaggcatttcctataaatgaaatcacacaacatgtggtcttcttctgtgtctgacttctttcattttagcataatgttttcaaggttcatccatggtacagcatgcatcagtactgcattcctttttatggctcaataatattccatcatatgactagacattttatttatccattcatccactgatggacatttgggttgttcccaccttttggctatcatgaagcgtgatgccatgaatatccacatgcaagtttttgtgtggacctctgttttcatctctcttgggtaggtgtctaggagcagagttgctgtatcacatggttaactctgtatttaaccttgcaaggcgctgcctgttttccaaagcagctgccccattttacattcccatcaacagtgtggaagagttccagtgtctccacatccttgcgaatacttgttactgccttttttctgacagccccaggtgtgaggtggtatctcattgtggttttgattggcatctccctgatggctactgatgttgggcatcttttcatgtgcttaataataaatctattttcctttacaaaattttcttaggttttttgggtattctttcgaatttcacattttgacctacaagttcagaacctctccgcatccgttcctctcaccctcctgtaatgtggtgtggtcgcctgtctttcagctcctacagtcggggcctgggccaccatcgctgctctcgcatggctgatgagccttatagagcctacatcacatctcttggacctggaaggggaaggaagaggaaaggcctggagactcaccaaaaggaaggaattcagcaatggcagaagtgagccccgaagtcccaaagtctctggattattctttccaccaagccatgttacgcccctaattcaacacttgtcatttctctttctctctttttttttttttttttaaagcgacggggtctcattatgttgctcaggcctcaagcgatcctcccacttcagcttcccgaatagctgggactacatcgcgccactgagcctggcttcaccatttcttaattgctacaaattccccaaatcccatgagacagaaatgtatgttcagtcataaatatgagtgcacattattctcccaggcatgacatggaacaagtaaaacagtaatcctgctttctgggtgcagagtcagtgaagaaacataaaaacagtcgcatagaatgatgcacagagatttagaaatagcaccataaaagctctaaacagggagattccacctggagacatcagcaaggcttgcagaggagagagaactgaccatcgccgatccactgagaaggaatcagatggaaaatgtgggggtggggaataatcagggatgggaacagcacattcaaagatccagtttcaggaaatagcaggtgtttagtgaaactaaaacagaaagcatgagggtcacaggcggggtcacagaaagggtcaaggctggaaagagaggctggggccagtgcttgtcagtcttccctgccatgctcagggttgggattttgtaggttctgaaatgcaaagcctgtgagtttttgagaaaggaaggaacgtgattagatttgcacttaaagacctcactgcagcaaccacatctctggatatcatacagatagatcttttcagcatagtaatgaaaactgaaaattactgcaaaatgcctaaacttgttcaagattctctttgtatcatttcttcttggcaaagttccgctgctcaagacccaacaattcatctcaaccactcaccacaaggttaagaaatgctctgatgctgtggtgttggaactcagctatgttgccacaaagtagtgggcttcaaacctttggcttaaatgtcccctagtagaattacaaaaaaaactatgaaagccctgcatatttttaagttcacataaaagttttccgtctaagctaggacagttgcaaaggatgcaatttctggtttgggatcaatattgacatttaaatgaaactattatatcactcttgtaagtgtgttcaaaggaatcaaattatcataaaaatgtgttatccaccatcatctaaagtgcatgaacaggctgggtttcgtggctcatgcctgtaattccagcactttgggaggctgaggcgggcggatcacttgaggtcaggagtttgagaccagcctggccaacatggtgaaaccttgtctctactaaaaatacaaaaattagctgggcatggtggcgtgtgcctgtaattccagctacttgggaggctgaggcaggagaatcacttgaacctgggagatggaggctgcagtgagccgaggttgtgccactgcactccagcctgggcaacaaagactacgtctcaaaaaaaaaaaaaagtacatgaacaaacatttcctttagtcaaaaatttgcattccctttcctccttcaagaaaattctacttcaccccaattccatcctaatcctgcttaaaagtcttacttctctgttttatctacaataaaaatacacatcaaaaaattgtagtttttatttcctgtaaccattaagctctaagtgttaagttttcatattatgaattgattcagttacaattaccaatagtacagaatggatcaaaatataaatgttttaaattttaataaaagtattatgtataacttgaaatccattggaaatccatcttttaaaaagatgaatgggcctttttatcctttctatagatgaatattacttatggctagaataagacaaggttaacatcaattctatttctactttccattttttatagatgttaacactgagaaaccttgtccatatacctaagtacagggaaataaaggagttttattatagcaatgctgctcaattctttaaactgcttccaacatatttgtcaaaaatcatgccttatctatcattaaaaagtgttttttaaaatcttgtcttttgctttctgacaccaatatttcatgttgccctgtctgccaccctagaggctgctccgtctcagacaggctccatccatagcaagattatggatgggtgagaaaagtcagttgtggggcggggcagggtggggtgcgtggcagtgggtgggagaagaaaacaggctgatacccccaccactgacatctgctcgggcggatcaatctcaggcaagagtccacgtggaggctaagggtctgaaaactccaccactccccacttatgtgccccagaatgcgcgccagtttaaaggaatggctctgaggcaggtttgtagactcctgggtctcctactccggttaaaccttgaaacagaagctctgttcctggggaccccgagaaaggagatgcaagcaggaaagaagcaaagatggaaaaagatgaaaaatgttagaaaatggcataaaaacaaacaataaagtgtttttcagaaaaacagagaaaagctctataaattagaactctgtggcttgccccacacaaagccatcagattagggagcagaccctcttcggctttctcctccccagctcctgcctctcctaaacatacccagagaacctcttcagtctttgtaccgttttgttattgttatttttaagcagagggtcatcatttcaaccctggttgttccaaacgaatagtaaactgtgatagaaaattctgaacattccaccaccagtgacccttactattctgatatggtctaataactcagaattattccctatcatacatactttatataacatcagctaccacacaagtttttaatacacagtaagcaggtggccccagcaatttctcttatatctcacatctggtattgtactccatataaggtgctgagtccgattttttaataaaaacatggcctgagcttgtaaaagctcaagtaaaatatgcctttaaaactgctgtatttaatttccagtcatgaaagtctaaaattattgtaaaataatactcaacttttttcacagatccattcaatgaagcttaaaagtactttcctttcagaaaggtaaagagcttcataactaacagtttcttgaattcacatgtgctgtcttacttttgtgagcgtgaattgtatacattttatacctttcaatctggaccaaattagttggttagtagcaccaaagtaatatacatgtatgtttcggggcagaggtgggggaagggaatggtaagggaagggcagaaatgctggaaattaaaccaataacttgagacttggaggaattcattattttttcaaaaaggaaattgaagacataaactgaagatacacactaggtaggaaacatcaacaaatgtgacatgattatgaatattatcttataattagggaaatagccattttgacggtcattacactttatgtgaggttagtgtacaatgtggcgtaaaagactggtgtaaaaatgagatggatttctgcaagttcaaacttaaaatcgtgcatctgactagatataagctgttgcgagtgcattacatctcccactccagtctaggaaaggtggagtccctttcatttacacgactattttcatgactgggcaaattcacagaggaaacacagggatcacattccttcgatcataaagtcctcaaaagcaatcttgctccatgtcagctggtgctaaatcaaaaggtaactttcatttcctttaaataattcagtttcatctctaactatcatcttcaaccacagattttaaattgatgctaaattgggtaactaagtagaaataaattagtagtagatgatgctggctataaaaccaagccaagaatttgagtagtttttttttttttttttaaaggttctgctctactgaatctatccgataatatttctccaaagaacttttatgctagtgctcattttttcccttttgggggatgatggaaagggggcagttaccctcccttgttatcacaagtaaaatgcaaaaatcagcccacagatggttgcagagaaaaaggtcctctcaaaccccaaaggcccaagtgtaaactgatattaatagatctgctcagtttgtaggcagtttaacaatagctatccagactaaagacacatgcttgatgacccagttcccataaaagagaaacatcacacatgtacatatatctggggggcagagttcctcgatgggcgttgcaacattggttctcagagaaaaacaacagaaatcagctaactatccattaggaaggaaacagctagcagctaaacaaagcgtagcatgctcttattgtggtataatgtacagtagtaaaaaggaatgagatagatcaattggctacaacatagctaaacctccagagtacatggctgaattatagagtaacacagcagcaaacacagatcaaaatccaaccaaatctactttccccttcttggcaacagaattttggctgcaaagtgcatctccctgactcccctcctttcagctaggcaggctaggaccaggttcttgccaatgaagcataccactccagcctcacacgtttaagagaaaatctctacccctctatttccactcctttgtcttatctgctgtgtggaaaagcaatgaccagatgactgacctagaaagtcacatgttaaagacggcagagcccctgtcagcctgggtctctgaatgactgcatggaacactgcagcccaatgacctacatacactacttattatgttctgtcacatgagggagaactacatgcccttcttttaaagccaaattactgtcaagtctcttactatagcaacttaatcttttatcccaacatagaaacatacagtaagatgaccaggtgcggtggctcacgcctgtaatcccaatacttttggaggccaaggtgggaggatctcttacggttgggaggatctcttgaggtcaggagttcgagatcagcctggccaacatggtgaaaccccatctctactaaaaatacaaaaattagccaggtgtggtggcacacgcctgtaatcccagctacttggaggctgaggcaggagaatcgtttgaatggggaggcagaggttgtaatgagccaagatcacaccactgcattccagcctgggccacagagcaagaccccatcacgaaagaaaggaaaaaagggaagggaaaagggaggggaaaaaggaagggaaaagggaagggaagggaaaaaagagagagaaagagaaagagaaagaaagaaagaaagagagaaggaaggaaggaaggaaagaaagaaagaaagaaaaagaaaaacagtaagaccccttctatattaacaccatatcaaaaagacttgaaaaagcagatcaatctcctgacagtgattatagaggtgggaatgagagaaaggaagggcacaggcaaaacaagacagatgggattagggaaaactttagatttcacttttaaatatatgaacagaaaatatatccatgtattactcatacaattgaaagctgataatctatagaacgtaacaattttaatgaccaattctattttttcctctaagtttttcattgaggtggcatttggattctaagtgattccagtcaatatatctttccataaaatataaagaaaatgatgaccaaaataaaaatagtcataaaaaaaaaaggcgtcatgagaacattgtctggcactcacactctggaaaggggaaaaaacaattggctggcacgacgactttgtccccacggagcgttgtaccgtacaagcattcttccaccaggctaccatgtgagtgtgggcagttgtccccatctcagggtctccggaacctgggagaagtccatccaccctagtctgggagacagcacaggctccaggagacgaagtgaaggctctgtcccctgccagccatcaggtatagtacaacctccctctctccaagggacagtttcttccaatgaaaaactgaggcaccgcacaggttgtgtctgagatacgactcctcgcattcaagtctcagctggaaggccctaaggaaacaactgcaactttttttcaatgacctgagtccatgcattaagcaaaagatgtttaatttatttatttatttatttatttatttatttatttatttattttgagacagagtctcgctctgtcacccaggctggagtgcagtggtgcgatctcggctcactgcaagctccgccttccaggttcacgccattctcccgcctcagcctccggagtagctgggactacaggcgcccgccaccacgcccggctaatcttctaatcttttgtatttttcgtagagacagggtttcaccgtgttagccaggatgatctcgatctcctgacctcgtgatccgcccacctcggcctcccaaagtgctggggttacaggcgtgagccaccgtgcccagcccaaacgatgtttaattttagatgagtttctttccccatctcagcatctaccagaaaagagattttcattttcaaacctcatttctttcctaaggattacccatgcaaactgcatttcatactttcaaaatgccctttgcttattaaaaagcactgtgagaacacagacatgcttaagaaatttcatgatacacggagaacaaaaaaattctacttttgatcattctcatctttaccagacttgcttagtacaattaaattatccaccctaaaataaattttcttctagataccatatccttattttgttaatcctccatcttaagtgtattgatgtccttaatcttgtgtttataacatctgggttaaaatcacagactcacagaacaaatccaacccccctacttaaagagaaagaacagaggtcttccacctagaatcattttatgaacaataggggaactttaacttctgggaaaaccctagattcctgctttggaatcctttaggagtgggaacaggaatatgaacaggagaaaaccacctttaaaataaaacccgtgaaccctagttatagcacctttgaattgcaaagaatctgagaagttgtttgccacgattttaaaattaattccacaccaaagcatgcatgtttttcatttaagagacttcagaaattgactctgaaggactgtcagcagcgaaacctggttgcttttgtgtctcgccccagtactgctattaggagtgcagcctctggccaccagtgacctggacacacacccagctacccctctgagaagctgcgtctggaccactgcatctccccgggaacctcattgacaccacaggcttattaccatgaaggggtggggggaggaagaaaagagaatacacctaagttctccttagcaggcctgatacggtcttaacagtcactctcatgattattagctattaattccttatttttcttagttattacttgcatgattttcacttatatgagcatatttcccccaccatttcttaaagtatcttcccatataattattaattttaaaactaggttatcaataaatagacctatatttctacctatgtcatcctccaacggttattgataaatttgctacctttgcagatatgaggattttcatctcagctttccagtgagaagtgattgtttcggaatcatagttacaagtttcccttaaagtaactggaagtcttaaaagggggcttcatgacaaaacatcacatgaggaaaaatatcttaaggactagttagcagtgagaattttcaataaaatcatgagctagagatatcaaggctaaaattcaaatactaagagaagaaaatgttcctaactcccacaggtctggtccaactgttttaaaagacctgggcagaagggtttggaaaatggcatctaagaaggaggaaaatttagcacctacaccccagccctggccccccactccaccttcaactggagccttagagaggctcttttgagcaattatagagtaaaattacatcagaatatacattaatgagagtattttcaataatgcaaacgctgctaattatatcttttctttttaacacgaggtagaacattttacagcaaccctgagaccggccgtgtgcccagcagggagcctcgtattccgcacacacttggaaaggccatgacagcaggctgcatgatatgaggtgtgagaaatgaaaactttatgtgcatacaaatttagatttttaaaatattttcactaggggcataaataaagagaaattagaccactgggatttcagaaaacgagaatacagactgtgatttttgttttaaattttggtacttagagtaccccaatacctaaagaagtaaataattcagcaagttaccaaaagtaacacttcacttttaactttatactttttatataatttgagctattttgttcaaggaaggagagaaaattgcacacatttaaataaaagaaaggagacaaggaaggaaaacaaagggacacaggcaccaccacagacggccctttatcaggctaccatgacacatccatgcaacaagggctaccaaaaacgctacgaaaatacaatttccatcaatttacactgatttttattataccatagcacttgaaaaaactgtccacagttatttgcccccattataaaaatattgacactttaccacaaggttggaatttagcatgaacatccacatacccaccacctagacaagtcacatactgggagttaatattcgcaaaacatatatctgaaaaaggactggtatctgagatatacaaagaacttctacaactcaataataaaatgacaagtaccccaacttcaaaatgggcaaaagatttgaacaacatttcacaaattaagaatgccagcagtgtaataggtacaataagtataatcatcctcaacaatatctgttttcaggaaaatgcagattgaaagcacagtgagatacaactgcacacccaccagaccagttgaaagtaaaagactgaccacaccaaatattggtgaagatgtagaggaccacctaccattaacattttcttatacttgctttagtacatatcaacctatgcatccagccattaattcatcttcttgctttatgcctttcaatgtaaattgcagatataccctttaatacttcagctgggctgggcgcggtggctcacacctgtaatcctagcactttgggaggctgaggcgggcggatcacaaggtcaggagatagagaccatcctggctaacatggtgaaaccccgtctctactaaaaatacaaaaaaattagccaggcgtggtggcgggcgcctgtagtcccagctactcgggaggcggagtttgcagtgagccgagatcgcaccagtgcactccagcctgggtgacagagcgagcctctgtctcaaaaaaaaaaaaaaaacttcagctgcataccattaactagagttcaatattttagtttttatgtaaaattggcctaccttgatatgctaagatctgctgggttttgacaaatgtgtacaccaccgccaatcccagaaacaaccattcttctaattttctcccaccatagattagatgtgtctgttcttcaatttcataaaatggaatagcacactatgtacttgttcatgggatgtttctttcactctgcataatgtttttgagattcgtgcaagctcattcctttttattgctaagtagtgtacctttgtataaatatgctacagtttatccattcatctgtcagtggacatctaggttgcttccaggttttggcaattacaaataagcttctatgaatacgacctacaagtctgcatagacatgtatttttgtttatcttgggtaaatatctagggatggggttacagggtaggcatatgtgtgcttttatttaaaaattgctccactattttttttcaaaatggtcgtatcattttatattcccaccaacgatgttcagaaattgcagttcctctacaacttcaccaatatttggtgtgtcagtcttttcattttcagctgatctgggggatatgcagtggtatctcactgtgcttttaatctgcattttcctgaaaacagatattgttaaggattattacacttattatactgctggcattcttctttttttttgtttgtttgagacagagtctcgctctgtcgccaggctggagtacagtggcacaatctcgactcactgcaacctccacctcccgggttgaagcgattctcctgcctcagcctccccagtagctgggactacaggcgtgtaccaccacaccaagctaatttttgtatttttagtagagacagggtttcaccatgttggccaggatggtctcgatctcttgaccttgtgatccgcctgcctcagcctcccaaagtgctgggatcacaagcgtgagccaccacacccagccattgctggcattcttaatttgtgaagtgttgttcaaatcttttgcccatttttaaattggagtatttgtcattttattactgagttgtagaagttctttgtatatgtcagatacgagtcctttgtcagacatatgttttgcaaatattaactcccagtgtgtgacttatctattcatttcctcatcagtacctcttgatgagcagaatttttctttttagagacagggtgtcactctgtcatccagcctgaagtgcagtggtgcaatcatatctcactgcagccctgaccttttaggttcaggcctcctgggcaactgggaccacaggcatgtgccaccacatccagctaattttaaaaatattttgtagagatggagtttcactatgttgcccaggctggtctcaaactcctaggatcaagctatcctcctgccttgacctctcaaaatgctgagattacaggaatgaaccactgcacctggctagaatttttaaatgaagtctaacatcatttttcttttatagttattgctttctgtcatcagtttaagaaatttcttcttagtcgcaagtcatgaagatattgttttcctttaaaactttacgatttttcacttctgtattaaggtctatgattcatctcaaatcaattttcctgtatgaggtgaagtacagcacaagattcccttcttttcctatatggagcacatatctacttactgtatcaccacttcttgaaaacacatttctttccccatcggattgctttaacacctgtctcaaaaatcaaaggccctaacacagtgaaaccccgtctctactaaaaatacaaaaaattagccaggtgttgtggtgggcgcctgtagtctcagctactcgggaggctgaggcaggagaatggcatgaacccaggaggtggagcttgcagtgagccgagatcgcgccactgcactccagcctgagcgacagagcgagactccgtctcaaaaaaataaaataaaataaaataaaataaaataaataaattaaaaagccaataaggtgcagatctatttccagggtattctgctctattgttctattttcttgttaatgccagtaccatatagctttgattattgtcattttatagtaagtcttaaagttaagtagtatgacttctccaccaactttgttctaaattactttctccattatagaacttttgcatttctatgtacatgttagaattagtgaggacgtggtggcccatctggagcagccactgtggggacaccagctgcaatgggggaggtgtggccagggctgctgcactccatggagctaacacaggccaggaatgggcgggagccctgccccctaccaagtcggctgggcaggagccccatgctcccaggtgcagctgcggccacccagccacggctctggacccaggcatccctgcactctcgggggtccaggaagcacccccggtccctgcaggcttggaagtgcctactcgcactccctggcctctccccgctcccggcacccacttcagtgcaaagttgtagccaagcgcgggtgctgtcatgacccagccaggtgtgcacatatgcagagtagccagcactcccctccccgactggtgcttcagccccctctagactttggtcaccaatgaacgcaggagggagaccagaggactaagcgtgactttgtacaggcctgtgggtgcccctcagcatagacagctgggcaccacggacagcatgttgatggcagcgggaggcagacaggctcctaagcaggaagaagccagttcctggtgaaaccacaccttcaagcctgaagcctgggctccaggctgccagttccaggtgaggtccacggcctggagtgagaatttcattgacaactgtttggccattcggatggtgctttttccaggaccagccagggacacccaaggaccagtcagcacacacttcctccattgtgacaacataaaaaccccagattcagccactcacactctcctctggaagaccccgctgagagctggacacatgtcgggacaacctgtctgcagaaaggagctacccaccatgggtctcctcttcgctgagagccagacagatgttgggataacatgtctgcggaaaggagctacacactacaggtctcctgtccactaagagctggacactcatcgggacgatctgcctgcaggaaggagctacccacttcaagtctcctgagagctgttctgccactcaatgaagcttctctctgccttgctcgccctccaattgtccacatacctccttcttcctggatgcaggacaagaacttgggacctgcccaatggtggaactaagagagctgtaacacaaacaggggcaacgtccccctgctcgccatgttgcaggtgatgaggagagaagagaggcagctcttcggggagccagacctaggggctccccaagccagggctgtgacaccctctttggggctctgcagttcctggtgtctccaagtttctggatgccaccacattccccttgtctaggtgctggtgcctgcagcagaagccacttgtggtacatctgatctagcctcagccttgcacggaggcagcacccgtgccagggcatggagctgcctgccccaccgcagcagccactgtgcactggcctgcctgtgcacagtggccagaccccaagcttgctcgttcacaacccctcgccagtgtgcgcctggctcacccgtggcaggcatgggatccaggctgagagtgcgagccaagtgcagcctgccagggctgaatgagcccagcaggcccgaacaaaactcaggcaaaggtaccaccagccacagaggtttctggctggaaaagcaatactctaaggatcctgtgacattttcgtatacatttccacaaaaatacctgccgtgattttgattgagcttgtaccaaattcgtacatcaacttacagcaaactggcattttaccagtactaactcttccaaaccatgatcatggtttctctacgtaggtcttatgcagtttcaaaacagttcgtactttcccttgtgatttcttgcttgaccaatggactatttagatgtgtgctgtttactttctaaatacttgtgggtttcctagatccatttttgttattgatttctaatttaattccatggtggacagggaatatactctgtgatttcaatcactttaggcttttggagacttgttttatgacccagcacatagtctaccttggtgaacataccaagcacacttgaaacaaggtgagtttggcaaggtatagtgttctggaagtattaggtatcaggaaggtgaaagtggttgagagtgttatccagattatctatgtttttcatgatttttggttagctgttccatcatgggctaagagagcattgctgaaatctccaactatgacggtggacttctctatttcttttattctgtccatttttgcatcatatactttaaagctctgttattaggtaaatacacatccatgagttgttatctgttctctatgaattacccctattgtcactgtgaaatatccctccccatcttttgtacttctttgtcttaaagtgaattttgtctgctgcttaaaaagtcactccaacctccttaggctgttaatgtggtatataatttcctatccttttacttctaacctgtgtctttataattgaagtgtgtcttgaagagaacatatactcaggtcttgctttttaaaaaatccattctaacattttctgccttttaataacagggcttagtctattatcatttaatgtaaatattgataaggttgaattgagttaaaccatttggttaatttttatttttttctctcttttttttgtgtgtgtttctagtcctcttttcctgacttcttttagattttttttttagaatggcattttatctattggcttttgaactgtatcttttgccttatgtgtttagtggttatcctagggattacaatgtacatccttaccttttatatcaacttagcattaatattgtaccatgtcagatcaaatgcagaaatgttacaatcttataggtccatttaccacccctttgttgttcctttttgctagagttgtcatatgtattctaccaatgaatgtaagactatgtaagatgatgctacaattttgctttaggtagatatatgtgtgttgggggagtattttaaatttacccagatatttgtccagagagcattccttcctaaagactcaagtttccctctagtgtttttcctttcaccttttgaaacttcctttggcatttccttccagcagacctgcactatgacacattatcttagtgttcttttacctggacatgtattttgccatcattattgaaacattttgttggatatggaattctgggttgacaagtttatcttccttgagccctctaaaaatattgttccactctcttctggctttaataatttctgagaaaaagtccacagacattcaaatcattgttcctcactgcatgaaatgctgttttcctcagattactttcagtacttgtttttttttttaatctttggtctgcagcagttggactataatatgcctagatgtattttcatcatattcatctggcttggagtttgctgaacttcttgagcctggaaatttatgtcttctgccaaactgagggaacatctggccatcattttttcaaattttttttccatctctcctacacatatattaaacattctgatattatccataggtccctgaggctctgtttattttttaaatctttttctctcttcttcagattagataattattactgtcttattttcaagttcatagaacctgagaacatgaagatgataaaattacattctctgtgggtaatcattgaagggtcattgtgaactagacagaagctagaagaaacatacaattctaattttaaaaggaaattgtactaaccagagatattctatcccaagtgaaattcaagtaaataaacgaaactactactactgagcacctattaaaggtcagaaattgtactggcactttcatacttaccattgtatttaatttagatcacagctcattaataaaggtattactgcccacaatatacacatagtagtacagaggaacaaaaaagtaacttgtcccactaattagctcaagagctgagactttaacttaggactcccgttatagctttaccactcatctcattgaaaaaataaaaaattaagagaattgtcaagagttagacatattagctagcctgattttcttttgtaataagattagtatacaagtagatattggaagtatggggaacatagtacattacgatttcagcaaagcatctgtcagaagtaatatagtattacaaactaacaattagggctcttaacacagataaaactcttaaatgctgcttctatcacttactctttatgtcactctgtccaagcatttaaactctctaagctatagcttcccccttatctctttaaaggggaaccatgatgatactatctcaccaggttttagttaagaccgaatggtaaaaatctacagaatgcatttagcatagtactgtcacatagtaaatggtaaattagtgttaactattattattaaggcatgatatctcttgaacaaaaataattggaatataacataattatgaatattcatgaagtattgtaaacaacagttattaaccccattcctattcaacttctgtcaatgtctgctttgttttataattcaccaagtatcttccagaaaagaaagattgtaatgggttcactacagaattatacagaactgctggctcaaaaagaaatatgattatttataataggaaatcaccagcaatgacaagaatgcattcacagaagattgcttaaataaattatgatagactaatcttgcacatgtagtgtaggaggaaataaaagactagaaggagatacaccagaagattaacatgattcatatctcttcaactaattaacaaacatattaaataccatttgggaaaagattacatttttttcaacagtatttggattcagatttccattttggaatggggtgggtttataaggagccattctgggagacagaactatctccaaggtgactggaaggggatgcctcaagttataagagctcaacagaccaagcacagtggctcacacctatagtcccagaactttgggaggccaggaattcaaaaccagccttgggcaaaaaagtgagaccttgtctctacaaaagctacgaaaagttagccaagcatggtggcacgcgcctgtagtcccagctactcaagaggctgaggtgggaggactgcttgagcccaggagttcgaggctgcagtgagccgagattgcaccactacactccagcctggatgacagagcaagatcccatctcttaaagaaaaaaaaaaaaaaaagagctcagtaaatatttgactgaacaaatggtaggaaattgcccagtatctggtgctcagacacatccacaacactgcagagggcattcaagccctctggcccctgaggtgcctgccagagtttggacagacatttgtttgtctgatttaaggttcagtagaagtcaaatccctcattcgtttccaatgatgacaacatggtgctggaaacatttggtgcacttcatgacaattttccaggtatcaacagtaaaaacagaaactgcctgtaatcttacaacggtgctctatctccactgcctggaacaaaggttccaagaaggcctcttagcagttaggaaacatgctcatattttgcaacagaaagaagggaagaggaggcaggagaaggaagaaaagagaacaagatctgaaacgaagctagagaaggcattttaattgagctaaaaaacaaaacaaaacaaaacaaaaacaaattctaaaagtagctccacatcagagattcacagcccaggtttgcaacatctaagtttcttgtattacctcaatgggcatcacagaatgcaaaaaaaaaaatcatattacatttcatcttgtttccatttataaaagagaagatgccataggttgtttccggaagtggaaagggtattgaaaatgagtagaaaggatgaaaataaaaaccaggaaagcagggagattgccacgacttgcagaatccacctcgaacactccaccaggattccaagcatatcagaccccacactccgattccacggcaggttctatactatgttagtaagtcaaataagctttaacaaaacatcgaaatccaaaatgtcagccacgacctcatccaagaccactccacatctgcccaaactccccttacccctcccagagcactccttagggcgtgggagccgaggggcattttccaccacagctgagttcttcacgccactgtatcatcccctcctgcgttctgggtgtttgggttggaagcgatgccagcagagagtttttgtttgtttgtttgtttgtttgtttgtttgttttgagatagagtctcactgtcacccaggctggagtgcagtggcgtgatctcggctcactgcaacctccacctcccagattcaagcaatctcctgcctcagcccctcaactagctgggactacaggtgtgcaccaccatgcccgactaatttttgtatttttagtagagatggggtttcaccatgttggccaggatggtctcaaactcctgacctcaagtgatccacctacctcggcctcccaaagtgctgggattacagacgtgagccaccacgcctggcccggcagagatttttcttctcggatatcactcagctgtaattggagacatctgaacacccacccggatcatcacccccactcccaccccaggagccactttgtctaacaggggcatggaactcattcgactttccctgggttccagaaggaaactccaattactcagccaccactactgttagcgtgggaagctgggaagcacggaatgaagccgagttatgaatcatgcacacacagacagctgtcgggggatgcatgccaaccagaggggccacacatattccgtgttgatgggacagcacctgcaggaggcagagagaacttgtaacagatcatatgaaatccccattgccgtaattcctttttggaacagggcagggcataaaaagaagtaatccagatgatcagccagacatgaaaagaaaagaactgtcctcaggccagctgggcctcagtgtccgtgttggaaggacacttccagctttggtggtcttgatgtccataccctgaggaacctggcctctgagaaggctcccaggacccatgtggacaggggggctctgcaccattttacttgaaagggggctttacaggcatggtggcacgtgccttaatcccagctactagggaggctgaggcaggaggatcacttgaatctgggaagcagaggttgcagtgaaccaagattgtgccactgcactccagcttgagcaagagtgagactccacgtcggccgggcatggtggctcacgcctgtaatcccagcattttgggaggccgaagcgggcggatcccaaggtcagatcatcgagatcatcctggctaacacggtgaaaccccgtctctactaaaaatacaaaaaattagccgggcgtggtggcaggtgcctgtagtcctagctactcgggaggctgaggcaggagaatggcatgaacccggaaggcggagcttgcagtgagccaggattgtgccactgcactccagcctgggtgacagagcgagacttcgtcttggaaaaaaaaaattaagccacagatctagtataaccctctaatctcacagatgagaaacagacccggagaggctgagtgattcaccaacatcgcacaagctgctgtgtcaaaatggcaggcaagaaagttacagtctgagattttggggtttttttgttttgttttgttttgtttttgaaatagagtctcactctgtcgcccaggctggagtgcagtgccgcaatctcagctcactgcaacctccacctcctgggttcaagcaattctcctgccttagcctcctgagtagctgggactataggtgcgtgtcaccacgcctggctaattttctttctttcttttttttttttttttttttttagtagagatggggtttctccatgttaaccaggatggcctcgatctcctgacctcgtgatccacccacctcggcctcccaaagtgttgggattacaggtgtgagccaccgtgcccggcccagtctgaggtttttgtatttcatttttaggtaaattctgtatgcacatattacccaattttaaactgaaaactctattagcatcaaggtgacctctggaaccaaagggcaaagaaagaggcaggtacagacttccccatcattcctccttctcatctccttgcccttccacaaccagggaaaatccttctccgccaggcaatgacttcatcgtttccttctcactaatttgaatactcttatgggagagccaaacaaaaaatgaaaatgatgaatgactccttgtgcaatgcagaaaaaatgtggcgtttgggatctcacagtgacggaatacccctcatgcagaaacagaacatgcttctctccaaaacaaaaagcagaaacaacaaaggtatttcagagctcagaaggtgttttgccaaatggtaggtgtgtaaaagattttaaaggggcaggtgaaagcaaatcaactctcacctccaaagcaggtaactgttttatttgaaagaaaaacaaaagttccctctaaataagccacaaagctaagtcaggggagaaaaagaaatggaagagagggatgcctaacaagtaggaggaaaaatacctgctgggataactggcacatttattttaaacattgacagattttgactaaaacatatttttaagccggaactcaacctctatctgcacaccccatgtgtccaggtgactggtcagacctcaatcatgaacactaacgtctaagaatatctaaaaaagtttctacttagaaactactgttaaatcataatccaagtttgggcaatgctgctttcttatcatagatttcttactgcatcagaatcttgaaacatatgctcaggttttatttgcagtttccactgtcggtggctatcagcagcgctgtgtggggaaagcacctgtcttccttggtagctgaagaggagattaaaccaactcttggtggccaccccactccgtgtcagagactatgcaatgggctttccacagcaccacctgctctgaccttccccacatgaatggctgccaggtccgacccgcagaccatggctgaacaacggatgaacaaatgcactcagacacaagaatccagtgaaagagcaggctaggggacccggccacccacagacaccaaggagggtgctgtaatgagtcagcagccacagccccgaaaagccggcactgtgggcatttattcagtatagatttaatgacaaaggccttgagtcaacacatttgtgggcaattcacatggtcacccagacccggagagagtagttctgtgcgtggatgcttaagggcgaggttccaaggcctaagtaaactaacttacctagatcagtttatttatatccccttgttatctaacgtaagctttcaggcaccagataaaagaatctggctgccttcagccaaatccttttccgaagcttttgtaaaaccttccagccttccaagaaggtttgcatcttctgcaatttttcccaccacccttaccaatctcctacaaatggcattaccatgagtgggcattattgcagcttgtccattttaagatgagatgtcatggaatttgccccaggccagtagccaatgaagctccagagcctgccctgctttcagcatcccatgcagccttgcccagtgggaaaccagacttctaataaactcaggctggttattccaaggtcatgtctttggcccttctgctaaagaataactcctttacaatctaaagactagagtggaagcagttccaaccctcagcagattcagctcactactaaactaaaatcaacacatttggatttttctctaaggtaaacctgaactggggggaaaagagcatagagaagtccctgtcaccctctttattgattatcttttctaaccctaaaccttgccttattaccttttgtggtcttttattgcttgtttaaataaaacagaggcatttgacaaaatgaatattaaatgtagttacaatcaagcaattctgcagagtaataaacatctggggttttttttagagcttaaagagaatgtagtaatgtcaggtgcacgtgtttctgactgtcatggaaggttcaggggtctcaggaaggtgtgggtgatgcacaaggcatatccaagggactgcgaaaatgttcaaaccactgcagatttggctcttttgaaatgactgtgaattacctgtgaaaatgataactaaagggttaagatttcaaaaaaagagaaggttcaatgaaaaagagacttgcttcacatataagagaaacacaaacatggacaactgactatgttttctcatctttcaaaaaaagttggactaaaatatttttggcacaacagtaaccagcaacaaacaattggttctagtatgagaaaaaaactgtcgaaatcttcaaacaaaaactccattccaagaaaacacctaccacaccaggcacggtggctcatgcctataatcccagcactttgggaggccaaggtgggaggatcgcttaaattcaacagttcaaggccaacctgggtaacatagtgggacccctgtctctacaaaaaatttaaaaattatccaggcatggtggctcacgcctgtggtcccagctactcgggacgctgaggtgggaggatcacttgggcccaggaagttgagactgcagtgagccatgatcagaccactgtactccagcctgggtgacagagcaagatcctgtctcaaaaaaaaaaaaaaaaagatacacatatcacagtcctgaacacagaccacaccaatctgtttcatggacgtccacagcactgctgctgaaggatgcgttataaaggctaaaaagaattgcacacaaagtttaaataataatgagagttccataaatattatctatgtactaagagtctgctgacatattatctcggcgcatcctcaccctatccagtgaggcaccctgaaggagggccccacatcttctctattccccatgggtcccagagcctcacacaggatcttgcacacagctggtgtgccagagaaagtagttaagtaattaaactttttatttttaagtagactattaccagctacatgacacagataaggaaatagaggcataaaaggttactgattttcccaagtttactcgtctaataaattgggattccaaaccagggccagcaggaccccatcccaagatctaagtaatgtaaaatgaatgaaccacgggctgatatgcaatttctgcaaatactttctaccccagcttttctaccatgttatctacttttttttttttcctaaaagtctcatacaccctcaaaagatgaagactgccaccattgagaacattcaaaagataggtgctgttggccaggcaccgtggctcaggcctgtaatcccagcactttgggaggccgagacgggcggatcacgaggtcaggaaatcgagaccatcctggtgaacacggtgaaaccccgtctctactaaaaatacaaaaaaaattagccgggcgtggtagcaggtgtctgtagtctcagctacttgggaggctgaggcagaagaatggcgtgaacccggaaggcagagcttgcagcgagctgatatcgcaccaccgcactccagcctgagcaacagagcgagactccatctcaaaaaaaaaaaaaaaaaaaaaaagatgggtgctatgggtttgaaagagcttcagcagaatccctgccatggctgggcagcttgccctaccctgaaggaggccatgttcgctccactccaggtgacattcactcctgctgttctgcgcagtcaaatttgggatgcttcaagttgtccaatagtaaaatgatactcaactgcaatggattgaatgtttgtgttccctccccaaccctctgtcaaaattcatgtgttgaaatcccagcccccaatgtgatggtaatcacttttgcaggtgattaagtcatgagggtggagccctaactaatgggattaatgcccttctatctgaggaccgttgagagctctctcaccctctttctgccatgtgcggatacaagaagtcagcagtcagcagggtctggtggctcatgcctgtaatcccagcactttgaaaggccgaggcaggaggatcatttgaggtcaggggttcgagaccagactggccaacatggtgaaaccctgtctctactaaaaatacaaaaaaaattagctgggtgtggtggcacatgcctgtaatcccagctgcgcaggaggctggggcaggataattgcttgatccccggagacagaggttgcagtgagccaagatcctgccactgcactccagcctgggccacagagtgagattctgtctcaaaaaaaaaaaaaaaagtcagcagtctacaatctagaagataatttgaccaagccgggtagcaccttgatctcagacttctagcctccagaacggtgagaaacaaatttctgttgtttataggccattcagtggatgccactttgttactgcaccccggaatgatgaagacatcaacatcaacgctgagaggacactgggacggctcagttctaatgaaaatgcacctaaatagaacacattatcactatcacaaaatggtaaacatcaaaataactctaccatacttgaaaaatcggtgacaaaatatgaaaataaacaaccaagaacactaaaaattaatgtagaagcttctctgaaaaataccaggccacagaataattcaacttcaggagcttggcatgtgaaaggttaacttattcaggtgttgaattggaacaacaaaaaaaatttgatggagaatttgccagaataacccttcagtcacaaccgttgccaaagtcaaaggccaaagttatattttaaattttagaagtaaacattaaaatgaaggtttcttaaaattctccaataattttcacttttaaagtaccaaactgacacataaaaaaattcgtgctaattatcccaagcaatcaacttctttaaaaccctttatttcacaattacgctaatatcccattaatttgggacacttaccaatgtatttattctttgctcattacctatgtgcacattaagagtacaccaataacacaatacaggcattaatatgtaaaacatcaacaaaagccatctggaaagctaatgaataatcaagggatttcaaattaaactacagaattttcccttagaatctttaggacaacactgtcaagctcaatctattcacttcgcctccagaatcaatttttcaaactttatgacaggtctaatcgcttccacctgtgtctccagcttgactcttgactggcatgctaccagccagggtggaaatgtagacaaagacccctattaggatccggctgtttctctactgtgaggtcactcagccattaaattagttccagcccaatttctgtcctctcgggcctcgacttcaggggaggagggtgcagagttgagtcagttagcagcacagacccagaagggaagaaaagggggaaaagatgtttgggactgactaggtaggtgtgcacaaagctgaaaagctggagttggtcccaaactctgaaatcgaaatactatctttcttaaatgactgcagctattctccccaatgcgatcctgcccccttcccatttaaaaaaaaaaaaaatatatatatatatatatatatatatatatatatatatatatatatatatatttatttatttattttatgggattgtgtttccttttcttctccttcatttgtagaaagtcaactgtctcccacacaacatttcctcaactcacatgaggctgattcacaaaactagctcagcaacctaaaagcgccagaagtcactgagagataaaaggctggttggtggaggctctggcgtgggcgcatcaccaggtcaaaggaggtgagctgaagatgcctggagagcatctagtgttccaacgcccctgatctcacagctgaagacagtaaggctcagggaggagagactgtcaaggtcacagagctagtgaatgacaaagtcttggttccagcattttccctactagattacgagctctacagcatcagaaacaaggcccaacacacagtaactgcaaaaacaaaaacaaaacaccacacatcgctcctatatcactgtgcccacctcctttctgcccaaagccccaatgatcagaccaagaacggtgtacacaactttacaaactggcacaggcactaggatctccttctgcaaacgcaccgtcaggcatggacgctgcctgagccgccaggacacctctccagtgcctaacacagtgcctggcatacaggagttgctccagaactgcttatcccatgaggcaaagaagtcaaatctaagcctgaaacatcaagggactcaaacggtgacaaatgagaaatcagcttatttaataagaaaatctaaaatattctttacaaatacaaaacgtccaaccttggacaacttattcaggatgcacaagtatacgaaggaaattggcgtaagcaagtttatgcccatctgctcaccacacactgcggtttcacgtcatttcactctctgatggagacttggtataagtcaatcaaaaaagacgctattggccaaataaaagatgattccaaaaatagcacaatgactcagttaccccaagctcctatgtttcacagtctagcctcatgctgtctccagagggttgactatcatttatcaggagattaaatggaatgtgccacacacccactacgtcaaggcagactgaactctgggaggggcttttcctgcagtgacaatggatttgcagtggctggtccacacccacttccctagaccccatcaccaccaatagctcacattttgcaaagggattcctgagctgtagctgtgggatgtgagcctggaacacggagaagttcactgtcccagacacagacacagacacagactggacccatgtccctgggactctacttaactggctgagctaactgctcacagggaaacctactaggaaatagcacagaaaaataaaggtctctggcgtgaaacaaaactggcaatacacacagcatggtgatatggttatgccctgtgcccccacacaaatctcatcttgaattataatccctgtaatccccataatccccaggtgccaagggagagactgggtggaggtaatcggatcatgggggttgtttctcccatgctgtccttgtgatggtgagttctcatgagatctgatggttttgtaagtgtttggtagttcctcctgtgttcattctcctgcctgccgccttgtgaagaaggtgccttgcttcccttcaccttccgccacgattgtaagtctcctgaggcctccccagccgtgctgaactgtgagtcagttaaacctctttcctttgtaaattacccagtcttgggcagtactttatagcaatgtggaaacagactaatacacatggcatccagaaggtgttaccctgacaatagtgtggaaaagcaattcatggtcgggaagacatgtcagagaaaatgactggagcccaggataaaggatgaaatcacgttttctaagcaaatgagttgggtggcacagccaagtcagattcctggggaaagcgcatcactaacggggttttgagtttttactctgggggtggaggggactcagtcatcagcaagcggcacccacattgccctgtgctacttcctctccccagagtgctctcccctctattcaatcacaaacacacttccaaatttgtggggtggagacacaaggtgaaggcggtggggggttcatgctctaagacaagccactcacatgcccagagagatcaaaagaaagctctctacaccagtaccatggtagctcagctggtactgaaataccagccctcaaaaaataccacaccctcaaaaatctgtcagaaatctccaaatcctcctagatgtgtaaacacctaaaaaaaattcctctaattaccttgagtaagcactgaaacaaaagcagtgttataagtcaaataattatcttcacctgtgatcctaaatctggtagaccctggcactatcagaaggtatactactttcagggcctccaagtatttttcttggtagtctgaaaaactgaaagtacatgcctgaggcagaattctaattgtcttccaatgtctaccaatgtctaccctcctttcctccttagtgatagaagcctggtttccagttagatccatggttgcctactataaagaccacatttatttcccagccttgtttgtaggtcacgtgactaggtcctgttcataatacataaacaaaaaggccatgtgcaacttctgtcccttgaagaatggggatgtagcttctttaccccttcctcccacttactggctcaagtaagaacataaacactgggatcaccatcctggacatgtgctgaaggtggccgagcaactcagctgggtccttgacacgtgagccaacgcaccaatgctggacttcccatctcagcctatctcatttgcaggagagaaaagtaaacttccatcctgttcaagccacttctattttcagatatctgttgcacacagtgaaacctaatcttaattgacctaggaaccggtacctgaaccgggggtgctaggtctcagattttatgtatgccccagaaacaaggcctaaaaatgcagcctgatatggaggagatgggcagaggatcactggcaaagacacaggtctcacaggttctcgactgctgactgccgcagcaaaacctttgatcgagtcctgaccttctatatgttgggaggtagacctggtgtctgttagaagctgtatccttacaggaaacagctctgaaaattcaaaatgtcagtgcttgccagtccttgacactctcagcaaggttcaatcaagagaaatgatctccaactaaagctaactagtctcaagaaagtgggaaagaatacagatttgattagaaaggagctctgtgtcagcaaccagcaatctaagtgagcctatggggctgtccctgcagccccagcaggagataagacagatgctttaccacatagagcccagaagccttgtgccaaagatatgattaagggcctggccttccacccaagcccacggtttcatttggcccaagggagttgctattaaattgggagggaaaggaatggcagagcgctgaggcctttaaaagaccagagtttttaggctgaaaaactgtctagacaagatcttgatggttactcacatggaaccaatcagaagcaaacagactagagggctactaaagtcctgagagacttgtatctctacagaaaccttaaggctggcctataaaaagctgtgactattcagtcctcaaaacaacacccagaccccaaatcctcccagcaagcgggttttggaagcccatcctctccagcatccatctccgatgtggtgcagagaagaccctttcagaaggcaaagccatgactccaaaagatcccaggcaagagagttcccggagggcagaacgcgggttgccagacagcgacaaggaaacatagtggccgccagtgcagggggtgcagggagacttgatggtcgtgatttctactacagcagtgtggcacatggtgtgctgggggcagagagctcgtctgtttcagctaacagattgcaagacctcaacaggtacatccggccctaaaagagaaaacggcacatcatccagagatcctgaatctgatcaagtggaaggaaatgaatgtcataccagggccatcttccttgaggaagaggtgagagttttctatggaggggaagacaaatgcatgtggatatctgggacctcagcagaaactgctggctgttccccactgtgtccttccccgtcttccttaggaatacaactcccaattttcagctggtgcaggttccatgatggggaatggtagacggagaaaaagagattttgtaaatcatatgatcaagatctatatctaacataaatttcactcctacttcagcccattaggaaagagctgctcaattgctgaagaaatgatacacacagacgaagagagaaataagcattgagagaacccagtccatagttctgaaaattcttcttgttctatccaatagtttcatcaaagtgatagtctcatcatgttgcccaggctggtctcaaactccagggcttaagcaattctcctgcctcagcctcccaaagtgctgcaattacaggcatgagccacaaaaaaagtatcccacttttttttgagatgggagtcttgttcggtcacccaggctagagtgcaatggcgcgatcttggctcactgcaacctctgcctccaaagttcaagcaattctcctgcctcagcctcttgagtagctgggattacaggagtgcaccacaactgcctggctaatttttgtatttttagtagagacagggtttcactatattggtcaggctggtctcgaactcctgacctcaagtgatccacccacctcggcctcccaaaatgctgggattacaggtgtgagccaccgcgcctggccatatccaacattttttataaatattcagaaacaggaacaattccacacacagtaaattctgttacctagaattctacacactggtataatactagtgtttgacactgttccagtaacaactccaaagcactaaaacaacagtccccaacctttttggcaccagggtccggttttgtggaagacagtttgtccatggacagggggtttcgggatgaaactgctccacctcagatcacgaggcattagtcagattctcataaggagcacgcaatctagatccctcacatgcacagttcacaatagggtttgagctcctatgagaatctaatgctgccgctgatctgacagggggcggggctcagccagtaatgctcacttgcaccactcacctactgctgcgccgccccgttcctaacaggctgcagaccacagcccgggggtcggggatccctgcactaaaaaataatgtatgagattcgtggatttgtttaaagcacacaaaagcagcaactggaagagaacagctgccagtacacataacctattattactatcacaaatagactatgtttccataagtatagctcgttaacatggtttggatttgtgttcctgcccaaatctcatgtcaaattgtaatcagtgttggaggagggcctggtgggaggtgatttgatcgtagaggtggatattccccttgctgttctcatgatagtgagttctcatgagatctggttgtttaaaagtgtgtgacaccaccccctttgctctcttcctcctgctcccatcatgtaggacgtgcctgcttccccttcaccttctgcaacgattgtaagtttcctgcggcctccccagccatgcttcctgtacagcctgcagaactgtgagccaattaaacctcttttctttgtaaactacccagtctcagttctttatagcaatgcgagaacgaactgatacactcatgtaggatcaaatatagttttagaaatattttagtcttattcttagaatgtaacaggccatgtattttgtgcatccatctatctcgtggtccctctgacatcaagatgacctcttcaaatgtcttctccttaaaaaggcaactgcctccccgcgccaggaatttcttcccaggttcactgactcagtaggtttctgtgagtaacctcacttcgtagtgttaggaaggaaccctgggaacagcggatgcagggcatctggtaagctaaggccgccaacaaccattcatccagtatcagctctgcaccaagcaagggattcataattaataatcaaaccaaacaagaagagaaacaaagattcctaaacaccctcagaaaggccaaaatatttttcccctttgtaaaagtaaaaactcttaaccctatgggaggttccacctctagtgttggcaagctcagcttcaatgtctgtcaaacacttttacagacccaagtttcctaaggcagaggtttttttttttttaagtttaatatcaaaagtgaacttcctgatatccaagaatattaaggcaatatatttatacaggttcttttttcacccaaaaacacaggctggacagcgtgtggtgaagcccagccctctgcggatgtgcgggagcctcagcctgtccgcactctcagggcgtgtgctgccctcttggtgacgcgctgccctcttggtgacgcgctgccctcttggtgacacgctgcctggccacgagctccaggaccacacttccaaggttcccaggtggcaatgacacgaaatattcttcagtattctccacagaaacaacaaaaatggcctggaagtacccgtatttttctatctgaacttcacctccccaaatcttttgttcaataacttgtctcatttttttattcagaaaatgtaactatcgcgagttaccccttcgatataatgaagtcttcgcttgagtaacaaaggattattacagagtttgcaacaagcaagtgatgactgttccatctaaaagaacaggctttttccttttctactgggaatcaatggatgtcaggggtgaggtggaaacaggagagttaagaagcgctgaaaaatgaaagtacctatgacatcacaaattaactcagtacacaacaattactaatgaacacggctcacagctcccctcccagcctgcccccattgctctgataatcctcccaaacaactctgccaatgcctcctctaatacaacacacatactaacactgtcattctgatgactctaagtgtgacagtcaagaaaatgctaaagttggctcatcattttatatccatatagcattaaattccagaaactattatcaagaaaaaggccaaaatattcccatacattgaattatacatctgtctaatcatgtggtcccatgagtgaaatgcctagaaactatgaatccagttatttttggaatatttcacgccttaaattttaacaccgcactgagggaaggcacttttgttattccctccctctataaccaaattttttaaactaaaatagtattagtactattggggagttttaaaaaattcctttcatttgttttctatttttttaatctttaatcagagtctatgtaacagaaggaatcaaaaggaaaacctgcagtaagagtaaatttctaatatccaaatggggttatcaactgcttaaaaaaggtatgggggttgggaatgggtggctcacgcctaaaatcccagcactctgggaggctgactcagaaggatcacttgaacccaggagttcgaggccagcctgggcaacatggtgaaaccctgtctctactaaaaatacaaaacttagctgggcatagtggcgtgtgcctatagtcccagctacttgggaggctgaggcaggagcaacccttgagctcagaaggtcgaggctgcagtgagctgtgattgtaccactggactccagcctgggtgacagagcaagatcctatctcaatcaatcaatcaatgaataaatgtattggatagcaatgtaccaaaaacacttttcaaaatacaaagctctgacctttttcaatttacacagcttaggtgtcattcaaacttcctattcaaatgcccctgaaaaacatcctgtattaaatgtctaacactgattgtaactgcacaaaagaagaatgataacctgagcaataatgccaccggttaaacatcttttttcataatattcgtttatcaaagaacattctgagggcctgattcaaagaagcaagacacaaagcacaaccaccttccattcccataaaaaacaaacctgtgatcaaagaacttcaatttcctttcccacgatttaactcttctaggacaagagtacttccaccttgctaataggtctggtcaaacgtattcctctacaactctatcccctccccgtctattggtaagagaggatgatcaatggaacaggactcctctgagcagatgcagacctgctcacaccttacccatccaggagacgcatcgttgtgggggtcacttcggcaaacaaaattactttccccaactgcttggtctgcagattttggcgatagatctctaagttgaaatgttctgatgagaaggcctccatgttggtcaccacaggtatacaagatggggttatttctacttcagacacgtaggatgaaacaaatctaagagagagctggccggattttatttctccctcggagtccacatgtttcccaagccactgcataagaggatccctgatttcctgtgtcataaagaaagaaatgagatggtcgtaatttggcattacattagatcatggtagcttttccttataatgccattttggtaatatgagtacttcctaattcatgaccaagaaaagctagattaacatattccatacatctaaacgattagacaatatgataatcatatacttagtatacttatactataaaataagctcttcagaaaccaggatccaagaaaatcagttcagttcatgattatacttcctatcttacatcttacattctctcatgattttcaagattcccctccagtccagagttcataagtagttctccagtcctccgttcattttacggaaaacttttatctttttgccccacaaagaaattcattatcctatttgcaaaaacaacaacagaaaaccctgggtgaaagaagtcacagaacacaaagcactcaaatacaagaacactcggtctcagcctcacatcttagagaatctccgcttcctcttgtaaagacaaggcaagttgatcaccaacaaagaagacaataatcttcacaaagggaaagtggggtaccccaaagctgctttctgtttgccccaaatggaggtacaaggaggagaaggaaggcaaaacctagaagagacgttgtccaatccaggcacagagctctctactctatccccaaaaccacaaggctggaggaggttcccccacgccagaccttagaggtcccagaggccttcctccagggtggtttatcaggaactgagggctgagggaagtcatcatctcaagaggcctgtacaaaacttactaagatctcagtaaacacagatccaggctcttaggccatcctcctgcaaacaccaggccctttacgtcccaaagctccctgtggctacagagtagtggcatcagagatgaaacttaattcaactaatttcaattgatcaacctttaaaactcacatctagtttgcagataatacagaggagaagagaacgagtcaaatgacttcagaagaaagcattcaggtccgcgcgcagtggttcacacctgtaatcccagcactttgggaggcccaggcgggcagatcacctcaggtcagtagttcaagaccagcctgaccaacatggtgaaactccgtctctactaaaaatacaaaaacttgccaggcatggtggcgggtgcctgtaatcccagctactcaggaggctgagacaggagaatcgcttgaacctgggaggcagaggctgcagtgagccaagatcactccactgcactccagcctggcaacaaagagtgaaactccatctcaaaaaaaaaaaaaaaaaaaagacaagaaaagaaagcattcagaagaaatccaggggataaaacattttacagaacagccgggctggaatcttcaactagtcaatgtcacggtggagatggggtggggacacagaggtggagagggagaccccgtctagattagaaggggcttaaaagacataatgaaacacaatgggtggttctttattggatcccaacttgaacaaactagctggaaaggacaattaggaaatctgaatgtgaacagtatgcattagacagcaaactggaattactgtcagttttaataggtgtgacaagggtactgtgggggccaggcgcagtggctcacacctgtaatcccagcactttgggaggctgaggcaggcgaattgcttgagctcaagagtctgagaccagcctgggcaacatggtgaaaccctgtctctcctaaaaatacaaaaattagccgggcatggtggcgtgcaactgtagtcccagatactcaggtggcagcggtggaaagattgcttgagcccaagaagcagaggctgcagtgagccaagatggcgccactgcactccagcctgagtgacagaaccaaaccctgtctcaagaaaaaaaggaagtactgtggtgacataggaaaagtccttaatttttaaaaatgtatatacgtcatgaaatctgtaaaatttacccccaaaatacataaagtaaggcaaaatgttgataattattcaactatgttgataattattaaatctagatgatgggtatttggggtatgtgttacagtattctctctattcttttccatgtttgagaactgtcataattaagagtaaaaaaaagtggtgaaataaacataagctatttaaaaataataaattcaggccgggcacagtggttcacgcctgtaatcccaacactttgggaggctgaagagggtggatcacttgaggccaggagttcaagactaacctgggcaacatggtgagaccccgtctctaataaaaatacaaaaattaactgggcatggtggcatgcacctataatcccagctactcaggaggctgaggcaggaaaatctcttgaacccaggtggcggaggttgcagtgagccgagatcacgccatcacactccagcctggagacagagcaaaactgcatctcaaataataataataatgaattcaattgaccatacactggcaacctattccctctgtcatccattcaacaaatgttacgggatatctcccatatggcaggcagtctcacaggctctgaggacggagcaatgatcaaaggggtcaaaattcctgtctttggagggttaatgctataatgtgggagtcagaaagttaaaaaagtccgggcgcagtggctcaggcctgtaatcccagcactttgagaggctaaggaaggcggatcactcgaggtcaggagtttgagaccagcctggccaacatgacaaaactccatctctactaaaaatacaaaaaattagccatgcatcgtggtgggtgcctgtaatcccggctacttgggaggctgaggcacaagaatcacttgaacccaggaggcagaggttgcagtgagccaagattgcgccactgcactccagactgggtgatagagtgagactcagtctcgaaaaaaaacaaaaaacaaaaaacaacaaaaaaaacaaagttaaaaaacagtaaacacaatacacagaatgttagagagtaacacgtacaaaggagggacaagaaagcacagaagagagggaggccacttcagaccagacagatggaggacctgctaagaaggcaacgcttaaggaaaggcctggagcaagtgaaggaggatgctgggacaaaatccacagaactatgtttttatatttatttataaagggattccagcaagtgcagaggctcccggagcagggaaagagcctgatcagggcacagcatttgagcagagtgagcctgggcagaaggtggagtgccggggccagaaaggcagagggggtggtgagagccaccgtccacatcgcggagggcctcaaaggccacagtaaggacggggctttcactcgaggagcaacagggagccccagaaggttctggggaaggtcgtgggatgtcctacctctgttggagcaggatcaccccactctgactcctgtgttgagaagagcctgaaggggaacaaacaagcagagaaactagttataaagtcacctaaatgagctaggagtgagactactgcctggaccagcatgcagcagacatggtgagaaaggataggattcacagtagactctgaagtacaggctacaagatttgctaacaagtcatatctgagatgttagagaaaacaggggctcaaaaaagagcccaagatttctggcctaaacatctggaaggacagatctgctgctggaaatactataggaagagcaggtttggagaggaagaggcaggaggtgagccctgggtgtgctaagcttgagatatctattaaaaatcccacgggggctgggcgcggtggctcacacctgtaatcccagcactttgggaggcccaggcagtcaaatcacttgaggtcaggagttcaagaccagcctggccaacatggtgaaaccccacctctactaaaaatacaaaaattagctgggcatggtggtgggcatctgtagtcccagctacctgggaggctgaactcaggaggtggaggttgcagtgagctgagatcatgccactgcattccagcctgagcaacagagaaagactcggtctcaaaattttttttaaaaaaggaaaaaaaaaatcccttgaaaacaatgaattggcagtagaacatgtgagtccagaatccaggggagaggtctgcaccatggatatcaatttgagaattgtcagactatgggtgatcatttaaagccaagaaagaggataagatccatgaaaagagtgactgtagttaaaaagaggatgcaaagtagggctgctgtcacaaaggactacaaaccgggtggcttgagatgccagaaatctattcttacagttttggaggacagaagtcaaaaatgaacacgtcaacggggccgtgcctcctgggaaggctctggggaaactagtgttcacgcctttgcttctggtgccgctggcactccatggtgcccctcggcttgtacacacatcacccccatctctgtggccatcatcacatggcgttctcctctttaagtgtcccgattctgtgtgtcctctagtcttctgaggacagcagtcgtactggattagggatccaccctaatgacctcatcttcacttgattacatctgcaaagacccagcttccaaataaggtcatattcacaggctccagggctggggctttcacatatctttttgggggacacaactcaaccaacaatagcagtccatgcttaggtttcagggagatcaaaaagagtgtgcaaaagagattgagaaagggagagaaaaatcaagtgtgtctgtggacagcagtggggggcggtggttgcgggagtctcctgactccagtttggaaggttggaagacgatgacagtgccgtggggagagggctgagaagtcaccgctggccttggtgccacagagcccagactctgatgagagcagtttgagaggcgtgatggaggccaaagtcagatgggagtagtgaaaagagaaaaactgcagactccaggataaaactctggcaaagggtctcctttaaagggtagagaggaatggggcagtggctagagggaggaatggggtgaaagcaggttttgtttggtttagaggggagaaacagcagcattttcagattgatgtgaaaggtcccctagagaaaagaatccaaagggccaagtggggtgggacctagcacagaagcagaaaggtcagccttgggagcagagacagctcacccatagggatgggggtggctcaggttcccctctgcggacacctggtcttatgaccccactggctgcagaactcccttggcccttgccggttgcacagccatacgggacagcctggtaactgaaattcgctgctcccaccctgctccacagctgcagggaggtgggaatcctggtgctggcagccggtagaagtcatcttatgattgcttctatgttctcaataaataggaagcaagatcatcggctaagagagaaaagaaggaaggaggtgttgaagtttggggagggaggaacgaacatgacaacagggagaatgagaagacgaatgcagtggggagaatcttctgagcagcgccttccccagggcagctggaagcatttgagcaccacggaaggtcagcgactctgaactgagagtgagaagtccgcatgattttgtgtttttatcctgccacagtcagctatccagccatgtgggcttagcagagaggaggcagtgagctgaaggtgtacagaaagcagtaactgagactaaccgaccacaaatgagacactgctggagacaggaagataaatatgagtgatcctgttggggaggagagtgagaggaatgccccaggaccaaaaagcttaggtcagcaccagagagagctcccagagaaggcatgcaaaataaggggtgatcctgcttgcaaagaaaccagaaaagttgttggaagaggtcaagctcaaatgagctaccaaaagctacatttgggtcctatcacagtactaattttcggttttcggactacagaataccaagatatatttcaaatggattattccctgttcatcattctttccttggtatatactctattggaagaagaagaagaaatgaataaataacatacaaaggtgatccccaaacctcaaatctggccattagttataaccaactctgcccctaaaactttggtcaatgcccttaaagcataaaatgcacagatctgaatttccatcactttccccagggcagctggatgtcaccaggtcaccacacaggctagagatacatataggtgaattaggttaaatcacaaaaacagaaagataaaactattatttaactcaagcagagagctaagaggttattcatcagatgatggtaatacaaatatcccattcaaagtcaatgaaaaccaggataaaatgaaaaagaaacaaccagcactaagtagaactttcagaacaggaataatgcaggaattatcctctaaagtgaatcatccagattgactatggtatacatcattcatttaagaaacatgtatggagtacccacggtgtctcaaacacagtaccatggtagaaagagaagaggaaggacagatattgctatagtttgaatctgtcctccaaatttcatgtgttggaaacataatcccccaattatatgttgatggtacttggaggtggggcctttgggaagaaattgagattgaatggggtcatcagggtagggcacctatggtgggattggtggctttataagaagagaaagaaagacctaagctggcacactcctgccctctcaccatgtgattcccttcccatgttataatgcagcaagaaggccctcactagatgctggcaccacactcttggattttccagtctccagaaccaagagctaaataaacgtctattctttctaaattgcccaatctcaggtattctgttatagcaacagaaaacggactaagagagatgcatacacataactacaagacaaaaattcactcaaactattcaaacatacacttctctttggcaaagtaagtcaacctgacttgccaaatttaatcatctattcttatgtgcatgcaagttgagagccatattctcaagaaattacatcatcattgttatgtctactaattactaaagtaacaatctaaattatttgtttttgaaagcaatacttagacacgtacaaatctgcaaaataaaactgataaaagcaaggcatgcaggtttttttcttatacttattttacataatctttcagggcttactcagaaccaagtgaattactcagaacaaagagaatctaaaaggtatcaaatgaaaccagggccctcttatgaaacataactatataccacccataattctcttaaatatttatattcactatagtcaaatacattttaagtaccataggaagcatttagcctcccccaaaactttctccccgctccaccattaaccctggacaacataaaaattctgaataaaattctggttgtaagaaataccaaaattactatctgtttgatataaatctgcctggcatgtcttctcaaatgcactcaaattatgattatgacttgagagttgcatatacagctgctaataatacatgtagggaaaaggaattaattcatgactcttgcctaaactctcctaatgaccatgcaatgtaaaaatgttactgaagaaaaaaggtttggatcatagacatcaagacaagtgggctgacatataagtagcactacccactctgcaatacgcaaatgcacctatttctttgaactcaactatcagaggatagctaaaacgtcacttctatagggaggatgtctctgacccacagccgttcacaaactttcgtaaacccttagttactttatagcacttatcacgactatacataatttgtataagtgcttattcaatgccacactgtcttattagaatataagttccataaagataatatacatatgttcctgttttgctcccaacggtatccatggaacctaggacaaaagtgcatgcttaataagcatttactgtataaatgcacattaaaaccttaccaaggaaaactctccaaataacagatagataggtaatcaagaggtaaaactcaaaaaagacaatgagagagtatggtcttgagatggctacgtaagcatcaaaaataatgcacagtctttgaaatcattacagctagttctattgacaacaaacaaccactatcagattccacttcaagggggtttataaaattctaattaatgttatttttctaacatttaatcttcaagaatttagtatttctcttcttctaggatttcaggttaattaaatatgatttgggtggaaccaacagctgaatgctttatagtcacataaatgtggcccttttaaatcagccacagcaccagtcattctcaagaaaggtgaatatattctttgtcttttattgggtcatgttgcacaggacatgaaaatccaaaggaatcttaaaaaaaaaaatagaactaataagtgagtttagcaaggttgtgggatacaaggtcaatatacaaaaattggctgggcacagtggctcacgtctgtaatcccagccctttgggaggccaaagtgggtggatcacttgaggtcaggagttcaagaccagcctggccaacatggtgaaaccccacttctacaaaaatacaaaattagccgggtgtggtggcacacacctataatctcaggtacttgggaggctgagacacgagaatcacttgaacctgggaggcagaggttgcagtgacctaagattgtaccattgcactccaggctgggcaacagagtgagactccatctcaaaaaaaaaaaaaaacaaaacaaaaattgggtgcatttccatatactaacaataaatatttggagcctgaacttctttaaaatatcattttaatggcatcaatagatctgaaatatttagggacatatttaacaaaatatgtgccagacctgtttactgaaaactacaaaacactcctgaattaaaaattaaagatgtctgagcatcataactcatactcgtaatcccagcactttggaaggctgagtatggaggatcacttgagcccaggaatttgacaccagcttgggcaacatggaaagacctcatgtctaaaaaaaagagtttttctttaattagctgggtgtggtggcatgcacctgtagtcccagctagtcaggaggctgaggtgagaggatcacttgagcccaggagctaggctgcaacaagccatgatggcaccactgcactccagtctaagcgacagagcgagaccccatctcaaaaacacaaaaagaaaattaaagaggctgtaaataactgaaaagatacaccatgttcatggatcagaagactaacactgttaagatgtcaattcttcaaattaatctatgggttcaatgtaatcccagtcaaaatcccagaaggctttttttttttttttttgtagaaattaacaagctgaaaatagaaactattttaaatggtcaaaacaattttgggaaggaacaaaaagttggaaaacctacattatctgctttcaagacttactataaagttgcagtatatcaagacggtgtggtattggcacacagagataggtatagattactggcacagaatagggtacagaaatagggccaaacatataagtgtgattgattttttttaatttttttgagacagcgtcttgcgctaccacccagtggggagtgcagtggtgtgattacagctcactgcagcctcaaattcctgagctcaagccaacctcccaccttggcctgtttgattgatttttgacaacagtgcccaagataactgacttgaaaaatgataatctttgcaatacatggtgctgaaacaaacattcatatgcaagaatatgaaaccttgatctctatctcacatgtatataaaaattaacttgaaataaatcatagacctaaatgtaaaactacaaaccttctaaaataaaatacaggagaaaacctttctgactttgggtaggtaaagtttttttcagatggaacaaaataagcatgaaccataaaaggaaaaaagtgataagctggactttataaaaattaagaatattaacaactgctgttcttgaagagataatgctggccagacatggtagcccacacctgtaatcccagaactttgggaggctgaggtgggtggatcacctgaggtcagcagtttgagaccagcctggccaacatggtgaaaccccatctctactaaaaatacaaaaattagccaggcatggtggcatgaacctgtaatcccagctacttaggaggctgaggcagcagaattgcttcaacccaggaggcggaggttgcagtaagttgagatcatgcgcactccagcctgggcgacagagcgagactccatctcaaaaaaaaagagagagaaagggaaagagagataatgctaagaacagtgaaaagacaaacaacaaactgggagaaattattctcaatacttatatcagacaaaggacttgtatccggaatataaaaaagaagtcttaaaattgtaagaaaacaaacaattcaacttaaagcctgagcaaaagagctgaatagacactgcccaaaagaaaatatcggatcgccaataagcacatgaagaaatgcttggcaccatttggcaacaggaaaatgcaaattaaaaccacaattagataccactatacatccacctgaatggttaaaattaaaaaactattttaagcccaggaatttgggcctgcaatgagctgtgagcacaccactgcattctagcctgaacaacagagcaagaccctgtctccaaaaaaaaagaaaaagaaaaaaaaaaacattctggccggccacagtggctcatatctgtaatcccagcattctgggaggctgaggcaagaggattgcttgagcccaggaatctgagaccagcctaagcaacacagtgacacccagtctctacaaaaaataaaaaaacaaaactagtcaagagtggtcgtacacacctatatcccagctattcaggaggttgaggtggcaggatcacttgagcccaggaattcaaggctgcagtgagccatgactgtgccactgcactgacagcctgggcaacagagcaagatcctgtctcttaaaaaaaaaaaaaaagaatctgacactttacaatggttggcaaagatgtggagtaactagaactctcatgccctactggtgggaatgtaaaatggtacaatggttttgaaaaacagttggcagtttcttgtaaagttaaacacacacttctcatatgaccgagaaattctactcctaggtatttacccaaaagaaatgaaaacacatgtccacacaaagacctgtatgtggatgttcatagcagctttactcaaaacagccataaatgacagcatatccatacaatggaatactactcaggaataaaaagtaatgggctacccacacatgcaataaggacaagtctcaaaaacataacactgatcaaaaaaaagaagggtatccagtacactatatgattccacttagatgacgtttcagaaaaggccaatctaatcatctagtgatagacagtatatcagtgatctcctgaggctccaggcttaggggtggatgagcgcatgagaactgattaagaaaagtaacaaaggcagtggctcacgcctgtaatcctagcactttgggaggctgaggcgggcggatcacaaggtcaggagatcgagaccatcctggctaacacggtgaaactccacctctaccaaaaaaagacaaaaaattagccgggcgtggtggcaggtgcctgtagtcccagctactgagggagactgaggcagcagaatggcatgaacctcggaagcggagtttgcagtgagcctagatcgcgccactgcactccagcctgggcaacagagcgagactccatctcaaaaaaaagaaaggtaacaaaggaatctttcggaatactggaaatgttctgtgtcttgattgtaaaggtagttacatgtaaaacatttatcaaactgtacactaaaatgggtgcattttcttgaatataaatcataactaaataaagttgattttttaaaaaagcaaacagcaacaaacctatgcaacattaaacaatactaaggcccaggagactccatattcactaacgtccaaataacaccaatatctccacttctaaagagagtgaatgcttgaatctgtatctagtgcaaattcacagaagtgactactctatggtgggtaaacatattgcagcatctgctacagacagagtgcaattaagatcagaaacccatgttatactgtgtctcgccactttatttattgattggaggcagcgtcttgctttgttgcccaggctggagtgcaatgacgtgatcatagatcactgtaaccttgaactcctgggctcaagcaatcctcccacctcagactcccaaagtgctgggtttacaggtgtgggccacatcactttagagcggttccacccctgttacttgtcttatctgctaaatttacccagctaacaagattcagtgttgaattcaaaatatttcttatgatctccatgtatgttttggagcttcttttcccaagaaacaccaaataattgatcttaacccataaaggttttctatctcagagacacatttgcctcattgcaaataataagattagttgtgcttcagtcataacatcgtaagttgctaggcagccagaagtgagttaatcagaaaatgaatcatcaaagacatggtacgcaatctccttttatgggtgtctcattcttaaaacactttcaaggaagcagaagcaaatatttgtctactcgtatggaatttatatgacgcaatccaattcttactattggtatttgacacgcaaaatactcacacgcaatttcatgttcgcttggtgtcttcactcacaggacaaagccagatggcacagcaaatctttataatcaaaagatggcactcctgggccgggcgcagtggctaatgcctgtaatcccggcactttgggaggctgaggtgggtggatcacctgaggtcaggagtttgagaccagcctggccaacatggtgaaaccccatctctactaaaaaatacaaaaattagccaggcgtggtgatggacacctgtagtcccagctacgtgggaggctgaggcaagagaatcgcttgaactccggaggtggagggtgcagtgagcagagatcgcgccactgcactccagcatgggggacagggcaagactctgtatggaaaaaaaaaaaaatggcgctcctgaaataggactatttttttttcctgacttcatctaaggcagggattgatcatctgacaacccttggggtgggcgtttattcagcgtgccagtaccaagcaaagcaaggctccatgcaggtttgcgaaatgcctgtctgggtgtctgcgtgtgtgcacctcctcaccagcctggtcccttatgcggcagcttctgtctagccacactggtcccctgtggtctaaccaacccctgcctgacctgtccaggttccacgctgcacggcactgcaccctggcatgagttcccaaaactgctgcttcctgcttcccaccctgtgttctgccactagccccaagcaccggcacacaaaagcgaacggctctgaagggcttccaccttccagtggcttactttgctgaaaccagtccattttcacaaacatccaggctgaccgtcacttagggacaccctcgggccaaaatgaatctggagatgtggtttatttagcccacattttgaaccagctgcaacacttaaaaattgagatatttcatatcaaatttcctgcctcttttgaagcagcagcaactctttccacacagcagtaatgggctacagccaagtagccaccctcatcccgtggagaacgcgctccagctggccctgtgtgtccccagcagccagctgcactctgcgctgcctctcctgccccctcccctggcctctgggttagagaccactcgtctcagccccagcagcaagcctggaacccatccagccatccttctctggggccctgatgatgcgtccttccagttaggtccattttaactccccagactgagtctagtgacactgactctcagaacagaaggggactattttggtagttcctcaaaaagttaaacaagaggccaggcacagtggctcatgcccgtaatctcagcactttgggaggctgaggcgggcggatcacaaggtaaggagatcgagaccatcctggctaacacggtgaaaccccgtatctactaaaaatacaaaaaaaaaaattaaccgggtgttgtggcaggtgcctgtagtcccagctacttgggaggctgaggcaggagaatggtgtggactcgggaggcggagcttgcagtgagccgagatcgcgccactgcactccagcctgggcgatagagcgagactccgtctcaaaaaaaaaaaaaaaaaaaaaaaacattaaacagagagggccgggcgcggtggctctcacctgtactcccaacactttgggaggggccgaggtgggtggatcacctgaggtcagaagtttgagaccagcctgaccaacatggtgaaaccctgtctctaccaaaaatacaaaaattagccaggcgtggtggtgagcacctgtaatctcagctacttgggaggcggagacagaagaatcgcttgaacccaggaggcggaggctatagtgagccaagatcatgccattgcactccagcctgggcaacaagagcaaaactccgtctcaaaaaaaaaaaaaaaaaattaaacagagaattaatacatgatccagcaattccactcccaggtataaacccaaaagaactgacagcagggacccagatatgtgtgtgccaatgatcatggcagcattattcacaacagccaaggctggaaataacccaggtgtccctcaatagacaaatggataaacaaaatgtggcatatacaattaaggggatattattcagccaaaaaaaaaaaacaaggtatgaagttctgatacatgttataacatggatggaccttgaaaacattacactaagttaaataaaagccagacacaaaaggacaaatattgtatgatgtcacttgtatgaaatatccagaataggaaaattcataaaaatggaaagtagaacagaggttaccaggagccacagggagaggggaaggggaattatttattcactgttacagagtttctatttaggacgcttaaaaaaaaagttttggaaatatagagtgaaaatggttgtaaaatagtgtgggtgtaatttacaccactgaatcggagacttaaaggtggttctaacagtaaacttattttatatatattttatcacattaaagagagaaagggagagagagaaggagtcaggatctcagttcctttactctcacaaagctccctgtcctctatgcaattagccaccccccccaacccctgccatcaattagccctgcagaccagggggagcaaagggacagcttgcacaggcaaccgaggggtctcgctgtgctctcctctgggtccctccttgctgtccctgagtatcactaagagaggccactcaaaggacctctcagaacaaaagtcatttccaaggtgactttccacccacttctccagctaaatgattttaagttctgcttaggcacccacttagctacaacaagagtatgaaagccaccactttctgcacatccatccactgccaagcactgctgggtgctgtggacccaagatccccagtcctttccaggcgacacctctgcatcattagcaccgtccacagcagaagaaatgggaccccagacagcattaacgactgcccaaaccacacaggcagtataccgcagagctggaatttgaacccatgaaaccaaatctgtctggctcccaaatccttgctctaattcctatcccacggtcctcacaaagagacctacctaacccaaaatgcagcaaattaggaaatgcctattttctataatcaaaatgctgatggtatcacaaagatataaactcaatatgcaactatgaataaacataaaatggatgtgtatggctcagagctgggggtggggtaggagggagaagggcagtgggcaggggtgggagcagagtgtttgataagaaaaacttcaatttggcggggtgtggtggctcacgctgtaatcccagcaatttgggaggcccaggcaggcagatcacctgaggccaggagtttgagaccagcctggccaacatcgtgaaactccgtctctactaaaaatacaaaaattagcagggcatggtggtgggtgcctgtagtcccagctacttgggaagctgaggcagaagattcacttaaacccaggaagtgaaggttgcagtgagccgagatggtgggccactgcaacactccagcctgggcaacaaagactccatcttaaaaaaaaagaaacttgaatgtgaaccttgaagctaccacccactagctgtgcctacttagacaaggctgtgagaggacactttcacaaagaaataaaggttttatcatgtaagtgagctactgctgacctcacccctatctggtttctgcaggaaagaggtgtcatattcacaagggttctgtaatggaaggactgtgggcagaggtaagagaacccaagaacaaggaaggggtgccaaagcacttggaaccagcaagggactgaaggagcaagagggggagctgctaatgggaaataatattaataccttgacctctctcaaatcctgcccatcaatctcctgccagtgcagccagtgatgagaaacatccagagttaggagcacgggagcccagggatgggccgacaggtgaacggtccaggggccagcacatctggctgggtgggcttgctggttatgcgtcccctctcacatccagccctgcacaactctgacttagtcccagcaacaacatgaacttctacacagcctgatctagcgatgagcccaaatcgattcagcaactccaaaggacttaggattgatgtcattggctatctaacccccaggaatatgagttcctccagggctgaacttgccacagggctttctagatccccaatgcctgggacacagtaggcactcaataaatgtctgttaagcggtcttccttttataatgtaaagtgatagctcaggctcagacgctgaaaggcccaggatttactgcatttttttgttacctgccaactagcgaagaccacaaaaggcttgagtagaacagtaaaagcagggagtgaataagtcatttctaataaggctggttttataggcatcacacctccaccaagccaaacaggctcactgtagaagcggaatctattctgcaagtgcagagaccaaagagaaagccagggttggctctaacggcgagggcggctctatggggcagctcagccactgcctccacaatgagagacgcgaacttccactcactggtctcgtgggtgcgggaccgacacccacaggagtctctggggccttcattaagcctgcccaaggaaaacgcccgccatttgtctcagcccaacacaaacaggcttctgacagagcaggcagcgtgggggtggagggcatggaaaacgctggggctgagccctgggggcccataggcagccctgcctggtgcacccagaggtgcccatcctagccgacatgcacaccaacgtgaccattcacacgttcccttccttctgatgctgacatgtccccccgccccaccatcctcagctatttgcctgttacctgccagccccacctgggcttcttgtgggggcaggggactctggcatgggatcctgccctcagctctgccaccatcagctgtgaggccgcaagaggcactccctgggctgaccgcagcttcttcatttttctaacgagaaaacgagaacatctctctctggtaaaacggagcttcaagattcaatgtttagcctccactgtttaattctcagttgaaattttaacatcatgttatgttaaaatatatgttacctggaaagagagaagcggccccatatcaagaggccaagagctttctgctccaggaccttatcttagcaaaggttcactggtccaactggctgtcaccatgacacttgggaacattcagagaatcccagggaataacacctggccaggcctggcaggagagaggggagcggcgtccaacactgccctacgtgtgcaaggagagggcgggtctaaccccacacactcaaggccacggtctaagaagctccggctcagaaggtgcattcgttcataggagaaaagcagagtttctactgaaaagtgtttttaataacacacaaaacaattccaacttttccctgaaactccatctggccagtttcctccggcatgcccacagctgattcttctagaaactgtttaacatgattgttaagaataacctaacaacctgttaggttatttatcctgctttcccagaatacagagctggactgtgcgggcagccgctcgggcagagagggctgtgcactgccggcctgtccctggggtctctgggggctctcggtgcacaggagccaaggaagcagctcccaatccattagggggaaaaaccaaaacactttgcaagtgtccaaataaaatgtgcttactaaatgtctactataagcaaaatactgggaaagggatacaaagattaacaacatatggtccttgctttcaaatcagcttgcatgacagtttaatggggaaaacagatatttatacaaataatacaacaatagcacttatacaaaccacctaaaaaaaatcttatggaagtgactagatctaaggttccaagtcacgatacttgggttaggaaattgcaagaaaaaattcaaatcctatacccgtgacatgatcatcagtggaattttcctagatcagaggggtagaatccctttgttgagtataaaagatcaactatctgtcctcatagcatccggctgtaagatttttttatgttctgtaatttaagacttttcttttaagagatagggtcttgcttgctcaacatgttcctcaggctggagtgcagtggcgcgatcacaaactcaactcccgggctcaagagaacctctcatctcagcctcccaagtagctgggattataggtgcacaccatcatgcctagctaatttttttttttttttttttttttttttatcttttgtagaggtggagtctcgctgtgttgcccaacctggtcttcaacacctggactcaagcgatcctcccacctcagcctcccgaagtgctgagattacgggcatgagccgctgcacctgaccaatttaaaacttaaaatcttactactctaagaactttatacacatgtgctttataaatgctggttcatatgaagatggaatatccccctcaaccctgtagggtgatacacagccatacggaaccatcacaaactagtaggctactgcttttacttcaaataaaacaaatactccccgggccaagtagaaactagagccgttctcctggaagcaaagatgtcaaagcctctcactcttagaaacaacccacaatagggtctgggctttgtggtttacttaaaggaagtaacatttgcatcttcaaaacaaaaacaaaaggccctctttatcaggaaaatgtggcaaaaggttcaccagtggtaaatctgggtgaaggctccacagggcttatagggttggtgtatgactcttttaccttttcttcagttccaattttttttaacaaaaaattgggggagaaataaaggattttccccagaagcttgaaaggccctgccagctcctacatgatctgtagatttttgttctgctgttaatcgtggaatcatcaaagaaacagccttcataaagaatcaaaaagcaaaacagcaatgaagaacaccttttagcttttgatctgaacaagccttcatgctgcctttgccggggaagggctgctgaaccattctgaggcaagaacacctccctgaaaaaccacagatttccatcctcatggagccatccctccacagacccagatcttgtacagcccaaatgcagggcgcactttccccgagtacaaaccccagtgcgtttcatgaagctgttcagtatatgcagaatcagtgcattaataacagcttattggcaccgaatgaaaaacacacaagtcttaatcttaggtcttgaattttgtccagttcctacgtcatacctggctgtaagggctacagccgtaagcatgcttggtgactggaggctgtgtagtgagacctgagttttgaaaccaggattggtagcttaacaaaatttactggttgtagaaaaagtaaacttgcctccggggaggtgagctcagcctcaccattctgacagcagcctctggtggccagtttagtaaaaagtgttggctctcatgctgaaagctcggaccttcccttcttaatgaaggtcgctgcaagcagacaggccattctaggtaacagctggaggtgactggggaagctgcagaaatccaaacgaaggtgtgactttggaccacgtaaatcaccaagtcattggatgatctgtctcttgcattaaaaaaaaaaaaaaatgaagtactctctttcaaaagtagaaaaataaataaagagaactgttttaaaagggctcaagtcacaaggcagataatacatactcagtttgaaagtaatctcattccttacttgcatagaaagcctttaaatattcaaggagcacagattcctgaacaaaataaagcccagcctgtctgctttcttacatagcaccccatggtacactaactcctatgtactgagtgccggaaattcttcctgcaaagtaaggaattgctccatatggcagaaacttctagaaaatgctgcaaccattcattcagagaacaaaattaaatattcaggattgtaggtgaggcctgatttctagtgccacagattcacaccatttcactggatataaatagaggaatgatcagaggctgacagttggcttcaaaggcagagagggtaagaaggagacgccatcagcttcaagccaacttcttcgtaaggtgcactctgtcctcagctgtcagagaacaatctggaaacaatctgctgagcagctgctctcatcaacaaactgtttattgtaagaaagtggctgggtcaaaggctaaacatcaacccgagctgaaagcatacagaacaaaaatcaataccgtccctgctaaagagacccaggacttagcatgcagaaaagagagggtgaggaactcatgtttagttctgaaagagtaagagttggaacaaaacccccatatttcaacattcagggttcttctgcatattattccaattggcgacttgctgctatttgcagaatggccttgtaatgggggctaaaatgtggcattcaacaaggacacagaaatcaactttgccctaaaagttacaggggttaacatcagttgtttctctctcacatttgttttgcaacaggaccaacgtgctcatcatacacatgtgcttattatacacaatgcacagatactacagtccatctttaaatatgtctaattggaaactggaaggctgactggacatgagattatatgaagagattgtttcattttaggtatgacggtggaattgtgattatgtttttaaacagagctcgcatctttcagagacacatactaaaatatttgcagatgagaaaactgaaacagtatctgggaattccttccaaataatactggcagagaagtgggtagaaagaagtgaaataagattggccataaatggataactgtgaaagagagtgatgagtacagaagaattcactcattatttatatttacttttgcatatttgaaattttctatgaaatgtttgcttttacttgtgtgtaaagttcaacagttactttgaaagaaaaaaagttttcttaaatataagagaagtattaacctaccgaggcaaattaattaagtcatatgccatggtattgctaggtatccaatttaacgtttttgagcaatgtccgagatatggttgttatgtcctgagttgaacgatggagaagtagaaagagatgctcaaagtgttcccactgcatacgtgctccagcaagccagaatgtgacacagaaacagataagacggtttcccatggtttaattgcagtatggggcaagaggacatacgtgagatgctaggaaaacccaactgtcataaataatggggaccaaattgttaaaagacaagttagcacacaaattttgaaaacacaatttctttgtaaatctgaggctgctatatagtgtattgataattcttaaattaacagtaaaattagagaattagcctgaaataaataaaaataaagcagatagcaaaacattatttcattgtgctgaaattaactgtgaagatgtatctatgattttaacttgttccaatataaagatgaaaatggtaataatcacaaattcttagaaaagaatgcattcaaaggaactgcttaaaaagttaaaaaaaattttttttagtctacttgctttgccaagaccagcataaatactgcagagagtcctgcaaaggatgagaaaggtcatcttgtctaccctccctcccaacagaacagagaagggtttggtcatgagaatttggtgacgcaccaggcacggtagctcatacctgtgaggccaagtactttgggaagctgaggcggaagaattgtctgagcccagaaatttgagaccagtttgggcaaaaagtaagactccatctctacaaaacacaaaagtaaaatagccaggtatggcgatatgtgcctgtagtccccgctgcttgggaggctgaggtgggagattacctgagctcaggagttcaaggctgcagtgagccatgatcatgccactgcactccaacctgagtgacagaacgagaccctgtctcaagaaaaaagaaaaaaaaaaaaagacacccaccctagtgggaaggtggggcagagatgggaatggttaatggatgcaaaaaataaaaataaataaaaagaacgaataagacctagtatttgatagcacaacagggtgactacagttaataataatttaactgtacatgctcaaataactaaaataatataatttgtttgtaatataaaggataaatgcttgagaagataggtaccccattttatatgatgtgattattatgcacagcacgcctgtatcaaagcatctcatgcatcccataaatgtatacacctactatgtacctattaaattaaaattaaaaaaaatttttaaagccgtctaccaagaaaaactcatttggccaatctgagacactacacctaaccccaacatcacagaaggaaaaaatacacagagcaaaaccttcaaaattatagacctttgacctttaaagcattttattaactaaaaagctacagaaaaacttaaatcctgaaatgcatcaaggttgcctatgaaaagtaatctagacaatcctaggcagagtctggctatccccccacccccaaattaaccatcattttttaatttatgaaactactgtttgatgtttcttttaaaaggtgtattttcttatttacggaaattaaaaacaggaagagggatcagtggtgccatcattcaatcactcttcagtgaactactctacgtaggattcatttttgttcagagaagagagcaacttaccaaatgtttacctagggcatacaaaagcaaactcagtaagttttctgagaagaatattcactttcagccgggcacagtggctcacgcctgtaatcccagcactttggggagccgaggcaggcggatcacaaggtcaggagtccaagaccagcctgaccaacatggtgaaaccccgtctctactaaaaatacaaaaactagctgggcgtggtggtgtgtgcctataattccagctactcaggaggctgaggcaggagaatcgcttgaacccgggaggtggaggttgcagtgagccgagatcgtgccactgcactccagcctgggtaagagtgagactctgtctcaaagaaaaagaaaaaagaatattcactttcaactttaattttaattttctaaacttttccttaatgcatgtaggaggcaggttgaattaaactaaaagtttttatagaccagtggctcaggaaagcctcatggtgggtgaaactgacaatggtcctatgatacgcatgttcaggacccagcgatctagctgactgctgatgggcaacgctgttctcctttcgctcacacctagaatctgaatctcagcctcggaggcgcagcagcacagtgccaaagcagccctcctcttcacccagagcccctgtcccctgcactcagacacacatgccagagacccaccagagacacaaacacctacacaacaaaattgtgctgtgaacctcgtgtcaagggaaagtgcatttcccttttaccagaaatctccagacccgctactctaagtcttctctcactctctgggagaaatgaccactccacaaaggcacgttctatctcagcaatcttaagtttttctgtagttctggttaaaacagacatatgcacttaaataaataaatatataaatgtatatgcatatatattatcataatatgtattcatatggttgaaattttaaaaactcaaatacccttaaaagtatcgattaaaagactctgtttttttaaattaaagccacgttcctcaattcacgaaataaaatttgagttatagaatttttttgtaaaggacagtagctccaatgatcaatgagaattgaaatcatagtctttaactccaatatctcctttttagaaaaaaatatttattttaattgacaagtaaaaagtatgtacatttctggtataccacatgatgctttgatatatgtgtatgttacggaacagaaactccaatattccttccactgattctattattaaaccaaagcctaaaaacattttaagaaagaaaagacccacgacaccagcagagggataatgtagaattgtactggaaacatggtagtacctggatagctgtgtggccaaactcggcatgctgtacctggggagacgcagccatacacaggcagctacaacaaaacaaacaaattaggaagatctctcagaaaaaaggagtcttcccttcttatctccaggagaaagtgcctgagggaccgacagacggactaaccttggctgagtcttcctgctttcacgaggaagcccgcaaaatcctcctggtgctgcccagcatcggccgagctccagcacaggagcgctctccttgcaccccaagttgtttctccccttaccactcaggtgggggaaatgggggattaaacaccactcaggtccacaaactgcctgtcagttttgaaacccccgaaacactataaacatttttccaagacagtcagtgcaaatctccaggcggcattctcaaatcattagcatgcatggaaacaaaatgtgctccccagctataattcacatcccaagaactgaaggagaacatttatcaaatgggattcgggtctcagaccccgacattcctgagctgacaccaccagctccgcggcccgggagcgccagactcaacggttccgtcatcgccgggcgccccaccgccgcacccaccgccagctctggtccttggccctgcacctgaccacaggagccctttgatcatgctctctaacccggcaccagtatgggcttattcctgggatgtgttttttgaactgggagacaaaaatccgcgtgtgagaatgttctaagcccttctggagacagcctccaccgacttccctgggaggtgaggccagaatccatacccgctcacacatggcagctattaggaagcccgggtaggagacaaaaagcatgtggtcttggaggattttttttattccaaaagaggccgtttcccatccacaagtttgtgactgcataaacggtggatataaatagacggaggaaagaaaaccacgcttcttagacgggatgctatcccaagaaggaaagtgctgagcgggaatgttccctcggcctcagagaccttatcaccccttcaccaggccagacagcaaagaccgcaacgcacagaagccagaatcatcacaaaactaattaaacgtggaaaacaacaaaagcgtttgtgcagatttcccacaagcacacatctctgccccgggtatttactctgcaggcgctgctttgaggcacacttgtggaaacaagattcaagtaaaaagacaggacacacagtagctgaaaagccttcttcccacaaaaataaaacattctaaagggagcacaggaaaaccccccaagtatgatttcttttgcaattcaacatcaaaacccatcatgtcaccttttgccatgggtattatgtttgataacaggaagtcagtcaaaatgaacaaaaaatttccagcgtaggtgaagggcgaaggaagaaagaaacgagagaaagaggtatatgaaagacccttaaaagcattcatagctataaaagcttttaaatgtttgctttaatctgctagctgcctttagccggtgccgtattgtaaaacagccgcacaagaccacagcagccacatgtcaaaagctattcaaggtgcacctggaattctgacttcctctctaatttggatctctaaaaattatttttaagctgtattttaaagttatgcccaaagcttcgccctatctatacattcgagactcagaactaggattaaaaataggagaaggggaggactccacatcaagtactatgttaaaaaatggcaggcaaagattttttttagtggagaattctaattaactcattagaaaaatacattaagccaggtgcagtggctcatgcctgtaatcccagcactttgcggggctgaggcaggtggatgacctgaggtcaggagtttgagaccagcctgactaacatggtgaaaccctgtctctactaaaaatacaaaaattagccaggcatggtgatgggcacctgtaaccccagctacttgggaggctgaggcaggagaatcgcttgaacccaggaagcagaggctgcagtgagcagagattgcaccactgcactccagcctaggcgacaagagcaagactccatctcaaaaagaaaaacaacagaaacgaaaaatacataagcctcttcactgtcctgtacgccagcttcctctcccgggggcaaggactccttccccgccctgccctacttatcagggtcactatgagacccaaatgagatggcgacacaggtaaaaaagcttggttaactagaacgcatgccacaaagacgaggaattatccctcgttttccagaaacttctgcagcaagggcttgtacttagtaggcacacagatgtttgctacatgaaggggccagttagagaaggaggaacaactgtgtggtatgtatgactgagtctaagtttcttcataaagctatcaacgtctgaaaagcagctccatctcagtatgttcatgtatatcaaatcatcatgctgcataccttaaatatatacaatttaaaaaaaagtaacataaaggacttcccggagtagaagggcctgtacccgttttttgatatgtttacaagtatctaaactatccttaccaacaaaacctgctttttatggggggaaaaagtttcacagtaaaaatttggggttaaatcaaaatgaaatgtcataactagtttctgtttttaagtacgtattacccattccataactccccactaccaaaatcacacaaacacacctcatggtgattttgcccgatcatttcagtaacaaacccagttgtcacttcttgtgacagctacatcttgatcccagctggacacaggacccctgctaagagtccagccggcttgtgtttctcaggtcacctacacactgttagccaccgttggccacgatgaacacccacaaggttcccaagctttttcattttggaaaaattcttgtgctccccagatcctaagcagatgtcccaggctacgggagcaatgcacaagctctctagttccccaaggtaaaggtgccgaccttcctgggggcagcacgtccagttccccaaggtaaaggtgccgaccttcctaggggtggcacatcccaccttcttctgcttcctctggactcactggggggaccaaaaggggtccactggcaggcaactctgcaggggtggagggtggggggctggctctgccccacacacagattcaggtcccagccggtcctaacccgccagctgcccctcccagtgagaccctgcagagcgtggcagcctgtgctttctttctgccattgctctggcagagataaaaaggaaaatggaacccagagaaacagaaacaaggcagctagcttctcaactgggaaagaattacattttctctagaacatcagattcgatagaaaataaaatctattaaaatgtttctataaaatataaaagaattatgttttttctggtgttctgtaagggaaaggattatgtttcttctataaaatcagtgtttctcaaaaacattcatgtcccagcacagtaaagatgtattgctgctgactgcctgtcacccactggtggcgggaagatgtggtggccaccaggtgatcgcaccccggacaccccacagtgagccatgtggtgtatcagtctctcacccaccaacatctgcagagaggaagccatggagaggtccccatatatatggtcttggagaaacagttcaaagggctctgccaagaaactggaacatccaagcaggggtagggcacccaggggtaccttccacccacagaagcaaagggacagcttcagctcggaggcccccacacaccaactcagagctcacagttaaccctggaagtcacagctgccacaggccatgaacaagagtcacgtgttttactatcagagcgaaccctttctaaataatatgtcaaatattaatattaaccaaagtatcaacacctatgagattccctgccttttaacattcaagtgtgaccatgtgtgagatgccttcaaagtccaatgacacgcagtcatttgtttttagtttttaataactaatttggctcattataaaataactcataacaaataaccaatttggctcattataaaataactaataactaatttggcttattatatatataatcattatagaaaatttggaaaatacagagaaagttttaaaagattattaaaatcacccttaagcactccaccacaaataagtcccatatataccagatttccttccagtcttgtttcctttttttttttttttttttgagacagggtctcactctgttgcccaggctggagtgcagtggcacaatcatagctcactacagcctcaacctccctggctcaggcaatcctcctgcctcagcctcccgagtagctaggactacaggtatgcgccaccatgcctggctaatttttgtatcttctgtaaagaatacgaaattctgccaggttgcccaggctggtctcgaattcctgggcttgagcgatccacctgcctcagcctcccaaggcattgggattacaggcttgagccactgcacctggcccagtcttctttctacggagataggtgtgtggtaaacgtgtgtttgtgtgtttgttttatggtttaactttttgtcattttgctgagacccaaatttcaatcctgctcctgggaggttcaattaaacgtgaaagccttggtcggaggaagcccagctcagccgcccacagcctgcatctcagccaagccctgcttcctcttggtatcgtgcacagtgacactgatggagccacacatgactgggttttatagtgggaatcacacgctaccatggtgtctgggtgtcgatgaaggtctccgagcacatccttcccaaatgccaagggctgaccgtcgctgaggcgagtgttttttctctttgggtcttgctactattctttccagttatatcacagtaacggagaagcacataaatcttctgcgctattcgtcataaagagcaagtgtcaaggcaccaaactgtgtaaacacagctggtacgcagtaaaactatttagataactagcatatttattttgttctttcatatcccatactataatagtacctaggacacagtaaacgttgaatgaaagatgaatattattaactgggacattgaaataatttctgcagacccaaaagaaagtgccaccaatataatggaaaactataaaattatactatgtgaaactgatatagacagaaaaaaattaaatctctgaagaacaactttatagttctagggtcctgtatgcgaggcagcctagctcagcagcgacaccctgtggtgagagatctttgactcccagcaacagagtgtcttgcagggcacaggaagcagaaagccagcccaggcatccaatccctaaggcaggcgatgagccaaatggacaggcaggatttagcagatgactgggtgccaagatcctctccatggaacttaattccgtgaggatgactgagatctgttaagtagggatgccagaaagaaaaccaaatacaaagcacaaacccaattccattcccagtctctgtggtccagatctataaatactgacccatagcacagtgactagatgcaggaggaattcagctgcctccggaaagaccacctcaggcagtgcatatccaccttcaaattcatttgcactataatcctttagagaacttgtattccaagaaaacatcatataaaaccttgacttctgccatttccttctacagcagattcaaggacacctaagcagagttaataaacattaagaggccgggagcgccatgcctgtaatcccaacactttggaaagccaaggcaggcagattgcttgaactcgggagttcaagaccagcctgggcaacatggcgaaaccctgtctctacaaaaagtattaaaaattagccaggcatggtgatgcacacctgtagtcccagctactcggggggctgaggtgggaggatcgcttgagcttgggaggtggaggctgcagtgagccatgattgcaccactacactccagcctgggcaacagagcaagaccctgcctcaaaaactaaaaataaacattaagaaatgaggatatgtacaacatacacgtactcattccattccttgggctcccaaagtaaagcagaattcagtcagaaataagcagctgagaggaaagtagtccacagcacagatatccaagaaaatcaacaaggccaagtggagggcccgcaatgggaagtgaacatttctgaaaataattattttccaaagttattatgtaataaggggcttagtagggagtgtccatgtatgtgtatacagagcaaatatttgctttaatcatgttcaagcatttcattcccaaagtttgtgaaaggggaaatcaatactccctcaattgatcaatgaacaggtgaaaaagtatcacctcccactgccccaggctgtttaaaaaactggaaggacaaaaatgtgaagcatctgttgtgtgcttgaatataagcagacacatgatacaaagccctgacatgggtatttcaggttatactcatcctaaatacaccagaaatgccaagagttccaaacttccactcacaagagaataacctggggcagggccactcttcctatccactactctgtccaagagtccggaggtcaagtccgaagaccagcatgatcagaactccgagaaagggcagggagctctgccaagggcaaggccaggccacctcactcccggacttccccagctgggagcctcagagcaggcactggctaaggtagccagccccagccctccatccccaggaaaaggcgacagagaaggtctaggggactggcagtgctctcagattttctatctgtcttctccaagtgagcccatcacacccagatagctcatagctctgctctcctccaaaaactaagggacacagtgtaacacaaaagaaagtgcctcctttttaaaaaatgttgggatgagaggtataatttgtttgtttcaagagaaagtaggtaagtttagtgtttaaagtcacctagactattgggtgtttgcagaaactacatggttatgtcattcaactcacaaatttgtctgttcagagaagacaacagaaatagacaaaataatttgtcacaatgactatgaaactgatagtatggccaagcagggggattagcaagaacctacacctggagaatctggcgacctgcccaaaaccaggtatcaatcacaggcagcaagtgcaggcatgggccaagagaattcccgaacacattcccagctccgtgggcattttcctgtcagacacgactcacagacgtgaaacccagagcgctgttgccacaagatggcagacattagcacaaatgtgattgttccaaagatttgctgaaagtggctcaagtcaaaacaaatgttttcaatcccaaatgaataaagttacagtctgaatatactcttgacacagggaccctcttccccctaacgtggaaagggccacacctgcagacttaacacctttctaaactctactagttggccctctcttatatataatcctcccccaacaaaatgaatatttgcacatcttgaagatgatttccaaacccgaagtcaaaacagaaatggaaaatcaaaaccaaccaaaataaaacaattaaagcaacgggtcgccactgtgaagagggccacgtcacagcgcgctctgcccagctgagcccacaactcacctccgcagctgacagcaagtaaagaggagttaaggcaggaacttgtttcatgtcacagctgaggccaagggttgtcagaatctctctaaggacttcgtatcttctaaaattgcttgacttgagcaagttaaaatcttctggagtttgcactatgttggagctgggaggtagttctaagtgcacctgaaggggaaagatagcactatgtaaactgagggcactcacaggcaatgagaaaaacagtttcttttttctttttctttttttttttaaatttagagacaggatctcattatgttgcccaggctggtcttgaactcctgggctcaaacgatcctcccacctcagcctcccaaagtgctgggattacatgtatgagccaccacatctggccaaaaaatttctttaccagttttcttctccaagtgagcacatcacacccagatagctcatagctttgctctcctctgaaaattaagggacacagtataacccacaagagaaaacttgaacatgaatttttctaattatcaatagcatataaactctgaagctgtatatctggaaagtcatggccaacaaaagaacgattccaaagagcctactcaaattttggttgtcaggctgagaggccacggtggaaatgaccctggacagtcatcatctctctccaggtactgatgttccacactcatcagtcatatgaccttccgcaagttacttaacttgattataggaacaaaatatctagggccgggagcggtggctcacgcctgtaatcccagcactttgggaagccaaggcgggcagatcacctgaggtcgggagttcaagaccagcctgaccaacatggagaaaccctgtctctactaaaaatacaaaattagccaggcgtggttgcatgagcctgtaatcccagctactcgggaagttgaggcaggagaatcgcttgaacccaggaggcggaagttgcggtgagctgagatagctccattgcactccaacctgggcaacaagagtgaaactccatcgcaaaaaaaaaaaaaaaaaaaaaaaaagacctagaaagacagttatgctgaaaacctaattgctagtgagttcagggaggcaaatgggtcatgctggaaacttccattttgcctattagccataactggaaaacaatacctaggaagagagcagcgttattcatcattttaagagcgtttgcaggaggctgggtataaaggctcacacctgtaatcccaacactttggaagaccaagatgggaggattgcttgagcctaggagtttcagaccagcctggacaacatagtgaaaccctgtctctacaaaaaatacaaaaattagccaggcgtgggtggtgcggctgtagtcccaactacttgggaggctgagctgggaggatcccttgaacccaggaggttgaggctgcagtcagccatgatcgtgccactgcactccagcctgggcaacaaagtgcgaccatttaaaaagaaaaaaaaaagagagagagagtttgcaggaattcaaaacagcaggtccttgaataatgttgtttcactcaaagtcattttgttatgatgttgatgaggggaaaaagaaatcacttcccagccggggccactgtctgtgggtccgtacgctctccccatgtctgcacgggttttctctgtttctccgttttccccccacatccccaagctgtgcacattaggtgaaccgatgcgtctacatggtcctgatctgagcaagtgtgagtacgggtgtgagtgtgccctgtgatgggagggcatcctggccagggctgactcccccaccagtagtaccctgagcttcctggatgagttccagccacgcggccacccaccatgctgaactgaaataatcaggtaaataattatctttgtttttattaatctttcttaaatgtacatataattcatatttatttcagtgtttcagtgttttggcctttatttagaagtctggtgatgtctttgtgaccagaaatacactatgggaactgacttcttgtttatatcaattagcctatggtaacattggtttcattgtttgtcatttcacttaagggtgcagtttccaagaatctatcaacaactttaagtgaggacttactgaggaaggcatacgatttcttggacaccagaaaggcctttcctcccaccctccttcccctgattgaattttaagatttggaacttcacctagttacttcaggctttgttgtctagttaaaattaaaatatctccacctatcagcagcctttgtctgggtatgaaggaacttactggaacctctagctcccctgagatcagattttaaatgagcattgaagcctggaggttgccagaacactgagtacccagaaaagcaaactgagctcgtctgccttattttgtttcagctttgcctactgtatgcaaagcttctagcctgatattatagaagtattatgaaaataaaaagcataatgccagctttcaggcgacttagaatctctcaattcctaccttaaccaagccaaatatactaaccaaatgttagaagttgaggcttagctgggtgtggtggctcacgcctataatcccagcactttggcaggccgaggcgggaggatcatttgaggccaggagtttgagaccagcctggacaacatggtgaaaccccactgccactaaaaatacaaaaatcagccaggcatggtggcgcacgcctgtaatcccagttacttgagaggctgaggcacaagaatcacttgaacctgggaggcagaggttgcagtgagctgagatggtgccagtgcactccagcctgggtgacagagtgagactccggctcaaaaaaataaaggttgaggccaatcagaaaaggtctgcagggcaccgtccaacatggtccccaaaccacagctgattggctgcaggctggctgcttcctccaagactgaggatgccaatcatgggacaacaggtcaggtgggcctgtttgtagacagccctggagaggggaagaggcagaaaagcaaaaccctctaaagaatccatatcctcacctgatgtcaggagttcgaaaccagcctgaccaacatggtgaaaccgtctctactaaaaatacaaaaaaaattagccgggcctgatagcgcatgcttgtaatcccagttacttgggaggctgaggcaggagaatcacttgaacccgggaagcagaggttgcagtgagccgagatcgtaccactgcactccatcctaggcagtaagaatgaaactccgtctcaaaaaaaaaaaaaaaaaaaaacaatctgtatcctactcagtgcacttctaccctaaatgtgtacctctcctctccggtggacaaagccatgccagtatagacaaacagcatagcggcgagacccgtttaattcacttgagcacacggctatcccggagattaacccttacaggtggcagaaatgaaataagtcaagttctgttcccactagagccgaagggatgagaggggtgctcgactgaatgcatgtggactcactggtcagggtgaatacacagagtagccaagatgcacacgcagtgaattgtatgaactcgttttcacatgagaacgatgccaggacggaaaacaggatggcgctacaagcgggcggagttcctggagacaagggggaagatggccgctgaaaccccgagaactgcttggcttcactgtcttagggtttcaagatgtaggtgcttctacaatggaaacaagaaaagaggccacctctggttctacgctcccaattagcagggagaaatggcacaccggagtgtgtgggtggtagatttgtactcctcgtccacagaggtactggactagaatctcattctctgagtgtaaccctgttaccataatgacaggtctatttctgtaacttggcttcttgtaaaaataagactttttagttggaccgaaaaccggaactaaaaaaatgtctccagccacaaatgcgtggagagggtgatactggcatccagtggggagagaccagggatgctattccgcagccgaaaatgcacaagactgttgttgccacgaagaattctctgacccaaaatgtcaatagtgccatggttgagaaactctgtcatcaaaggcgacccactgctgccatgtgctaagctaaacaagaaaacaaaatcttttaaaatcccttttaaagattttctgtggacaacttcatggcaaattcctggtccatttgacagtcaaatgtcagcattaatccacagccttaagttttccctgcaaacttgatcagtacagcgagcatacaaacatttcctctctttctttattattatgaatggcaaaggcatcaaatctgcagcttactcggctgggacaccagtgcctagggtgcagctgtgttctgcccttgaaatactttacctcctcttattgggttacatcattactagatttattacaaaggtgaagactatgaaattgaacagggaaagaggaaactaaccagcctgtgataatatttattttttgatctcagtaaggtatcacagagacacaggcctgtggagaaaacagtgaccctgtcacacagaagactggaagtcatttaaaatcaaaaatgacattctaatcctctgaatctgatttgtgaagctgcatcatattgccttttttttctagggcaatgcactgcagtatcaaattttatgatagtaatggggtcaatttaaatggtgcagcaagcagatttgctatgtaactcggagaaatggatcacaacagtgccaaatcaattttctagtacaagtctgtgctcaggggtggtaaaattcactcttcaaaactgaaatatggctctaggaagtcgggtttttaagtggattttctgagaatatgcagttactatagttacaatatttgcagagaaaaagataagaggaacatttattacgcctccaaaagctaattcatgtggcctgcagcactgcaggaaacctgcttgggctgtacgtgttcatctgtcctaatgtccaaattccttaattttaagcatctctgcttgagtattatcttaagaacaagtgagtcggctttagaatagtaaagaaacaaatatatactctggaaaaaaatgtttggccagaaaattcaagaaacttagcttccaggagaactggaaaaagacaaggcattacaaaatgaaaacaaaacaaaaaaggaaacaattctctatctcaataaaaagatccctataataaaacaaaatcgattacacttatcttgggaactcttctggacaaaatatctacatctgcgtagttttctcattagagcatcaaatcctttagggcaagtgaatgttcatctaactctaatgaaaaccttttcccctaaggattaaaagatttggagtcaatgacaaggaattctgaaatagtttatccgctaccgtttgcttaaacaaacaaaaagctaaaaggaaaaagaagatgagccaaaggatctcctacgcaagaaaaagaaactagcattttcctttcatcctctttccattttccccctacctatgtattagtatgccacaaatctaagtagcttcaatattctcttatttgaagtttttcttttcagcacttggaagagtgacaaaacataagaaaggaattgggaacctgaagatgttttcaacaccaactaccttggcaatcaactgcagtatttcatcgcagtggtcactgacgtctagaatcactaccctgatggtttcaacttcctaccttaaataaagactcaattatattaaccaaggggtgctctaaggcaagaaagcagaccgatgaatttgagaaagatcattactagtaaagaacaaaacgagaattttctgactaagcctcagttaaccagcaagctcatttaaccctgacagctgccttgttcctccctcacaagtcttttggttaaccagggtattcaagaaagccctgaactaaactaaactttctgctcactatcagcaaaagctcccagccaatagtcaaaaacagcccgcagcacacgaactcctgaaacttttaagcgtgtacctttaaaagacatattccctcgcaaaaatacccacagatacccaaagatcaccaaatccatgctgccctgagtacctggcaaagaacagcttctcccccgcgagttccaaaaggcacatgcacaatcatcctgtccttgtcctcattctccaggtggccctggagcctgccggggctgagccggacggggccttcctggtacctgcagccactgctcaagacgctgagcttcacctcgctctggtcagccttggagaaaaccaagttctggactgtcttgtgcagtgcacccttgcttgtcacctgaaagccaccaaaggtgaaggatgaagacaggcccaacaccttccctccctgagaaagataggccatgaacttctggtacaggtcttcgggaatggactccctggtagcaatgaccaacagcagacagttgtccgtccacgggtctctgagagcactgtcctccagcaggtggtagagaatataactgtcaatgtccacacagtcggccagcacagaccggacctcgtggaaccggccgagggcttcctgggagtcggagcccacatagaggaggatgttgggtgcctttcccgtgaggttgactctcctcccttctctttcgggggaggtctcatcagcaacactctccaaactgctgctataatcgtagggaaggtctggaatgttctcggcagacgcaaacttgactgactcaatggtgctgttctcaagttccagacactcgtggcaactagacagatggaggtgataatgctcaacggggccccctcccctgtcactgtccccagcaggctcactcccagaggcactgcctctcctttgtttgggttcttcaccaagagcctttgggtcatctctgccaacatgctccataccgtcctgctcaggcttaatctcaagagaaggttcaggcttcggctctaggatctgggcttgcttgtttgagacctgatccttaacttccttcagagtggagtcctgcaagtgcaccgctaaggcatgaataggagagagagacagaaaattaatcaacacttcttgtatgacacatagctcatctcaagaatctcatcaccctctctgcattctgggacttacattccaggacagcctctggcacggctcccacctgcatcccccctcaactcgggggcatcctttggaaacactaattgttcccacctgaagaccccaagtgaaatcagcagtttgcccaacatcttttatacctattggagaacctaagaccctcttacggaatggtgaagaaagtgagattcagagaggtgcctttgcctccttacttacagattctatttcttgggtgttattctccttcacaataatgaaactgagcaataaaaaggacacatatctagagtctaccccagcacgccccagtgaaatgtcactctcaagacatgccataggatcaatgggagaagattcttcccagtatcttgtctcaggactggaacataagttgacaatcactaattcaaaaacatttattgagcacttgctacatgtcggacatggtattagagacatgtacgaggtgattctggatattaagggatttacataaacttccaaagctgataagggacatttatttgcccatcagatgaaagaagacattcatagacataaaaagcctgcttttaagtctaattaaggaagaacagtttgtgtgtttcctgaaaaacgatttgtcccaagaaattgtgatacatatattttaagtaaaaagcggtttgatttagaacttcatagtaacactagctatgcttcccactcaatcagaactgtagtctagacactagttatactgtattaaactatgtgaaataaatattatatgggttctgaatttgaatgccacctcatgagcaatgcagtcatgaaaacttcttgtttaagaaatttaataagcactgaaaatgtaccctgcagccccccaaaaaaatcttgacacatgcatgaattgtatattattacagtaaaatcaaacctgtggactgaattaaactgaaaccaagcatagcctttatgtcataccagtaagagtgctcaacagtccttaagctaataacttatagtgtcccactatgataaaaacagggtctcactttgtcacccacatgggaatgcagtggcgtgatcatggctcactgtggcctcaacctcccagctcaagtgatcctcccatctcagcctcccaagtagccgggaccacaggcatgcaccaccacacccagctaatttttttgtttgtttgtttttttggagataggggtctatgctgctcaggctggtctcgaactcctgggctccaagcgatcctcctgcctcggccttccaaagtgctgggattacaggcatgagccactatgcctggccaataaaaacattttctaaagttacttacacacaatcttttggggtaccagtccattatccatgtggagtctatcttccatgaacgccacccccagcttgctgaagttgtccacacttgcttcagcaattagccgataaggatccccaggtctgcaagctaatggcaaacaacagtctgaccacttgacaatctgagaaaaagcaggagagggaggaggtgggaaaagacaggttgagatttttcttctctaaaataaccacatactttatttttcccttgaggctcctaccactaaattacagtcattaataacaaattactggatattacattttactaatatcagagttgttttgaattcagcattctcatctctacctgacaacagtgcttacgaaacactaaatataactctctcatttaaaagtaactgaagtctccacctttttaaggaattaaaagataaagggacattccccagacactggaaaaacaccatgctgccctttaaaaacagagaagaggagagaacaagaagtccacaatacccagttactttcaatgtaacctgtggacccgcttttctcaaagtgtggtccgagaccaagtgcaactgacctcccagggagcacatgagaccttcagagtcccgagcacaactccctccctatctggtgcactggactttctggagttgaagtccaggaatcaggatttaaaacatgcttcccctggggttcctgcactcgaactgtgagaacaatccaaaaagactctccagacagttcctccctgtaaggaggttcacgttcctaccacaagggggacagggagaaagagagcaggcaaaacacccggcttagccttccagttcttactacagaagaccgtgacactggggcctggaacacccatgctctctctgagggttcccatggagaagacagcctgtgaggtgaagagcccggcgctgcagtcaggggtctgaggccgagtcaaaggcaactaatcatcactgtctgtcctcgggcaagcttccgaccctcacagcatcctaatttgtaaaacaagaatactctactaaaaatacaaaaattagccgggcgtggtgtcgcacacctgtagtcccagctactcggggggctgaggcaggagaatcgcttgaacccaagaggcagaggttgcagtgagctgagatcgtgccactgcactccagcctgggtgacagagcaagactccatctcaaaaacataaataaataaatataatttaaaggttggttgtgttcatgagatcaaagagtatacgtaatgcccccagtaaaaagcttagattgactggaataaagtactcaattaccgacagctgcttttattagctgtcacaaatgtggctttaaaagcagcagtgagcagcacagtctttttctaagatgccatgaacgattgctctacttcctaaagataccttctcagggacacactgccccgaatttcataattatagataaataattttttattccatttttatttatttgtatttatttattttttgagatgagtactcgctctatcacccaggctggtcttgaactcctggccttgagtaattctcccgcctcagcctcccgagtagctgggacaacaggctcgggccaccacactgggcttgaattctattttagatattggtgggctaggattttagaactaactcctcctaaaaactattttttaaatgctagataaaataaatgaataaagcattaccttaaaagtctggaagaacagactagataatagtgaacttccaggccaagtgtgggataaatcctgaacctacagaggaaaggggtattcctgcaagacacgccacttctgcccccagggtccttgctcatccaagcaacttgggtttcaaaagtcatcgtccaactggcataagcatagacatatagagatatggtttggctgggtccccacccaaatttcatctcgaactgtaatccccatgtgtcaagggacggacctggtgggaggtgacaggatcctgggggcagtttcccccatgctgttctcgtgatagtgagttctcatgagatctgatacttttgaagtgtttgggctgggcgcggtggttcatacctgtaatcccagcattttgggaggccaaggtgggcaaatcacctgagctcaggagttcatgactagcctgggcaacatggtaaaaccccgtctctactaaaaacacaaaaattagccaggcgttgttgtgggtgcctataatcccagctattcaggaggctgaggcaggagaatcgcttaaacccaggagttggaggttgcagtaagccgagatcatgccattgcactccagcctgggtgaaagagcaagactctgtctcaatcaatcaatcaataaagtgtttggtagtttcctctctgtctctgtctctcacctgccaccatgtaagacataccttgcttccccctttgccttctgccatgatggtaaatttcctgaggcttctccagccatgaagaactgtgagtcaattaaacctctttcctttaaaaattacccagtcttgggcagttctttctagcagtgtgaaaacagactaacacatatagaccaagagaacagagctgacagtatagaaataaacagattcatggacaactgaatttggacaagggtgccaagacaactcaataaggaaataatagtcttttcaacgaatggtactggtacaactacatactgacgtgtaaaagaatgaacataggctgggcatggtggctcatgcctgtaatcccaacactttgggaggccgaggcaggtagaccaccaggagtttgagaccagcctgaccaacatggtgaaaccccatctctactaaaaatacaaaaattggctgggcgcggtgtctcacgcctgtaaccacagccctttgggaggccaaggcaggtggactgcctgaggtcaggagctcgagaccagcttggccaacatagtgaaaccttgtctctactaaaaaatacaaaaaattagctgggcgtgctggcgggtgcctgtaatcccagctactcaggaggctaaggcagaagaaccacttgaacccgggaggcagaggttgcagtgagccgagatcgcaccattgcactccagcctgggcaatgagagcgaaactgtctcaaaaaaaaaaatacaaaatttagctaggtgggagcaggcacctgtaatcccagctactcaggaggctgaagctaggagaattgcttcaactcaggaggcagaggttgcagtgagccaacactccagcctggcactccagcctgggcactccagcctggcgacagtctcaaaaaaaacctattaaactttaaaagactcagatttgcattaaattgatacagaaaaagaaaaaaaccacagatagagaagcgttaaagacctcttttagaaaaaggagaaactggccaggctcggaggctcacgcctgcaatcccacctgagaggtggaggttgtggtgagctgagattgcgccattgcagtccagcctgggcgacagagcaagactccgtctcaaaaaaaaaaaaaaaaaaaaaaaaaaaaagaatgaggataaacctcttcctcacatcatgcaaaccacgtacaaaaattaactcaaactggatcaaagacctcaatataagagctaaaactacaaaattcagagaaggaaaacacaggcataaattgtcatgacttttgatcaaccaatgacttcttagataagacaccaaaaacagaagcaacaaaagaagaaatagataaattgaacttcatcaaacattcttgtgcttcaaaagatatcaagaaaatgcaaagacaacacagaaaaataggagaaagtattggcaaatcatataagaactcctacaactcaacaataaaaagacaatccaatttaaaaatgggcaaaggatgtaaggcacccggcaaaggcacctgtagtcccagctactagggaggctgaggcaggagaatggcgtgaaccccggaggcagagcttgcagtgagccaagattgcaccactgcacgccagcctgggcgacagagcgagactccatcttaaaaaaaaaaagaaagaaaagaaaatatacaaacgcccaataagcacaagaaacactgctcaacatcagtcacgaaggaaatgcatctcaaaaccacagtgagacacaaagtcatacccactaggatggctggaatcaaaaaagataccaacaaggacaaggaaaaactggaactctaatacactgctggtagaaattaaggtgctgcagctgccttggaagactttgggagttcctcaaagagttaaacatagagttaccatatgatctagtaattctactccccagtatatacctaagataactggacctgaacatacgaacacatctagattaggctcagaggatcttcccaaaggcaagccccagaggccttcacaaaagaaacaaactacgttcactgagaaacaactggaagatctgaacttgttcaataagaacgtatacccaaaccccagccttcagaaagatatggtctccaaaatggaaatagatccaaaagtactgtaggtttggctcaaaaaccttggagcaaaactcaagaaagccaaatgcaagcatatttggcaaaaacaagaagctcaacaacagcaaatatctgagaatgaggctgggtgcggtggctcactcctgtaaatcccagcactttgcggggctgaggcagaaggatcaggaattcaagaccaacctgggcaacatggcaaaaccctgtctctatgaaaaactacaaaaaatagccaggagccaggtgtgttgatgggcacctgtagtccccgctactcaggaggctgaggtgggatgatcgcttgagcctgggaagttgaggctgcagtgagctgtgatcatgccactacactccagcctgggcaacagagtgagaccctgtctaaaaaaaaaaaaaaaatctgagggtagactcaagaccaatccttctcagggaaatatggacacactacccacatccccaaatgaggcccatcctagagtttacacagatcatcaggcaccctcattccaactaaacttaggccccagtggtagggaccctatagaccaccccagtggccccaaaatagttcattttggctgctgccaagatctgaacatatacggcttctagacacttcagaatcccaagttcattctccaagcttccattttaattcttttggttcctcatctctacaaaatagagacatcagacacaaaaggtcacatattgtaatggtttatgatgattctcatacaaaagaatacttttcagcaggaagaaacaaacttgagatatgcacaacatggatggatttcaaaaacattatgttgagtggagaaaaaagatgccaaaggatacatgctgtataattccatttctatgaattcctagaacaggagaaactaatttaccatgtcaaaaagattcgtggcccaagtagaaagaattgaatagaaagaggcgcaagacaaatgcattggggtgatggtaatgtttcatgtcttaatgacctaggcagttacctaggtgtataaattcatcaaaacacacagaactgtgcatctaaaatctgtgcattttattttatataaattatacctcaattaaaaattaatatacaacaaaactagtaaggacaatttctttattttttttcctgcttctttgttttgattttggttttggttttttaattgttgttgttgttccatttgttcagctaatgagatttagtcagcatcactaagtggacagttggcttatgtttctaaatcctgtttttgggtcacctccctccatcatcatacttgaatgacctcgtcaagctcccttcattcattttggctctccccaagacgttcttcacgtagtcaccagggtaatgttattattcctttaaaaatgttgcactattccttggcctggcacggtggctcacgcctgtaatcctaacactttgggaggctgaggcgggtggatcacgaggtcaggagatcgagaccatcctagttaacggtgaaaccctgtctctactaaaaatacaaaaaattagccaggcatggtgacaggcgcctgtagtcccaactactcaggaggctgaggcaggagaatggcgtgaacccaggaagcggaacttgcagtgagccaagatcacaccactgcactccagcctgggcaacagagcgagactctatctcaaaaaaataaaaatgttgcactattcctctgcttaaaatccttccatgaataagttctgaagatctactgtacgtcatggtgactacaggtttttttttggtttttttttgtctcaaagaaaaaaccacatcatatgttgtaccccataaatatatacaactaaaaaaatactttcatggccatttttcatcattcaggaaaaaaaaatatgcccacatataaagcttgtatgcagatgttcacagcagcattattcacaatagccaaaaggtagaaacaacccaaatgtccatcaacagatgaacagataaataaaatgtatatagctatacagaggactattattcaaccataaaaaggaatgagaatgaactactgatgcatgttacaacgtggacgaatctcgaatacattacattaagtgaaagaagccaacaactaaaggtcccatattctatgaggctatttacatgaagtatctaaaatagacaaatctagagtcagaaagtagattcgcggttgccaggagctgaggtgtcagggagcagacagtgaatgctgacaagtgtgtggtttctttctggtgtgctgaaaatgttttagaattagataatgctaatgattgcacaactttgtgaatatactaaaaactactgaattgtttttcaagggtgagtttcatgtgaattatatctcaattttttaaaacaaaaagaaaagagtccaggcagtttgtttgtctctacactcttccagcacagcctagtcagcccaacttcccaaacttcaatcctggctcccctggttaagagcgtgtgacctgagcaagctactcaaattccccatgcttcaatgtcctgtctgtaaggtagagataagagcacctaccttggaaggttactgggagcactaaaagggatcatccataaagtgcctgggccacaagggtgctcttatggttccaaaatataaagtcctttagagcaagtaacctcatgagaaaccacatcatccctagtgggcaaaaaccgaacctggcagggaatggggaggtgaaaaaaatcttagacattacaacagtttgtggccctccaaggctcaatcctatccctcaacttttttattttttatttttattttttttgagacagggtcttactttatcacccaggctggagtggtgcagtcatggctcattgcagcctcgacttcctgggctccagcaatcctcccaactcagcctcccgagtagctgggacgacaggcatgcaccactatgacgggctaatttttgtattttttgtagagacgagaattcgctatgttgcccaagctggtctcaaactcctgagctcaagcgaccctcctgcctcaacctcccaaagtgctgggattacaggtgtgagccaccatgtccggccccccacaacaaaatcttattccttagtagctcatttctcttctcagagtgaacgtgaatttaattattctcctcggaaaaacaatcatgaaaaaaaaaaacttgagaaacattgcgtttgaggggaaaagaataaacgcaggcctttatggccaactcactaacctgtgtagaatatttggacaaagagaaactccagaattttcatttagctctacttgtatctttccttccactttaccacctacttctcccacctcctcgcagacacacagccaagggaagcagaattcacctagagggtcaggcccacccaatgtttcagcagagttctacatttcagaaatgacatctttgattcaggacagagagttcgttgatttcagctttgggaatgggggaaaggacgtcagttcaggaagatgagaagataaactaacaccgtggcagggcagacttctgggatgaaggtgcgtgggaaacagggaaacgaacagggcaacctcccgcgggaagctaaaggcaccattgtcctcagagcaatcaaaggaggaggagaaccgctcagccaatggagactcaacccggaatttagctgtaaaaacattgatttagccccctgcggtagcaggcactggcagtgtaaaaggagccaatgatgaaattcccacacacctctgaagaggaatgaggcaggagataaacaaaggaagaggaaggaccggaagagcccaaagaatacatccacacatcccggatcaagtttctccactctgccaactgtttcctcacctaagtgcatttccgttttctaggagcgtggtccatgagccatggaccatgcaaacgccttcaagcagcgctgggtgctccgatcaaagcagaaccgcgctgtcactgatacgtcgtccagggtgtttgccttccagtggataaaggcaaacaggacactttaaatttgcacttcgagatggaaacaaaggcatggaaaagagaagggaagtcaagcaaaaggctcactcccaaagatcaaagctaaggaagccctggctgtccctaaacaaaggagtttcctcctataatagcagccagcagaaatctgttaagtaactaaagctcttgacttgatgttacaatgtatggcagcaggcaaggcatatcttctctgctcaacttaaaactcacatccaagaagcagtccgggagtgaaagaccccaggttaaactagcacaggtggccctgcccaacagggggcattggcaggcagcagctctgcagtgagtggggaacagaaatctcaacaacccactggtacccagagtcagatcacggatgctgctaatttttctgactcttgtttctcctcttccaaatcatcttaattcaacgtgaaattgttaaaaagctctagtaacaaattggatggagcaaggctggaaacgcagaggtaaagaatttgaaaatacagggccaggcgcggtggctcacacctgtaatcccagcactttgggaggccgagacaggtggatcacgaggtcaggagttcgaaaccagcctggatggcatggtgaaacccccgcctctactaaaaatacaaaaattagccgggcatggtagcgtgcacctgtagtcccagctactcgggatgctgaggcaggagaatcactggaacccagtaggcagaggttgtggtgagccgagaccacaccactgcactccagcctggacgacagaacgacactccgtctagaaaaaaaaaaaaaaaaaagaatttgaaaatacaagactaaagggaaaaagttatttttaacttttggctatccttgctgtcttttgtgtttggaaatagagaggataaaggagagctacaaaattgactttcacttgatattatgtaaaaagacaggccagatgcagtggctcatgcctgtaatcccagcacttggggaggccgaggcaggaaggatcgcttaagcccaggagttcaagaccagcctgggcaacaaggtgaaaccccatctctactaaaaacaaaagactagctgggtgtggtggcacacgcctgtattcccagctacttgggaagattaggtgggaggatggattgagcccaggaagtaaaggctgcagtgagccatgatcatgccactgcactccagcctggatgacagaatgagaccctgtctcaaaaaaaaaaaaaaaaaaaaaaaaaagacaatataccctatggcacttttaagggtattggaaaatcaagtaacagcgtaagagttatcacaaagtcactgcaagcaggagctgaaatagtcaactaacccagatggagctgaaaagaggaattgcgaaaccatgactgacaagatgctcagggaaagggcaggtctcgctgaataactgagaaaataatacaaatattatgagaataaatatctttgttgccacacagaagaatgttattattgtgttctgtagacagccgatacaccgccgaggcctgctaaggtgtgctgcattcacatccacagttacctcccacctcatccccccattccactgatgtaagctgaggaagaagaggagttttaagaggtatcccaagtggtttagttacccactcatgtgtaacaaaccaccccaaaattcagtggcttaaaactaatcatttattttgctcacaaatctcaatttggacaggactgggcaggaacagcttaactctgctccatgtggcatcaggtagagtgactaaaccagggctggatgacctactttcaagatgcctctgtcactgagctggagctgcctgtcagctgggagctcagccagggctgtccacgaagagccacatgtccttctacttcatgtggatctcgccacagggcagcttgagcttcctcacagtatgggagctggactcccagatggcatgttccaaaagcccagatggaggctccaaggtttctcatgatctggcctgagaattttcagaatgtcacttctaccatatcccaatggacacacaaatcactaaggtcagttcagattcaagggagggggaagtgactccacctctcaataggaggaaagaatttgcagccatcttcaatgcgctgcaacaagtttgtgccagcaattagtcttccccttctgcatgagaatgacatgtccctaaatgggcatgctcctttggcccaggaccctgcacaagagagatgtagagagcagagagctcaaagcagagtcacagctggaaacagcgcagcgaacctgctgagcatgagtaacatacccaagaaactaggattcactgttagaagccactgggattctaagcttatctgttacttcagcaatctgattaacacaatgtgcaaaactgcattcctgacaacagccttctaagcccttcctgctacattccccatctgcacaagtgacccaccatccacccacaggccatcacctcctaaccagtatggacatgtctctatctcagcgttcctactcccaacactcatcaagcccattatcttttcccatgtggccacaatctgttccaggtttgctcccctccaatcccttctgcaatctgcctgaattgtgaccttcctaaagtgcaaatctgatcattctgctttaaaaaaaaaaatagttttagcctactgtccctgggatcaagtccaaattcctggttaacacatataagccttgtttgatgtatatattatgtccaatttgagtatattcaattctgctacatagaaaacaagaaaaccaatagcatggatgaaactcatagtgagtcaaaagcttgtaagacacgctcaagacagacaaaataagtggaacatacgtgcattgaacatagataaaaaggacaaaaccagagtgttagtcctaggcagaaagtcacgggagaaccaatcttttttttttttagaggaagacagggtctcacagctttgtcacccagcctagagttcaatagcgcaatcaggactcattgcagcctcgacctcctgggctcaagcaatcctcccacctcagcctcccaagtagatgggaccaaaggcatacgctaccatgcctggctaaattttttttttttaatttcttgtagagacagcatcttgctatgctgcccaggctgaccagggccaatcttatcaaatcttaaatattagtaagacacaaactatgccacttgacagttatatcatccttaatttggccacccattttgaccccatttatatactgtctagaaacacatgaaaaaacacacacagcatcccagcaggtctctggtaagccacagctattgcagacatatatatccaaatatctccaacaaagcaccttccaccttctgggcccttgtgtaacttcagctctagtccttgtgctgacaccattggcagggaaggctgatgcagcagagagacaggactccatgtatgaacattgcatggcccaggattcaggttgtgctgcttccattccataggcacctgatcctaagtgttaaccaatcccagaactctccccttatttcttgctgcatgttttgaattgatgtgataaacaatgtgattcgagcgtcttaactcagcctatgagcctctctattctgtgactgctggaataggctgcttggccatgttcttggaagctaccaccatatcagggtaatttcccacacaacattccagcccctgctttcccctctggccttatctagggccattccccaactcaggtgaatgcagactccaaatgtactgagctgtgtgcaggggccaggtgcaaatgctttctgtgcatctgcacatgctgttctacctgggaagtcctttcctcctttcacctatttttaccttaaacctcagacatcatctaccctggaaagtccttcctgacctcacgcatctaagtaggtcccccccataatccctatccatgccttctatagtacttaacatggtgacctttaattgttcatttacttagctctctgctctcccacactgtgaactccttacaaacagggaatgtcatctctgaatgaatctttcatctccatgtaacacatgcctccaaccctacctagcacacaatctggcatataacaggcactcaataaaccttcaatgaatgccttgatcaagtacaaggaacataagcaaatttcctgtggaaaaaaagaattgtattaagttctttgggtcaacaattcttactaaatgcaattgctaatataagtatagaaaatattgaaaactgagctgaatctgccatcacttgttggtattactgcatcaagcaaaataagtgaaacgtagctgttcaataaatgttaatgaatgaataagcgaaaatatgagtatgtgaatgctacattttttaaaactgaattttaagatccatttatctgttgttggtaatctgtagaattaccacagatcaaagccatttgaaatatccaaaattcaaaaagatattttaaatatctttaagagttgtatagtcttaaagatgtgaaaaaatataagatcccatcaattcaaatgtccttcttccataatatatttttctatttaataccttaggaccctgttaaattcaaatggctgtgaagtcaggtagaacatacacacacagattcataagaaccccccaaaatgcaaaatcccatcaagcagtcaacccaaatgggaactgtcaacttggctagaagacagtgagctatgagatcaatccctttttaagttttgaatcctaatttataaaatggagctcggggtaacagccagagtggtcaacatgaatggctctggacgtctctagctcctggttgcaagacccactgatgtctctgatcataagtgaaattagttaactggactgtggcaatcctccttgttgggaaggcattctcctaccccagaaaattaagaattaagtaaccacggccgagcgcggtggctcacgcccgtaatcccagcactttgggaggccaaggcgggcagatcatgaggtcaggagatggagaccatcctggccaacatggtgaaactccgtctctactaaaaataaaaaattagctggttgtggtggtgcaggcctgcaactccaactacccgggaggctgaggcaggagaattgcttgaaccaggaagtcggaggttgcagtgagctgagatcgtgccactgcactccagcctggtgacagagtgagactccgtctcaaaaaaaaaaaaaaaaaaaaaaagaattaagtaaccaccattcagcaagaaggtcttaattaaatcttccttggaaagtcagttaactgaaatgatagctgtgacagagatgctaattatctcccaaaatctagcctttctttctcccttacaagaacagaactcccagtttctgctgaatccatgactgtccagctagggaatgcattttgcagactaccctgcacctaagtgaccaagggggctatgtgacaaagttctgtacaatgaaatgggagcagaagtcgccacgtgaaatttctgaatcacaacagtattttttttaatttactaattttttagagatgaggtttcactctaatacaatggcaatcaaagctcactgcaacctcaaacttctggcctaaagtgatcctcccaccccagcctctcaagtagctgggaccacaggcgggagccaccatgccaagatggatcacagttttaaagaggaaactggttgtctcccaaccttctctcttcccccactctgaaggctagatgaagctgacactggtggagtagcacgggagccagactctagcaagagagaaccactacctaggatagaggagggaagacaggagaaggaaccaaggaagaagatgaggaaaaaaatgggtccctggatggacttccaaagcaaaaccactgcccagagagagaaatttaacttctagcttgtttgagcccctgtagctctgggtcccactgttatacaacttagcctgtatcctacataatatagtaactatgttccttaagacgctgtacatcttttagccccataaagacatataattaacaatttaggaaattaaaagcacggcagtcattattttatgctaaaaaggaacctgaacatatttgatattttatataattgcaatattttggaaagtctgatcttggctttaagttgaaatcttactaaatttatatataatattagaatatataagaaaacttcaagcttaccatatttgtaaatttaatacagtcatgtaccacataatgtctcgcccaacgatggaccatatatatgatggctgtccctcataagattacaatggaggtaaaaaattcccatggtctaatgacattgtagtacagcacagtactcacgtatttctggtgatgccggtgtacacaaacctactgggctgtcagtcatataaaagtatagcacagacaaggccagacgcagtggctgatgcctgtaatcccagcactttgggaggccgaggagggtggatcacctgaggtcaagagatcgagaccatcctaggcaacatggtgaaaccccgcctctactaaaaatacaaaaattagccgggcatggtggctcgcgcctgtattcccagctactagggaggctgaggcaggagaatcacttgaacccgggaggcagaggttgcagtgagctatcacaccactgcactccagcctggcgacagagcgagattccatctcaaaaataaaataaaataaaataaaaagtataggccaggtgcagtggctcacacccataatctcagcactttgggaggctgaggcaggcagatcacgaggtcaggagatcgagaccatcctggctaacatggtgaaaccctgtctctactaaaaaaatacaaaaaattaaccaggcgtggtggcgggcgcctgtagtcccagctacttgggaggctgaggcaggagaatggcgtgaacctgggaggtggagcttgcagcgagccgagatgcgccactgcactccagcctgggcgacagagcaagactcagtctcaaaaaaagaaaaaaaagtatagcacagacaattacatacagtacacagtacctgataataaacaactgttactggtttatgtgttttctatgttttctattattttagagtgtactccttctacttattaaaaaaacaaaacaaaacaaaacaaaacaaaaaaaacagctgggtgtggtgcctcatgcctgtaatcccagcactttgggaggccgaggcggggggatcacttgaggtcaagggtttgagaccagtctggccaccatgtgaaacctcatctctgctaaaaatataaaaattagccaggtgtggtggcaggcacctgtaatcccagctacttgggaggctgaggcaggagaattgctggaacctggggccggaggttgcaatgagccaagatagtgccattgaactctagcctgggcagcagagtgagattctgtctcaaaaaaaacccaacaaaacagttaactgtaacagcctgaggcaggtccttcaggagctactgtgggggaaggcattgttatcacaggagttcactgctccatgcacgttactgcccgtgaagaccttccaggaggacacatgtgcagtgaaagtcagtgatactgatgatcctgaccctgggcagcctagactaatgtgtgtgtttctacgttagtttttagcaaaaaaagtttaaaaagtaagaaacaggctggacatggtggctcacaactataattccagtgcttggtgagggctgaggtgagaggactgcttgaagccaggagttggagatcagtctaggaaacatagcaatttgtatgttcacaaatttgtagagataaataaatgaaaataagaataaaattttaaaaacaaaatttttttttaaatatataaaatcttagaaaaaagcttttagaataaggatagaaagaaaatattttttacagctgtacaatgtgtttgttttaagctgttattacgaaagaatcaaaaattttaaaaaatcaagtttataaagtaaaaatatgatagtaagctaagattaatttattatcgaagaagaaggctgttataaattcagtgtagcctaagtgtacagtgtttataaagtctaaagtagtgactgttgtgtcctaggctttcacattcacacgccactcactcactgactcgccctgagccactttcagtcctgtaagctccattcatagcaagtgccctagacaggtgtactgttttttatcttttatactgtatctttactgtgccttttctatgtttagatacacaaatacttaccactgtgttacagctgcctacagtatccaatgcagtaacatgctgtacaggtttatagcctaggagcaataggctaccccataaatcccaggtgtaaagtaggctacagcatctagacttgtataagtacactctatgatgtttgcatgatgaaatcacctaaggacgcatttctcacaatgtgtatctgtcgtgaagcaacacattaactataatgtatacgaattatgtaagtgttcaaaaacgtggtgtctgttaatccagacaacttaaaaatctaaaaagaaactgggaggaggggtagggggagtcatgaggaaggagcaggagcaagtagatggactcagggggtggggaggcacgtgtagttctagcggtgagttcatgggtatttattgtattatttcaaatccacaggtgaatgagatccatgcataaaccaacgatgagagtacatttggaacaaggagtatggttaacccaattctgtgtacctagagtcctaaaatgaaatgaaatattttaagatatttgagtttgtaggccaggtgtggtggctcacacttgtaatcccagcactttgggaggccgaggtgggcaaatcacaaggtcaggagatcaagaccattctggctaacacggtgaaaccccatctctactaaacatacaaaaaaaattagccgggtgtggtggtgggcgcctgtagtcccagctactcgggaggctgaggcaggagaatggcatgaacccgggaggcagggttggcagtgagccgagatcgtgccactgcactctagcctaggcaacagagcgagactccgtctcaaaaataaataaataaataaaaaataaataaaagtccaaggagccagaatggtggctcatggctgtatcacagcacttcgggaggctgaggcgggcagatcacctgaggtcaggagttcaagacccaccctggccaacatggtaaaaccccgtctctactaaaaatacaaaaaattagccgggtatggtggcaggtgcctgtaattccagctacttgggaggctgaggcagaagaatcgcttgaacccaggaggtagatgttgcagtgagccaagattgcaccactgcagtccagcctggacaacagagccagactccgtctcaaaaaaaaaaaaaaaaaaagcccaaggaattggttactgatagaatctggaagtttgtcccctccaaatctcacgttgaaatgtaatccccagtggttgaggtggggcctgtgggggaagtgtttgggtaatgggaacagatccctcatgaatagtgtggtgctgtcctccctatagtgagtgagttctcacaagacctggttgtttaaaaatgtgtggcacctcccccagctcagtctcactctcattcttgccatgtgacacacctgcacctctgtcactttctgccatgactgttcctcaaggccctcaccagaagcacatgctggcaccactcttcctgtatggctcgcagaacctcttctttataaattatccagctccaggtatttctttatagcaatgcaagaactgcctaatacagttaccatatgacaaggcctctttgtagttcaaaaagaaaagccagatattagcaatttcatgtgatttgacctacttgattatttaatttatattttcaataaattcaaaatcatttttaaaataaaaataaagtttatgaatcgtcttttctgcatatgaaaattagccctgaattggctgggcgcagtggctcatgcctgtaatcccagcattttgggaggcagaggcaggcggatcacgaggtcaggaaatcatcccgactaacatggtgaaaccccgtctccactaaaaatacaaaaaattacctgggcgttgtggcacgcgcctgcagtcccagctactcgggaggctgaggaaggagaatggcatgaacccgggaggcagagcttgcagtgagccgagatcgcgccactgcacttcggcctgggcaactgagcaagactgcgtctcgaaaaaaaaaaaaaagaggccgggcgcggtggctcacgcctgtaatcccagcactttgggaggccgaggcaggtggatcccaaggtcaggagatcgaaaccatcctggctaacatggtgaaacaccgtctctactaaaaatacaataaataaataaataaataaattagccggatgtggcagcatgtgcctgtagtcccagctactcgggtggctgaggcaggaggatggcgtcaacctgggaggcggagcttgcagtgagccgagatcgcgccactgcactccagcctgggcgacagagtgagactgtctcaaaaaaaaaaaaaaaagaaagaaagaaagaaagaaaattagccctgagttcaccaaaaccgtcgtatcaacagctggtcgtcttctaccaaacataagagacacaagtactgtttgactggacctaggttaataaaagctttattttggaatctcaatgatctagatctctttaaaaccattaattcgttctctagttactagaaaggatagaagcattggttaaaatcttatctctcacttagcagctggttaaaaccttgtctaggccgggaacagtggctcacgcctgtaatcctagcactttgggagcctgaggcaggcagattgcctgagctcaggagttcgagaccagcctgggcaacacggtgaaacccggtctctgctaaaatacaaacaattagctgggcgtggcagcgtgcgcctgtagtcccagctacttgggagggtgaggcaggagaattgcttgaacccgggaggtggaggttgcagtgagctgagatcgcaccactgcactccagcctgggcaacacagcaagactccatctccaaaaaaaaaagaaagaaaactttgtctgtcacttagcaatgatattcctatcactttaggaatgtcatttaatcttataacctaagttttcttatcttcaaaatggcaataataataatgataatactttgtagagccgttaagtattagtgatgacagctgcagccagtctggagcagggtaggcgcggccagggatacgcgctctgtggaaccagggggagctgggagcaggcaggagcccttcccgcttctgagttggcagggcaggagcccagtgctcccaggcataactgcagcctcccagccacagctgcggacctgggcatccctgcactctcaggggtcccagaggcccccgcttccccacaggcttggaagtgcctgatcccgctgcctggcctcttcctgctccctgtgcccgctctgattctggagcaaaattgaagctgagcctgggcggtgtcgcaacccggccaggtgggtgctgctcaggatggcgctgacacaccagccccctgccacctcagcccccctctagactttaggagccactctggaccacgaggatgggagggaggccgaggaggggctgaggacggctggttgcaggcctgtaggcacccctcagcacaaacagcctgggcaccttggacaacatgactgacagcagaaggcagacaggctcataggtagaaaggggcgggtccctggtgacgccctgccttcaagccaagaccagcccaaaacctggggacctggctgtcagttccaggtgaagcctgtggcccagagtgagaacttagagtgctttttctggcccgcccatggctgcccatggaccaatcagcacgcgcttcctcccttctgagcccatgaaaacctcagacccagccagactcacacagaggctgggactaccagctgcagaaaggagctacccacttcaggtctcctgagagctgttctgccactcagtgaagttcctctctgccttgctcaccctccacatacctcattcttcctggatgcaggacaataactcaggacccaccgaatggcagtactaaaagagctgtaagacaaaccagggctgaaacatgtccccgtactcactacattgcaggcaacaagaaggagagaagaactgtggccctttaagaagccaagatctaggggctccccaagccaaggctgtaaacaccctctttggggctctgcggttcccagcgtctccatgcttccaggtgccaccatgttccccttgtccagacacaggtgcccacagcaaaagcctcattcagtacacctggtccagccacagccttgcatggagccacccaccccccccccccccgaccctgcacttctcacccacacaccccttgccgctctgcacccagcttgcccctggtaggtgtgcaatctgagctggtagaatgagctgagtgcagcctgccaggccaagtgggtggaataagaccagtgggcacaagcaatacttaggcagaaggcaccgctagccacagaggtttctgtctggtgaaacgacaccccaaggatcctgtgacattaggggtaacgtttataaaatacctagcaagggctcaataaatggcttattattatcataagtgtctacagggctaaacgaaacattacaaaccttcaggagagaacgtactgtcttaacacactgcactgctccaggcccatctgcctgatgctctgcccgctccagggcccccatcagaaagtctctcgctatcctatactatctgcacctgcctccccttattttggttcaccctgaattccagtcaattacttcttgtttacttccccatttttcttcttctctcaatacagcatcttacagataatcttcatgaaatgggaatccagtaaacatggctagcatcagcaaaatccccactggatgatctacatagcagggaacaatggcgggtgaggacccacaagtgaggggaaggaagctgcaagggtacactggggtcagacctccaggagcctcagggcatggactgcacctggagggatgacatccaccaaaagcttatgcaacactgtcccaactggatgtgggtccagaatgactaactctggccatcaagaggaatgcccaaagaagggacatgagacagggtattttcacagctcagacaaaagataatgaacatgaggatggaatgaggagcagtggagatgaaggagaggagctaacaatttagggagtgctgttacaactcataacttcacggaagcgaggaggaggtgcgaggaaaagccggctggcgtgttaatttgggattttctctctttgaagcagaagaatacaaacacaactcattttggacatgtggctgaggttgaagtattttcagaatactcaaggaaagacgtttaggacgtaggtggtgatataccccagccactcaggttgatttaggaagcaagaaattgtaggaatggatgagatgacctgagagagagtgctgctcaataaaaatataacgtgagccacaaatacaagccacacacgtggttttaactttcctagcagtgaccaggcgtggtggctaacatctctaatccaagtattttgggaggctgaggaggtaggatccctggagccctgagtttgaggcttcagtgagctataatgaccactgtactccagcctaggtgacacaataagaccctgtctgaaaaataataacaataaatttttctagcagccacattaaaaacataaaaagaaacaggtgaaaataattttactaatatatttaacccaaaatatccaaagagaaagggagccacaaaggctaggaaagagcactcataaaaagacaaatttgaggccgggcgtggtggctcacacctgtaatcccagcactttgggaggccgaggcaggtggatcacttgaggtcaggagttcaagaccagcctagccaacatggcaaaaccctgactctactaaaaatacaaaaattagcctggtgtggtggcacacgcctgtagtcctagctactctggaggctgaggcatgagaatcacttgaacccaggaggcggaggtcccagtgagccgagatcacaccactgcactccagcctgggtgacagagcaagactctgtctcaggaaaaaaaaaaaaaaagcaaatttggttttgactaagacacatcagttccttatgggacacaagtaaacatggtactcactgtttctgaagaggatgatctctgtaaattctcactttgtacccaaatgctctccgtcacaaatgctatgtgttctgcttcaagtataaaaggagacacaagaaatagggcccacttgttcaagtcttcaatggactgtatagagggaaagaaatataatgagattgtcacttcataccacaactgccataaatttcaaccccctctgaaacataccctcccctataattccaagtgacatggaaataagcttatctgatgctcctctgcaggccgcaggaaccgtgtgtttcttgtttagctgtgactgtttaagcacctgcaaaagcccatcgatgactcaggacagctttaatatctctagaccactgttttcaagccatgaattctgaaacggggcctatccccgccattcctcactgcttagcacacagtagctaaccgggaagtacatttaaagatgaggaggctggccggcacagtggctcacgcctgtaatcctagcactttgggaggccaaggtgggcagatcgcttgagcccaggagttcaagaccaccctggccaacatggtgaaaccttatctctacaaaaaacataccaaaaaaatgagttgggcatgggggtgggtgcctgtagtcccagctactcaggaggctgaggtgggaggatcactcgagcctgggagcccgaggttgcagtgagatgagatcatgccactgcactccagccttgggtgacagagtgagaccctatctcaaaaaaaaaaaaaaaaaaaaaagatgaggaggcctagaagtacgtacccaccaacagaagctccttactcacagaagcctgaagggctgttccttcattccctacagccatcacagcacagggcaccaggcagtttttctttacaccttccttatagtgaaatcaaccctgctcctctcccggagatctgggaagtgtgcaagtctctggatgctcacacagcagttaaatccagagagaaaagctatttcagggaaaggcatttaccatatgcagacgcaatcagacatactttaatggaatgtaaactccagtcaggagtgattgtagtttttcaaaaagaagattagaatcaagattggttagcaaatcagaaatacccagttatctctcgttttctttcctgaaatctctctaagaaaaacagcaaattgatttgaaaaggctttcacatacaggatatagccagagaagaaaaagatgaaatctgagcggggtatgcaggaggctttcaccatcacccagaacgaaggtaactaggcaggctccactgtgctgcatatcagttcaaatctgcttgataaaaacctattgaactaaataatgaatgaaaatttaggggagaatttgcccctccctcagtaaacataattatcaatatagtggttaaaaagtatgtccacttaggccgggcgcggtggctcacgcctgtaatcccagcactttgggaggctgaggcacctaaggttgggaattggagaccagcctgaccaacatgaagaaaccctgtctctactaaaaatacaaaattagccgggcatggtggtgcatgcctgtaatcccagctactcgggaggctaaggcaggagaatcatttgaacccgggaggcagaagttgcggggagccgagatcgtgccattgcactctagcctgggcaacaagagcaaaactccatctcaaaaaaaaagtatgtccactttatccaagcatagaatgtgtacattaaacagacaaaaagcttgatactgccaatttgtataaactgtctttggttaaacttatcaattgattgtagggcattcaattataaacacacatattcagtattcatgcatttgattttaagtgtataacatatgagaacacgccaggcttggtggctcacacctgtaatcccagcactttgggaggccaaggtgggcggatcacctgaggtcaggagtttgagaccagcctggccaacactttggtgaaaccctgtctctactaaaaatacaaaaattagccaggcgtggtggctcatgcctgtaatcccagctactcaggacgccaaaggaggagaatcacttgaacctgggaggtggagattgcagtgagcggagatcgcgccactgcactccagcctgggtgacagaatgagatccatctcaacatatgggcatgagattcaggtgtgtccttatttcagcccaagtagactgaggtatccctcaaaagtagacccaagcagactgagatatccaccaaatcatcaacctgatcatattttaaatctcaaaataacagtagccaaccacaaataaatggtcaagctttccacctgtagaccttcaacatcacagcttaaacccaacaactattaaatttactatttcaggtcaagctgctatgctaaacagtctcatttcctaataagaaaaagatacgaactagaataggaactgtgatttaaaggctacagggatgcagagcatggccatcccatctagtctggaaaactaggaaatgacgcagcaatatctaaccaaatctgtaggcaaagcttactgtgcagagtgacagagcagagttacagaatccatgaaagcaccaggccactcctactccggcctgcacaggtaggcaagggctgaaaatcactagttatggttagtgtagttaacagaaggccagcggagtcatgaaaatgttcaaaagtaaaactgtccaagaaaatcagacattcccatctccatgtttttatatgtccaaaatttctattctgacttaaatcctaaatgtaattgatccaatttggaaactactacaaaaagctcacccctcaattttttgccattttattgagttatctttctcaatcaggttaattcccaacgctctaagccatacattgtatgtaatgcatgaacttcttccccttttgtctgggtagtgtcagttatgtggaggtggtactagttatttgcataactagtaccttgggggacctgagaaaacagtcattcatattcagtgtgacataatacatatatggtactaacaagaaagagtattttttatttgctagtggcacaatttcaacccatatctaagcacagcctccaggcaatgttcaaacctgagataagattcaattccccacaggggctttacggtgtgacatatgcagaaaacgtcattttagtgctaaaagtgaggcaatattccagaaaacagaggaaagggacaagaaacagattaaaagcaaaacacgtttaaatattaatgagaacaatgctaccgatgtccatgaaattttgtgcagtactgcactgtgaagctaagcccatttccaaaaacagctgaatggaaagatctattgttccctttacagcaaggcagcagactttttacagagattaattgactggcccaagtcacaaggtaggtgacagagtgggctgaacacgtaaccaccatcctaagcactgggtcaaaaaaaacaaaggctgactgtcaactgaaatttaaaagacgcaaagaccatcagtcgggtgcccaagttggtgaatgatgcaaccaactgacagaagatggagagggaaaagggcagtttttgtaaatttggggacatctgacaaaaagctgatgacacaggtgggagttttttgtttgggatttttttttttttttcttaagacagggtcttgctttgtcacccagactggagtgcaatggctcaatcatagctcactgtagcttcaaactccggggctcaagtgaacctcccgggatcaagtgaccctcccgcctcaccctccagagtagctgggactacaggcgcgtgccaccacgccgacctaagtgttttttttgttttgttttttgtagagaggggtctagctatgttgcccaggctggtctccatctcctgggctcaaagctgtccttcctcctaggcctcccagagtgcagggattacaggcataagccaccgctcccggcccgccacagctgtctctcctggttcacggtcacccaaacgccggctcgaagtgtgggagaggaggttgggggcgaccccaggtgggcactgctggcgtccggctgtcaatccacagctcacgtcctcacaggtgcgcgcctagagtcacgcgtccagcaccgcccggctggccgggaagaggcgaccgggtccgtggtccgagtcccgcacctccggcctctctctgggccccggggcaacagcccctcccgggccgcacaggccgcactgagggcgccactccggggctcccgaactcccgggctcccggcggggacgaggcgcagggacgggggcacttccggctcgcggggcccgggtcgcccgcccgcccgacccgcccacctggctgtcgctgacgcagaagacgcggccgccacggctcaggcacacgcgggcgcccgggggctgcgcggccgcgccgcagaaggtgaaggaacagcgcgaggcacgcagccgccgcaccgtggcgcgcacgagctcagccggccggcgaccccagcgcgcccacaggtacaggtagcacagcgtgatgagcatggccgcgccgccggcagggcgagcccgccttgcccgcccgccccagcgccccaggcccggccccgccccggccggaagggccgcgccgcccccccgggccaggcggcgcgggggtggggacggcgggggaggcggggacccggaaggtgacgcgggcaactggaggctgcggcgggaggggcgggggggggtgaggccgcgcccggctgtgtgatggggagctccggaggccgcgcccagggctggtggcggcggcgaggggcagcgctggggcggggggtgtgcaccggggtcaggggacgccggggctgcacccggagagggggctcgagggagtggaggccggggtgcggggccgcgccagggctgaggagtgggatgggtatgttgtggatgcgggggaggggaggctccagtggctgcccgacctgtttaagccaagtccggcctcccttccttggaggggtgggaggcggattgaggagggggctctgcctatgttcatagctgccaaggccaacctttactaaccagcagcacaccgggagtcccagagcgctccacagccgctacccagtcgacttgggaaaataagataaggccgtttttattaaattatactaagccttcatgcaaaagattttaaggtcaatcacatacattcacgggatgcaataatgtttttttaaataaggacaggaaacagaaattgaagacagataagcaccaagaaggctgcctctaaaaaggctgtgccaggaaggctccctatggtgttcttgctacatgtgggtcaacagtttgactgtaagcatcctaacaccagtgggaaaaggaaaacatcaccatgatttggtgttcttgtctccaagggaagcataattagtcctgacacagaggcttctcccatagaacctcatttctttaaaaggcattatgtaaagaacgtgttctgaacagctgcgaagcacagcaaagaattccatccagtggcttcctattctggccctcgctgaaaataggtggcaagatgcagcaaaagcaatcatgtacaccacgtccatgtcttaatctaaggatagtttttgtttgtttgtttttgagacagtctctctctgtcacccaggctggagtgcagtggtgcaatctcggctcactgcaagctctgcctcctgggttcaagcgattctcctgcctcagcctcccgagtagctgggattacaggtgcccgtcaccatgcctggctaacttttgtatttttagtagagacagggtttcaccacgttggccagggtggtctcgaactcctgacctcaggtgatccacccgcctctgcctcccaaagtgctgggattacaggcgtgaaccaccgcgcccagctaggatagattttttttaagagacaaggtttcgttctgtcgcccaggctggagtgccgtggcataatcacagctctctgcagcttcgaactctgagctgaagtgatcttcctggccaccatgcccagctaattttttagaaattatttttcatagagacagggtctcgctgtgtcgcccaggctggtctcaaactcctggtctcgagcagtcaaactcctgcctggatctcccaaagtgctgggattacaagtttgagccatggcgcctagccataaagatagatttttaaagtaccttggccatttgttcatctgctttaatatagctgcatagaacacccactcccagaacttcagacttttggttagataacatagtatattttcccccttgcatatagcgatagatttttaaaagagagaaaatccaaaaagaaataactgggcttaaaagcaagcatctctgtggaccagaaatagaagaaaaacaaagtgataaacaggactaaagccatatcctacacttctctacaggacagtggcagccggaaagtgggttcctgcatggtaacaagaccttaaaattgtgtcactggagaaggacgtgcagttcccgctgaggagagacttggccactccaggacaacacaggactacaagtcaggaatttgaagatgaaaagtgctcaacagtgataaatcctaaatgtttcactgaacaacctttcagatagccttcttgaagtttgctgaattatggctataaggaccactccccacccctgctaggtatggagaggtcatctcctctatctgaaggtgaccaacatctccagtttttccaaattccctaagggttttgagaccacaccttcccacaggtactctaactccacctggccaataggaattttctaggtttacccttaggtgtttcgagatatggtctcagaatacatcatgggaaaattacattttggggtcaatcctgtataccaattctaggttaaaagcatggggaccaccatggttcaacatgagctgacccttgcattgaagagtactgataccattcatgcctggggaaggaatagagggaggaagatatgaagggcacagtgagaagtgaaacagtcacataacaagctctgtttatgatcccgccctaaaatgatttcattttgcaaaggtcaaggatagagttgagtttcatcacccctatataacaaaggaataggggaaggatgcaaaaataatacaccaagggatattaatgtgtatgcacctgatcctcatcctgtagtccctcactgctcaaagtgtggtccttagagcagcagcagcagcatcacttggaagctcgcaagaaaagcggaatcctaggccccacccaaccccaaatcagcgtctgcattttgacaaaatcccaggagactcacaaacacattaaagttagagaagcactgctaacatcttcctctgtcattccctgggtctgggctactctagactctaataagacatttccaaaatgatgtggaaaataagaccacagactagggatttttttttttttttttagatgaagtctcacttgcccaggttggagtgcagcgcgatctcagctcactgcaacgtccgcctcccaagttcaagtgattctcctgcctcagcctcccgagtagctgggattacaagcacatgccaccacacctggctaatttgtgtatttttagtagagatggggtttcaccatgttggccaggctggtctcaaactcctaacctcaggtgatcgtcccacctcagcctcccaacgtgctgggattacaggcgtgagccaccgcgcccggtcagactagggatttagaagcaagactttgtcatttataagaacactgcagaaaggaacaagaatgacccagctagccactgaagaccacctctgaaacccatcaacatgaccggctttctataggaaaagtctccacagactcaaaaagtctctagtttcttgcccttaggaaggcatgccctgggaataatagtttggggacaagagagagtagagtgtttactgtcctatcccccattaaatacatggcagaacttccccagggaaagcctatcatactgacattaactcagtacctgtttgaacttggagagcattcagaattctcatcagtcaaatggccagagctgagaaggatagcttgttttgtttgtttttgagacagggtcttgctatgtcacccaggctggagggcagtggtgcaatcccgactcactgcagcctcgacctcgtgggctcaagcaatcctccctcctcagtttcccaaagtgttgggattacaggcatgagccaccacacctggctaatttttgtattttttgtagagacaaggttttaccctgttgcccaggctggtttccaactcctgagctcaagccatctgcccaccttagcctcccaaagttgtgggattacaggcacatgccaccacacctggctaatttttatatttttttgtagagacaggattttgccatgttgcccaggcttgtctcgaactcctggattcaagcaatctacccgcctcggcctcccaaagtaccgggattacaagcgtgagccaccgtgcccagcctgggatactttctaagaaccaaggaactatgtagaaaatcttcgccgggcacagtggctcacgcctataatcccagcactttgggaggccaagatgggcagatcacgaggtcaggagatcgagaccatcctggctaacacagtgaaaccccgtctctattaaaaaatacaaaaaagttagccaggcgtggtggcgggcgcctgtaatcccagctactgaggaggctgaggcaggagaatggcgtgaacccaggaggcggagcttgtagtgagccaagattgcgccactgcactccagcctgggcgacagagcaagactccatctcaaaaaaaaaaaaagaaagaaaagaaaatcttgatctctattcagtaactttaatacgtatattaacatgttcttgtttttggaacaatcgtcaaatcaagcaaaaagtaattttattttgttaatcaaaataaagagaaaagtagacaatatttagagcatcaaaagaatttaaattagaacatctttaactattggaaatatgcatttgaactcatgtctttaagaggaaaataattatctttcctagctctttcactgagatggcctcagagtagccttaccccaagatgcacctgagtgctcagattcttgaatgggtgctcttctcctcattacaaggaactagaaatccttggagaaatcactgattctggtgttcaagagataccagataagctggaacatcttatgctaggaagcaggagaagcttcaaagaaaaataggtccaggcagaaggatgcaggagacaagctagaagtgccaaatcaggacgatttgagtatcaaattgaaatacacccaattatgaaggtacccaattttcaagagccggctgggcgcggtggctcacacctgtaatcctaccactctgggagactgaggcgggcagatcacctgaaatcaagagttcaagaccagcctgggcaacatggcgaaaccccatctctactaaaaatacaaaacttagccaggcgcagtggcatacacctgcagtcccacctactcaggaggctgagccaggagaatcacttgaacccaggagacagaggttgcagtgagccgagattgcaccactgcactcaagcctgggtgacagaaaaagactccatctcaaaaaaaaaaaaaaaaatgaagagccatgaaatccatggttatcctcaataaaatttaaatattcgaaaagaatgtaggataaaatgtgttactgctgagtctcgttatttggttatgtttgtattgattcatttgttgtattgataaagattagtaggtggcaaattcttcctttagaaggttgtttgtgacccaagagggcatcaatacaaagaccctaaagctgggattccgaagcacagagtcgcgggagagaaccaaagctcatcgcatctggtttaagactccttcagagttggatcagcctaaaaacaggacatggtacaagattttattcattccaaagattgtaaaaattaaattcatcctgagaatttatcagtctatgtgggagctacagacttctatgagcaagcagaggtaagtaatgttctaacttcaactaaaagaggctaagagatcatcttccttcttttgaatttaatttttttattattattttaaaagacagggtcttgccctaccacccaggctgctcttgaacccctaacctcaagctgtcctcctgcctcagcctcccaaagcattgggattacaggcatgtgtcgtgcctggcctcaccctccttgagatttcagaattgttgacagaatgacaataagtaggattcactgtctccttaaagactgaggaaagaaacccagtgaaacctctgatggacaatggcctcagttaactaggacagtaactgtacagtatccatctcctaatccagtaaaactgagttacatatagaaaggcttgaaagaagcaaagccatagatttatatttctgtattaataaggaatctatgcatatttttggtcttatatatacttgaagtgtgttagagtatgtggctgttttaagtacattcttataactaatttgaaatgggtacttctatattgaaatcttactgagtttatgaatagtattgaaacatctaagggaatattattaggtttgccatattaatatactgaatctgctagattgataagaattacataatcaggccactgaaatgtataaaaaggaaatttaatttaaaaaggacttgggggcagacacagtggctcatgcctgtaatcccaacagtttgggaggccaaagtgggaggatcatttgagtccagaagttcatgaccagcgtgggcaacacagggaaaccccatctctatgaaaaaaaaaacaaaacatttttttaaattagccaagcatggtggtgcatgcctgtggtgacagcttctcgggaggctgaggtaggaggatcacttgagcccagaaggtcaaggcttcagtgagctgtgatcgcaccactggtctccagcctcagcgacagagaaagaccctgtctttttttttttttttttttttttttagcagctctggaatgagaataggtatttgtaacacacataactgataaaggattcatatctagaatatacaaagaactccaaatcaatgaggaaaagtcagaaaaccaaaaaaggaggacagctaaagctgaaaaagcacttcaaaaacagactgtacccagctgtctgataaatatgaaaaagtatgcagtctcaaagtaggtccaaattaagaccttcatgagaattggtatacacccatcggtttggcagaaatccccttctcaagccctggaattctgggctctacccccattgctcaaagatctgaccattttccatttccatcccttccatctttctgcagtacctggcattcctgaccatgctatttctaccaatcaacaaaaactactagatactcagaggggatttaatacagagagctggctacaacatgacaaaacaccagacaagggagggcactgtggctcatgcctgtaatcccggcacttcgggaggccaaggcgggtggatcacctgaggtcaggagtttgagatcagctagccaacatggtgaaaccccgtctctactaaaaatacaaaaaattagccgggcatggtggcaggcacctgtaatcccagctacttgggaggctgaggcaggagaatcgcttgaacctgggaggcggaggttgcagtgagccaagatcatgcccttgcactccagcctgggcaacaagagtgaaactccgtctgaaataaataaataaataaacaaacggacacacaccacagaagggacagtgaggcaacccagggaatagaaagagcagaagccgcgaccctctgtagggctgagggcacacaacacaggtcaagttaccgtcgcccgggatccagggtcccctggtggaagctggaacccacagatcagtgctgtgggagatggagccacagagaaacaactgctgctggagacatcagcaggggaagaaggcggaaaaatactgtagccgctccacacctccagcccaacgccccatggcggaacttcactagaggccccacggcagaagagcctccaggaacctccttgtggaccagaggagagagatagagaggcggcaggaggcaagggtgtgtctaagacaaacaggccacagccagcccctggccttcctgaaactcctcccttgggttcttttaaaattcaatattctgcttctgttccagggttaatgggctgaactgtgtccccccaaattctaatgttgaagttctaacccccagtacctcagaatgggactgcatcaggagacaggtactttaaaatagtcattaaggtaaaatgaggtcaccacctaatctgttatgactggtatccttataaggataaaatagtcattaaggtgaaatgaggtcatcacctaatctgttatgactggtatccttataaggagaggagactagacacagacatgcacagggggacaatcctgtaaggacaaagggagaagacagccatctccaagccaaggagagaggcctcaggagaaaccaaccccgcccacaccttcatcttggacttctagcttccagaactggggaaatgaatttctgttgttgaagccccagtctgcaatacttagttatagcagcccttgcgaaccagcacatccaagttctccgtctctgtctctaacccctctctcaactgtcggccataagtgagcctctgcccccaacttctggcctcctctatgttctcttccttggtgacctctggcagtgacgctcagtcctcatggccagctctggcctctcccaggctctggcgccgcaatcatctcttccacttgtctctgcttggatagtctgtcagcatctcaaaggcaacatgaataaaaccaaatgcattttttcctcccacaaattatctctttatcctgatttctcttatctctgttcatgacttgttcaccttttcactaggacccagaattcatgcatcttggagtcccaacttctccagcccctgtgtcttgtttatttccatagcagttggtaggcgggacctctgcacagtctcacatggtcccttctttctagtccaggcccagctcagccctcaccagaacaggcactagcacgacagcctgctggatgattcccggtgcccgtcccctgtttcccacggttctgcctcatccagcacactctgcacttgactgcctaaagcacagcgctcatcccatcactcctgcttctcaaactcctgcagtgcctgcccccaccccagaaagtgcaggcagtcttgcctggcattcaagaccttccactgagcctaagcaacatagtgagaccccatctctacaaaaaatttaaaaattagccaggcatggtggcacgtgcctatagccccagctacttgggaggctgaggcgggagaactgctggagcccgggagttccaggatgtagtgatccatgttcataccactgcactccagcctgggcaacagaagagaccccatctctaaaaagaaaagaaaaagaccttccattggacccacctaaccgggtctccctcattggcagccattcacttattccacgttcattctgcacctcctgcacacgaggtgctatgccaattactggatacatttaatccctcaacaactctgcatggtgaccattattgtccccatcttgcaaaggaagaaactgaattttagaacagttgaattttagaacttgagctcccataattaggtggggaaactgatgtttgaatttgtgtccttttggccccaaagtccttctctggataaactaggcaaccaagagcaaagaatgctctatacccgacaaaaatagaaatgaaactcaagatccaagacgcaagagtggcagaaggttcaaggtgcaccactgccagccctgacagcctttgtatccaggtcagttgaacaggccgggattgtccccaacttggacacatctaaaaagctgcaggtgggatgtcatcaaaatcacctgggaaaacaacctgctctgaaaacagaggcatgatccaaaagacaaagaggtttgtgataccctttctgtacaatagctgactatcagtaagtcattactgttttaaggaagtcagtcacacacacacacacacgcatacacacacagaaaaatacaagttagctgggcgtggtggtgtgcacctgcaatcccagctactcgggaggctgaggcagcagaatcatttgaacccgggaggcagaggttgcagtgatccaagattgcatcactacactccagcctgggcaacagagccagactgtctcaaaaaataaataacaataataataataatgttgcaccaatgtcagttttggtaaatccatggttgtgtaagatgttagcattagaggaagctgggtgaagtttcaaagaactctctgtactatttctcttttgtaagcctaaaattatttcaaaataataggtgataaaaattagaaggtgacattccactgaatttcatcagcactccttttttcccctcttccgaaccagccatgtgatcttaagcaaattatctcatctctctaggtcacagtttttcaacttaggaaaaaaaaagagggacacaagccagatcatctctaacttcccctccatctctcaaattctgtggtcctcgtacatttacaatatgatgcaatctacaaacatttgatattggtgctctcttattcaccttcatatccctggtatttagcattgtgcctatacatagtaggtgctcactgaaagtttttgcaactacctcaaaaactgaggttcatacctcagtttgtaaagtgacgtagaactgctagctcttttacctagttgaccactagagagcgaagcggtcacaaattttttctctgttaaaagcaaatttatcttcgtccagcagaggggagtggtcctttatatttcaggcatgtaaaaatcaggtcctggttgggcgaagggagaaatctgtgagcagtttcctgcctatcagacaggccctccagaggggtgatcagtaccataagcttccaggtaagcacatggggccactgcccccaccctccaaaacaccctcaaaagtctaaaccacctcaatggatgggagattgctctgcaaatgggggagccccactcctaatatgttcatcattgtcttcctaacaatcgtgactcatttcttgaacaaatgtttcacttttaaagggtttgcacagaggcagctttaagaggtcaaataaatgaatgtggaaagaaattaaaacttttacaaccacatgaaaaaggcattagccagtcatcctgcccagcagcccaatattgagcctgtgtgagttgccgtttgtgtagtgaagcaatagaggccatggtctggaatcagaaaccctgggttcagatactgcctctgaccccccaactccccaacaaaatgcacacattcagtggccatgtgaccagggcaaatgcctctcgttccacagctccaatgcaggaataataatagcatccacctggtgtgggtgggcgggttcacagagaacagccacacaggctaagagtgcagactattgtgacccagcaactgcccacctgggcagagtgaacaggaagggaatagaagggcaacgcgctttcacttcatcctcatgagcgctcttcgtggggaaactattacacaaagtcggggtggggagttccttcccagtaaatcgagttgcctttttcaggcacggaaaagcccatctgcctgaattttcctcaactggtcaatcatggtgccagaaatcccaaccacttgaagtgctccttcaggttaagttactttatctgccaactgtgttagtttaaacaagtcagtttccaagtcctacgctgctgcttttatcatcccattaatttataaaactaagaataggggccaaacgcggtggttcatgcctgtaatcccagcactttgggagatcaaggcgggtggatcacctgaggtcaggagttcgagaccagcctggccaacatggtgaaaccccatctctactaaaaatacaaaaaattagccaggcatggtggtgcaacgtagtcccagctgctcaggaggctgaggcaagagaatcacttgaatccaggaaacagaggttgcagtgagccaagattgtgccactgcactccagcctgggcgacagagcaagactcccacctcaaacaaaaaaaaaaaaagaaaattaagaataggaccccacagtgtgggaaggaggctggaagcgtcctgattaaactgcagcctgaggactgctgggtgggatcctgtagagcacactgagccctgagaagggggcaagaagagccccagggtgcaaggccagagactagctggggcagagaagagtgcgaagctggcaggactgaagggtcgggagacccttaaagagaccctgtagcagacgccttgggaatgtacgtgtcaccgagcaaagcacatgaagagaactgttcaacagcggactcagctgggaactccagacactgcggcaaaaccagcacagatgcatcctctcctgtggctaaaagctccatgaggggccagtgagtcacatgacaaccgaatttctcctctgccaatctgaacatattctgggactgagacttccgtactcagggaaaaccaatcacactgcttaaaagaaaaaaaaattggccaggtgcggtggctcacgcctgtaatcccagcactttgggaggctgaggcgggcagatcatgaggtcaggagattgagaccatcctggctaacacagtgaaaccccgtctctactaaaaattcaaaaaaaaattagccgggcatgatggcgggcgcctgtagtcccagctactggggaggctgaggcaggagaatagcatgaacccaggaggcggagcttgcagtgagccaagatcgcgccactgccctccaggcctgggtgacagagcaagactcagtctcaaaaaaaaaaaaaaaagaaagaaagaaaaaaactacctattataaacccttgatgctataaatttaatggagctggaaataaattccctggaaagactatggtgggagaaggggggcattaccttcatccgtttacattctccagccatgggaactagctcctttgttttcactgaatttatgtttctatagaggcacccaggattgagtctcctataggggggtcccatgaagctgccatgcccctctgttgatacaccttgctttgcaggtcaatttgtgatttttaaaatggttttatgcaaacgacatgtttagcccaaatgcactgcaggtagctggtgataaaacagcaatacggaccaggcacagtggctcacacctataatgccagcactttgagaggccaaagcagaaggatcacttcaggccaggagtttgagaccggtctttgcaacatagggagactccatctgtacagaaaattaaaaattagccaggcggccaggtgtggtggctcacgcctgtaatcctaacactttgggaggcaaaagcgggcaaatcacttgaactcaagttcaagaccagcctgggcaacatggtgaaaccacatctctacaaaagtaaagaaaattagccaggcatggtgctgtgtgcctgtagttccagctactcctggggaggtcgaggctgcagtgagccgcaatcacgccacttgtactccagcctgggcgacagagcaagtccccatctcaaaaaaaaaaaaaaaaaaaaaaaaaaaaggctgggtgtggtggtcccagatactcagaggctgaaaagggaggattgcttgagcccaggagttcaaggctgcagtgagctgcgatcacatcaatgcactccatccagcctgagcaatggagtgagaccctgactatatttaaaaaaaaaaaaaataggaagaaacaactcaaccacagggctagtatgttactcggttataaaatgataaagccctaaacagagaattagcccgtttccagaagaggccaagaacagatgatacagctgaactgaactcctgcctgtacagctcgttttctacaagattccagacctggaagatgatggcatccagcccccattgaagcacctcgaacaagaaaaacgccgagtccgaagagccaggccttgaacacacgattcctgtctataaataactccccctggggaataaaaagcaggatccaaggcaggaaacccgagccgtggaatctggtaagttcttaggaaacccactcacgggcctgagtcccccgtggaagcggcgacttcggcacctggacacccgagtccccagagccccgggcggccgcgcgtccctacctgcaggcctgataccggccgcggagcgctcctggccccgctcccgccaggctccgggaccgctgaaacgcacccaggggggtgaaggcgtagtcgccaaggacagcgcagatggcagcggaggcatgggagccggaacctaccgtggcaaagggccaggtcgggacgcccctcggcgcagccccaaatcctgcccgcgccccagccccgctcaggccgcgcccctgccacctctggccacacgggctgagacgtctggctcctgcacagcgcacttcccgctgcccttctccactggctgctcaggccctgcctcgccagcacggcatccgcgggggatccctacctgtcctttagggcttgcctcataggtcaaacgtcacctcccagggaggtatggcctgccccctggccaggtgggccccttccacgctcgcctgcaacaccacccacccaccttgataactgcttgtaaaggttgtactgctttcccccttgagactgcaaaccttcaagggcaggaaatgggtctgttttcctggcaaaataatgaagttggcttaaggttttgctgaataaaatgagtgacagacaaaagtagccaaatttggcactcctgatgggttatttgatgaaggaggtgcaatgtatgggcttaactagttattctggatttctttccccatgttactcctccctaattctgatgaggaactgagagctgaatctattaatctattaactcttaaccttcctttttttttttttttttttttttgagacggagtctcactctgtcacccagcctggagtgcagtggcacgatcttggctcactataacctccgcctcccaggttcaagtgattctcctgcctcagcctcttaagtattgggattacaggcgcccgccaccatgtccagataatttttgtatttttagtagagacagtgtttcaccatgttggccaggctagtctcaaactcctgacctcaggtgatccacccacctcagcctcccaaagtgctggggttacagctgtaagccactgcatccggccttaaccttccttttctaaaggcactaccagacttctcctgctaccctaaggatggagtcctaattctgccactggaaccctgaatgcttcactttcagcacaaaaatttcaagcaaagacttgcagcctctccttctcagtttaggggaatgggggaattctttaatctgtggtgggacacacatgatgttaattagaatactctctcccaaagaggaggaaataaataggaaaatgaatcaagtctgatgcccgggaagtgtttatggatgttgtgcagaatagccctaccacaaagaaaatttcaaatgagacatcctatcactgctggggtttctcataacacaagagctgaggctaggtatggttgttttttttttcttgctttataagaatattattcaataagcagatttccaagccttgcattctttctattcaatgtttctaagattcacacatacaatttcgcaaagctgcattttattcatgttcactgctatctaatattctatttgtgatcatatcctactttgtttagccattctcctggggatcaacatggggttatctccagtttgtttcctctaacaaataatattgttctgaacatccactcgtctcctggagcccctgggcaagcatttctctgggtgtggacccattactacaccaggcatacgtccagcaagctaattaatgtgcagaattaagagataatgctaaactgttttccaaagcagttataccaatgtacactcccattaaaagtgacttttgtttttgactcggtatttttcaggtcaaacacattttcctttcaattttagatttatactgattttcacaaactgtcttggagaattatgaggtcctcaaacacaaagcttcatattgtggttcttagtcaagaaaatctcctagaggcaatgatccagctaattacagatcccctattgtccacgtctaaatttacgcattgtagctgggattagacccatgaatcctaggacaatgccaggggtgtcattaacttaaaaactctggcaggccaagtgcagtggatcacgcctgtaatcctagcactttgggagaccgaggcaggtggatcacgaggtcaggagttgaagaccagcctggccaagatggtgaaaccccatctctactaaaaatacaaaaattagccagccatggtggcacgcacctgtaatcccagctactcgggaagctgaggcagagaattgcttaaacccagaaggcggaggcggaggttgcagtgagccgagattgtgccaatgcactacagcctgggcgacacagcgagactccgtctcaaaaaaaaaacaaaaacaaaaacaaaaaaactctggcgtaagcatggtgtggagagtgtctgcagtgatatgagaatcctgggcacaacagcataagcagctgccttcagaatctaccgctcttgcctcccacggtccatacaacctcttttttattttcttcttttttaatgtttgtttatttatttatttaatgagacagagtctcactctgtcacccaagctggagtgcagaagcacgatcttggctcactgcaacccccgcctcctgggttcaagtgattctcctgcctcagcctccgaagtagctaggactacaggtgcccaccaccacacccagctaatttttgtatttttagtagagatggggtttcactatgttggccaggctggtctcgaacccctgacctcaagtgacccgcccacctcgacctcccaaagtgctaggattacaggcacgagccactgcgcccagcctgtgaaggctttaatagcaacaatccttataaaaatgatttttttggccgggcgcagtggctcacgcctgtaatcccaacactttgggaggctgaggcgggcagatcacgaggtcaggagatcgagaccatcctggttaacatggtgaaacccagtctctactaaaaatacaaaaaattagcccggcgtggtggcgggcacctgtagtcccaactactcaggaggctgaggcaggagaatggcgtgaacccgggaggcagagcttgcagtgagacgagatggtgtcactgcactcaagcctgggtgacgcagagagactccgtctcaaaaaaaaaaaaattttttttttttaagacagggtatatcacaggctggagtgcagtggtgctatcatagctcactgtagcctcaaactcctgtgcttaactgaccctcctgcctcagcctcccaagtagctgatactatatgcacaaaccaccattgcctgctaattatttttgtattttgtatagagatgggttcttgctatgttgcccaggctggtctcgaactcctggcctcaaacgatctaaccacctttgcctcacaaagccctagaatcatatacataagccaccacacctggccaagaatgatttttttaaattggaaaattttaaatgttcaataaggaacatattaagcaaactgtggtagagtagtccccccttatccacaagggtatgttccaagacccccagtggacgcctgaaccctatatatattgttttttcctattacttacctatgacaaagtttatacgttaggcacaataacaaattaacaactaataataaaatagggtaataataaactaataataaaattaaataaagtaagaatgactagaacacaagcactgtgataccacaacagtcgatctgatcaccaacagagctactaagtgacaaatgggagaatctgctggacaaagagatgattcgtgtcccaggtgagacagaacaggaaggtgtgagatttcatcgtgctgttccgaaccgcacacaatttaaaactcatgaattatgttctcacttctaagtgggagctcaataatgtgtacacatggacacagagagtggaataacaggcattggaggctcagaagggtggaaggggtgaacaatgagaaattacttaatgggtacaatgtacatgatcaggggtgatggctgcactcaaaatccagacttcaccacttcccaatatacccatgtaacaaaacaggggcacttgtaccctctaaatctatcaaaattaaataaacaaataaatcttatgaaatgttctggaatgttccattttatattttctttttcttgttttttttttttcatttaatattttcaaactgcagttggccacaggtaactgaaaccttggaaagcaacagcacagctaaggggacaattactatatatccattcagtggtacaaagtataactttctttccagaaccatttgagattaaattgcagaaaccatgacccttcaccctagtacttcaagctgtatttcctaagaacaagaatatttctccaacataaccacactgcaatgatcagatgcagaaaatttaacactgcaatattcagattcaggtatcagcatccatccaatgctaataactgctattcacatttagtcaattgtcccaaataacattcttgctagcagtattatttttcccaatgcaaggacacacatgtcatttagctgccatgtctctttattcccttttaatctggaatagttccttagtctttcatgaccttgacatcttttaaaagtcagccccggctgggcgcggtggctcacgcctgtaatcccagcactttgggaggccaaggcgggcggatcacttgaggtcaggagtttgagatcatcctggccaacatggtgaaaccccgtctctactaaaaatacaaaaattcgctgggcacggtggctcacgcctgtaatcccagcactttgggaggccgaggcgggcagatcacgagatcaagagatcgagaccatcctggccaaagtagtaaaaccccatctctactaaaaatacaaaaattagctgggcgtggtagtgcacacctgtagtcccaggtactcaggaggctgaggcaggagaatcgcttggacctgggaggtggaggttgcagtgagccaagatcgggccactgcactccagcctgggtgacagagtgagacttggtcttggggaaaaaaaaaaaaaaagttagccccattatattgcagctggtccctcaatttgtgtttgtctaatgtttcctaaatccaattcaggttatgcatttttggcacaggatgtcagttcaaattgatgacgctgactttgttcacatggttaaggtggtttccagaagaaccactataaaggttccttgtatatgtttgtaattcatacgtaatctgtggagtgaggctttggcatcttattccccagtgctatggtttgaatgtattccccaagtgcatgtgttggaaatgtaatccccagtgcaacagtgttgagaggtgggtgatttggtcataaaggctctgctgttattgcgggagtgggctcctgataaagggatgagtttggccccttcctttctctttcccttgctcaccctcttgcccttctgctttccaccatgagatgatgcagccagaaggccctcaccagatgtggctcctcaatcttggacttcccagcctccagaaccataaggcaaatacatttctgttcattataaattacccagtctcaggtattctgttacggaagcataaaacagaccaagacacccagtaagcgcccacctgaatgagtcatgactgtgttagttgcaatgtggtaacttttcgtttgttttttggtttttgagatggagtttcactcattgcccaggctggagtgcaatggtgcgatctcagctcaccacaacctccgcctcccgggttcaagtcattctcctgcctcagcctcctgagtagctgggattacaggcatgtaccaccatgcccagctaattttgtatttttagtagagacagggtttctccatgttggtcaggctcaggtgatccacccgacctcaggtgatccacccgccttggcctcccaaagtgctgggactacaggcatgagccactatacccggcctacaatgtggtaacgttttctgtatgattagtcaaatgcagtagtgagaagggggaaaagaataaaacaaagagttcaatctgtaactgaccatgaacaatcaattgagataacttgctaccttcagactagccaacttttccaactctgttgttccttcagcaatcattagctggcattctcctcttctacctctgtttatgtatttgttggtaagtttatttgctttttagtatgactctggactcatggattctcttttattcaacgtgataattcattattgccattattaattttgatattcaaattgttccaggtttggccactggagccccatcaagctgacccctgtgtccttctgacctgtctctatcattctttgagcacctccttgtgttttgaacaagccgctcctgactcatcgttgaccttccctccccttcccacaatgagccatttctcctaggagctctgactccttttaatggacaatggtatttagaaaacaagatatgggcatgaggaatgctcattgctacttgggtggccctgctccccagctctctcagcagacagatcttagaaataactcaagtcaaaatgaaaagcaggacaggcgcagtggctcactcctgtaatcccagcactttgtgaggctgaggtgggcagatcacttgaggccaggagttcgagaccagcatggctagcatggtgaaaccctgtctctactaaaaatacaaaaattagccaggtgtggtggtgcgtgcctgtaatcccagctactcaggaggctgaggcagaagaattgtctgaacctgggaggcagaggttgcagtgagccgagatcacaccactgcactccagcctgggcaacagagcgagactctgtctccaaaaaaacgaaaagttgtgttatccaccaagtttccaagtttctccactataaaggttccttttttatctttgtaattaataagtaatctgtggaatctctcattccaattcatggagctcttctttgccttccttcactccatatttttatctttcttctctcatagtgaggatcccagctcccaagaatatcattatatttacttatttgtttaatcctacaatacacagaaaatattttcagaattgctataccagatcactaccaactaagtgaagtacaaaatttctttgtagttttgtttgtttacacacaggtggatagtcaaagagctgtgttcaaagttatttgagtttgcctttctatgactaatttactatgcagtttagctcatttgttcacttctgtttgtattcaattttaggtttcctttcccccatcttatgttgatttagtttttctttttaaatactaaaacattaacatgttttgaaaagtcaaaactgcccccaaaaaaggtatgcctggagatgtgtcatttcctcttagactttcaccccattctcatccacccactgcaagtagccaatttattagtttctagttttttcttcctaggtttcttttttcccttttctctttttctttccaaaaataaggagatacttgaatgtttcacacaaaaagtagcctaacacagtactctctgtttaacttttgttcacttcctagtactgtataccctagaaatcactccacatcagttcagagaccttcctcactgttttttatacgtgcattgtgtggatgtaccagggtttattcacccaattgcctatgtattggcactgaagttgtttccaaaattttgccattgcaaacaatgctgcaatgagtgaccttgtacatatatacacttttatactggtgtaggcgtttctccagagtaaattcctacctgtagaattgctgggtcaaggggtaaatgcatatgtagttttgttaaacaatgctaaatgttcctctctaggagttggaccatcttgcattcccaccagcaatgtatgagagcatctgttaccccacagactgtcctgttgctttgcacttagcaacgggatcagttagaaccgtgatggtatctcagagtaccctgcatttctcctcctatgggagaaacggaacatcttttcattgaagggccagttttatgtcatttttgtgcagattgtcagttcatgttttttgcctatttggtctttgcttccctcaatgtttgagttatttacatacttgggatcttaaccctttatctgtgatagatgttgcaaatattttttcccagtttgacatctgtctttaatcaatggtaggggatttttttttctttttccttttaattttattttattttatttatttatttatttattttttttgagacagggtctcactccctcacccaggctggagtgcagagccgccatctctgctgacagcaagctctgcctccctggctaaagcaatcctcccacctcagcctccggagtagctgaaacgaacttttcttattttttgcagaggggttttcgccatgttggccaggctggtctccaactcctgaactcaaagagattctcccacctaggcctcccagcgtgctgggattacaggcgtgagccacagtgtctggcccatcttttttttttttttttttttttttaatgagacggagttcgctcttgtcgtccaggctggagtgcagcggtgcaatctcagctcactgcaacctccacctcccgagttcaagtgattctcctgcctcagcctcctgagtagctgggattacaggagcaccaccagcagcacgaccgactaatttttgttatttttagcagagacacggtttcaccatgttgcccaggctggtctcgaactcctgacctcaagtgatctgcctgcctcggcctcgcgaagtgctgagattacaagcgtgaaccaccgcgcccggccccagcttccgttttttaatgttattatgtatcagtcttttttttccgggcacttaggcgctgggtcattaggaagcctttccccacacgcaggtcctagtcaaccgtgctttttagcggcgagtaggccctgcggctctgcccctaacatgggcgcggggcacgcggccaggggcccgtgggagggggacagggcgcgcgaacccaggttctcaggccgcgtcgccgcgcgtgcgcactgacagccgggccgagccagcccgggtcccgcagggaagaacgccagcggcgcgcggaggccgcgctgccctgggccgcgaggtccctatggctgctccaccggaagccccgcccccttctggcagctggaggcggctttccggccgtcccggctgcagccccgaggcctcgactcaggagacggctgttccctggcagaggctcgcggtggactgcctgaccctcgcccggccccagcacgcccccggcgaacgcccacccctgtcccggcccgcagcgccccgacttacttctgaggccgaaacgcggccgctcctgcgccgggtggtcgcccgcgaatccctgccgcgccgcgctgcgccctctcgtggcccgcct

SEQ ID NO: 681 - DNA, 476666 bp, Homo sapiens
cggctgctcgcgagctgctttctctcctcttccctttccgggtgcacggcgaggagaaagtctctatgcaactaagccccggcgcgcacttggccaggtatgtaccgcgggagcggcgcgttctgcgcggaagcagatgctgctgccgccacggcggcggcggctgccagctcctgagctctgtaactgtcacactgcacctgagctgaacttgaaaagagagtgaaggggcgattgggcgaacgcttttggcagacacagagggtgtttgtagacgtgggggaggagaatctctattaacgccccccaccgtaaccactgcacatcacctccatctctgcaaatacagcccgaggagtagaggcagcagcagctggacccccaaagagagacgtggggcagcggctgtgaccgcatctcctgagctacaacaacaggtcgcctttttgagactcctttggcgggaagggctacttggaaaggaaggtttgaaagagtgagaagggtaggtgtaagggttccctaattcgtcgaaagaattctattgggtgactctcgttcgtcttctctatcctacactccacatactgaccctatattatccagactgtgccggggagaaatcaaaaacacctgtttgaagaaacggctgcacctgtgtgcttatttgtgccagagggtggcctagcccacctgcaggaagagatttggctgggttctgttgagggtgattgttaggacgttgtattttgttgccattattccaaatacctgtcttggagggaaagttgcccttctgagaactgtgactttaccaggagccctatcttggaataagagttacacctctggaccacgtttctcactagtactttgcttgactggaggaagtgggtgacttttggctgcttcggtgacccattgtagacgcctcgttacccttcttccttccgcttcaagtaatcatggcggcgggggtggcagcgtggctgccttttgcaagggcagcggctatcgggtggatgcctgtggcctcggggcctatgccggctcccccgaggcaggagaggaaaaggacccaagatgctctcattgtgctgaatgtgagtggcacccgcttccagacgtggcaggacaccctggaacgttacccagacactctactgggcagttctgagagggactttttctaccacccagaaactcagcagtatttctttgaccgtgacccagacatcttccgccacatcctgaatttctaccgcactgggaagctccactatcctcgccacgagtgcatctctgcttacgatgaagaactggccttctttggcctcatcccggaaatcatcggcgactgctgttatgaggagtacaaggatcgcaggcgagagaacgccgagcgcctgcaggacgacgcggataccgacaccgctggggagagcgccttgcccaccatgactgcaaggcagagggtctggagggccttcgagaacccccacaccagcacgatggccctggtgttctactatgtcacggggtttttcattgccgtctctgtcatcgcgaatgtggtggaaacagtgccgtgcggatcaagcccaggtcacattaaagaactgccctgtggagagcggtatgctgtggccttcttctgcttggacacggcctgcgtcatgatcttcacagttgagtatttgcttcgcctggctgcagcgcctagtcgttaccgttttgtgcgtagtgtcatgagtatcatcgacgtggtggccatcctgccttattacattgggctggtgatgacagacaatgaggacgtcagcggagcctttgtcacactccgagtcttccgggtcttcaggatctttaagttttcccgccactctcaaggcctgcgcatcctggggtacacactgaagagttgtgcctcagaattgggcttcttgcttttctcgctcaccatggctatcatcatcttcgctacagttatgttctacgcagagaaggggtcttcggctagcaagttcaccagcatccctgcagccttctggtataccatcgtcaccatgacaacactagggtaggtgccataatgggaaatgggatggaggttgggtatgggtgaggcgattgtggacccatcgaggttacatggtaactccggggaaatcatttgttttctttcctgagtttaggaaagcattatctaaatggtttggcaaaactcttttcatctgtgaaatgggtataatacacacgttgaagtattaaggcattgctggcaaatgttgatgcctgaaagtgataaagatacaaagaaattttagaattcctgaatatatgaaagtagtagcaatatttatattaatatataaaaatatgacaatgaaaaacaaaatctatgccctaataaagacacaaatatatacaatgtatattgaaatgtctataaagtggttcaatgcatttaaatgaaaagtttccaggtatacttgaactattattttcatatgaatagatacttatggtgtacatttttcctctaagaaccataattcctattttacatcgtaatacatagattgtagatgtaattatcaaagtattttataatatatatgcacatattcatatgtatgcactttaattatggttgataggttattcagtcttttagaatatcagagctgaaactgatcaactctacaatatgcagtggaattaaatttgcaacatatttcaagctctaggttcatagtttcaaaaaaagaagcaaaagactgtcatccacacatttttttttagaatctacagatcccatcaggcaatgggtccacacccattaaatacacatagaagatagagcagtatctggtaagattgatggtcaccaaggctggctgtattataaaatttggggtcctaatttccttttagaatttttttgtgaattcttttttgggggtataatgaagttctgcaaccaaagggacaaatttctgaattcatgctgttgtttttaatatacttttagggctagaattaagtttttttaggtagtagagaaaaggaaaggaggcaaatgattaataatgttaaactgcagaaaagtagcagcattttacatattagagaatctaataaaataaaatggttagatctttttacttttatgagttcttagataagctggggagtgatgtgagtgccttttcttcagctttgtgctactattcttgcataggtaatcagtttagtgaggatttggtaatggctataagaaaaaagttattcccaaggctactctttaagctttgtgtttttggataatttaattggcttctttaaatgacattgtggttaaagtcaacttaattttattagacatattgtgttgtacagaatttctcatgtcatgtggccagctaatggaatagtttatatatgaagaattttaggctaggttaaacaagaaattggggtaaagaaaaatacaatgatttatgatttttatttagtctcatttttttaaagacctactggtacatttaaaaaatgaattagtgaaaatccatgttctacttcttatatttcctttttatcttgttggcaaatttgtgacagtttataaggataaggatgatgcagaatgccttcgcagtgtaggtgctgattctttatcaaagaggtttgtttttgttgtcttgtcattttgtagcaggagatccttattaaggacaaatgggtagtgcaaatcaccatcatgacgtcaaattagaagtacacttgaataaaaaagattctgttttaataggaagggagaactattaaaatgaaatacactttaaaaatttggtatatatggctgtgtttcttgaggtatcagtgaatcattttaatgctatatagtgtctatatgattgaatataggtataaaaagaatgttgatgagaattctaatttcatatagctaatagttctatactagacttgagaagttagcattattttaaaacttgtttctggaaatgactttccaatttttattttattttgaagcttatttttgtttcaaggaaaatatgagacaacattaaacattagtgacaattttttattatgtaaataaaatacttaaaagcacccatttttgaaaatatttaagaaattgaattatattgcctgagtaaaatctatgcagtggatttagttcacatgtttcataggtaagtaagtggattagaagcattgaatacacacgctttctcagaacttggaagctaagtggaagttactttaaagacttagcttcactgaatttgaacattttaattttcaggaaattaagctaattaatgatcctgatggaatagagcagtcatacttttaagatgtggaaatgtcgatgtaatcaaaatgagaacatatatggacacttgacaaatcatatgctttataatataacagaatttcatagaaaaatgtctttaatttctcatcaaaatgtattatgtattgtaccctgaagaaacagattcttataagccctgcctttttggtgccatctttgtgactcagttatttaataatacaaaatattcaataaaagccattgcctaactttattgtttaggctgtagttctatacttagaggatgaagtgtaaggtgcaaactttctgggaaataatagttgaagccaatatccaactatgtctgaatgattatcaagagttatctgagctctttttatggggctattaattttaatggagctaaatgttcttcaattagtgataatagaagtgaaaatgtgattgtaaacagtggttattgaaagttccatctcgtatgaacgttatctacatgagaataaataaccaagagctttgtcattcaggactggcagaatcatttgcagcttctagagtattttagacaatattcagttggttttatgatctaaagaactgagtgtgtctatcttagaaccaaggtgtatttgtatcaccattttatttgctccttgaaatatcaaatatatcagtagactataacttgactatgcttactgtataagtcattacttaatctatcagaaaaatgaacgctttaaaaatagttttcaggctacttaatttcctactaaagtaggaaacatagaaagcacagtttaaaaaaaatgaaaaaataatgtcagaattttttttaagtgtttagattgagtaatcaggtagctctgttcctccatttcatcccttctttctgagcgcatttcacaggtccctgaatcacccttttatccacccggctcccctttccataatgtaaactctagttactgccattaactgccttattagaaaaagaacctggaactcctcttttgtcctaaagtcctttggaaaataacatccagttgttatttttcatttagattgtagtactcaaatcttgctaaacttaggaaatttccaagtgttcaccaataatcaaaaactattttgtaaaaatgtactagacagtgtcaagcttcagtttactattgcacctcatacacatgatctggaaattagaagtggtaccaggtggcacattaaataattgaagggttattattatgttaagtaatataaatatttgcattcttggtcttattaccatttagacaatttctttaaaagaagggatcatattactcataatataaaacttaagaatttcaggagtgttatttttgtggttcatctcactttaattttaaaacaaaattgttttcatcaaagtgttcaatatgggaaagttgctacatggcatttctgtaaagtttatgtttagagataaattttattattttaacgatataaattatatgctgatttcagaacaaatttgggaaagtaaaaatttaatttgtattatatatttatctaaaacaaatacggtggcgttacatctttgctgccagaaaacttagcataattgccatatttcaatttttgtgcgtttggtgaattactattttaaggaacaacaaaaaagcagaaaagttttcacttaaattttcatagcgatgtatcagggaaattccttttttagaatggcatactttgaaataatttatcatatgcatatatatgatcatatctatgatatacgataacattatgttataattatatattattaaagagaaggataaacttttaaatactattctcctgatacctgtcagtattctgattatatagctttgggtaatgatgggagtatatcttgcagaatcatttatgtagagacttaaagtttacccagctgttactgaaatgggtgaaattatcttcccttgtgccaacatctatacataactattgctagtgcattaatataaaactctttaaaaggtaggaagtaccaaaatttatctttctggtgaagtgccataatatgagtaacatctatttttattttgacatactatgacatatttgtgtaaagttctttatagaaaatgttagttgatggaagttgaaaatgaacttttaaagaaatgtagagaaatgtggtatgtattcctcttttagccttacaagtaaccaaatcttatgtgtcttcattttgttttagccatcacttgaattagagacaatatttgatgtggaatttaaaaatatgtatgttaatccagcctgtagtacttcagcatttacttggttgccagacagaggtatttcagaaaaggtttaatatgtgttatttcaacatagtaccctagagaaaacgctatttttaaattttcagtgggtctgttatgctattcttttttatttttaattttcctttagactactgataaactgtcttattttatttttatatttacatcatttacttctgaacattcctctcaattatactcatctttgaaaatgagtcacaaagttcaaatttcttattacctgatctctacattcctagtggaagaaaagtgacccatcatttatttaaaattaataattttgttcatttaagaattgtgtggcttgtccatagttacataattggatagcagcaatattttttgaaatttcacttttatgctcattttcttctgaagaccctaaaacattatctagaaatgtgttataataattatcgggactgctgctgattatacagggataagagaaggaatacatttgctatttattctattaatgtagtgcatttctcccttagttctattgatgtgactcattccacattcctcaatatcactgctggctctgcatttattcaaacagcactggggtttatcataatggtgcccatctgatataatacaaccttgtattctcatccagtgaactttcaggccgtttggcggcaaactactcaatggtgaatcttttacctggcctgatggaaaagaattcagttattttgccctaatttcctgaaagagttggcctatgagtcattaaaaatatgcaatttaacttctctttcattgaaagaacacaaatggtgaaataaacattcactgaaaaggaagtatattttttcctttaaagttgtgataatgaattcattccctttcctcccttctactctccatatgtcttatattgttttctaagcagggatacacacacacgtatgcatgtatgtatgtatttatgtacatatgtatgtataagcattgctctcccactagcttctgcagctagatttgatgatgtgggatagcgtctgatattgaaaaaaaaaaaaaaaccccagggtgaaacaccatttttgtgcatatttgcactgctctttgaatgttttgccctttagttttctcctttgagaggcagcctttacgttgaccttctccatgaaggcttttcagccccctaagcaagcctacgtcatttatagttggaattgtgcttgatattagtaagtgtcatttttatatataatttatggttttacctcttgacattctaactaaattgaaaggcttttgaggtttgagtgtataccttctggggagttattacctagttcggtgctcaaatgtaggaaaatatctatgttaatgtgttgctgatcatggtgtgagatggcacttgtacgccatggagagctccttagccatggagctgtgccatctcaacattagcaataatctgctactcttaagccaaattattttgctttgttcaatgttaaaagtatttacatttgttatttgaacattttgtcctctcatctactaaatgtacccttttaatttttctctttttgactgggaagggctgtgagacctcaactttttcatccataactaactactctgcaaaggctagaattaatggctaccagttgccattttcttgaacagtttgatttctggtgaagtccaggtaaattgcggatgcctttgggaagcatatggagatgcttcatgatataggtgaatcaacatagaaatatactaccttcccttgaaagcccagttccttatgtaaatacgagtagcttaaaaagcccatgggtcaacagatactttgatgatgcttcatcactagaaaggtgttctctcttaccagtaacacaagctggaactcttgtttttcatccaggttttctcatttatgcataaaatagaattttttaaaatagggaaatattgtctgtaaatgacataggagatagatgcaatttctgtcaggaaaagctcaatgtaatcaccatcaggaagaagttaacattctaagaaattaaaaggcagattacaaaatgtaaagataaatgtaggtatatattctagcataacgcaatccattttgccttgggaattttgacaagtctattatgtaatgatctaaatcattaaaagtgtggggggagtagggaatgagttcctagaggttaataatgggaaaaaataacattgaaagagtaggatgacagttgagataatgtcaaatagaatgggaagattttgttctaaaagtaaaaggtcttgtcttttttgcttttatgtggacctaattcttccgtcttcttcattttcttcacttttaacaatatcagtaatagtgctcttggaaacccaaaataacaccagtaacatacactctcagggaatcagactgtggctcacagagttcaattcaacataatagacctttgttgatcacttgctacctgtcattgaccacagcagtaaccaaaaggtcaactttctcaccttaggaactatttaaaactaaaatagtggaagagtcagaaataaaaatgtaaatatatgatataatgccacgtagagatgagtgctatgaacaaaatacatctgggtaacaagcctgctattttgcataggggacaaacaaggcttttccaaggggttggcatttaagccaatggctgattaaagtgatgaaatgactttctgactatctggatgaagagaattagaggaagagagaaaaggagtacaaagacttcaaggtgggatgaagtttcatcaattctatctaatgtccctgtaatagaagcaaagagagtaaggggcttagtagcaaatggaatctgaaaagtagttaggactagactatgtaggatatgatagaccacaataaagacttctgatttcatttaagatgaaagggggagccattagagagttgtgagcatggtagggataggatatgatttctgtgttaaaaggagcaaatgctctaaaacatttaaaacatttttaaatggtcaaattaaaattatttaccatgaataaattttcatccttcattagttttttatatttaccttagcttaaaatttatatccaattattcaggagattatctaaaaaatgagtattttctaatacataagtaaattgttactaataacacaaataaaactagttcaaatgaaaactgaattccatattttagctgaaaagacaaggctagtgctcagtggatatggaattatttgggaactgatgcagataattatttcttttgaatatagatttgcatacttaatagttgtcaattgtaatattagtgttcaagaatattacacacattttgaattctagttaaaggattttcattccttttttgtcactttgcagtaggtacatatatatcttttccaggtgttttgttagttatataagcctgaaagacaaaatggcttacataccttaaaatctgtgaagattgccataggatatgtatttttcaacacaaattaaattgagaccatgtttatagcagatgtgtgatgaaaacttgcagaagcaatgctttgataagaatcaccatgctgaagaataaactataaccatgaatggataattggaaatacatgggtttggagaaagaaaaattggattaacaacataaaaatgcaaaaaaagggtatgctttccagatgaacaaattgtgaaaatagtttttgaatctagaggaattcagtgtggcctctcactttagcatgctgtttccatgaagacatttgccctctagataactctgcatcttacccagttctttccagaggcctatttcctgataaggaagcaaggattcatgggggctaacacacacacacatgcacacgcacacacacacacgcgcgcacactccaaccattcgctggtttcctttcgtcatgctgtagaaattaaggctgtctaaccctataccatcttagtgcactttggaaaaatgaaattcttctccatattgttttagatagcacattcaaacttatgaaaatatgtctagattgtatcaaatgaggtgtttttgtattcttcttaaattagatcaacctaataatgcacattagaaacaatattgaatcagaaaggaatgtgccctacaggctattcctaatgtttgattttttgctttagtctagaagtattagagtcatggaattttgacttgctaggctcgttagaaatcattttgtagaaatgtctcagtttatacttgaagaaactaagttagagtgtagtcatgaaatttatataaaattatagggtctagttagtggaagaatctaagctagatttctggaagatcatttgaagtccagtgttctttacagcacaatacactggagggttcccccattatatttctttctctactttatgcctatttccaccattaaacaaaatattaaaaacataacagagcagcatcaccaagcagtgtatgtgcaggtctaaaagtttccccatgttataattaaaactctgatgatgactttgtattttatttgtaatttttaatgagagactgaactagtaacaaagataaataaattcatgtaatacataacaggaaattaagaatattgttccactggtattacttttactgtgacctttttgagctgagaaataaagcgtagcagttgtaacttgcattttatccaactcaatgatttgtcattgggttccttttattttttcaacctgaaaatatttactctggtaataacactgtatttatattttcacaatgcagaatattttattgtcttcagttatgtgtttaaattcaaggctgaacatatcatagccaataatatggaaaacatcaaacctgaaaatatctcacaagactagtttacttattcttgtgaaattaggtatgagaattgatgttgatagtcaattggttttcagatactttattatatctgaatatacaatcaagaaagtattaagtctttttgttcatattgtctattttattagaacattactatagttagaaaaaatgcactaatttcaaaacatctcatagacattcagaagaggatacatcactgtgaaataggacataagaatagatgtcaaaaagaaattacttccatttcagtaaattcttaattatggaaattcaaatgaatatttttccaatcttttatagattgccttgcatttttttaatgtttgcaataaagggcagttgttttgaaaaacataattaacttagaagtatacatgttgatctgttgtctgctattacttttttaatatggaatttctgcttttgcatttaaaattgtattaatttgatgcaaaatctcagaagataacacaataaatatcctattacaaagaaaaagaatgtagtttagaaaatggctcttgactcttctttgtggaaataggacactttatttactttatttagggttggcatggtcctagagtagtgataagtaaagtgcctatcaatttagcaaagaactttattatttttatggaaagagtccaaatacattcatagttatctaaatgaaaggtaagatttctttatcttaaaaaaagctaaagggaggattttttttcagtcaagtagcaaatgttggcaatatattctgaaatacactatattaagcaaaaactatgaataaattaagaaatcactttatagaccactcacattccttttacttctgtttcctttattattttccacactatttaattcacaatttttggatctgtacatactgttttaatattactaaaatatgtgtgaatgtgtaatgtgtactcaaatctgcattttgggaagcacacacatatacaccaatacaaaaatgtacagatgtgtaaatcaatattatatacagatgcatatgtggatatatagctatatgaccgatcttattttgctgggaaacataacctattgataatatttttaagaagatttggggatgtgggagataggaaaagccattttaaatttcactttgcaaaataacattacaaataggtgctatatgagggattgctattatattgttattactattgactatataacagtattaaatatagtacatatttgccttgcattagagtaagtctctatcacatcagtagacaattaggcaggaaataattactgaagagttgttgattgatgacacaccataaatcaaaaggaatttcctatttagaaattggaattttgagtcaccatacaaaacatatttttaggttagaaatccaacatttagtgattttgggttaccaaattataaaaatcttatgactctatcagacttgttttgaaattatatacttattcattcattacttttttactctgtgcattttcaaggaggagttgcaacagtttattgtcgaataaacagaaatgattaggcaagcatcaagtattaaaggtgacagaaagtgatggagaataaaaattatgttgaataaaacattgctgagcataaaatcaactttgaaattcctggtggacaaagaaaagcaggaagtatagtatatgtttcataggtatttaagaaaagaaagtatcttatttcatgaagagttttttagagaatactatctaatagaaatttggggcaaaatcagtataagcaggttatttaacaacataatgaagtgtggctgcaccagtagtttcacaaaatatttagaaatatttttgattgggctataccatatacaaatttttataaagcaaagtgataatatgtatacacataaaggtgttttcgtaagaaatatacataattatcaaaatacataactcccagatgattgtgagattcatatatagagtttagtaaatctagagtgatgtttcttaatatagactgaggatcatcaggattaggattacctggaatacttattaaaaatgaatattctgggagttcacctaaagcaatttaaatagtctttgcaggtgggaaccatgatgtcagcattttcaattctcacatcaaatataagaaccactgaagaatgccctctcagcctatttctatcattttcatcctattttgacttcagctggaagtttgagtgacagttaaagcaaaccattcaagtctggatgtggtggctcacacctaaaatcccagcaatttaagaggtgggtggatcacttgagatcaggagttcaagaccagcctgaccagcatagtgaaatactgtctctactaaaaatacacaagcatggtggagtgcacctgtaatcccagatacttgggaggctgaagtaggagaatcacttgaacctgggaggcagaggttgcagtgagccgagattgcgccccacactccaacctgggtgacagagtgaaactatgtcccaacaacaacagaacatttaaaactatgatctactagctaaagtgcttgttttcaattttatttattagatattatagatagaaaatcagaagtcttgaatacaggtaaaaaaccaatgctttattgcaaaagccatatcttatcacgtgctaaggtataaggtttcagagataacaatcattagtcagtgtttaggagaccaactggactaaagaaaatacagttgcttccttttgggaatttaggattgtgagcttttaaagctactgattttctaacattgtcaaggataggtaggctgagcttttcttagtagaggcagaagataatcgaccaattggttgtaataaaagtaaagaaaatggaattagataaaagcctctgaacaaaggaggagcttacgaaaaagaagacggcacaaagtatgaagacactctaaatcttatgaaactagaatagtctttgggtatgttttttctccttttactctttctttcttttatataaacagaagttgatttgaaaggatttactttccaaagaagataatttttaatcacatgtaagggatttcaaatgtgcaggacctaaagatagaaaacaaattactggtggattcttagattataattgagcataaggggagttttatgtaaaaatccactgaatggctgatttgatgttgagatgtttaattggcttttcatggatgttagcttgtccaaaatgatttcatgttctttcttgatagatatatgaaatatacaataatctttttctcatgaggtccaggtgtaatgagaactgtcttacaaaaggctgattgaagattaatatggccagaaattgaaattcatttcctgtattggaggatgctgtctaattagttgtggttacaggatttttgaacatcaggtttggtaaaaagatgaaacctatagtcaaaagttatgatcacagaagtctggttaaacataacttcatgcaaacccaaatgttacttagttaaaatcaggaggcctgatgtgacagttttgaaatcttggtttgaaatgaggttagttagatgatgcgggtttatcccaagtcagataaatagagaagagtcttatcaactgcttgtaaggcctctcttccttaacagagtatatatggggggagagaggaaggcagaggtgggagggcagagacacaaacacacacacacacacacacacacacacacacacacacacagagagagagagagagactaggagaaagaaaagtaaagagaaagaaagtgaggggggtaaagagatgatttgattcttacaatgggacaaagaatagagtatacacttattgggcccctattctgtagcaggcacgatcccttgtatgtaagctgtgttatgttttcatgctgtccgctgactgtcccccttatttgccacatttcaattctcattggcaagagagctaaataaaaataagctaaatatgcaataaaatggaaatctcataaaataaggccactccactaaacatttgtttaagtttaaacagccagggctaaccaacaaaatcaagcaaacacttttagttaaaataaaaaggaaccaagaacaaacaacaatagaacatggtctgagaagcaagtctgaattttgaaatatgaagtatttctgggaggataacagggaaaataaaagaaaaacctatgtacttaatctcatgtcccttttcaggtatcccagtaagagctaccttacacttctaccaaagattcgagtcttgagccacaaaataaacatgtcctcctactgtcctgcagaaatgatcggtgggcttgccaaaaacagcagctattctttcccttcaccttaggccagacataaacgtcagccaagtaccacacacaccatgcttggaagcatcgacctgcatttttaatttggaatattaaaaacaaaatggcttccaacttttcatccaacatctattttaattgggtctatgattcttgttcacctttattttagttggtttagaggaaagtgtttcactgaagcaatacacatacgatttaattttaataagtagtttcgaagctcacattgtgtttttgcttatttgtagtatccctaggcaccaaataagaaaataaatatttcataattttataatgctctatctggggccttgttgtgttttaagctgcctcaatatgcgtgctgacaaagttctctcttcaaagagcttcacactttagttaaaatctcccccacagattttttaacaatgcctagaacattgctttgccgatcatggatgctgaataaagattttttttatttttactgtagagtttaaaggtccattcaattttagaaatttatatcactcataaccctttctagccacttcttcaaccacatatcctctgacatacaactacctacatacagaaataaagttcccatagaagcaaagtcctcaggtcaatatacattaaaataattatacatgaaataaacttagaattttgagacctttttgatatgctgattcattcctctgcaaaactcttttccaaatacttatttatgctctttcaccattgaaagaaatcccctatatttctgtgctatttttctcatctctatgctattggctcgtagttatacatatctgtcccagaccattcttatgaatttcaaacaataatttccagctatatgtcatcaggaaatattatacccttggcttttctggacaatcagtggaagcaatagccatatggagaatatttccaaatctaatggaacccctaccattagacatagaatattgtctagctggcatattattcaatatcctgtacattaagagctacacatatatggaaatatatatatatgcttttttttcttgcatgccaactttattaaaatttggatgcttcctgatgtggctaatgagaagaattctcaggcatatacagggtcaccagtaatgggtgccatgaccaattagtgctgttatccgtaggttggggatagaagaaaattttcttacctgacataagcaaaatctcagtggcagaaaaatgaagagtgtattctgggcacagtaagtagatttatttggcactcatatcttttgaatattgactgaacaaaaatctgaaatcagttgtcactttttgaatcttaataaattctgctatgaatggatttgaaagtaatcattgtggcacaagtaatccatttataaattatatttgctcatgtatttgtattttatctatgtgatttgcccatcataagtgctcaataaatactggtgtaaatgaaataaaaatgaaaaaattatctttatgcatagaaatttgattcatttatgaagatggaaatataattttagcaggaagatggaacagattgtcttagatggtatttgaactttattttatggtcttaacacttgagctccccaaaaatctgtgatatttgacatggcattactttatgtctgtagtactgtactctgtaactatcttttgccatcattaagattattatttattaataatctgaaaaattggtgtatattaggtgttgaatagaatttaacaacttgaacacaattgtttagcagaaacaaacaaatatgatgtccagaaacacagaacaacaaatgcacggtcatatacaaagcatagcaggtaaacacagaatccagatttcagttaacccagtgtgctgtttctatgtgctatagaatatacatgacactatgaagaaagatataagggattaagttatgtgcagatctgggattttgaaccaaagacctgtgactttaaatcctgactcttcacattggctgattctacagagcctggatgcagttaaaaaacatgtttatgtttttatgatagaaaatttgtgaggtcctgtttaaggctctgaaatgaccaattgttttcttgagttgaaaagaataaaagtcaaccatcaatttttgtagtcaaattagagctcaaggaacatagaaattgcaatgacatttgaacctgattttccttctgccaaatcctcctttccttcttttaaacctgtcctagcaaatgtccaggatacatgtaaactaaattttcagctgatttctatacctgttgtttttctgtctcttatttctttgctaaaacataatcagtatttttcccaaacagtttaagatcccccatctctgttgtagtttgaataatgtgcaacacaaaataataaataatgcaatattaccattggtattacatattttttgtaatataaatctgtcattttgtagataattatattgaaatatagtaaatgaatatttaaccactgtaaatgtcctatttgtattttgacacatttctctgataagaaagcaatgatttaaatattactttttatttttttaagtgcccatgctgtctttgtcctaactgatattaattcatttgcaatattatccaaataccttttgtttcaccttagtggcaagtcattatattctatcatatttacttaaatttagtgacatgtttcacagatatagacttgtaagtgagattcttcaagtgggtagttctttttcttcagagaatcacaggatcttgaaattaaaagtttccttggagaaaacttttccctgttcaatcttctacccatttaaagtttctctttctactgtattttctacatttatatggccttctatgaacttttcaaagattctgtgtaattggaattttaaggcaacccatttctttgcagcacagctcaaatttttatcaagttttaaaaaattgagctgaaatgtacaccttctacattacccatttattcaaattaggtattaagaggttaaactgaaattgttttcattttcacatcctttccagggtgatacttggagaaaactattatgttcctccttaggctttttttgctggggttatcttccctaagtcattcaaacttttgttgtataatgtgatttcttgacctccttattgccttaatttcaagtcctctgaagctgatctgactggaagagagtacattggaatcatgacctaccatgacaccaactctgtatctctgagtagattctaagtgcattgactcgtatgggtcatgtggtaaaatatcaggtcttttacttttatttgaaatgctataaaacctttctgttctctcctttctttatactgttgattcatagttgagaataaactctaccatatttttaagaaattcttgtaaatttcattccatgaactaataaaaatgtattgtttgtgtgctacctagctacatggctcaaatgtctccattagtctgtttaattggattacaaaaattaaacagaatacacaatggacaatattcttctggaaaagctataaaggaaacttcatgagtggaagtgtttgtccagatcattgtacctgaaagcatttgcccagtgcaaccagacatttaaaacccagaagggaaggagaagagaaggaagactctataacaaattctaattgaattgttctggcacccatgtgctgttctggttctgcttgaccagaggctgaggataattcagctttctgatgatttttcccttcactttccaggaggctcattattgatgaagcctattaagacaactgggatggacagaggaaaagggtcagacacatatggctttcctgtttctttttgtttgaccagattcatttgaaaggatgaaatgcaatcatcattattatcatcgttatcacagaagctctcacttaatgagtaattaccctgagtctgcaccatactcagctctgcttaacatatattgtctttgattatatattaatctacaacgtgttacctttattttacagtgaaaaaaatgtgactcagaaatgattgatgttagttctgtctcccaaacatgtgcattatctgtagaagcacatagggtcaacaattatttatatttgtcaaataattagtagttgtaatgtcaactgtgagtctagatgtagaaatgctgtttaaaaaagcttggttcaaagtatgttacaaccagcaatgacaaaactaaattctctgctcttgaagtatatttagagaccaccataacattctactcttgcattcgtttgtgatttgcaaagtttaagatttctaattgaagtcactcaacataaaaaagcaattctcaatacaaccattctaaaataatttagtgaaaaggtgggtagatcatggaggcttgtttatttcatcttagtacagaaggaaataatcctctaagatgttttggatgtttgaagttgtccaagcatcattgaaataatacatgactggttaaaatatacattcattatagcagaaaggactgattatgttactactttagaaattgagtttatattgaatacaaacagttgtagactcttacctggattgcttattggtcatgtcagcaataacgaatatatttatcgagtatgaaattcatttcagcttacccttgttaaatggctaaacactatttttaacaactgtaatcatttttctcctataattaattgtatttattatattatctcatttataaaatcactagatctgattaatgccgtataatataaaaagttatgattatgaaatacatttacatatttataaagacatttttatctaactgaaagtttagagagaacatacatataggttctaccaagcaccttagaatggtttcagaatttactgaacattaattaggtcttgattaaaaaccattcctacaatgaaagaatttttaaaaatcattaatgtgacatagatttgaagaaacatattcttattagccaaacacttattcatcttattgtatgtttaccttgtttatgtttcatctatctatataaagatatgtacatacacacatatacatatatacacatgtatatacatacacacatatgtacacatacatatgtgtgtatgccagtaaaatatgtttgcaatgtatctttaattatcttttactcttgcctaggttagaaactcttgaaggtcaggacgtgtatctaacttcatttgttctgatactctgggcattgaatacatttttttgctgagttttatgttggttttgatgaaaatacacagtattttatttataaaggggaattatcttgacttgtagataatgattttcaatatgtagcagtaagaattcgtattgatgccagggaagcaaattcaataaaacaccagtttagttcagctttggctgcaagattattgtaatgttctgtttcagtagttattagaaaatatcaagatctcttctttcatttattcagcaaatatttgagtgcctacactgggccatgttctttctaagtgttaatgatacaacgattaatgaggcatattttctgccctgaaaaaatatgtcatagagtaacacacacacacacacacacacacacacacacacacacacacacagacacacacacacacacaaacacacccacacacattctacattacagtgcaaagagtaaggtaataaaacttatgtcaggaaattatggtgcttggggagggaaaccaaatctcgtgaggagtttcacagaaggcttgctaatggtagattctgaatgaagcatttgaggttgaatatgagctatcaagaggaatgggaataaagagtgggaagaatattccagattgagagaatggcaaatcaaagggataaggagaatatttttagccataatatacaaatacctgttattatgtgttaatttactagtaattctactaagatttttacctggatcctctaatttatgccttacagaaactttatgaattaagtgaaatttttctcactattttgcagatgagataatgcaaactcgaggtgcaagtgtaggggaagctgagattcaaatgcagtcagtctgaccccagaatccctgctgttaaacacccctctatctacagtcttaccatcttgggttgggacattccaaaattcagtcactattaattatttcccaaggaataattcacaaacaattggactggagtcccacaacaaaggtacatgggaatatttgaggtaaacactgaatactcaagtataatctacaaaaatgtgaacactttctaatgtatagtattacatatttaaatatgtttttcacatattgaaaagtttggcatatctctttctactgctgggaaacttatatatagtcattcagtctccttttggcagggtcaggatttcagttatgtgtgatatgtaaaaattttaagtgttgtatttcgggttgacatttcttccaactttggaaagctatgttttacatatcatgcttttccaactggagtgtttgaggttatacttctaattgtgacttttgtcctacaaaatttcacaaagtttctaagtactggatctcattaagtttaattcctaggaccatggagagaggaaatacctatttcaatttaatctctcaaaaatgaattttctatttcaattaattctcctgagaaagacttagttctaataattagcttcacattatattacatttttataaaccagaattcaatatgtgccaatagtatgatcatatgggaatggtaattgtttacttaagaaagcctttttagttcatagtaaaatggtctaataatgaattctttatagtcattctcattctctgagtggtactcattacagcaattggaaagatcactttaaatgcagtactgtattatacatagttgctaagagaaccagttttccaatatttagagaaattaagcatcaggcatttgaaatagtcattggatatgttggctagggtagaataaaacacagccagatctgtaattaagatatcaatttaaaaatcaaagaataaacaattagaatgctgaaaacactatgcttcttatccatttagcaattattttctaagaatttttaagcaatgtttttttaagaattgtagctttgacatgaaaaggaggcatgataaacacaactctttttattagctaaagctttaatttgacatatttttatgatattgctttaaatctgtttttattttgttgtttatttgtataattttataggtacaagtgtgattttgttacacggatatattgggtagcaatgaaatctgggcacttatatgtatccattacccacatcacgtacattgtatctattaaatgatttattattattcacttcccccccagctcttccaaatgtctatccatctgtccaaatgtctgtccaatgagatagacatctctaatgtctatcatgccactctctatgtccacatgtacacattacttagttcccacatataagtgagaacattggtatttgtctttctgtgtctgagttgttttatttaaaataatgacctccacttacatctatgttgttgcagaagacatcatttcattctttttatggctgaatagtatttcattgtgtacctataccacattttctgtatgtgatccatcaatgaacacttaggttgatttcatatctttgttttggtgaatagcgccacagttaatacaagagtgcagatatcttgttgatacaatgacctatttttcctctgagcagatacccagagtgggattgctagatggaatggcagttttatttttagattatttaaaaataatttctctgcatcattattatttttcagaaacttaagttttaaacatttctactcatataaacttctgttatatttaacttgttaaatgcacttctgttcacaaatggctgtgatttctcatgaattttcaagcctcttgtgctctaattgaaatattttggagaactgttttggattttatgtttgttctgttgagtaaaagtcattgtaaataatattaactttgcatttttaaattagtactctttcaaactgtgttaatgcctgaaaatttagtttagcactgtccagtagaactttctgtgatgatggaaatggtctacatttgttcagttcagtacagtagccactaaatacatgtggctattcaacatctggaatgtggctagggtgattgaggaattgaatttgtaatattgtttaatattacttatcttaatttaaatggttctatgtggctaatagctgctatgttggatagatccactcttgttactacatcttaacagagtgactagttaagttttgtatttctaaagatgcataattgagatattaacttacacagacatacacatcaaaaaagagtctctctacacacgggtattacagacttctctagggcgcatcctctccttagctaattttatggtaaacagtcaccaaaaggggaactcatttagctggaacatcccagttatgttactgtgttatgatggtattgaaaactatagtagattttcacattgagaagaaccagaaatgtgaactataccagtctagtgactaaaatttttgaccaactgtacttttcagtccaggtgtttggtgattgatgtgttcatgattttaaattgaatatcagtgttatttggatgatggatgattggaagtgcttctttatgcagccatacatttctggtgttcctgctaataatctctaaaaataagtgttgagaaccagtcacaaaaagttttctatgataagaacattgatttaaacatttattttagtgtcttcttaactgaattcaaaacaatagatgttagaccaaagtaagaaatgttgccgtcaaagcctaatcttggaaaaactacacagagaattaaaatccatttttcttctactcatgcaaattagtaatatttgagcactactattagaaagtgtagcgaagtcttacgctttacctgttattgcgttggttcttgctgaatcacaactgtaagtaaagaaattgagaatggaggcctggcgcggtggctcacacctttaatcccagcactttggaaggccgaggtgggtggatcacctgaggtcaggagttcgagaccagcctggccaacatgggtgaaaccccgtctctactaaaagtacaaaaaattagcagggggcagtggcagatgcctgtaatctcagctactcaagaaactgaggcaggagaatcacttgaacctgggaggcagaggtggcagtgagctgagattgtgccacagcactccagcctgggcaataagagcgaaactctgtctaaaaaaaaaaattgagaatggattcactgcttaatagtaaagtatatcatttagtcttgcttgttattattattttcttactaccactttttactgtctggtaaaagaaataagtagacagatgccattcactaacataaatgagtcacgatcagtgagttaacagtttaataggaagtgagacttattgttaccagattttcaccattcttttgtgtgagtgtgtgtgtgtgtggtatgacttgtgtgtgaaagttctcctggatgtctaaagttttcactaccttgttcttttaataatagtcgctcatttccaagcataacatctatatagtttagagttaggttcagctatgagtaatagaaaacctaaaactaaaaattatttaaacaagagacatttctttatttctcaaataaaattgatattctagagctgctttggttatttcttcatcagagacagaggcttctttcatcaagttctctgccaaatgaaacatgattttcaccttatgatcaaggtggctaatcgagctccacatataacatctgcgttccacagagtagaaagaagaaaggaaaagaggcaaagtcctgtgatactcgtcattgaaaagatttcttggtagtttccacataaaattatttttttccaagcctgaatatagccaggcctacttgcaaagtggctgatccagaggtttttgacagaaaatatgaagtattaagttcccaatagtaaggttttctttgaagagtaatgttgaaatagaatgacttttctgccttgttgtagaaatagatgattattttggcatatattattactatttatagtatatatagccagagctctgccaataaacatgaagaaatttttaaggatatgtcctaggttttagcaaagttaactttaaggaagaactattgcaaaagaggttggtgacattgagtgggacaatgacaccaggctgtataaaatacctggtaagggacacaattttttcagaacagtttggaagagattcactccattagattgacttaatttggaattgaccaattcatattagtgagatattataattttatgcttccactgtgttgtgtccagaaaatacaggtgttcaggggaagtcaaaaccctagatgaactctttgcagcaaatacatgaaggaactaactagtatgtccataggaatggattatacatttatattaatatctttaagctctggatttgcattctgattgctgtcttggcagaaaaccttagaaaataaagagcattttgattcctattttaagaatactggtgtatattgttttcatttcaaaattatctgaagcatattgtttgtgtttaaaatatatagtgaacatggatattattcagaggaaaaaacactgagtagtgaacagatctaaaattatattcttgattaagttatttttatagcgattgatgcattataaaatattctcattaatctaacaaaatgtaaagtaactgtaattagagtgaaagtttttatgatcatctagacacttaacatctcttctcttccatattctccatcttccctaagattctgatttttataggccaactttgccctaagacacactaggcacagtgtctgtggcccgtattacttttaaaggattcatgaaaatagttttcttacatttaaaacaagaaggaaaaactgaacttttaggtcaagaaattattatttagtattaatatgctcatttttgccccaatacagttgtaaagtatgatttttaattgcttaagggggaaaggggcccacaaaggtaaaagtcctcagggcttcaaaagttataatgcaaagttgtaatacacacctggacagccaaataagaatctgtagaaatatctccatttttcttgatgaattatatacaacaataaaacaataacaaataacaaataataactaaaatgtctataatattacctatgggccaaatgttgttttaaatgttctacaaaaattatctaattcaattgctacaacaagattctgaggtaggtaatattactatagttatcttcattttacatagtctatgccactctttcacttctaggcaagatcatgggaaatctgcttagcagatattagcatctgcttttgagcaataaacatacatattctgtaaccactggcattttcccctcagtaaacaaatgaagtagaatttgttatcaggtaaatgtcgaatttctcctgccatatttctcaaagttatgtttttgataagtcgccatctaaaatctttaacaggccttaaaggtttgcagggtttttttttcagtcttaataaaatgctagattcctgcagatttatttaattctggaattgcatacttttttataaataaatactatgaatattgccacattgttgggcctggttgcatggcagcctagtttcttttgaggaataatatattgtaacttccacaaaatatacgaaaattttattatttcaatgatatttgaactttttcaacttaagaattgtgcttgagttgtgagcttaaaggaggcatttgtgtgagctaagattcaaacagaaaatataagttaaatcttccttaaaataattaacaagaatgaaaaaatacttttcctgacatcgttttgtgcatcacccctataataccttcctaagagaacatagagaattgaaagaggtaaccatatgataacttttttccaaaatgcgtgttttctggaatcatatgtatgatttcaatatccctgcattatatgtttcatttctatatttttagtttacttgttagaaaatggaacaccaagctacagacacattaatattttaacatgttactgtgagatcctatcatctacattatatatttacatgtacatcatatgatataaagatctttacctagttaattcatccacaataatcaatatcagtagtgaagactccctaaaagttcaaaccagttatgtaattacttatctagttacattattacttttatagaataagtgaattatttgcatgaactatgcactttaagattttttgtttgtttgttgttgttgtttgagacagtctcactcttttgcccaggctggagtgcagtgttgtgatctcagctcactgcaacgtacgcctctgaggctcaggcgatccttggacctcagccttccaaatactggagactagcggtgtgcaccaccaggcctggctaatttctctgtattttttgacggggacggggaggtggtagtttgccatgttgcccacactagcctcaaactcttgagctaaagccatcctcctgccttggcctcccagagtgctgcgattacaggcataagccactgtgcctggccagtattattaaataacacattaaacacactattaaaagggtgtctgaacgatgttttatatatggttaaaatgttggaatttaaaagagtgatatacaaacaacttatttatttcatttgtgtcacaatataaaattcttcttgttaggacttgtgtacaaactgtatttaaaaacatatttctgaaagaggaatttttcagtggtcttatctggactacctttcaacctgtacctatcttaggaccaaagccagattttcagaatgaatcactaattcagtgaacttgagtagattttagagattacctgtctaatgctctcattttatatatggacaaaatgaaatatataaatgtgaaatgatctctacaaggtcacacaacatttagagacagagatggaactaaaagcaaaatattagaacctcagtttcatccctatcctttacacttcactttgttacctgtactacattatacaattcaaagttctattgctaataaattttactttgtttggcagacagttgttataaaaaaaaaggtgagagatggatattacaagtcaaaatgactagaaaaactgtcttgtcagtaacatttccatagattacagaaaagaaaggtgaaataattactttatgaagagagacactgcagaatttgagaaagagtagattatgagttttgtttctagagatacacaaccaaagttacctataattgtgaaagtggtctgtgtctacatattatgaaacaacaaattggctatctttggccatagaagtacagaaatgtattttcagacagagctattatttctcttttttgaaagaagagatctaagaagttaaagataaaatcattaaatacctgtctttgaaaaactgtatagcatatatgctttctcctaaagtatcatcttaaatcatgtttagcctccaaagtaatatttagaaaataagttagtttatcctcaatattctgccaaagacaaaatttttacttcagcaggatttggggaagtgcatttcccaacttcatgctctctttggacattccaacatttaaaactattctcaagaatgttcatccagagcagcagaagacaaattaaatctttgctctcctaatcatccttatgtgggtgaaagagagaatgtatctctctactctcattctgaatgtgtatacatatctttcttctgtttgtcaatgtatcctttaaaataatgacagcacaagtgaataacaggaaaatattgaactgaccaacaaaaagcacagtgggatctttttccttctcttctggctgtggggagtgttaaatatcataacacatgtacaacatttagccacgtgaccagcatagagttagtgctcaattactgttgttattaattgtgcttgcaatggtgcctttagttgcattattgaagcttttgacagagagtgtcaaaaattattctgaaacaactagaccaaattatacttgtaccagcaatgaacgagaatgcctgttagtatggtaggataagatcttcagggccaatctgtcactaccacatcagcataaatgtcactgctccccagggcttttggattttgttcttttttagcatgtcttatatgtgaagaagtagagagcacatctatttaatcattgcaaacatatacctaataatgattctaacaaatatataggaaggggaagttcggtattttgaaactaaagaatatacagcacacagaatatgtaatgacctttggaaagatggtttctgagacaattttcttaacaatgtaaagaccaaactgaattacataagatttttcttggtgagactgcatattgatggagacctataacacaatcctcaatgtgtggcctccatgccggcagcattggcatcaatcacctgggaacttgttagaaatgcttactaacatgccccacaccagatagactgcatcaaaaatggtgggtggggctcatcaatcttcgttttaacgtgtactccagcttattctgatgccagttaaggttaaaaagcactgaaatacaaattagcaactctctctctttctccttccatatttctcttctttcctctttttcacaatctctttctacatctttacttctctctctattcctccctttctgttcctcctttcttctttgcgaattggtggttgaaactagccattgcactgttgttaaattagagaagtcgcctaatttgacctaagtattctggtgattcctaagagagcctgggcaggcgataggaatacttgtctcttcatctccagctcggcattgttttcactgcaccgagtctgctaatacgttgaaatgctcttgaagaaaccttcttctattgtcaatattattgtccttggagacattgtctctctgaatataatagaatttcaaagcttactgatttaatctttcatgcttcaaatccagacactgttctattctaggtgaaagattgctatttctttattattaaaggaagaattgtgtcttcctagctataattagttatatcagccttcacatcaaaagggtagtaattttctgagccagagctttgcaaagtagcaagaaaataattttacaagtgtctttttcaagagcatgaaaattatgaggctgtaggttcaaactgttctgttgaaaatgtgcccaagtttaaccagacataaattcatattttacttttttcttgtgggcctagctatgttgctatgacattttatctcacctgaagtctccatgaagagatggctagatgtaaggtaaagtaaaaaaggagacaacctgcaataaaattaagtaggtgacatatcttcaaccgagagacaatgagggattttttcccgtaagtcttaatgaagcaatgataaagccttacttgttttgtctgtttacttttgcttcccattcagtttcccttattctcaaacacatcttttaaatgtgtctttcaaagcacattgctatttgcattttacattttcctattcaaaatcctcagtggctttgcaagggtctacagattcctttcttttcccaaccctcccaagtatttcttcctggatttcaagctttaagtggtacttctctgcaaattgaatccaaatgtgtctgtcccaagcataggccaggttttcccagaggtattatgtagaattacagtatttataaactcttagcaacagacttcattattgctgactgaactttgatttggtgagcaagttctcaacatgctgattttgaatccattttaagggtccaaacccttgtgacaatgcagtgtatgagactcctcagacttacctggcttcacctttggcaagtttcctaacatctatgagaatggtactaatcttcaagtggggataaatggctttacagtagaattgtttgaaaatttgttcagataacataggtaaaatggctagcatagagtggacatacagtcagttgtagctgtgactgtttcctgcattcaagactttctctagctggatcctccaccaagaattttgtgtctcttaccttatcatcagaaatcctatattgccttgacattgtggtatatatctcaatcccacctcctccgtaaaacagcacttaattagacatagccatacaaagtttttagatcttttatgaccatatttctctttatttattagtaatcaactttatttctttctcaaactcaaccttgatttttttctttaaaactgatatttttgaacaatggtttagactttgttttgagctccttgtggtactttgtttaaaacaattcaataatgaattaaatgaagctttaattttttaaaaaatagacaaaacagcaaagtttagatggcagtgaaacaaaacaagttggaataccccaaaaatgattctggtcacactgattatgcaaatagtttaatataaataattagtgatatttcttcttaccattataaaaaaagatatgtttgcaaaaatatctctaattttataaagccatattcaaaatcgactaataattatcatattcctcaaaaactttctctatgaaactccatgtttatgtgtgtatatagagctttttcaaatattgacttctataccgttatcatatttctcttgagcattctctaactgcatttaatacaattgaatattttttttaaaattcaagagaatattattagttcataaatgatattcagtatcaaaattagtgaaacacagatatagtgactatccacagagtattggactatggtctgtcatacagattgtgaacccaagcagctcttctgccctgactctggcaaaagataagatatttattctttgaggaaattaaactgcattttaaattgtaaaaaagaaagattattcaggcctaaatagccttaggtcactctaaggttttgattaatgtaaaagtttattcatacgtttgcttttaaaatttatgctgtgttagattacaagtagattttcatgtctaatataatattttccccaatctacaatttttttccaaactctgatgtcatttttttctatctaatagacacaaacccctttgtttaacttcatttttatgtagagaaaaaaaaaccttcacatcaaataaggggaataataactagtatttttctagtatttatttattttttcagtgaggggaattttcagcataaagtgaaattttttagaaaatagcaaatgagagcttttttgatgctgttttacaaggtggtaaaagtatacaaatttggggacagtgatatacctacctgtgactagcttacaggttttctgaaacttgtacaaaatattttgaacatagtgtattcacagtgttgtgaaaattggttaagaactacagcaagcaagatgcctttctcttcttgaaaataattccaagaactggaagttccatatccatctcatttctgaaatgagaccgtcttctcagtaatagaacagtgttcaacaagtaaagtgtttagatgtgcctgtgtggtcagatgtatgttgtatcacagcatgcattactcatgttgcatattctattcagaaagcatgcctcagccatctgagtggaacatatcaacgtgtaaaattggaattactctttagaactgaagcaagctttaatagttgctgcacaagcttctgagactagacaccgtgaatattctctgggctatttcattaacaaattgtatctctgcagcctgcatttctctacatatttattgaacagataataggaaataactgcttttttgtgaagtcgtaaataatatggcagaaggatattaaacccactgagatgtgacagaagaactaaagcttgtgggttttagaattttatgatacaagcctttttttgttccatgagtacatgtagagtaaacagatatatttgaattgtttatgtggacaattataaatttgacattgcagctgctgaaatgagactatctcaaacccagaactctttcgtgtactttttactgaaataccacttactgaagggctttactaaagagggagagagagaaaaaaaatctctcttagccatatccatagtgcagcttcaaatgacgcaaaaccttttatgattataaaggtagttttatggccatgcttctcataatcactgtatggctcctataaaggtcataggagggccctggtttttctagtctaacatagctttatcctgtttactgaaatagttccaagcagtgccatgccgagatgatacattaccattcttactgttatcagcatgagagctctttcagtttgtcttttgagaacttagccggattttacaattatttttaacagtaagtgaagaaaaactcaaatagagataaaatcacagagttaaggtttcaagtggcctaggcattgtacttgtttctttattatcacaaacaattgccttgaattatattggtccatacaatttgttgactcaaatgttgttttcagttgttactgattagagatacatgccctggatataatcattttggttttctcattaaaaagtcatattggtcttgttcaaataagtgtgggacaggagaaaactgccttgtaggtgggtatatctaaaataaattttgtccatggccaattatcagctgtgtaaatgataagttgtttaacttctctgagacttagtttcttcacctgaataaagcaaataaaggattcttgtttaacaaattaacttgaacacatctctaccccctttctgagtttcttattaaactaaaagcaaatgaattttgaactgtacaaacctacaaggaaaaagagacttagggacagaagataacagcaaatgaatgtttattataagatttttaagaaatggcctgggaaatatatgggcagtggcaaatgactcagtggattagaaaagccaagaagacctaagtgctttttacaaggaacacaaaacaggacaccaaaggctcaataagtggagatatttggtattttggaagacatgagtgggtaatgacttaaaggtcgttatagggaagagctagaccttgcgatcccactgactcacctctgcatccacgcaatcgctcttcgcagattctggcaaaagttaagatgtttattctttgggaaaatccaagaaaacctttgaaggaagagaacagaggtgacgcaccatactgaaaataagagtatttacagaaggcatacttaatattttgtgtgtgactggatgtatctctagaataaaagaaagcaatgtgcatgagaatgagtttctctggtaaatagtttaaatataatagaaaacatatatatatatatatatatatacacacacacacacacacacacacacacatatgtatgtatatatatttaatttagttgaaaacacaccccccacagacacacacacacacacatatatataattctgacacagatcattatatgccagctgtgttctaagtatctcacaaatattaactcatataatccccaatatcaccttataaggtggtgttatttacttctatcttatggacttctatcttcagatatcttatgttatggacttctctcttcagattcacttaacccttctaatccaatctctgatcttgtcactgtctagttaaaaactagtccctaaaaactctctgtatacaataaaactgaaactttaaattttggcatacatgatccttcattgtctacaaaccagtcacagggaatttcttttcatgggccaaagtctgtcataatgatttgcctttacacacactgttccttctagcttttactctttgaaatcttgtgtacttcacaggtttttactgtgtctccaaatctcagtttttacttcttctttgattcctttcctgactccctcaagagggaacactgagtactttacttccatgcttgcagaacacctcagacatgtccctatgatagcactgatggcactatcactgtactcctgagagaggggatgggacggaggaaaagatagaatcacgttagtaacacacaatgttaattttataatgaaatgctttaaaaatatgtaaataaaggataaatgttctattaaaaactaagttacttgtgttagtctaaaattgcaaaaattataggataatatgaacaaatacaatcatacaactggtaattatatttcagttagtagcacaccatatgttatttacagaatctaacgacaatgaagaacaatttaacttgatttatcctccattatatttttctttaaaagaattttttttcttttattaagataattggcatctgtcaactataatttgcaaaatacttatataaatgtctggctcacaacatgcagaataatatattcagaagattgagtctgtttctgtgcctttatttcatactatagaatcaatttggtaaatataattgtgtttaatgtgattaaagaaaaactaatgtggattatagaaagctatatagactggtcgtggtggctcacggttgtggtggctcacgtggtggctcatcccagcactttgggaggctgaggcaggcagatcacttgaggccaggagtttgagaccagcctggccaacatggtgaaaccccatctgtactaaaaatacaaaattaacttggcgtggtggtgcatgcctgtaatcccagccactcaggaagctgaggcacaggaatcacttgtacctgggagttggaggttgcagtgagctgagattgccccactgcactccagcctgggcaacagagggagactctgtccaaaaaaaaaaaaaaaagaaagaaagaaaagaaaactctgtattacatatattgcttgtatttttatgtatgcatacatgtatgtatgtatatacatgtatatgtgtgtatatataatagtgaagtatatattacagtttatattttgttaagttggcaaatatcttagattgtgttctcattttcatgacatatacggtttgtttccttttctatatttaggttcctgattaacagagtgtagacatatgctgcatcttcctattagcaaaactgtgctctttaaggatttttgctgacataagcagaatttttgtggcatcttaataaaaatgctattttaaaggaggtattttgcacagttttgtaaataattatccaaattgcctttgttataaaaatcagaaaagaagaatagaaatagtttaaacatttgccaacacttttcattacaatgatagtaagaattttaattatagaggcaattgggatagaataggacattgaggaaatagcattaatctgaggaagactgggagtgagcccagagtttgcaaaatgcctccttttaataaaagcaatgactaatatttattaaccacaacattacagtaactattctgaatggattttctccttttttaacttctattttaagttcaggggtacgtgtgctggtttgttacataggtatacttatgtcatgggggtttcttgcacagattgtttcatcatccaggtattaagcctagtactcattagttattttttctgatcttcctcccccaccctctaccctccaaaaggccccagtgtgtggtgtttccctctatgtgtccatgttttctcatcatttagcttccacttataagtgagaacatgctgtatttgttttctgttcctgtgttagtttgctaaggataatggcctctagctccatccatgtccctgcaaaggacatggtctcaatttttttcttttatattttgagatggagtttagctcttgttccctagactggagtgcaatggcacaatctcggctcaccacaacctccacctcctgggttcaaacaattctcctgcctcagcctcatgagtagctgggataacaggcatgcaacatcatgcctggctaattttgtatttttaatagagatgggggactttctccatgttggtcagcctggtctcaaactcctgacctcagatgatctgcccacttcggcctcccaaaatgctgggattacaggcatgagccactgtgcctggcccttaggtatttttttttaaatgaccgcgtagtattccatggtgtatatgcaccacattctctttatccagtgtgtcattattgatgggcatttaggttgattttatgtctttattattgtgagtagtgttgcaatgaacatgcacatacatgtgtttttataacagaaagatttatattcctttgagtatatacccagtaatgcgattgctgggtcaaacgatatacaacaggtaatttttagccacattttataagaaaagcaaactgactcagaattggaaagtatttactgagttcatgcagctagcgagtgatttgtagaagatatctggaaaggatatttgattcagattttgatctttctaaattgacattcatggctatggcgacaaaaattcatacattcagcctcaaagaattacttgaattcttcactatttttcccaggtgttgttcacggcctaactccttcagtaatagttctagcttagccttgagtgagtgagcataaagaggcattatcatccatgacattacagaaggtaacactcagatacatagatattggtagtcctagaaataatagccacaaaataagttggatttggagatacaggtggattaatgggtagttggcctactgttcaccaactattttaagatcaaaaaggaaaacttgtgactttttttaaaaaaaagactgatgacatccttcccaacatttgttgcagatctgacttctagctctgacagcattacccattctagaagcatctctaatgtgacagtttaaccactgtgagtgcttttccattgcaggaatccgatgatgtggatttacgtagggagtctgttgatccacttggaactttattaaccccatggcgcccatggggccaaacattgtctgctctatttcacactttcatttttctttgtgatctcatgaaattttctttatctggcttgccataaaagttgtattgaaacatatttagataagagatgcttgtggtatggaaatttaggttgctaatactgactgggaaatttatcttaaacaaattgattgataaagatagttgttcatcttattatcataatagataaaatatttctattgtatatgtatataaatgtatgcatgacaattaaatagataataggcagcttgtttcattataaaggtaaagacattttgggaaggaaagcctttgttattcaatttttttgtgaaaagaaatattattaaaattttaaaactacattgtgataattttaaacatagaaagcatagttatagttgacttaaacccgattttccatgtctccctctttcctttcagttagtagcagaaagatctgaatggcaaggatggaatgacgccttgaagtagtagcagctggggctgtgttgagtgccataggctgccttgttggtagtttccaaattacttctagttctgtctctgctggtagaatactgaagcattgctcttctttagaaaactctgctcaagatgtctcctgggatttttttttttttttttgtagatttaaagaacagtatccttctttggaaacatgcaatatttttagaatcctgtgatattctactgtaagacataagccaacagtttatacatccctgtccaggaagttgaataataagtaatcctgggaatttaaacctctattttaaacctttgtaaggacacttttatttcttcagtataaatacaaaaaagaaaaaaaagccaacatcatctgagcttctacttgcttcaaaaagagttctatactagggtttaaaaaatcaacaaatacagtaaggacacttttatttcttcagtgtaaatacaaaaaaaaaaaagccaacatcatttgagcttctacttgcttcaaaaagagtcctatactagggtttaaaaaatcaacaaatacaggaggaaagagaaatattcagattcagtgaatttatttctttttgaaattacttttgtacaaaatgtataggaaatatgtttattttcaaaatgcattgaacccgggaggtggagcttgcagtgagccgagatcgcaccactgcaccccagcctgggtgacagagcaagactccatctcaaaaaaaaaaaaaaatgcatttttttggttagattaaggcaaagagaaaagataatatggttctctttttttccctaactctaggttaaaagactaattagtaaaattgataatgtatggacagtgtgggagaataaatgtgtaatcaaattagtgcttagtaataatttggcatttcatacattttattgtgtttataccatgttaccataaagaataaattataaatcatattttatgcacagataaacagactttagaggcttaactggtcattcatacagctaatatatgtcagggcccgtataagcgatggatctgtatacaacataaaggttgcctgaatgattacaaatttgttgtctctatagtataatattacaatgcaaagcagtgaataatggtagtccattgtcaagataaaggttatgtaacttgaaatctatagtagtctctacatagatgtggatgaatccacattgaatatgaaagtatacaaaatgttatttaaaaaaatttagtatgttaaatttcatctcctcattagctgttataccttgcaagcttaagtcacagagctctttctttactgaaataatgcatgttatcaccactgaaacttttttttttaaaagaaagcatgcacagcacacacatgcacacatacacacacatctatggaagatataaaaagtacaattgttgaaagatatatggaagtaaattatcaatttaccaactgattacagcttagttcaacttaaattgctttgtaaagggaaaaaaaagcatctattaatatgatttatttcagatccatgcaagcttgaaagaatcgaatctctctgagcatttcattagggttcctgctgtcttccacgttccccaccaccattcattgacaggcttaactctcaaccacaaagggagagtttgaacagacccaagagttttctgtgggaatttgtgcatctgtgggaaacagtacttgacttcatatttactaaacttgaatctgaaaaatcctttttctacatagcatggatgcttctcagtgtctctaggcggttaagccctaagggtatctttagggtaacacagtggaaccggaaacaatgtaaaccttgaattttccacaggaaagcaaagggctaaggatcagaatgacacctacattgtatacttctccagtgaatctcggtgtcgattattttgccagatacagaaaataacacacgtagtgcctatgaaattttcaacaaattctggtgccacccttatgggatagtccctaaagcccccagaaagtcagtcacttgaaatagttcccctctatcagcatactgtaaatttcatagtcataaatcattgttgtcaatgtagggaaagtcaagcagtgagacacgaaatgttttgtggtttttccataagcagtgtgtgtgtgtgtgtgtgtgtgtgtgtgtgtgtgtgtgtgtgtgtgtgtgtaatatttgagatttttaagacatagtgagatggactaaaaatttgatccattgaaaactgatgaaaattgaaggtgattgaatctttaggtaacatttccaaaggtgtttgtggatgtatcagaattccagatttctggagggaggaggcacacattgaaacataaagaaggaaagtatacaaaaacaaattcatacataccttaaacattcattgatggtgctcaaagtaggaaaaggtggaaatatttgtttattccaaaaaactaaatacattcatggttcgtaatagatcataaaaaactaaaatttggcgtttatcttccattttagaaacctaaaagaaaaaactatactcttttacatttgccttaacatttctgtcaagagttggaaatccaggtgcttctgctttctgtactacttttctttgcgcctattaaaactccaattttgctttgagagaaagaagaatgattctacttctcagaatatttagctagctatgtgatgcagaggcaattttcagatttacattcttatcactgcttctgtaagctcaattattttaacaaggtctttccaatttcccctaatgtttttcataactaccttgaacttacatttaaatcaaaactcatttgtgaaataactcatttctcctagacttttgaagctttcagcatcacacgtgtaggaagttactgtttctatgtgtaaaagtttggtataaatgtttcctttttattccaatggatttattaagtgttagccaaagccactcatgtaaattttaggtttgcatttttattagtttatttgcaatttgtgttgacatattggccacttattctgattacgatgaaaaaagactaaactaagcctttaaaacaggtgtactagaagtgtccatgtgtaaattttttcatttgaccaagaatgatatcttttttttgttgtactgaattattgtactttatgtgaaggaaaaaaaatcagattgtgacatcctaattgcagataattttttttttttttgggacgaggtctcacttcatcaccaggctggagtgtagtggtgcaatctcagctcacagcaacctctgcctcccgggttcaagcgattttcctgccccagcctccagagtagctgggactataggcgcattcaacgatgcccagctgattttttgtatttttagtagagactaggtttcaccctgtcagccaggatggtcttgatctcctgacctcgtgatccacccaccttggcctcccaaagtgctgggattacaggtgtgagccaccacgccgggccctaattgcagataatttttatgaatcatttatatattcaacactttattgaacagaagtattatatatatcaaacttcttcaataaactgttaggaacactttgacctgcttttattatgagttgtaaatattctgaaaaaaacatcaaaatgatggcatcaaattctctaacatatgcattaattgtaaattaggtaatttttgtattaatatttcattaacctttacaatatttcaaccactatgtatatatatgtatcatacctaactcatgtcaattgtgtctttaattattaattgtgtctttaattattacatttaatttttacatttttctccaaaaaaggaatgcatttttctgtattcagtgtgaattatgtatcttttaccaacaacatctcattctaattaaaagtacctattacattatttagttctaatataccttattagttactagttacccaaaatttaaggataggtttagaatactgcaaagtacaacaaattggttttcatccttatacttcatccgcatttgatttgtgtaactctatgatatggctgagattgcagtacatggcttcagaaattaaattgtctttagagattattgcttctgtgcatgtgtaattaagtgtactcattattgtctataaagccgtaaaaccccacagttttatgggaagaatataaagccaatgatttcaaatcaatcagttggagagaattctgagatgttccaacaattagttttgtgaaaaactttaagatacacaatcttcctgcagtcagcctagatagataaagtagtaaaggctctgccatattaattaaacaagcattcattaagcacctgctgtgtatttgccaccatgttctctaaggtgtgagggttgatgtcagagatgtcagagggttatgaaatgttagatttgaaaagaattttagagtaaatcttgtctaatttttattctttattgctgagacctggaaaatgcaagtggcttcagttctcacatctaaaattagtatcaacactagagttagaatgcacaagagaaaacaaaattatattgagtggacctaagagtcagagtgggtgttgggttgactacaaatagtaaagtgtaaactgtacaaattacatagtgatgccataggaagcaaagtcaaagaatgattacatataaaatttgatttatatcactaagtctagatcataatcctaggctctttcagaaataatgtcaaatactctcattgattctatatgaaaggtgaatagcattctctgtgaattggggcactcataatgaccaaaactgtgctgaatcaatacttttataatactttaataaattataacatcagtcacaacacttatgtgtttggcaacatatttatttgctttgatagcattgttacttgttcatttggcctggaaaattccttgaaataactccatggtgttctaaatccagagattgagaaccaaataaaatctgatgagaaagttttttcttcagtggtgtgtttaacattttagtgcttcaggattaacttccaggtctcatgttatgaagaaataccaggaacgaaatactttttaccaatataaacaaatgaagttcatattgaatactagcatatcagattcagaagatggcttttcacatgtttgtactgatctttggaacaatgcattaaacatttagaaacaaatagaacatcattcacttgttgggtgaataggaagattaaacatagcaataggaagattaaacaaactaaccttatggtaaacttcaaatattgtaaagatgatttgtagtttaaaatattcacttataattttgttctattatcatcactacaattcaacagatttgctcagttttcctttcacctattacttctcactcctctccttccctatcatagttttactacatggaagcatcagagcgtttaattttatattttctaagctgcgtttccttcccattaagctagctaatagagatgactctattatctttcttcctgaatgaactctaagtttgctatttggtttttttcttatttcctctaaagccttctaaaataatctcaggcatccctccagaatcattgtggagtaacaagggcatagctatggaggtactttttatttttaatagacaagtagaaaaaattacacattttcaaacaaatatcaagtaaaaaatgggacacataccttgcatttactcttctatcacatatactttctatattagaatagacattcttattaacattaggcacaggctctgggaattgaaatttattcatacagtagataatcttttagacatattggttatgaaaaggaaggagaattggatacagtaacccagaagcaagttctttttctgcttctaaaggcaggtcaaaataaataacactcttgccgatatatctaaaacataccatgtttttacctcttcttcatttaagccattgaaacaacacagtaatttcaaacatttcggaatcatttcaaaaatattgttaagataattagatagccaagaagataagttgtgtcaagaaactaaagatacaatttaatgtaattatggtattttttccattcttaatataaacattttgccatccatttaacatagtagaagccatataatcaatattatattttatgtttttaatctatatattctaattagtatcatgctgcttttaaagccatgcagttttttgttttttgttcttctttaacatgcagagtttagttggttagcattgaatggtagagaacgtatattagtttaggcctatgaaaatgcaaaagtgcaagattgttattaatttgatttaaataaatactgaaattaaaatatattgagtcactcagtttacctgagtggtcctgtttcatcttgcgcttgtcagttggtaccacttgtacaataacaaacattgaaaaaaatttgaattgggagtatgtgccagacactggagatacacagaaattgtgtagggaagacaggcacgtaatatagtaatataagtataataatggattgtatagaagtacaggggtgttacaaagcaaattattatatctgcaaaggagagttaaggaaagattaacttctataagaagtgtcactttggtctagcctagtataatggatgtgaccctaccattgtctaagattggaatgggcacccagggactagcagatgtgaaacctgtaagtgtgagaatttggtatgtctaaggaatggcaagtggttcagtgtgcgaagcttacagtgcagccagggtgaagagatgaaggtggcaaattagggaaaaggcctttccactctacaaaaggactttcactttatcctgtcaaagacaggggatcactaaggaatttcaagacaagaagtaacaatgtagctgcactttggaaaattgattgaagcagggttgacattgaaagcaggaaagtcaattaaaagtttattgtagtggtttcaaaggaagaaaatgagagtgaagatgtagtaaagaagagagacacatttagaaagcaaaagcaaagaactaagagtctaagtggaaataggatttagaggaagggaggtgattgctctgtcgctaacctggctgatagagtcaggggtagaaccattaatcaaaatacaaaaatgcaggaagagcaagtttattggagaagataagttcactgggggtatattaaggttaaagcgtctgtggaaatgtaagcttcctgcaaggaaatagcttatgaatgagtgaagaatttttcagtgggcttttgtttccaagtttcgaatctaggtcagaagtgagtgtttgacagtgcccaattcatagtaccttcccagcattaaatgctaacctttttttcctgtatgtatgcatttgtaaattaatccattcaagatatttttgtagatttttgctatgtaggcattgtatatatatcagtaaagaacacagcctcagccctccactattttaatttagtaggaaatactaagaagtaaactaataatcataataacttgtgacaagtgcagatttactacattctcatatacagttacatctatctatgttttttctgtattcatctttggattttattttgttttgttttgtttttgtgttgttacattgtttaggcatgtcttgaactcctgaccttaagcaatcctcctgcctcagcctcccaaagcttcagtgttataggcatgagccactgctcctggcccaggattatttatttgttagaaagttacagatttttaacataatttgtctaagggctttatatttttggatatcaatatactttatttaaaaatttattgtccacttatatttgaatattattttttttcttgttactgaaactataaaaatgtgtttatacttttaaaatatctcatattagagattacaaaggtgaaagtacattgcattgtgcctagcatggaatatacacacaagcaacactttttcttccatttattgactttgctctggagtccttttctttacatatactgcctaatgttctttttatgtccaacacgcttgctgttccatatttcatgattaagtcttttataaaagaaaccaaattttgggtatctttctgtcctcaccaacctaatcacagttaatcatttctcaataagcatttgttgaatactccgtataacattcggaagatgctaaaatacataaaatatgttccaagtgcagtatggaagctcagagaagatgatgttaatattaatgagaaaatatgagtaggaaattcccacagaaatatctacaaaaaatgataaggatattgcaagtagagagaacaagttaatgattcataggcattaaattatgtgtattaaaaacaaagtaaaaaatcacaaatacctttaaatttagaaaataaagaaaatttaatatcaagtaaattaaatattgatatgtcagtaaaaaacctttttttaaaaaaaagcataattaaaatcaatggaggaaataagatgtcctagttcatagcacttttctatgtcaaatataagctgcttggatttaataggcatataacatttagaaatataatgtaaatcagcagccacttgttctatattactttgcagatggggaaactgagactcacggatataaattgcttcacataggtagaacatcctcagtgacaggataaaaacaaaacctaactccctttctttgtctactgctctttctgctaaacatcattgacaggtatagcataagttaaagtttatggtgttttaaggaatacagttcataaagcaaacaaaattatttctagttatttctaatgtaacttatggttgtgattctacaattttgtgtagcttgcataatgagatgttatgcatatttcagatttttttcatttacaaaggaaatatttattttaattttgtcactggcattgtctaacatctaaaaagtctccatatcctgttctctgggtgttaactccggttaagaatgaaagatggcactcctctgtgttagctagttattagcattttctatgtcttgagtaaaactcagtaactttgtcttttgataacagaaaatctgtctgaatacacggtgtttaagggttagatcaatcaattctttgttttttatctagtgccattaaattgaaaattttaaattagattctagatattactaaaatgaatgctttaattataattttctgatttatagtataaaataaatagttttaaaacaaagtcattgatcagcacaatgatgttttgtttttaagttctgggatacatgtgcagaacgagcaggtttgttacataggtatacatgtgctatggtggtttgctgcacctatcaacccatcatctaggtttcaagcctcgcatgcattaggtatttgccctaatactctccctttccttacctcccacccccgacaggccctggtgtgtgatgttctcctacctgtgccctgtgttctcattattcaactcccacttatgagtgagaacatgcggtgtttggttttctgttcctgtgttagtttggattagcacaatggttttatttatttatttttttattattatactttaagttttagggtacatgagcacaacgtgcaggttagttacatacgtatacatgtgccaagctggtgtgctgcacccactaactcgtcatctagcattaggtgtatctcccactgctatccctccccactccccccaccccacaacagtccccagagtgtgatgttccccttcctgtgtccatgtgatctcattgttcaattcccacctatgagtgagaatatgtggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaatggccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcctgtgttttttgggtgcataaatgtcttcttttgagaagtgtctgttcatgtccttcacccactttttgatagggttgtttgtttttttcttgtaaatttgtttgagttcattgtagattctggatattagccctttgtcagatgagtaggttgcaaaaattttctcccattttgtaggttgcctgttcactctgatgggagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacataaggctagccagttttcccagcaccatttattaaatagggaatcctttccccattgcttgtttttctcaggtttgtcaaagatcagatagttgtagataagcggtgttatttctgagggctctgttctgttccattgatctataactctgttttggtaccagtaccatgctgttttggttactgtagccttgtagtataatttgaagtcaggtagtgtgatgcctccagctttgttcttttggcttaggattgacttggcaatgagggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctccgtttgtctgttgttggtgtataagaatgcttgtgatttttgcacattgattttgtatcctgagagtttgctgaagttgcttatcagcttaaggagattttgggctaagagaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgttggtttgtcatagatagctcttattattttgaaatatgtcccatcaatacctaatttattgagagtttttagcatgaagagttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtagcacaatggttttaattaataggtgaaaataataacttggaagaaaaactgataatattttaaaaatagaaccagccatttaaaaaaagtggtgttggtttgagttgagatttttggagtttatgatcactgaggtggcattgatgggtactgctatgtggggtcaaacttgggtcctaaaggaaccctgtattcacagcaggagaagaaagctgacatcaaagggaaagcaggagaataatagttcaattaccagtgaaattaggtacactggttttcaaagtttttcttaattgtacaaattgattttttaaagacatgagcttgataaatgagaagtggttgggctcacataaacatttataaatgaaagtattttggggatcattttgtttactgaagttaatgtattattaaaatatcattgtatagaaatgtaaatacttatattgagtaaatatagaacagtttgtatattaaatatgcacttgattggggaggactaatgacgaatgtacctatgcagatgttgcctactcttcctttgggctgcctagaaagagcactctgataaattcaatgtaacctttttaatacagtttattaataaatgttttattactttatgacagagagtagagaaatgacactcgttttaactttgttcattgacagctggtaaacaaacaggcagacatttctggcttaattacaaaaatagaaaagtgattacaataatattcataataatctatttttaagtgactttttcgattacaacaatatgcatagatgtgtgtaaacattcatgcatatttataaagtaaaatcaagactaattggtagctcattgttgaagggaaaatatattctatcttgtcttcaaaatagagaattagaagaacacttcaagaaagttgtgcagataattatattcagattatatgagaatatggatacaaaatgatcaaaataaatattaatatttttcttccacatgttctgcaaatatgtatggaaatataaatatttgtatttgtttgtctttatcttttgtcttgcctacaggaaagtaaactgcaggaaagcagcaatatggtctgccttgtttacagcagcataacctttactgctaacagtgtctagaccttggggattgttcagtaagcactgataggtgaatgaataatgtactgaactatctaataagtgcagaacaaaacaaatgtgatctgttgccttcatgtctaatagatctggtagggctaggatttaaaaaatcaaatacatcaataaatatttatttacaattgttaagtgatgaggaaaaatgccatttttttagatttgaatgttactttttgttgacaataagtctttcttacacgttgtaataaactatgcaatctacaaagcttactatattacttaactttaggatcaacaagagaaaagattttaaacatggactctatttcttttctggcaatttacattctagaattaagagtgtgagtttgagtatagttacccatggtgacctattagcataaaaggtctttagagactgcagatggtataacacaggatgtacattaaacctttcagatgtagatgtgccaacataagttttcacacacaaacttaggaggaaacttaattattactaaattcagaatgtgtttgtaaatgtttttatctccacatttatcttaaacattacttaatagagaccagttaacatttagaattccacctccttcctacctatatgaagagtgattcttccaaactgtaaataggagtattcattatttcaacactatagacaaaaccttgctagaaccaatcctgaattgcagcaactaaagaaatttatgaattaataacactataggaaatagttctaatatgaggtgcataatatgctatttgacacatttatagccttccttgtatttattcaactctgtttcatcaggaagggatggaaaatatgcaaactcagatctttgaaaggaagtacattatagtgcatattgtctaatcactctcactgcagaagttgcctttttttttttagaaagttttaaatataaccttcttttaaaagcaaactgttcttggtcacttaaaagttcttgggatttattttttaactgagttacatgtaaaactttttgaaaatatttattctataagatgttccatgttctgctgagccttttcttccttagttgagtttgagaacatgccatagcaactatgtccctaaatctgcagattcaatattgtctcagatcacaatgagcacctatcaagctctacagcacataatcacctatggagaactttatcttaatttctctcagttacttcctgtcattattctgcctgctacagcccttgtatttcatgatacaatgtcatggcattcccaactggacctggtggtggtattgttcaatagctcagtctttattgatagagtttccattgcttagttccatacagagctcttatgaggtattgttattgaaagagttccagagtgtttaggtaggcaaattcattattaattttttacttgatacttgatagtatttattggatattaactttgtgctaggctctgtgaattatctcatctagtttttagagaaaaacagttggggttagcataaaagttctttagagattacattttattatcctcattttatagatgaggattctggcagttacagagttaaagtaactttccaatgccattcagctagtaaatatcaaagttgacagtttaaccaggataatctctttcccatgtaagcatgcttaaggactatactatgaatagatgatgatgatgtgttacaatctcaagagaaagcattttatcttaaataatgaatgagtgagtgaattagtacataaaatgtatattaacaccaaagaaagggaggaaaaacttatcaaaatatggtgataaatttctgatctacaggtaacttatctttcatctttacattttcttcttatcttcaaaatagggaaatcattttctgagctcatgtataagaaacgtagattttaaatgtacattagaaattgtcttagttatatattcttgattgtgtaaattatgcaagttagcagatgatatttcaataaacatatatttaataatgatgaaactcaactttcagtattatttaacaaatcatgtttttatctctctaaagtcatttgggaaataccataaaaatatcttgctatgaattgttcaattggttacttatttgccctgtcttaattcagttttaaattctcttaatctagataatgggcagctactgcaatctactgtcatggaaataaaataacattttgtggaaagatgaaactgaaagataattaaaatataactagcttagtctttttttttttttttttggagatggagtttcactcttcttgcccaggctggagtgcaatggcataatcttgggtcactgcaacctccgcctcctggattcaagtgattctcctatctcagcctcccgagtagctgggattacaggtgcccaccaccatgcccagctaattttttgtatttttagtagagacagggttttaccatgttggccaggctggtctcaaactcctgacctcaagtgatccactcgccttggcctcccaatatgtagcttagtatttttttatacccactcataccttctgaatcaggaccttaatatgaattttccttgccacctgaaaattaagttaaatctcccaaatgtttattctgatgctatttttattaaaatgataaatttaatacattttgaaggaaaaaaactgttgcttttcctagttgaaaattgaggaattttgttcaataaaatgagggctaatatatctttttctggtcattttgtcttttctgaactgacacttgcttcctcaagatttttttgacaatgagggaactattcttagctccagaatttgcggtgatttgataaaattctttcaaactacccttaaattggatattttaggtaccaaatagttgagttagtctaggcagtgaaggaagtactttctgctattatccatatgattaagagttttaaagagtgcagtgaatttcttaatttagacaaatgtggagaatgcttgctgattgtgctgcaaatttgtccaggactcatgttgtttaattattcatgactttaaaagtagcatacattacaattttgcatctgtagattattaatagaatgctcttttaataggatgttcaccactgagaagtgtttgtcatttgttagtttgctttgttttgctgtaaataaaaaaaaggtctatagaggatgtatagaataatcaatccaatgtctagattgacactacctgggttgaaaactcagctccccattcactagatatgtgaaccttaggtaagcttcttaaactttttttctgtcagtttcttcctctctaaaatgaaggtagtaaaatacctactgtaggtgaacgtagtgaggaaaaaaaatgaactaatctatcttaaatactcaagtgcctggcgcataataaaaaaagtaggctgggcgtggtggctcacgcctgtaatcccagcactttgggaggctgaagcaggtgaatcacctgaggtcaggagtttaagaccagcctgcccaacatggcaaaaccctgtctctactaaaaatacaaaaaattagatgggcatggtggcaggcacctgtaatcccagctacttgggaggctgaggtaggagaatcgcttgaacctgggaggtggaggtttcagtgagctgagattgtgccactgcactccagcctgggtgacaagagcaaaactctgtctcaaaaaaaaaaaaaaaaaaaaaaaaaagttagctaacattactcttctcaatatagtccttttcatcaaactcaaacaaaagcttcagaaataagaaaaagcaccagaagctgtggtacttatatccattagtctatcaaaggcaatggatgggtaccattttagaatgaaaaattatagaataatcttgaaggtgcagagcaattaatatacgtagatgtttggctattttattattttttaatgccactgtttctaaaaatgcatggtgctttcaagacctcaataaggactttaaaaataccttacaaactatcaatgttgttagttatgtaagatccacaaaaacatctaaatgaaattaaaatgaggaagaaaaatatttccaactgaagattgaaataaaagaaaatgaagttgaaaatgttttaaagaaaatagtttttgtgtgattctttgttctttcttaatcattgtgtaagatttcaaaactattattttcttaggttttgatatattacattctgaaagttaatcagtcataatagtataaaacatttgagaatatgtttttccaaacttgtattttaaccatatgttccattcctttttcactctcataattagaaagatagtcatgttgcccagaacttaaattaaaagaaagaaaaagaaaatcattttgaagcaaattaataacttttggttaaaattaattatctttgtgattttaatttgtaacagaaaaggatcaaggtaaaggccctttgcttttcctttcttccttatctcttttttttgaaaaacaaattctttttaattttgatgtttgtacatttttacctaggtagtttttaaaattattttatccttatcctgggatcccagagatgcattttaattacaaaaaaaggaaaaaagacaaagagtgagagagagagaaaagaacttgtgcatgcattatgtttgagggaggtatgagaaaagtaaattttgctggcatataccatattagcagaaacgatgagatgattgattttgtttgtgttagttttcataaccccacaagtaagtgaagaaattaacagtgattataaactaatatctatacttttaatttatcttctagaacaatatatgaaaagttgtcatattaaaggaaaaatgtcatcataatgaattactttgtggctaacttgaaatttcaagtgaaaatctccaaagaactctcaaaaatcaccctgatgtttgctgcatattgtgtcatatcctaagactttaaaataccttcattttatcccattatttctagtcataggctccccactctccttttctgtttctcttttaaaaattttatttgtattttattctcctgttcgactttcaatttattcactccattatcaccacctctttggagaaggggatgttgtaaaagccttcttctacattttcctcttccctagactttcggttggctttaaaaatatcagtatctgttctcccctgcaacctcattcaattgaaattgatatcattaattatctccaatacctattacaatggcattagtagaatgtaagttaagcaaattagcttctgaaacagctcttgaattcttcttaccaaattacaataatgataacaattattacaccttaaaagactagataaaggcaaatatacacttttggaatcattttaaaatgttcataactttcagtctattatgaattcctattgcagtatttccaaatgtgagtaccaaggcaatatgccatgtatattttattcatgttttaaaatcagtgatacatttacaaaccaagtttgaaaggactaattatgtcaagtaacaaaaagtaggtagatgtggttgacatctcttagaatgttctttattaaatgtaagaaacccaaatgcagttagattttcatttaatcaagcagtgtttttagtataaatgaatggctattgaagcctttatagcctgtacgctttcttaaatgcttcgctgaatgtttagcactctggcattccaatttggagcttcttttaaaggaggctttcataaaactttggacagaaacctgctctagaggaccatatgggttattgtacaaaagagaaacaaattataaaagctcattgttacttgattgcttaacatttttctcttctttttataaaaacaaaaattagattaatcagtgacctacttttgcttatacagcccagagagtcaacaatttatataaaggtttatatttaaattattttataacaagcaaaaagagacctagacaagccttttaaattaagcaaactcttatccaagataatagacttatttaacccattcaaaatcatttcaccttacatacagtttaaaattatttagatccatctgcccatccagagctgttgtgagtagtcttaagagtctatggtatcttctagaatttgtcttcatgacattccatacagcattgtctgatgattggaagaatatgagtctggagaacagagatctggatctcattctgtttcagtcacttagttatcatgttatttggtgtgttaagaaaattgaggcttagtaggaacgagttatttataaagggggttcaagttattccttatcttcttcacagacttattgtaaggaacaaatgaaatactgttttcgaattgcaaagggcttacaaatatatgggttatcatactagagattaattgatgtaattatgttcaaatgagtttttgctacttggcctcatctcacccagggttagtttctctttacactcaggttagccatctttcaggttgttactatcaattaccagaagaaatagaaaatataacatggacagattctaagaaattcaactccatttgttcaaaaacagcacaaaccttactcaaaccagcaaaccctgtttatgataaagcactttcggatttttgctgtaatgacacagttcaaagcgtaagaaaaattcaataaaaatttgtggaaatgattttaatataataatttccagaatacagtgtgctgattgcataaaatttgacactctaaaatttattgattttattattattatactattattttgatcaaaacagatattttagctagccacttccattcatagcaacactttggttctgggttcaatagagttatctattagcattcatcaaaataaattatggttgctcagtattacactgtggcatgggtttgtagataatctttcagggctggtttccaaaatatttttcaaacatctttcggcactttagatcttaacaatatgtgactacattttttaaaaatatattttaacatgtcatgtgtatataatcattttgattttctgtgaataaattataatcagaattttgtatgctatagtataaaggcagaaatagaaattgggttcttgaggtaatacctttgtttatgatttttaagccagttttatttttgttttctgtttcaatggacagctctgtaagaggaacataagaaaacctgagtgtgcttaaaaagggtaacaggggtcttgaatccatgtcaaatgaacattaagaggagtaaaatagttatggctgtttagcctaaatagaatattcaactatcaaatagaagtgttgagatgtttgggttgccatttcgaagagtgattttacttatgtacgtattagaaaggctagaactaacacaactcgatgatggttacagggacattaacatctctttaacaaaatgatggattttccaaaaatttcagtcttataacttagaattgctttatttttctaataattctcatttatttgggatagatcctctatgtttctgcagtaatgaatatgtccttactagagttgataattaactgtccctgacttgaaagatacctatttcagtcaaggtcagaaataaaaattactttctcagaacctgcagacaaaccacttagtaacactctgtaaaaccacactttccgtatatgggtgtttgttctaacagtctaagcatcatagatggtatgccaaggctccacagaggtcacatggttttcagtagtgccaaggtgatatatatttcacctcatcttaacattctagtagggttactgtgttcagcagtagaaacagtttatttgcatcacccccaggacacactgtggtaaaatataatgagtcttcttaatatgtaagcaattcaggcataggatttaaattgtattacagtaaacagagaaaagttagcattttttccttttgccagttccttcttctagaatagaataatgtcatggttcagtaatccattctccaacatggataggacaagcaccggatgtggagatgacaccatgaagagtacagcttgaccatgttaagtctgtcaagtcttactcgcatccccactgaagaggaaaaggctaggagaataaaattgagtttaaaaagtaatcctggctgggcgtgatggctcacacctgtaatcccagcactttgggaggccaaggtgggtgaattacctgaggtgaggagtttgagaccagactgcaacatggtgaaaccccgtctctactaaaaatacaaaaattagctgggcgtggtagtgcatgcctgtagtcctagctactctggaagctgaggcagaagaatcacttgaacccaggaggcagaggttgcagtgagaatatgccactgcactccagcctgggcgacagagcaagactctatcaaaaaaaaaaaaaaaaaaaaagaaggataggaaccatataaatgaacctgatagcaggccttggtttgtccatggcttgctttatttatttatttatttatttacttacttacttatttatttatttatttatttatttatttatttattagacagagtctcgctctgtcgcccaggctggagtgcagtggtgcgatcttggctcactgcaagcgccacctccgggttcacgccattctcctgcctcagcctcctgggtagctgggactacaggcgccccccaccacgcctggctaattttttgtatttttagtagagatggggtttcaccgtgttagccaggatggtctcagtctcctgaccttgtgatccacctgcctcgtcctcccaaagtgttgggattacaggcgtgagccaccgcgcccggctggcttttttaaagaaaaaatatttcttccttttcttccctggcagcaatagtatggcgattgccatttacaagtaaaacttcaccaaactttttacactagaaacacagattaattactaggttcttttaaatattttttttctagtatgctcaaatacttaatcaaacttaggaaagaacaaataagcaatatcacaaataatattgcataaggagtaaaaacattctaatgcaaaaactcaaaaccataattcctaatttttttggctaaccattattttttaaggtgggataaacatatagttatatattttttcttttaaaaaaattttcatcacaggaattagtcggaagtaaccaaacgcactgctcaagaatattgtagaatttatttaagggcaatgttgatagctaaatcagattatgtctatagacattttcaaatctgagcatccttggttctgttaataattaccccgctttcgcagtcccaatctcttaaatttgggattttctgaagattgttcatattgtcatccaatttgaaaatgccaacttctctttttatttttctttttagggtcatatatgttttagagtgggctttttccaagtctcttgacacggtccatcttgtgattgcatgtgtaacttcttccttatgaagacattgttttttgaagccaggttccgtatattatagagttgaattttattagcatttattactttattagtatagggatgtagatagtagctatagtatttattttataaatggataaataattacataaaccatttggattttaagttttaatgaagccagtaaagtccttctccatgtagagatagcattattccagttctttgctgattatctttctgaaaataaaatcagtttttctaatggtagaagcccaaaagagatgagaaaaaaaaatcacttttatgtgtacagacataagggtgcatacatatcagctaggatgtgtgttaaaatcctcaaataagtggaagattaaaggaaaagcccaaatcagtgtttttagaaggatctctaggaggccactctcttgaaccctaaaacactaaaattaaattttaaaaaactggtctaataaattagtttctctccatcatggctttgtttacaacttaagctctctatctccacctgaaagggaagattgactatacaaaaaatttagttaacttttgtttggctttttttttcttggaaaattcatatgacaagtaaaacaaagaaaaataatagaagcctctccacgtatgtaactttaaggtttctcacaatttcgagagcttgtcatgctacaaggtgaaagtcattcctttaaaaaaagtatacgatttaattttgaaacaagaggaactggataatattgtttttcaccacctagaaaaccaaataagattctttttatttatttagtctttgcaaataggtaatttaacacattcagtatattgtgaaagaattgccatgcaggtagtaattttggcaattgaagttgaagtcatttttaaatctcctattcaagcaaagattatcaaacctaagatgtatgtaaaaacatcagggcctagcaaagattttgtttagtgagcctctgtcagctcagagagtatatagtggagcagtgtggaatattagaacattgccactaggggcaggagacctgggttctgttaatgagtaggtatttttaagactttcacttctatttctccattatcaaaaccaggagattgtaatagactacagtaaattctcttcccattctaaagtcatatatctgtaactttaactttctagatcaagaaactaataggtgtatgtgtataaagatgcaggtaagccaacacctgcaaataacatgtgcatataatgaaaaataagcacaagtctagaaagagcaaaaggaagaaagataataactgattattcgtttacaaaagttgtaatgaggtgtgattattgttttggaaacaaactttatatattttctgacattgtatcaagaactttcttctgagaaatgatcctaagacactgtattcttttgaagttttaaaagtttttattgagctgcccagaaaaaagtctgtttgaacataatatgctgacatggtgcatcaaaaaagtcaagctgttttacatttcagagtttcacagtgataaaaattgtccttttatccattaaatataacatctttacacaggagagctctgatatgaagatctttagaaatttgaggagttaatgggtacttagatgtttgttattcctgattgctgtgctgtcattaggcatcataattatgaatatttcattgtctcatgtcattttatcactttttaaattcatttgtgtcttagtgtggtacgctaatcacaagttcaaaacaactaaaatatgaaaaacctttacaattcagacatagtgtttgggttttgtttgtatccagtatctcttacttctcactagataatagaaagtacagtgacttttctaagttatatagccaatctttccctgacttattttgggctttgttttttatctaaatgttgtacatttttgctttcattcttttttaagggctttgttttttatctaaatatcgtatgtttttgcttccattcttcaactatttaatgtgaagatagattttttaaagcatattgaaatggtattttgaagttaactatagaatattctaccacgttcttttttattattttttgttttctataggcctagtatttcttggggatatgattttatcaaccgaaatttttcttataatgagaaaacttacaaaataattttaaattttaaattatgttttaaatgttttgaaggttgtctacatttatagacatttgatatgtttttaaatttattttagttgtataattgttttaaattgtcagttaataaaatagttatttggtttatttggcaaacatatatttatatgcactcataattttctacagagagttgggtgtagtaaagaacactagtctactagaaaagagacctggtgtcacattctaaccttgctactatcttttttttttgagacagagtctcactctggtgcccaggctggagtgcagtggcatggatctcagctcactgcaagctccacctcccgagttcacgccattctcctgcctcagcctcctgagtagctgggactataggcacctgccaccacacctggctaattattattttttttttttttgtatttttagtagagacagggcttcaccgtgttagctaggatggtctcaatctgacctcgtgatccgcctgcctcagcctcccaaagtgctgggattacaggtgtgagccacagcgcccggccccttgctactatctttaatagctgtgtaatcttaggcaacagtatataacattggctttcaattttctcattgcaaaccatgtaaaatgtcccccattactgcagtattcaagcacagactagaaaagcaatatgaaaaaaaacacatagaagaaatataaatattgcatgcattgttggattataccacctttaaggttcctcacaaatttgagagcttattatcctatatacataattattaattatcctttagatgtaggctgtcatatttcaattagtgaggacagatttccaattctctttagaaggctgtgtgtgtgtgtgtgtgtgtgtgtgtgtgtgtgtgtctgcgtgtgtgtccaggtgagtaggatataagtttgagcaagcttatgcttcactattttatatagaaaatattttctgaacatctaccaactgtccgggactattctaggcacttgggttacattagggaaacccacacacgtgcgcacatagacatgtgcacacacacacaaattattgagatagtagagagtggtcagtgctgttgaaaacacagagcagagggaagggaaggggatcaggttgcatttttaaattaggtggtcaaaattggcctcagtgagaaagtggcatctgagcaaagacttgaagtttaggggaatatctaagcagatatctggaggacaacactcttaaggactagtggcagtgcaagccttcaaagcatgtgtatatctggtatgttcactgtataataaagaggacaggtggctaaaggtaagtgaatgagggagccattaggtcagaaagggagtggagcctaatcatattcactgtagtgtttcacaggtgcttgtaatcacttgacttttacactgagatgaagaactagtaggggatttagagcagaagagagacttacattacacaaggatcactgtacctactgggttcaaaaacagtttgcacatagaagaaagaaaaccagtttagaaaggaatatagtaatccacgtaagtgataactgtgacttggtatcagggtggtatcaatagaaattttgagaaataactgggaattctgcatatatgtaaagatattacaataggatttccaacaaattggatgtgtatatgagagaagggaaagatctgaaatgaagccagcatgtttgtttcatcaactgagcggatgctattgccatccacctatgtgagaaatgagaaagaatcttagtggagtaagtttgtagggggcaaaggaaacgaaaacttcagttttgggcatgctagttttgaaatatctatttgacatctcaatgaaatgtcaggtaggcagggataataacgtggttagaagagaacaattagtgtggcgtcatggaagccaataaagaaagtatatcaaggacaatggacttgatgttgataagccaagtatggtaagaattgaaaagatggccatttgatttggcaatccagagttcattggtgatcttgacaaggatgcttttgttgtaattatcagaggaaacacctgattggaaaggattacaaattgtaagaggatggaactagtgttactagcaatggtcaacactctctagctattttgttgtaaaagggagaagacaactggaattaaaactaatgggcaaaatgtggtttaaagcaggattatgtttcagattggagaagaataacatttttgttttgctggtggtgattactatgactacataaggaaaaaatagtgacgcaaagaaaaagaagtaattccaatgtgtagttttaaataggtgaaatgaattgtatttgtgcataagggaaggttttactgaggagagaatatttttatctcaagaaacttgatagagaacagagtatatgagtttggttgtgggtacatatatgaggctgtgagactttctgaagcttctccctggttacttcaattttatcagtggaaaaagaagcaaagtcatgaactgagagcattagggtggaggtgttcagaagaaaggaaaaactgtgaaatagttctccaagatagtggagagtacatggactggttaaatatattatattgtgggcagctgtaggagtcctctaacaatttgtcaaattgaatttaaagtgagatcattaagacctgtgtgtttctctgtgcatctttaattgcacaggtgcaggtgttgaagaaacagtgagttagatttatgtagggctgtaattttgcctaatgaaagatgttaaggggccttgaaaaatatgcgggatcaattgatttaaggtcatgttggcatcaaatgactgctagagttgggatactagagcaaatgagctagaaagatagaagataatgatcagagacatagatgcatgaaacagggattatagaagtatggacactactggtaatggatatgtctataaatgacctggacttatttggctgcaatagagtggaggacaagatgttagaggaaagaagattaaggaattaagatgccaaattttaggaaggatatcatatatgtgtttattgaaattgccaataactaaattaggagtcatgttgaagagagtggcagttaggcaggagataaaatagttgagaaacaaggaggggttaattgcagtatcattaaatggttgcaacagtgaagataatgatcaatataatctgccgaccagagattgaaagctgggatttacagggatgggaggaaaatcgtatagaaactatagtaacaatagaagtggccgtgtgtcaatgtgatcccatctcatgtgatttttaaaactgtattatatttgtcatactgtaggaatcattaagtaatgaaatctatttgactcatgtgttgatatttagaatagggaagtaagagtaaacacaaggtgtaatgaaagagtacatggatgaaaatcttcggagaaaattttgtgttagagagaatttgcatgaaagagtaagttagatgtgggctccaatcatggctctgccatttatgaattgagttcttcattaaagtgttttgtctctggaatgggataaaaataaataactctcagagttgtgagtgataagtacaatgatgtatgtaaaacacctggcatagaataagcatttggtgaatgctagttctctctcacaaaggagagattcaaatattgaatgcatttacagggtactgtaacaaagatagacttctgaggtaaacaatttctatttctatcaccaacgataaatgattcatgaactcattcatacaccaactgtgtgttatttcagtgacttgagaatgtgtttttggactctcaaagattttctttttcaatttctggctttgtattgtatattacaacatgtataaggtacaacagtcataagaaaatcaggacatcatttgcttttgtagtaaatactaaagtattaatttcttgtattactttttaaaatgtgtggatatataatagcattatcattgagtagaatctaaatgcataaaatgattatttagagtattttatgaataatagaatgcatataatataataatatgggaaatttaaagacaatgcacattttctattaaacaaatactcatgttgaatgaatgttattaagtaattgtagttgcttatagagaggatttgaaaaagcattgggatatatttccagtcttgcatgatcaatgacagaagtgaaaaatgatcacagaattataagaatatcttagaaagtggtctattggggtggagaaagtagctctgttccatatagttattgaggcacctatgagctctgccatccactagaatcttttcatccttgttgaatcctctgtatgtggccattcaaaaagtacaaagaaggaggatgcataaaagatttaaaaaggtttcagagttatgtctcaaaaggatgcacactgtttttggccacatgttgatggctaggactagtcaactttgtgggccatccagatgcaaagaggctgggaaatgcagtctaaatatgggccagtgtgtgccaaggagaagaatgcctgcttatggatgaactagctagtctattccagagttgatgcattactagatgttaaatcagaagttatatatggactctgtggcataaaaaatgtagaaaatgggtagaacattttaagctacctgactatgagatagccaggtaatgcttcactttggtggactatcagagtagaccttaaacgacacatcaatgtggtttgtcacaaaaggctggaatacattttttatggagcaggaattaatctgtagtatattccaacaatgtaattagtctgaagaggaaataggcttttattagtgaaggaaatcctcatatgcagatagcaaaggtaagtgggaccagaccagggtctatcttggatatcaggatgagaagttgtgttattatttggaaactatcttttcagttatgttattttaagccataagtaaaatcatgttggtgatacatttaattaagaggtttatagcaaatgcatttataatactaagttctacagttcgaattttttattttatattacccagaatggaacactattttcacatgatattcagggttgcttctgtttatggaaagcactatataatcatatgcatgtgcacttgcaaatgagcctttatgcttattgccatgaaaaggtttagcaccacaactatcattctagacatcactgatagatccataaagtctttacgactgcaaagaactttcgagctaatgcagttcaaagcagtcagatgatttttccaaggaatcatagatgatcttaaatctagatctatatacagttctcctaaattatgaggttcaaaattgttaagaaaggaatcctatttcctattgtcatagttatagcaaccgaagtgtgtatattgtacatagaaaggatctggactagattcttattactttgaaaaatagcttattttagccacagtttaagataaaaataataatatgacacacaagtggatatacattagaaaacaaattgtggggaatagactgtaccgcctactcagaactgaaccagacaagataacacataaaagaacagatattgtagtaatgagagcacagctgcttaggattctactgaaatgtgggaaacattattcgtggaacaaagaaaaacaactaaagagaacagctttaaaccagcaccttcatatttagcctcatattgcatattttacatattttaatcatagcccacttccttccaaaataggcttgaggccgtttataagaagataatgttgcaatagcaccgactgaaggataagataggatggggtaatggtgcaatagtaccacattaatcgtactagattactaacactagaggtaaacttttatttaggacaaacttttggcatttagcttcttggcactcaagtcaacaaagaaaaataaaattatgctcatattatttggtaaaaagaaggagtgtgtgggctttttctttctttcgtcttcacagttctgatctctgagaggaacttattttgcaattctttaataaggcagttttacaagacatgacttcaacatcatcccataaataaatactgaacttctatttcttgcctagttctctactgagttctttggacacatagatgaataaggagcatccttacccttaaggagctcacagctgggataaacttaattggacaataaatgcaataaataagttccttgcaagacaaaatggtggcccaaaggaaaaagtggtcagcaaggtcaaagagagaagccctcataggggaagagcgttgaactgatcttaaagtatgagtgtagatcaaggattaaaaaagaaatgagaagaacttactctaatctgaaaacaaaacacccacaatgtataattttatgcagacattcatagagaattccttcagagagccaaaacaatatagtccaggtgcctaaaatgtaggataacttgtttgattaaaaatactgaaatttgagaaatgagtggttaattggtcccttcaactccgtttgaatgtaattgatcatatagtgttcttctggtggtatgtctgttcatcacataactagtacgattaagacatttgtcaaaaagtaattttttaaagtgaaagtctagatgaaaaaaaattgtggtaacatctatgtagcataaaatttactaccttaaccagtttaaagttacatatgttcacattgatgtgcaaccgacctctagaaatttgtcaccttacaaaaccgaaactctgtacctattaagcaacagcatcccgtttcctcctccccgactccctggcaaccaccattccactttttctgtttctatgaatttgactaggtctctcatacaagtggactagcttatttcacttagtataaaatcctcaaggattattcttgttgtagcatgtgtcaaaatttcctttctttgaaaggttgaatagtattttatacattttgtttatacatttatccatagatggacacagggttgctttcacattttggtgatggtgaataatgctgctatgaacataactgcacaaacatctcttcgagatcttgtttttaatccttttgaatatatacacagaagttgaattgctacatcatatggtaattttatttttaatttttttgaggaagcatcatactattttccataatgattgcaccatttcacatttccagcaacagaacagagttctggtttttctacatactcaccaacacttgttattttatgtttttctgacagtggccatcctgataggtaagatgatatctcattatggttttgatatgcattttcctaataattagtgatattgaacatcttttcatatgcttcttggccatttgtatatctttgttgaaatatctgttgagaccctttggccattttttaattgtgttattttgttgttgagctgcagggatcctttatatatcctggatattaaccccttattagatgtaatgatttgcaaatattttctcccattttataggttgccttttcactttgttgaatgtgtctctcaaaattttttgccttgagtgagttcatagaaaatccattacagtatttgagattcatggaatagggaagataagtcattgtcctgggaaagaaaatggaagtatgagttactaattatattcatttctattttaaaatattagctattaatgctcattttggcaaggataaggttaggagctttaagtccataagcccaggacagattttggtgcttcttgacataataaaaacaaagacattttaaataaacgattaacttttcagaaaatgagaaaactgtatatttatgtctaaatttagtagtctctttaatttgttttgctttttctctttttcaattttctcttctctcctctctctctctctctgtctctttctctctctttctcctcttctctctgtctctttctctaaatccctttatattgctcttcctttaccagtgtcttgaccttcttgttaggtaatgtagcacagtgccttgatgaaaaatgtgacagaagcttcttttagacattccactgattgacatgaaaagaattattaataacagctgtcatttttgtagcacatactaagtgctattttgttctctgctctggaaaagaggaggatgtgagaggttacttcccacatagttccttccctctaagggattatagtctaatgggaggacaataaaattgggtaaaatatgtttgctagccttcaatgtctcatggctcttttttttttgttcgaagctgtaatatgagcaacatttaccttaacagttaagccagatcttcacgctgttttgaataagttacttctaaaagggtttaagctcaaaaaatgttatcttacttttgtgatctgtatgggctgtcactttgatgcctttctttttatttcttttctgtttttgtcttccagtaaatagttgtcatacctataagcagggtctttagcccttaactacttaagtattcagaacaggtttcagactgtgtatatatagttatgataataaacaggccctattctaacccagctcttaaacttctgcatctgggcatgctacttatgtgtaaatgaaaactaaatagaactgcattaaggagctaagtaatctcaagaaggaagcgctcatgtttgacagtaagaggtacatttttcaggccgggtgcggtagctcaagcctgtaaccccagcactttgggaggctgaggcgggtggatcacctgaggttaggagttcgagaccagcctggccaacatggtgaaaccccgtctctactaaaaacacaaaattatctgggcatggtgtcgtgcgcctgtaatcccagctacttgggaggctgaggcaggagaattggttgaacccaggaggcagaggttgcagtgaggagagatcacaccatcacactccagcctgggcaaaaaatgtgaaactctgtctcaaaaaaaaaaaaaagctgcatttttcagataaagattattgtagtctgttcaggctactataacaaagaaccgtagacagagtggtttataaagaaatttatttctcccagttctgcaggctagaagtctgagatgagggtgccagcatggtgagggacctcttccaggtttcagactgcttaaatcctagtgcatcatcacatggtggaaagagagcaggaactctctgggatctctttcaggaaggcgctaaactcatttataagggctccactctcataaactaatttcctcccagagactgcaccatctaataccatcacattgggggttaggatgtcaacatatgaattatggtgagacacaaacattcagtccattgcagatataaacagggaatcatcagatacgctataatgctatctctttgattccaaatatcatagataaatctcttagttgccctacaacccaccgtttaacagaatagttattgttatagatgaatctggttagttttcctccctaaacaagctgatagaggcatggtttctggggaggctgagttgacttgaagccctttcatgatagaactttaagcagtcatttttgattgtttttatgaaagcctatcatgattattttgttgttcaaatgatattaaaatattgacaagactatcaatttagaaccaaggtgggcacatgtaccttgacaaagatgctatatatcttgacaaaggctacatcatcttatctaagacaggaacactaactacctttatacatgcaacatagctaagcaattgtttctctgatacaaatagggattcacatagtcaaattactctatgctctatgaagtctgattgaaacatacattacaacttctttgtgagcaaacacattctcatcaaaaggaaagctatgacctcatgatggtttcctgctgtactgtaagataggctgctgcagccattattgaatatgtttttagggattattcatatctttacttttagaaaaagaatattctgtatttctaaatttatatagtaaaagtatttgttttactgttgctacttaatttctgtattttattataatgtccttagtaggtaggtgtcatgtcttactcatcagcatttcactggcagtagagtaggatttgcacataagtagcttacctagggggctcataataatataccaaataatattttctgaatatatgaatgaacttgtttacatatctatctgtggtatagcttcccaagaataattttagttagctcactacagaactaataccattacactccattaatatcttaccacccctcataaatatgggaaacttatactacttgcaattgccactttcttaattctacaaagaaattaacttttgctcttctacatccactatggaagactcaccatgcttttctgatgcctttatgtggctgattagatggacatctgaagtagtgagacggacatgagaccaccaccattgccaccacatctaagctgctatacacacacacaaacacacacacacacacaaacacacacacacacacacacacagacacacgaggatgctttcctagggaatgtgagcattttaacaatgtctttctggaattaatgcacctgtctttgttgtttaacccagtgagataaattattagtaaaatgtcctgaactactattactagagtttctgataatatccttgcatggattttcattgcagaccacattcaattttggaatttttttttcctggagtaaatagcattcatgctgataattcagatttgacctgctgctaaatctttctcagagaatctcactatcaattaagggagcttttgaatttttgtgttattgaagataccatgcaagttaattcattacacaaatgttttttgagcccctgttatagtccagatatcttttatgtgtcactgaacaaaatgtaaaaggactctggcccccttggatctttaattttgttaattttcttattcatcttattcatttatgttactgttttgctgtctgttaacccttttactttagtccactgcagatgtaataagaacaatgaaatcttaatgatttttactacttattctctttagtatcttttaagttcctttgtgaatgcaatgtagttgaattaattgaattaattatttttgatatgtatatatactatataataaatgaatgtgtctatgttatttattggataagacttttataactttatataacataaagaatgttttacagatttttcagacatataataatatcactttgtgaggtaaatgtatcagggtttatgaaaactatgaaatcattcaagtttttatctgctgcctttaaattcagattctataagtgtttcattcaggaaagcagacatcatttttattgagtgaatatagttcattttctcaacaagtttattttattaaattgcagaatcctatgctaatacagtgttaagattgcaaattttaaccttcataactcaagaaagtgaaaagttaaggttttcataacagcattaattttcctacatttcttatgccttataataaagtgtacatttagcacactaaccagcaatccaggaattatatataatcaatgttggacaagttaatgttactaagaggatcttaactttcatatcctatgatttgtttttaaatttacagctttaacagtgcactaatggaaatacattgcatttaattttctgatttttataaagcagacaagagcacataataaagatggaaaagttgatatgtattatttcagtacaatgactattttcagtagtgaatttaaagataaccctgtgaatttttaatcagtgcatttgatttcagaatattttgcttatagcacatctatgttatttctaacacagctccttagtcaatttcaacctaaggacagatttctgttcccatgatagcctataactgaacaattgttaacatccacagcaagtgaaatcaattgccaacttctaagttgtgtttccagtcatacttctattttgacaaccaggtccactggatatatttaaacatgaaattacttataaactgaaacacaaaaataagtctaaagaaaaatctatcttaaactgacatctctattgaatgtttgttataaaaagttttaagtgtagttattgaaatataaatgccttttaattttttacagagaattacttaatcaagtgggtttttttggttaaaaccttatagaattattatctacattaaatatgtagattattttattaccatagaagaatcacaaagttgtagaaagcttattatatattttgtattgtgcattatatattaaacttcattttatattgcaaattatattttatattttatactgtatgacaataccatcatattatatatttatatgtgtgtatatatatatatatatatatatccagtatattatttcaggttatatattatgtatcatacaatttttaaaaaattaatcattagtttaaatgggatcatctcaaaaaaatcgaagagcatacacacacacacacacacacacacacacacacacacacacacacacactctctctctctctctctctctcacattgcaaggttataatcattacaggctcttactaagtccccagcagtgttgacaacaaacacaatgtgcaccaggaagaagcatgcagtaaaattgacagtgtgatttaatgttgttatttattggctcttgttcaggggtcagatatgcaggttcagagttggggacttcatataatttattttcaacgtttatataaatgtagacctggtaggcagttgccttcattgtgtgatttgacatgttcaaaaaatgtccatgctgaaaaatatatctcctccagtctgtcatggaccctgccatctcctggcactatatactatattctctgctattttcttttcttttctttttcttttttttcttttctttctttctttttttttctttttgagacagtgtctcattctgtcaccaggctggagtgcagtggcacgatctcagctcactgcaaacctctgcctcccgggttcaagcaattctcctgcctcagcctcccaagtagctgggactgcgggcatgcaccaccacaccaagctaatttttgtattttcagtagagacagggtttcaccatgttggccaggatggtctcaatctcttgacctcgtgctcctcagcctcccaagtagctgggactataggcgtgcaccaacacacccacctaatttttatatttttagtggaactggggtttcaccatgttggccaggatggtctcgatctcttgacctcatgatcaacccacctcagcctcccaaagtgctgggattacaggcatgagccaccaggctgggccctctcttctgttttctgtaacagtggtcattaaccctgtctatatcaaagatttcttttaaaatccgaaggaagcaatagttttcccaaatacatacatatatatttttcccaaatacatacatatgtatgtatatacatacatatatatgaatacatacatatatatgaatacatgcacatatacacacatacatatatacaaatatatatacacacatacatacacacacacacacacacacacacacacacacacacacaacattcatgaaacattgcatatattttcatgaattttatagagcatccctatccttcataaagcctacttatgggaaggttaagacttttactgttatacgagtccttagaagaaatgtgttttaaaaagtgagcttagaattttgccaacctagggacaatatgttagcagggtaatcttgttatacaatttagcttacatgtgttaaaatattacaatgtattttaaactggtaattaggtaggatttttaaaaattgagaaatatgactgaaaaatgcaaacagtaataaaactaagtcagtctacatttgtagataatttagagaaaaattctcattagttactgataatcattattaaacatcacctatatttcagatattgaaataagtgaatataagttaaagttaagaagatcatattctaggagtgagaaagacatgtcagataacatttacaatagaaatggcagaaaattttcaggagcgaattgacaaaataataatcagtaatatttattaattgtgtgctagatttcaggcttgtattaaccctatacaaattcatttagataatactgtatatgaatttctgattctatttttgtaacaatgtgagataaatacttttactttttttttttttttttttttttttaggcaaactataacacacagcctgagtaatttgctaaggttactcatctgggaaggggtgaaagtgggaattgagaccctggctgtgtgaaacagagccttcgtctctgaatattgcgccatttagatttgcttcttcaaaacctacctacagtaggacaatggagactgaatgggaggaggagactaaggaaggaaatgagttatagggaagtttgtttatgccgcaggcttttagtaactcaatctttgtgttaggcagaaatgaaaatatgtaagagattgtactgagtgactaattagatgcaagggattatagagaaaggaaaaagcaatagtgactcctaggttctttacttaaatgacatggaaaataatggtgtctgagataggaaatgaaagaagagcttggggaaaagaaggaaatgtgaccaagaatcggttaagattcttgaaataagactatctatagggcgtctagtagaccatcaaacatatgggtctatagctcaagaaagggcacaggaatgctcaaactgtgggccatagacctatgggggtctctgagatacttttaaaggatccataatgttaaactatttaaataatattctaatacattgtttgcctttttcattctattgatatttgtagtgatgctacaaagcaatagtgggtaaaggtgccttagacaattgaaagcagtggtacaaaactgttctattcttcatctccacatattcattgtttaaaaattacaaactagtttcacttaagaatgtggatgcagcaaaagttattaattttataaaatctcaacctttgagattttagtatcttaatattttgtgtgacaaaatgggaaatatacgtagagtacttctgcttcatatgaaagtacacttattgtctcaagagtaaaacacttgtgcccttgttcagttgacaaactgaaccagccatttttttaatgcaataccatattttcttggaagaacaactgacatgtcaactatggttattcagatgtgggcatttggcagacattttatgaaaaatgaaattagcctgtcacagccactactacaggttttgcaactttccaatattcaaggacttttttgataatattggtggtgatgttgaagatgtgttttctatataggcgttatataatgaaacttgtcaacatttcaaaaattagtatgactgggaggaccaatattttacacatgtccaatataggatgttacaaaactgtgcatggtaaaacagatattcaaagtgcaagctacaggagtggtttaaaatgtaacagtatggaaagcccattgctatggtttcagaatccatgttgtaactgcacttttggcaactgacactagtcaaaatttggtatgctgtcaaagaagactatccacagttatctgagaaagctatgaaagccatacatggtggcatgggcctgtggtcttaactacttgagggggaggtgaggtgggaggatcacttgaggccagaagttcaaggatgcagtgagctatgatggcgccactgcggcacttcagctcccacctgggtaacagagggagacgctgcctccaaaagaaaacagaaagaaaagaaaagaaaagcaaagaaaagaagaaacatttttgctttagtaactttaattaaaaattatcaaaagaaaacccataacattgtatatatgagatacattatataaactatactattcttcagctttgataagtatctaggtgtatgttcaaatgagtaacattaaaacacttttaggggaaagaatgaagaaatccagtcaatatgctagtaaatttaatcattcttcttgaattatatctgtccagactatgaagaaatgaccctcctctcctgcacttgctttttcattgaagctctctaacatacatatagagctattccttgatttacaatggggctacctctccataaccccattttaagttgaaaatattgttaagtcaaaaatacctctactacacctaatctactggcattgtaattacccagccagtgttaaatgtgccagaacactttcagtagagtattcaataattaaatgaggccaggtacagtggctcatgccataatcccagtgctttgagaggcagatgtgggtggatcacctgaagtcaggacttcaagactagcctggccaatacggtgaaaccccatctctactaaaaatacaaaaattagctgggcgtgctggtgtgtgcctgtagtctcagccactctggagactgaggcaggagaatcacttgaacctgggaggtgggggggtgcaatgagctgggatcatgccactgcacttcagcctgagtgacagagtgagactctgtctcagaaaaaaagaaaattacatgagatattcagcactttattataagacaggctttgtgttagatgatttggcccagcatcatgagagagtattttactacatactactagcctgggaaaagatcaaaattcagaatttgaagtacgctttcccctgaatatctgaatatatattgatttgcatcatcataaagcagaaaaagcataagtcaaaccatcataactaggggactgtctgtatcttctgtgaggaaattcatgcaacagaaaccatgtcgtcatcgaaatttgttgttatttagtatttctgagtaacttccacttgatataacttctaaatcttccatgtaaattctttgtaaattataatgcctctatctcctgagtaaatttacataattaatttatacctaaatagagaacatcgaatccatctttgttttctctaatcttgtatagtaaggagcatttaaagtgttatagtttagaggcaagagctcctggaatatcaaataacacatttagatgagaaaaagttattagaaaggacaaaccagtctcgatgggagtatgaattgtgtgattcctatgtgttaaccttgaattgagggagggcacctaattttttatgccaaccccatatgactaatgctctaatggaaaactactgagatgtaatatactccctgagcataaggaatgctatccctggtgattatataattacaacattttttacaaagtcatgaaataatgtgtgctcccctaggtatgcctttaacatcatgtaaactatagttacactgctgagagtgtagctactataaggataatagcaaatgttaggttctttataaacataaaatctggagacattgtaacaggaatgctaaatcataaataaatactttgaatgatcatatgtccggcagtagtatatcatgttaggtgagaaatgatgtgatcataaaattgaaatcctgtaaccatgatttaattgaaacgtgattaatcagggtaaaggggcccagtctggcccactgttggggtataatcacatgtagaatttggggaagccataatattagataagtcaagaaataacatagtaaaatgggagcatgaaaacaaccacaatttccatttcctcatcatttcttgctattggcaacttcttggatttttttatccaggatgaactaaggatctatttcacagaaattcttagtagcactctcattctctctatatcgttattatttttcttttaccatactctccagactaatcgcaagctccatgtgaatccagtctttctctctcttgtcttattatttccaggctggttagcgttactggggttgcgggagtgacaagctatgtgaccatgtgcataggtattattaaaaagttagacttccaggctgagctgtgcttttcagtactgctttgcaatccttttgttttcccatagtaagctctttattttcccatcctccatatttcatgagctccttcagatctcttgtaatacattcaccctttttcaggttaattttttttcactaatttattctttttctaagtgaatactcaaaatcatcaaaataactaacatttattaagcaagtgccaccagaaattaaaatcagtgcttaagcctctttcacctctaataatattgaaaagtaaatgttattatccaaatttttaaatgatgaaactgaagaccaatatatacagttactaattgaaggagccaggattcaaattcaggattttatgactcccaagtcaaaattattttcattacaatgtgcttttcctgttttatactggtattttaagtgatttttaccctcctatcccatcagtagtttaaatcttcctaaagaatactttcgtctataagaatttgaatttatttgtttatttatgtatacctacatgcaataatcttatgttattgcaataaataaactattcctagcattgtaagagatttttagaaattaggtaattttgattcatgcactccagaggatcagagtcaaagaaggaagaaaagatcattatttactaaatacaggcagtatattattttgccaggcctgccataacaaaccagatgacttaaacaaaaaaaaaaaattatttctcacagttctggaggctggaagtccaagatcaaagcaccagctggtttggtttctcctgaggcctctctgctttcagacagtcctaagtatactgatggtgcctctgtctcctcttataaggatatgagttctgttggattatggacccacctttataacttcatttgactttaattatctctttaaaggacctatctctcaatacagccacatcgggggttgcagcttcatcatatgaagtttggagggacacagttcagtctgtaattgacagcaagtataatcattgtcttcagtgagttttgaaggtattatgggtgttcagaaaattggagtatggtggaggtgaggtgattctgataacatgctggaacaaaaggagatataaactagaatttgatggatgggtatggtgtgaaaaaactgacacagagacagaatattctgatagaaattaactacaagagcaaaaatacttattaggaattagcaaggtgtgtataacaggtgaataagatgtgtcagtacagatggtgatgaccttgaaaaatcctctcgaagttgtcattaggatgctccttgtggttagaattatttttctctctccttttttactcataggtaagtctaacagagatttaggggttttgtttttattttcaatgcataaatctgcattggattgatgtgaaactaaaatgatctgttggtggtacatgggataagcagtcatcattgtctcttgcactgaattcaaacttttcagattttggtgctttaatgacttcaatttaaggtttcctttttttttgtctaatcagttttctttctttctcctgacatgaatcttgtgtttttaatcagcttaatatcagcaatattgctgatactgctaatgtacagaaaatacctaagtctaccctgatgcacttgctcatcaatttctcttgcccgaaaatctctacctaatttccctttgtgaatgcagttgttttgttaaggctaccttcaaacccaactactgcagaagtcagccttgcctaaggtttgtaaccagtgaatttcgaactatgtgcaggctgtactcttctgtaaagtatttgataatatgctatcttgtacaaatctctggatatttcatacaagtaagttatgttttcacaactatatgcaaatattttctttttttactacctacattgcttagcattgcattgtgcacaaaatgcatacattgtaaacttaatattgactctaacagcagaagctgttctgtggcataggtcagatactttaaaatagagagaaagagaaacccttacaggccacaggtggcattcgttgatctttatagtgtgacccttcctattgtgctttattttggattgatattaatggtattttacaaactggaataagtcaggttagcatgttcagtgcttcatataaggaaaaagattgagctctgtatgaagcctaccttttaaatggccatttttggaaagattttgtgctctgtgcacaatttttttcttcattctcttgccaaagaaggcacccttcctctcttcataacaaaacttattctgtatatgtaataaagataatacatgtgaggaaggaaattgttataaatttgcctctctgatggcctttgaccttttcattatagcatgacttggaccaccaccgatatgggttgcaaaatgggtgacatctccaaacatttaagataagactttataatatggtaagatcttatgtgtccttgcaatgtttaatacatgtacaatttgaaaaaatctcatgttacatctattttgtataaatggtaatgtaaatgtagttcctcgttattcccttatcttttccgaaagaggaattaccaactataaattaagaaggtagactgtaagaacttcttttgataataaaaaatacttaatatgggaaaagtttctgcatcaaaaagcttttgagcaggggatctgatatagttgggctctgtgtccccacccaaatttcattttgaattgtaatccccataatccccatgtcgaaggagggaccagaagggaggtgattggatcatgggggtggttccctgatgctgttctcgtgatagtgagtgagttctcatgagatctgagggttttataaggcagttttccctgctcttgctcactctctctcatctgccaccatgtaagccgtgcctgcttcctcttctgccatgattgtaagtttcctgaggactgctcagcaataaaactgtgagtcaattaaacctcttttctttataaattactcaatctcagttttgtctttataggagtgtgagaatggactaatacaagatctaagtgtgaaaattatttaatatagctttttcttttggaggcagtataactctccatgcaaaattctggttaggctgctaagaataatgctgattattactatcatcagctcattttcactaaaaattaattcaatacatataatttactgaactttattatcaccgagtgctcttataggttttgcagggaaagggcacaaaggtacatgtcttgatatcaaggagccttaaaaggttatcctttggttttataacttttctgaccaaaaatttccagtgatatcctaatattgatttggtttatcaaagcctatctttgatctctatctgccctttcttcatcttgttgcatatgccatgctcttatcacatcatattttgcctcaatgtttgatctggaggctttggaaagactatccattttaaaaactgccaaatttaacaggatatacttaaagtctgtaaaaagattaagcctttgtgccagtactctgtggctctgtaatacttactttgaaagtagactgagtagtctaaataaatttttaattaagcatctgatttagataatttgggacagagcaaagttgtattttgggtatttttcttccctgtcattgacacttttaaacatattttcactaaaaatatgtgatttggctcttcttaatcttgacgccagtgttacatacttttcaatttaaacacaccaaaactaaaactttagatataagaaaacaatggatggaaatgcatagcttccaaaaatggaaatagacttttacttatttacttcatcagagacttgatatcatttttgtttttctttttctactttgtgctatttatgagcataatctgtaagcaacaggttacattcttttaaaatacttttgcaggcaatatagtatatatttgtttaaatgaaattcatttcagctcaaatactcatcttttctctgtacacacacatatgataagactttcagtactggtccttgtggcttgtcaatgtagctctatacaagggtggtgatttttacaaaatccccaaagtagtacctctgttttgactgtcacagaagcctttagtttggcaggaaacagattaccatgtaagccaagtgtgaaatgcctaaccttaaccttgaaaaaaaggggctgcttagtaagttctctttagcttgttctaacctaaaaattctcctttctagttctgaagcaaaaaagatctgtttcccactcatttttataagcagagctcagtccttaggaagaatttcttgtttcattcttggaaatgggacaagttctctctcgctctctctctctcttttttttttttcctaatgagataaagcttagaaataaaacataagtcaatttctcagtagattatctgcctacattaaattttcaataaatcaccttcctgtgcttagaagggcaatttgtaaaagccatttatttgaggatggagagttgggatttgaagcattcagggcaggtgagaagaatgagcaacagcatcatatggtgagtgagttgcatgttaagcatgttgtgagaaaaggagaaggccatgatagaactttgaaaagcagaaaggcgaaggcagagtgtttaaatgtacagcttcaaaaattttacatattgatttgctattaaatataatcaccattaatccctatttgactcattaatgtaatgagagaacgtggttgaaagtaggttccaaagtaagttctaattctatttaaagtttattgtaaagctaaatatttaattaccataaagaagtccaggctatttctgtactgtcagaactgaatagaaggatttacagctccccatgaatctggtgccttttctgtggatccaataaacatcaatggttttgggagaattttctgaagaagatacagaaagaaagctaaaaaattataaccaaatccataatctttcattttctatagctaggaagttataattaaagctatttcaccttacctacctgggcgagattgcatctctcatttgattgcaagcctttccatatgaaattacagctaagtctgtagtagaagaaagagctgctgcaaaatcttaaagaatgtttttctaaatttttattgtccgttaccctctccataaataatttttggaactcttgtaatgtcatcatttttatatagcccaactctactcatgtaaatggcttttgaagtaaaaagtttctctggtttaaatctgagactatcttactggtgtaaataatctatctgcttgacattttataagccgtcgtattcatcttgagtttaactgaaggtctccaaagacatctaattaggaaaggaaggaaaagacaaagttttgttttcaaggccaggacagtggtgaccctatgctaaaagtctggcatttaattgtatttccaagtaaaaatatgtaaatagaatgtgaatgttgcagtgtatgaattatagcaaaagcaggaaatcagctgagaggcagcatgctctaacagcttacaggagctctgggttctagctcgagctctgtaataactagatgactgaccttttgaaagtcatttatccttgggcttcagctttctcaagtataaaataagaggttgctgtagattctgcctaagattcttaaaagtctgtaattctgtgacataggctatactttatggcttccttctagcatccgttcaacaatgaaatatattttatctttggcaatttttcaatatattttctgtttttccgttgaccacctctataggttggatgcagggtgaacagaaccaggaaggtccaagcagagtattttccctaggaaagtattaattgggaggtaggagtatagctggagaaaggggaaggagagaagagagtgataatgtcttttagagtgactcttgtataaacccttggaagtcaggcagggtgtcgtggctcacatctgtaatttcagctttgggaggtcgacatgggaggatcacttgagctcaggagtttaagactagcctgggaaacactgtgagaccttgtctctacaaaaatatgttagccaggtatggtggtgcatgcctgtagtcatagctactcgggtggctgaggaaagagggtgacttgagcctgcaatgtagaagttgtaatgagcttttattgtgtcactgcactttggcccttgagcctggatgacagagcaagatcccatctatatatatatatctccttggatgtctaagaatctctcaaaccacatatgcccaaaactaaatttctgatattcctcataaaatctcctctaaccacattttagcaatattagggaatagaaaccctatccttccaatttccaggagaaacaccttgcagttatccttgattccaagctctttctctgatacctcatgtaatctatggcattatgtttcaaatgatgtatccagagagcaaccacttctccttgcttccacactggtcagctattttgatctctcatctgctattacactagttgcctaacttgtgtctctgctcaacccttgctcctcttgaactgccaaagtgattctgtcatacctaattttgatcatgtatgttacctctctaaggaccttgtgatagcttccagttttacagagaataaaagtcaaactctttacagtagtcaacattagccctccctgatcttctcctacccttacactcttatctgacatcaccttatctttctgttcctctgatagatctcctccagctgtttctgttgctcactctgcccttctcactggcattcttattgcttttcttattcctggaacacaggagaggcctctgcactcagatgcctttgcctagaacacttttgcccagatactcacttggcttaatctcatcctttaagtgtctggtttgccactctgtttaatcctccacctttgtctgttttgtttactgatgcatcccaagcacctaaaacagtgcctggcacataagagatactcagtaaatatttgttgaatgtattgttcttagattttatatttctaccactttgagttgacttactttcacaatttctaatctcatcttcatgtatctggtttatgaatttaacactgacatcaattttgtactttgttttagggccaagttctctggggggaaccccaccatttccctctgtgtcatcaaccatactatcctaagtgctctccagaaagaaggctggtttagtaaatggaagtatttttggtactattaactccagagaaaagcagtgggaaggatactaggtcaattttcaaagcaaaaccattcacagactaggaggcataatttatggacataataagctgggacaatgacaggaggattattgaagataaaatatccagtggtacttggtaaaacacaatagggaatactttatttaggattaatgcaataggtatagggaatgcaaggttttgcaatgggggagagaaattggactcagctcccaatacagcatgggcaactgggaatttataggaaaagagcggggtagaggtcattggacagacattatctaagaggaaacatcaagggtaaggaggattctggctaaactgaccccacggtatttttgctgaagacaggccagcatgatcaaacatcacctggggagtggtagaggatgaggaacctaatcagacatcaaagatgatcagatattgaggatgggggtttcttgcccgtcagacttagcagggttatttgctaaaactgtatttgacaaagaattgcacagatgggcctaggagaaaattcagaagcctaactaaagtttggcccagcaaacgattttgtaaggagcaaaaagattataagaaacaaaatagaaaagttatccattgtaaaaagaaaaatgttaaaatacaaaattgatattgtagacaggtataaacatgcatttaaagacattaataacaagatggtgagtatgtgagaaagccaaggtaaagttcatagttgttatttatttcttcgtattttgctttgagatgaaattaaggaagggaaaatggagggtgggagggagcaaagagaggaaggaaggaagggaggaaagaaggaaggaagggagggagggagggagggaggcagggagggagggacgggcgagctaattcagggatactaattgatgaagcctgcttttgagatgtctcctgagccgaagtgtcatttgtaggtatggacagcaagaatgcaaggttaggcagaaagttaagaccaaggatcatgtcagacagtagcaatctagcaggttttttactgggtcaggacctgaggaactaagaaggctgtaaggccatgtatacataggtcagtgtatcagcaagagctccgttttctcttttcagtccctattcagggaggacagaagaggcagaaatgtatttatgtttattacagccaatggtttagtcaatgccctgaacaagcctgcgtgcccctgattaaggtaagggcagaggtgctggacctatggggaatgaatgcagaaataagaaaatattgagatgtcaatcgtacaattactaaatactttttgacgtgcatggttaaggttataggaaagaaggaaactgaaagatgcacctacaggaaaagataaatgagattttcgagcaaaatgtacatgttctaaatagaagctctatggatagtgttaatgtaaagttctataagtaagtgaaatggatgttcaggtaagtaattaaaacaacataaatataactgaaaaatgttgaaactgtacaatttacataagaataaaatgagatatttaatagacatttaaaaatattattacaaactttagttaaaatgttcagattgagaaaaaactttgagggggtggataactgtgccctttatcagcaattttagacaattgttaattatagtagagatgattccagttagtaaacagcattgtggtgaatcacagagtcccatgaaaagtaagctttatcttgatagaagagagtcattgagttatgataactaaatacaagcagggtagtgtgtataggaaacattaagctaagagttaaagaaattttggctgggcacagtggcttacacctgtaacaccagcactttgggagtccaaggcagacatatcacttgaggtgaggagttcgagaccagcttggccaacatggtgaaaccctgtctctattgaaaatacaaaaaatagctggacgtggtggcgcatgcctgtattctcagctgctacttgggaggctgaggtgggagaatttcttgaacctgggaggcggaggttgcagtgagctgagattgtgccactgcactccagcttgggtgacagagcaagactccattaaaaaaaaaaaaaaagggagggagggaggaaggaaggaaggaaggagagagggaggaaagaaaagaaaagaaaagaaaaaagaaaagagaagaaagaaacttttttctcccaagttctcagtggaatagattctctatatggtgctgctccccgcgttcctgctggaacccaacatgtgacagaacaatgctctgtggtcagaaaacaactgtcctaaaaagcagcacaccagtttcgttctaactttctcacagctacctgaacattgtctattcatttgttaaaagaacagattggaccaaattatttctaaaatccgaatctctgtcattactatgtgaccttgggtgtaataccaacttttgtgtcacttttcctcatctgttaaattgttaagtgggataatagttgttgaccttatctatccattcctttcttcctccctccctttctcccttctttacttcctagaatcaaattagataatatacatgagagcactttaaaacttaaaaatttggtgtgtaaccacaggcgtagttacagtatctaagggggtgtaggtttgccgctattgcatgcatattatgtgccaagcccattgctatgtctttatgatacattatccttcccagatttacataaggtggttgtcatacacctgctacagacaagaaacctggaatccatgggagtaaaggaacttgtttaaggacaaaagacaaatagaagaatttagggtttgaacccaggtctgcctaattattttctgtggttttaagagaagcagttatgaagcgaagcaaaatgatctatgtatgaggttgttttcctgttgtgttctgagaaaaagtaatgctgactcttctgtttcctttaaaaaaagacaaaaagggtctgactagctgcctctatggtttagaaccaggagataattttgagaacagtattccttttcccttattatatttgcattattacaatatctcatcactagaacctgaagttttaataaggctcgtaaagtaggtgttgaggagggagtgcctctatgggaaatttcagaaaatccatagttaaaaaaaaaaaagaaagataatttaaacaggccctcttccaaacaagaacttctatggttaacatcttttctttttctttttttttttaatgaaggagggatttattgcaaaattttagaaatgttattctcattactaaatagctatgggtttgcttctcagaagaaagccaggagattcagcttgtagtgtcaattagtttcagaaactagtgaccagttacttttataatcattttcaaaaggagcaagtagcagtgaggacacagctgataatagctaaatatttcgttttcattgtcctatcaaggtgactagggaaggactgcattcttcctgacaaatatctgctttacaggtttaagttcctttgggatctttgttgccagagtgtaaaaggcctgggatagttgttttatttgatactaattcagcccggcaagccgtaaccaggagtgtcacatctaaatgcctggacacactgctcatcttttctctgtgattggtctcagattatagtactgtgtcaaggttcattcgatccgaagcatttcagcatcagcttttacttctccctggcttcaatgaaagaaatttctgtgatgtaaagattgaggatttcttagccattaataattttatttatattactcttcagattcttctggcggatccagtgataatttttcttcttagtggtgaaactgctaattgctagttgaggataagatggagagtttttatttttaatgtaagtttcttgggttttaaggtatttcttgacagtttaagtatttttttgtatggaagcccaactactaccctgaaaaaataaaaaaaataaaaaataaaaaactaatccatgtatcctttgtataaattttaaaaatcgattaaattgcttcttagtaaacatgggaatgaccaatcatctttttcattctaaaagtgacttttctctaccaatggaaatctgattgtaagttaaaaaatatttgagagcatttttatttagaatacaatttgcaaatttagcctatactaagtgcgtaagctctccatacatttcatttaaatttgcaggagtattcctttttactaattctcctttatcattttcagtttggttgataatatgaagatgtttataggaaatttgactataagccaaatctcttggaaataattattgtcatccataaagaattaaaaggttgaaatgtgaagaagactgtaataaagacatataaggatttcatgtaggataaaggacagaattaaattaaatatggcagtgaggagaagttaaaccactgtgttttacttcaaacatttttacttaatcagatttcagttattcattgtccttcaagattaggttttctgtggataacctgcagctgctcatttgccaaactaagctggagctactgtttgttcacaccagagtttgttaatggttgttgtagtagagatggtatttggtgttgtttttgttatctttgatccttctttgataaatgtacatgagttagagtttgaaagttaacaattttggtgggttgagatttttttttttaaatagaaagttttgacaagcataaaagtttcaaattaatattttttaggatcatctcaaagtgtcaaaatgtgcaacaatcagctttgttgtcctaaaaaaagaaatctgcaaaccgtgtggttaattaggtacctcttatattttgcttcagtttattttcaactctaagttaaaaagatgtcccatcagtgactggttttataagaaaaaagatactattttaatcttcaaaaaacaacagcttgcgggggtcaatcttttaaagtacatgcttcactggttgcaattattaatcagtttccttcaggaaatatatgaaattaaatattaaagtacagatctaaacaaagccgcagtctcagggcttctgagggcatgatttccttattagcttgaaatagctgaccttcctcaatccagatgtagagtctgcatgaatatgaaatccctcattttatctgtgtacttcatcatttgggctttatttacattttggcactttatttcttttaataggcactgtttcttagatgttaactttccataatggcattgttaactgctaaccagttttgtttattaaaaagaagctttcacagtatgctcaagtttgttcattcactcagacaacaatatttatttaccacctgttatgtaccaggcagtacctagttacttggaatcaatgaacaaaagaagaacgctttcctcataaagcttgcatttttgtggcagatagaagataatcatgaacttatacatatatcacattacatactatgttaaacggtaagtactgtgacaaaaatgaaaaagcaaatgtagatgtgagtcataggggccagagtatatatggtggatggggaagagacttgcaatgaaaacaaaacaacacaaaaggatggtctgtttgccttcctatgaagatgacatgtggataaagatgtgaagaaggtgaggaacttggcagtggggattcctgaaagaagatcattccaggcagaggactgagctagagcaatggtcctaaagtaaaagcatttcctggagtgtttaaggacaaactgagcagggagaatagctccctggagtataaagtaagcagaggaggaatagcaagagaggaaatcagaaagggacaggggaggcgtggccagatgcagatcctggagggcacaattggctgatgttcttacactgagataaatgggaagctactgcaaagttttgggcataagtgatgtcttctgacttatttgcaatcaggacgcattttgaatgtagagtcaacagaattttctaatggattagtattgaattcagacagacacaaaagtacatgtgttacctacagaagccatggacaccttggcaaataacattcatagcaaataataatagtgatattaatggtaaataatgacatccatattattgccattgccagatactctctattttacatgagagagtaaacactcaaaacatcctgtaaaggattagttattattattctcattttacaaaagaagctgcaaagcacagaaaaatcagttccttgtccaagataacagcggaaaagggacagagttggatttaaatcttggtgttagagaatatgtgctcataatctgtactgttcatattttgaaacaaagattataccagagctccaaacagggaaaggtaacaaatacctcttatttagaatcaattttcttttgcttctttacaaggaaaaaaataacagagctggtaagtgttgacagtgctgaaggtgagtgattttattactccagataggttagcttatgctgtgggaacaaccagtctgtcaacagaggtttatttctccctagttgcagctctgcttcttactgccttcattttggacctcaggccactgaagcagtccttgtcttgggacatgtctctatcgtaattgatgggagagagaacatgccacaccgtacacttcctctttaatcttctatctgtagacagaatgtgcctctgcccacctttcattggccaaagcaagtcatgtgaccatccctgagttcagcagagccttgctatatacatgtcccacagacaggccccacagagagggaaatgaaataatttctgagtagattctgatctaccacaggggcactgccttatttttaatcatgcttacatactttgcagctgctaatctgctgacattttccaaaggtggcaagtactataaagaaaagataaaacacagttaatgtatttcttggactggaagaattcttagactatctaaaccagtgcctaggcagagaacccttgtgaggaaatttgattgataagtttcctgattgaggccatggagttgagtgggagggaggcttctgtggatttttctcaacaagttgattttaagattccataagaccctttcttcacattcactcaatgttcactcactgattcacccagagcaacttccggttctgcaggttccattcatggtagatattttatacaggtgtactttgtcttttatgctttatttttactgcattttttatatttagagacataaatacttactattctactacaactcctacagtattctgtagagtaacatgctatataggtttgtagcctaggagcaataggctataccatacagcctaggtgtctagtaggctacaaactctatgtttgtgtatgtacagtacactccaggaatgttcacacaatggcaaaattacataacaacacatttctcagaacgtatccctggtgttaagcaacatataaccgtgtataccaccttttctttatctcttcatgtgatgaggacacttaggttgattgcatatccttgccattttcaataatgctgccacaaacataggagtgcagatacctgttggacatactgattttattctttttggttatctacccagtagtgggattgctgattctttggtattgttttagatataaggtataagatctgtgacagaaattttcttgagatttaggataatttgatgatactcttataagtgtaatttactctctttcttcaagtactgttttgctagagattctccagtgtgcaaggcattcactcgaatttctctttaaactccattcctcgacactgctccacttctcttatagatctagaagtggtataaatcaagttgatctgaaaatgaaaaaaaaatgcagaattctctcataaacggtttcaaaatttaatattacagctgttagttcactgggcaatgagcaaagtttgcttttttaaaaatctgaattcattttatttactctgcaaataatttacttcaatacatttaaaaactcaagttttgttttgtttttgattttaaagacaaaaacattctcatagttttcagacctagaaaaacaaactttgtattgtattgtaatgattttcagttttttataaagaactacctgttttattaaattgtaggccctttatgtaacaaatctcctttcttttcctttatttgaaatgataactctagaactttcacacaaataatcaaaactgtgaatagaaattcgtctttttgtttaactatgaacttctttcttacctgataggtttctttttccaaagaggaacaggactgctaaatttagtactgtcaaatactccaggatcaaagctctctgctaagtccccagaatggaatagctgccaccagcctttcaactacaagtctttatgaatctggactttttggactgaagttagtctgtgaattgaatttcctttataaagttttacttcggatttgtgcccttagcttcatttcccctcagggatcctttaacttcacgagaatattctctggaaaatgatacctttcagtgacttgtgcctgagtcctctcagaatgttcctattcattgccaatgctccaagacttcctagtgtaattcattattaaattcaggatataacttatttaatttttatagggattatttatatcctggcatttcctcatcttgttgctttcctctgatctaaggctagatttttgaatatagtattgatttacttcatttttcttccataaataaggtagtagaatacaataatcttctctctttggtagctagagaacagagcctgcccctaggccctgctgctatttcttactggtataaactggcacaatacaatccagaatagccagtgtacattcatcatatcacattggaaagcaggaaactataagaagtgattcatatgcaaatctgaaaagctcttttcctactccttagaaatgacttagctttaaattgctcctcatttatgagaataataatgaacttaattgttcttctggaatatctgtgctgttgtaaggaggaaccttccatacttttaggacgcatccaagagctatctccacactgggaagaaagcgatcatcagtgtgaacacttaaatccttagatatctaatacctttataacttgaatgtatagacccatggatagacctgccagtagacatagacaaaattaaaatgttcatgttaatgaaacttgtttggctttttctttaaaaatttattttgtgtatggaggagagtattaaatttgagaaaatttgctgacagatttttcctactcactattgaagaattaagacagtaccattcaaattacacagctttgaagtttatctgtttccattatgaatttttaaaaaagatttgaaattacatgaaaattaaatatagatagtaattatatattctatcgcatttggggctatttaataaatccagaaatataagcaattaagatagttgatcctactgctagcttatttatattttaaaaagttgctttcataattaccatattttttgaaagtgcagattgaaagtaattcaaaaggtggcctacaattccctattccagtaggtttttatcttattttgtctatgttgaaaagaaacctatttttaacttggaattacattattatattttgattaaatgtaatttttggtacttattcacatgattttcatactatttttaactcttaaaaaattctaatgcttatgacaatttttacctcatagtagatattcaagtccgaaagttatggatttgtaaccactcagttaaaacttttgtattttaaagaaacattttacaattcttagtcggcttactttttttgtacaatctagtttggtgcctcccactcccccaacccccgaaaaagtggattcgaactagggttaattacgttttctgtgataattttaagatatttcttagttgaattacttcaagtacctccatataggtatctctctcagacttgctgtacatgggtttcatctttgaagttgccaaccaggtaagcgtcttaatatatactttgatcttaattaagagacttgctttaacgatttcccgttgattttcagataaaatttagactgtttaatgggcaattcaagtccttcttcatgtggctttgcctttcctttcagcctcatagcctgtagggcatattctaaattactaaagcacttttcttgtcacaaacacactttgtcctttgacatttctggatcattgcgtttcttctgcctgagtgtgcatctttcccttcacccacgctgctagattttagtaatcttttaaggtgtatatctgatatttttttctgatgagcttcaccaattgtcttgtatttaggccaaaccactggctcttttcagtgtttacactgtcgctggcccttcctggaaaaggagctagtcaaatctctgctttacagtcttctctccatgagaacttgggcttctttaacagagatgtctcttgcctcatgcccagctcttggaataatgccaggaacatattaggtacacaatacatggttttgtttttgctatttattgatttattttgttgttgtcatttgataaataatccacaaccagtaaattaaaatccctgaagtatcttaaactatggaatttatgatttgtgtagatattgcttgtttctagaagaacaaacatttttgcaggaataagtgaaatagctaccttttcccccacaaaatactattaaaaatatcagcgtattaaaaagttattcaccaagaacttccatccatgccacttctaatcaagatacacttggaaatttagactcctttcagtctcctctgtgtaaataccaggtggcataatgcttattacataccatacagaatctttttagatcaaagaatcattgttcagttctatttcttgtcagtttaaatgtaccataacagtggaaatatgcgttttcaatatgctgcatgagtttatatcaaggcttgataactgaactgtcagaaaccctaaattcatcagagagggcattatttttatatagataaaaagatatggttcttcattctattacacgaattgtcatcataatattacagttaaagctaatgaaccattctctggcatttgaaaagccagttaacatggtgttttcctgacgaagctcaagtttataaatgaattaaatctatttgcgtgggtgttgtaatgattatgatattactcctcgacgttataaaataactactttctgcccccaattaaggccagcatgacctacaaaaggaaacaagtcgtattcatttaatcaaaataagatatgtagggctttagtgggaaaataatcctataaggaaaattagttgtcatagcaaacattcttattgaaatctgagttgtatattgggcttaaaacagaatttgctgtcattcagtgctaaccaagcgtaggcagagccacacccttgataaagttctaggataagtaaattcatgttcaatatcctttgcttatctcccagtcaagaaactattaaagataatagtttaattattttaatagtttaataactttaactatctttaatagtttgaaactattaaagataatcaaaaataactcccagtgactttttatctgtattctatttcttttattttgatattccattgaattttagatgaattctggttgtcataagaagggctctgttggatggaggaaaggcatggttatactatgagctaagaacaattgtcaatccttgcaaacgtcttctgccaacttttaaagaactaattttggattttctttgaattaggtgaataaattatttaaaaacctcaaatatgttcacttactggtacttgctatctgcctattgttacagtttttaaaatatttttacttatatttttataaaataaaatataaatacataggcacaaaatagaaatattaaataatctataaagtgaaaataaatatatatgatatgtatttatatatcattataaaatataaaaatacatttgcattctattagtatctctagtcctaaacttaccctctttgaaatattgaactgaatggtgatatttagttttagccaaagctcattgatccatttgattcaattcaatagctaattctacttttcaagaatcatgaaaaactttaagctcaatccattttatctaactgaatgctaaactgacagcattaaaaaatcagctatcctgagtttttcaaatttatgtatgttaattgtgttctttaaagcattcacacaactcactaaatattttatatttgctcagctgttctgatattgtattggaagaatctatagcccaggttttttctctcacctagagagatgtatgtcttcagttcacacaatttcccttaatgtttcacctgaagttgaagttggaatgttttcaaattgcaatttgatgtttggtttagcattagatacagtgttgaagaaactgctgaaattgaaatctgaaaaaattgggttcaaattctgactcagctatgtatcagctgtgtgattttagatagatcacgtatcttgtataaaagttaattttgtccttctaaagctgaaagtaataatgctgacttaactccttctgaggattttttagaaggatcagagaaatataggatatagatttatttttgaatgcaagttatgatatagagctcaagtatttatcttagaatattatagttggttccttcatttactgtgtgaaaaatacatccagagaaggcaaactactagaagtgtagtgggctcaagttttgacaaccagaaagagtttgtggtgagattgttaaaaatgtgattccttcacttcttgaacagatttctaaaatattccatttaatcattgagtagtatgttgttagatgctttcctagataggacagaatttttaagtttactgattttgtaaataattgtcatttctcatttccctcaccccaagaaaaaaaaaagagtatatagtgttaaggtaacagtttaaggagtcagacagacaaaaattcatattcaagcctgacatttagattcttgaactctcagcttatttttatttgtaagaatgggagtcagtgtattattttatattatcattttaaatggcaaatattctgggaacttgctgaattgtttcgtatttccataggttggcacatgctctcccttcctggaatgctctttcccagtctatccacccagaaagcctctgtgtgtcccttcagcttaatctcagaagctacattgtcctcagcaatgccttctgtgacgcatcagccagcttatatgtccctttttgtatgctcatgttgcatatgtaatgtgacccccactaaagcaattaaattattggttcataactttttatttgattgttcttgtccaattagactgtatacttttagaggagagagaatgatgcatagaaggtagtatatgaataatgaatgaatgaacacaggaaacacttaagcctagaacatttaaggcaaacaaatgttactctcttttctgtatgtatatacgtgtgtatttgtgtgtgtgtgtaatcttaaatattaaaatttatattttaaaagtaattctatatgcaatggtttaaaattcatcttctgattgtcacatgccatgattaatattttgagggctgaaaagatgacttatactagcggcagaatcatgaaaaaccaagtatgatattgctttcttttaggaagtgcagattttgataagaacatttgaaatgtaaattttacaccaggaatcacaaagtttatagattttccatgattaaactcacccaaactcaggtggaagttttttttccatgaaatatttggtgggagttaggaataagctgcagaatttctttagtggccgctgtattttccccagtgacacctactgtatcggattttaagtgaattagtaactaaatacagtgaaaagccttttgttaagtgcataagatatttgagataatcggtattattactacaacaaaactacgtgtaaagcaggttcacaaaaatgtgactctttactggattgccttgtcatataaatctttagggatgatttcggctttcaacataactttaaaattcattaagtaataattcaaaaatgccaacatctcaaaaatctggcaagaataatttactttcttattaggactcttaccttttgaaaaaatatagaatctcatatactggaactattctaaggcctgagagggtgataaaatcttagttgtaatattacattctaagtggcaaatggctcatgtcttctactttaatctatgctggaaatttatatgcatgtttcagagaagaactcatttgtaactgaaaatacaataaaactgaaataagtggccagaaaattttaatagttatttaaaggcagacagatctctactcatgcaaaatttttatatatgaaatgcttaatataagttttcttcaaagttaactctttcttatgaatggaataaaatgattctaacatacatcatagcccaggaaagtaaaacagtgtattttctatgtaccatggaatttccaaacttgatattatagttaaggtgagtttgaaaatcccactgataatattttggttattggcataccagcatagaagaagtctttcatccatatgtaataacatatgtcagggaaatagtaatgattaatgaatacttcttgccagtatttggttgagggaatcgtggtacagataaattagatagtgtgtcctgtttaaggtcacaactggccttcattttaaattccataaccctagcttctttattagctgactatagttatttgaaaaacatattaaatatagtttatttcaataaaataaaatatactcaaacatctctgggtgactgacagagaaacttcaaatttgcctttctttaagtcattcttaaaacgtgtcatcctcaacttatttatgtctgtggcccattactctttttaagagatttgattcttattcctccttgttgagtataatgcaactagagtttacaaagatcttgagttagactacataatgttctgcctaatgtgactggggcaaatatgtctgatgtctgggcaggggcagggaaacacttctgccctgtttttcagcctctctctgcctgctgtggccaactgaaagactcctgtctagatagtggaaccacaaagtcaaggcacctcagattactgagacacactatttaaaatagctgccctggagttttgcagatacagaatttactttatgtcaatgaaagatagatatgttattaatactaattatgatactcctatgatatgacactaggctttggagtttgtttgttactacagtataacctacgctatcctgacctgtacatattttcatatgatatatcaaataaattgcaatcaataaatatatccaatacacgaaaatatgaatttataaggaaataaagttatagcaagtatcgtaaatctagttcaatattagataactttcagaaacagctactgcacaaagaagagaacactgatacccatacatattttatgtaggaatattataaaaccttgccagaattactttactaacataatcattaataatactagaaatagaaccaaggtggactgcatttatgtgactctctatgtgctgtagaatgtcattgtctttgtccatttatttatgcctttcctgtttccatttataaagcactgtatttgttctgaagcaagtagggtcctaggtcagagagtgtgtaggtgatgaactggaacctgacaactggggacctgaagtggcttctgatacagcacaaattccaaagtagtataactttgggaagtaagaaaaataaaagacaatacaaaacaattgaaagagtcacataatagctttttaaacctaactcatcattagatagataatatttaataaacctaatttctttttgtgtgtggctttgcttttttgtatatagtttagcattttattgctacacatttactaatgttatgacattacatatttttctgagaaaaatatccagttgttatatagatgttcatcacttcagagaaaaatcattgaccatatcgtaaaaaaaagataggtgtaagttgtttcccaaaacccaaactgagcctgcattctaccctatatacataatcaggaatgcagaatttaagtgttcatatttatgtgttattaaaaattgttttagatgcatttacctcaagagcattggtaactttttaacaatagtgaattggttgaataaattattttaaattcacaaaatggttttagttttcaaaaccagcaaagatttaaagaaatttttttacaggctggggttggtggctcacacctgtaatctcagcactttgggaggctgaggtgggaggattacctgaggacaggagttcaagctcagcctcgccaatatagtaaaaccccatctctactaaaaatacaaaatagctgtaatcccagctatttgggaggctgaggcaggagaatcgcttgaacccaggaggtggaggttgcagtgagctgatatcacgccactgtactccagcctggatgatggagtgagactgtgtctcaaaaaaattaaataaacaaataaagatatttcttacaacagatttaaagttttgaaaaattctcagcatgcattgctaaagaaagaggtaacaaaatattacacataatacaattcttattttccaaaaggtaattatattctgtaagtattttttgcccaagggaagcaacttcaagttttattggtaataatatgatagacaataaaaataagacatggtaaatttatttctggctacattctgccaaatgctttattttctttttaatttgatataatgtgaggaacaaaagaaagcctttttggcattacatggacaaataaaaataaattaatggggtagagtaatacatagaactgtcatttgtaatttcagttatacctggggaagattcgattatcctcagagagaagtaagatctccgaaaagttagtcaaaattagaggttaaaatgataaagaaacaaagcatgccaaaattttgagcaaatgggttctgtgatacataactataaggtttggtttgattgaatatttctagtaaaaagtctttttaagtatgtaaaaacaatttttatttaaatgacttttcccactcaattttaagaaatgaaaaggagaaaacaagtaatttcttatgaggtttaacagtaaactattcaaaaaatgataaaattcaaaagtcaaatccgtcatttttgtatttagagagataagagcatagttggtagtttcgtgtggtttatttactttatagttctatccagaatccaatcacatttgttatgctgaacacatttttattttttcttgaggagtttgaaaaacatatagcttatttggaagcatattccaaccaggagaaagtgttgttttcctttctttttaaattcaaggacataaggacaagtttttagaatctattagtaagaggatccaatactcttcaactctccccacttaatcttctcattgtctaaagtttgaatatgaagccatgatcctaattattcagatactgaataggacacgtaagagcacaaggatgaaaattttatagggcatagatgtctatgttctgaacaagaatatggtaaattacgctaagctgctagaagagtacaagcatagaaaaacattctattcattatagaataattctaatacatttttgtaataaatgaactaatagtttctgtcattattagaattcaaatataaatgtaatcatggtgatttttgaaaaatcttactggcacatgttgataaaattttactttagagcagaacaggatgtctgctgtattactcttgttaatttcttacctttttgtaatgctaaattaatgatcaacattaacaaaatgtttataaacaacttaagtatcttttcttgagtatattttcctactctaacaaaagctaaggtttaatttaaaaatatcttccactaagtaacagtcacaatagaattttactatactattgtgaatactttgggggtacttgctcaaaataaatcccttggagcaactccaaggattactctttgattatgttttagatcacctttctttgttcttaagagtatattttggttttgatatgtattatgttactcacaatctttctacttctgttcagagttcgaaaatcagcagtcaatatttttcagtggagatgtttactagagtccaatgtcaagatcaaacgttctcataatcttaaatgacattacctttcctgtcactagttagctacacctaagtttgcagttctcaccaatgactcacatgattttaaggcaaatttctcatgaagaagatgatttaaaagtgaatccaaaagtttagatgatacaaattgttctgaaattaattctgagtgatatcctaccactcctcattcaataatcccctttggatgcagaatgcattatttaagttactacctttcctctttctttttgctctttttcattggccagattttctgtctgtcttatccacttctgtatcagccaatggcatctaggctgcaaaggttgcctttctacccgcatttactctaaattgtcttattttccatttggcaccttatagtcgttaatttatttgaacaaattacttaagaaacaatatatgtgaataatattcaaattaagtttttcttctttttcgttagaaaatagaaattaaactattggagaattttaaatgcatgtgaagccttatagtgcactcactatatggaattttaatactaatatgttctaaagtttagtcaaaagtcaccaacttgttgacatatgattacagaatgagcaagaggtcttaactttagtgaaacattgttgaatataccaaaataagcaacatttgatccacgttcaatgtgtacatacatgtaacatgtaaatatgtctgtatacacctccccacacatgtgtgtgaactgggttatccctttatatctcaactcagaagaaaaaaatacagtgtaaagcttaactacaggaacagtctcttgcagtgtcaaataaggtataattatttaaaaggcaaaatatacttcacagtgcaccttataatcattttagtggcatgcttgtttatatgtgagaaagactggattagtgagacaagacctatctgagttatcaatctaattaaattacatctggcaaatgtacaaggattgtgtatatcccaagtctaaccttgttatccaggagagattgcttctaggacccctgcagataacaaaatctgtgagtgctcaggtccctgatataatatggtatggtatctgcatacaactaccccatcctcccataatcatctttagattacatattatacctaatgcaaggtaaatacgatgtaaacagttatgttgcattgttttcttatttgtatttttattgctatagcgatattttcattgtttttttcccccccaaatattttctgtccatagttggttgaatccatggatgtggaacctggacagagggctgactgcaagttatatctaagaagttatacacataacttattagttatacatccattgtaacttttcttattaaatataaacaggaagcaaaagactgtcaaagtgggtattatttaaatatacaagttaccactagcttcatcagcaaaaacttctccttgcgctccaccagtgacacacatatgctctcagcatgcatcttaagctcctacccctgaataatatgttctgtagtgttaacttgagtttctgtaattatgtcactataatacagcacattgcatatacatgaaatatcatacctttataactatgtccactttattactggatctaaatatcttttacacagaatacacacaatttttctagaactttcattttcctgcccagaagatatcaaacaaaatatagcttaagtgaacccttgtttgaaaataaaaccctcaactattttgaaggaaaaaatccagaactagctcatatgactgccatttacatttagcttgtcagaacttaataacatggctatgcctggctgctgagaaggctggaaacagccatacacaaggagaacttgtgcctaggcaaaactctgttcttatggaaaaaagattgagtttcgggaagacgagttgtattttatagtcttttctaccttcacagactatttggttactcctggttacttttctttgtgtaaacaaaggcatttgtatataacttttttttttttttttttttttttctgagacagggtctcactctgttgcccaggctggagtgcagtggcacgatcttggttcactacaacctctgcctctcagacgcaagcaatcatcccacctcagcctcccaagtagctgggactacaggtgcatgccaccacgctcgactatttttttttttggtagagacggggttttatcatgttcaagaactcctgagctcagggtgatctgcctgcctcagcctctcaaagtgctgggattacagacatgagccaccatgcccggcccatttgtacacaacttttaaagcataaatcccatcatttcgtaaagatgaatatcttgaatgcataaattccttatatgtctctgagtaccccatgcaaaaaattaaaaactagggacttagtaaatgttggtcgaataagtgacttttctgagtttagaatcatccaagtcatcaccaatccatgtttacccccaacgtaagcaaaacatagcaaataaatagatgaatgctgaaaagggagaacttttaacttataatctgccataagagaaaggtcactcagttattctgaacgcttggccttcaaagccaataacttatgtagataaacagaaacaaaaataaaaccatatacagtttcaaaggacatgatgttttcatttgcagactcattaatgctttataaatagccaaactatgaatgtctagttcaagacaacattaaaggttttgaggaaagaaaaatgttcttgatatacagagttttctctgccatataccggtatttttgtaggatcctccttcactgtacaactgtagctcagttggcttatgcattggtttccagccgttcttcattgagctcttttcattccagcccatagttattttcaggctcaactggaaatgagtgcagtgatcacctgatgatactaattccatctagacttctttgtattctgagactgaacacacattatttttggcttgacacttttttgtattgatcctaagaattctgtgcaaggctcaccttttctgtctagcctcaggagtctgtcaggatgatacagccattgaaatgcaggtttgatgatagggcagacaaaagtcagaagcatttgtatagtgcattatttacctcaggagtcattgtacttggatttcaacttgaaagaacacactagaatatttcaggatatggaaacattttgctataataaaaatcatatttatttttatttttctcccacaccattttatgaggttcactcttaagtggtctgctttatataattatgtaggagtgatgcatcccaggttaatcatttatcttgcccatgcatttctcctctctgcccttcttgcctcttccccctcaatggtgcttcggagcacaggattatcttggaactcaacagacattttttttgtctgtctgacaaccacaggtgtccatgaacaggccccaaaaaggacccaacaacaaagagtaaatacaattacaaatattctttggtactcaattagcaatgcttcttaaaaagccaaaagaattagaattatgacatccctttcttttatatttagaaaaccagaaatatttgtgagatccagtcttcctttcttagttttttaacctaataaacaccattcatcacatatgtattctactcacaaatgttgacagttccacaaatttcactgttatatgaaacatttcatcactcttagcccctctttattgtcttaaccttctttatgttaaagctactttccagaagtttccttgaaagaaatggaggggaaaaatatcaaggaattatattctgtgcaacattattttaacaggtatcaacattccaagtatgacaatagttaaaggatgtttctgtcctcaccaacttcagttctttattcagtgcaattattccagtgatgggaccactctaacaaaattaactaaatcatcatgagcatcatcacttgcttaatttttcttcaggatatttatcactgtctaacatactatgtagctgatttgttattttgtttatctgtcttcccccactaaaatataagctccttgaaaacaaacacttctaatctgtttggattaccactaaattcccagcagctagaacagtgtcagccacatggtagactctcaataaatatttgtttgaataactgagtgacacagtgaatgaatatgcatatgatatatatttaaaatgacacattagttatgaggttttccaaattaccataaaaatattttggtataaatcaaaatttatgtaactttgttttgcccgttaaaggaggtaaagacgatggcttgaaaacatagtcaaaaatatgaagattaaaattactgtttttaaaaaataaataagttaaagagtatttttaatcattatttttacattggagtgactatatttattgcctatatgtcatctcataaacgaaatagggacttttacataaattttaagcacatggtattcctcatagctctacccctgtgtcttctcattatggaagctattaagaaagcagcatgaaatccaaactgtattttataaattggttaggaaaataattatttaaaatgttcttttgtgaatgacagaactggggaaaatgtgatttgcagaatgttggactaaatggctatcctctcttaactttttttcttccacaattgagaagtaagtggtgaaattttgtttcagttttatcatagaaaaataaatctcaactgaatcaatgccctgtcccttcttagtaggatgctggcgataatacattagtattttaaaaaatatattattgctaccactaatgaagattttacagtgtctctaggtcatcattccaaacaaacacaaatcaacataaatttatataatcaaaggaagattcttagggcaaaactctgatacaattttgtaaatggctgttgtctcttttccataaaaacagatttttgtaaatgtgtttatacttttaaagttctgatagaataaattgatctattgagtcaattcttgtttgaatgtttactaattcttgctgggaaaaataaatggaagtttagagcatctagcatctattttagatttctggtgatgtagaaaattttatgatagtatagaaattaactcctcctcccaaggaacctttttttatataattgaataaaatccaagttttaagttcaactataaatccatagttttaagttcaactatgtagtgttgtctatattcattgagttgtacctgcttatgcaaatgaaagtttagtaggagatatttgggtccaacagtatctgcattaattcatagctctctattcagcaacagcatggggtattgtacaaagtagatgccaacaactatatgctcaatgaatatatgtgtgaattagtttcttcttagcaaaccagaagcctagggctctgacttagactggagtgagagaggaataaataatagagatggaggtggaacccatttgtggttctttcagggaaagaacaaaagggaatgagaatctcaaatacagttggaaaactttaaatccatgggggcaaattgagagccagactcacacctcaatgagggttctgcaagagaaaccaatccagatgaactagaaccgagctccccatgtgggcatccatgggctatgtgtattctctacaaaacttctgttttggactgagtggtacatttttgttgataatctcaaataaattaatataatcctgctgtggattacttaaatggttatatgttatacataataactgaaaattttataatatgttatattctttactttatatcatttatatatacatgtatatatatatatatacacacacatacatacatatagtaaactggtagattttatttcctaatttagcatttgcatgtataaatattttgatgcatctacattttgttgccatgctggtctactttaattgtctaagactatagagaaaagaagtagacaacacatacataattcagttccactaaacacaggccaactgattttaatccacaaagaagatagtacattgccaaataggggaaaaaaaagatgagaaaatgatattcatatagcgcttttggtaggataggcttactgaagccaaaaggtccataatttagcaattatttacatttcaagttgctaaaacatttctttttattatatatatgcctaagatatacatgatattttgatacacatagtgaaatgattattacactcaagcaagttaacctatccatcatcttacatagttatgttgtatgtgtatgtgtgtgtggcaaaagtccctaaaatccactctcttaggaaatttctagtatatagtacaatattattaactatggtcctcataccatacgttagatttttaggtttctttatcttatacatctgcaactttattccctttgacctccatcttcccatttcaatcctgccatcctctccctactcctagtaactacccacctttctattctgtttctatatatttaaggtttttggtttgtttgtttgtttgttttagattctgtatataatcatttacattaacttattagttttactcatgttaacctaatttttgttgatattacagtattgttatatttaaattctaccattttagttattttaggtttgtgataattttcagcaaaagaagtttttaacatagattgacattgaaggatggttatgaatatagaaacaactaaagtgtatcctgggttgttgaataattttttaaacctttttatagatccccagacattctcaaatttctgttcaataaatggagtcataagaaactcccttgatcacctattaatgagagagagctggtttggacactataaacttatgttcaccataaacttatgttcatggtctttattggataatggatagaaatgattatttcctcttagaatgttttaagtttacattaattaatgaggggaaaatcaacacgttagtaattccttgaattaaatactctattttttactaccaggttccataaatatagtatgtcctagctactaatggaaacatgaaaataaataagacacaatcagaatttcaaaaataatatattctttgttcataaggataaaatttttactacctggttccataaatatagtatgtactagctactaatggaaacataaaaataattaagacacaatcagaatttcaaaaataatatattctttgttcatagggataaaatttgcaatgacgatgaaggtgattatggtgatttccatcatttacggaggatttaccacatgccagtacttatggtcagcacttacatatgttatctaagtttaatcctcacagtacccttatgagataccttaattattttccctatattacagataagtaaaccaagtcttagacagctgaggggattgagccaaatcacacaattcttgcaaagtggaatgagatgggattcagttcaattcctatgctatatacttctcccatcaaaagttatgttaaagcatttcaatgtttaagattcattactaagtaacatagcccaaataaataattgtgattttttgtttccttcattttgtttatcaaaaaataagtttatctttgttcatcattttttacttgctcaataatagatatataatttgtcattccctggttaatttaaatttaaaatttgtatgaattataaataagatatgtttcttccctatgaatccaaatgtctgaagtcatacttagtcaaaaacttggttatggcaaacagaaagtttttttattgcacttttaaatttttttaaattttactttaagttctgggatacatgtgctgaatggggcaggttagttacataggtatatatgtgccatggtggtttgctgcacctatctacacatcatctaggttttaagccccgcatgattaggtatatgtcctaaagctctccttcccctttgcctccactgcccaacaggccctggtatgtgatgttcccctccctgtgtacatgtgctctcattgttcaactcccactaatgagtgagaacatgcagtgtttggttttctgttcctgtgttagtttcctgaggatgatgatttccagcttcttccatgtccgtgcaaaggacacgaactcattctttcttatggctgcacagattccttggtgtatatgtgccacacttgctttatccagtctatcattgatgggaatttgggttggttccaagtcttggctgttgtaaatagtgctgcaataaacgtatgtgtgcatgtgtctttatagcagaatgatttataatcttctgggtatatacccagtaaggggagtgctgggtcaaatggtatttctggttctagatccttgagaaattgccacactgtcttccacaatggttgaactaatttatactcccaccaacagtgtgaaagagtccctatttctccgcaacctcgtcagcatctgttgtttccagacttttgaatgatcaccattctaactggtgtgagatggtatctcactgtggttttgatttgaatttctctaatgaccagtgatgatgagcttttttttcatgtttgttggccacataaatgtcttcttttgagaagtgtctgttcatatcgtttgcccactttttgatgtggttgtttgtttttttcttgtaaatttgtttaagttttttgcagattctggatattagccctttgtcagatggttagattgtgaaaagtttctcccattctgtcggttgcctgtacactctgatggtagtttcttttgctgagaagaagctctttagtttaattagatctcatttgtcaattttggcttttgttgcaattgcttttggtgttttattcatgcaatctttgcccgtgcgtatcctgaatgatattgcctaggttttcttctatggtttttataattttaggttttacatttaagtctttaatccatcttgagttaatttttgtataagatgtaaggaaggggtccagtttcaattttctgcatatggctagccagttttcccagcaccctttaatgaataggagatcttttccacattgcttgtttttgtcaggtttgttgaagatcagatggttgtagatgtgtggtgttatttccgaggcctctgttctgtcccattggtctatgtatcttttttggtaccagtatcatgccgttttggttactgtaaccttgtagtatagtttgaagtcaggtaacatgatgcctcacacttctttctttttgtttaggattgtcttggctatgcaggctctttttgattccatataaaatttaaagtagttttttttgtttttttttttagttctgtgatgaagaaagttgattttacaaaagttctttgtttattatcttcttctaagaataaaaaccttacttttctttaaatttagacctactaatagttttgagatttgttatttgaatgttatgaataattttggccttatatttactttttctctagaccattttatgtaaaagtacgtttttcacgaccaagcctgtgttaatgaattcaaatttgtttccttactggagtgattcttttgctaatccagaactgctcccccagaactgccataagccatctcttgctgccgccatgtttgtgctataagtagttagtttccaggcacagggctaattattttcatctaacattaatatatttaggatggtaaaagtgacaaataccaatatcacaaaatttaagaacactattatccctaaactatccaccaatcactatgtgtacactgtagagtctagcattaagaatatatatttaaaacaatacatgtatcagttaaaatagcatgcgcttattattatattacattgtttccactctttttcttcaaacattgtaataaggatgtttgacacaatgtgaaaaataaaagttaataaaatttgatagcctcactgtctcttcttatgttttctaaactgtccaaaatatttagaccttttgaatgaatgacgttgagtttgtttttttatccaatggcatttacaaactgtgtgaccttgggacaatatttaatttctgtgaatcttagtctacatgtatttttaaaaataggaataattgtagataactgtcagacttgttgggagaaataaatcgtaccaatatgtatattgcctagcacaataccaaactcatcgggagcaccattaatgttagttccttctttctaataatccatggaaaatcattctaaactctttacttttaactcttaaacttagatacctttggaaagataactttttggtaagtgtcatctagaaatgcattcacttctcattgttctttagcaggtgaaatgtgtgtgaactgttttaaagttttatgtgacgtctacaatgttgtaggtgctttcttccctcttcattgtatacccatgtatccttggtaaactatgatttatttaagcaccatccatcctgtgctagctgattatggaaatatatgaagatttaaaatttagagatttcaggctgatcagtttgtcttggtgtttaggttacaaattggttcatgtaatgattttcttaatttctcccagaactgtctctagataatgccatcaagcaacatggtgaataaaacctgttacttttgttttttagattctaaaacatattctgagaaaaatatttgcagttctattgtgtgtagcaatccaatgacaaaattctctaaccaccataggcttaaaaatgatgacatttttggaagtaattttttaactatttcacaaaacatatcataagagagagaaaaatgtgataaattatatcaggcagataacttactgtctttttcaggccgtaaattatggttttaagtatgtatgtaccataatgaatttatgttaaaaataatcagagatgggaggggcttgtagtgtaatcatccgatgggttcttcctgcctgctgcatagacaaaatcaattcactgagaccgcatcattgaagtaaagagtttaattgatacaaggctggccacatagaagatggagttattactcaaatcagtcttcctgaaggctcagaagttcgggtttttcaagtatagtttggtgggtagaaaactaggaaataggtgttgcagattggctggggatgcaatcataggggtgtggaaaagggtctgtttgcactaagtctacctcttgctggaggggccacaagactagttgagtcgtgagtcctgatggggtcagcctgaaaaatatctcaaaagaccacttttaggttctataatagtgatgttacctataggagcaattggggaactcacgaatcttgtgacctctggccacgttactgagtagaaagggattatagaaactaggcctatattttagcagaccttcaggaccctcccataatcctaatcttgtggcctttcattagttttacaaagcagtttcagctccagaacaaggaggaaatcagttttagggagggactattatcattgtgtcttcagagctaaacaataaactaaatttctcccatggttagctagccctacacccaggaataagcaagggagagtagtcagcctgtgagactagaagtaagatggaatcagtcatgttagatttctctcagtgtcataatgtttgcaaaggctgtttcagtagtgactatcagaacttcctgtagtcaagtaaccacttaaaccacctaaatcaagtgactgttcatgtacattggatgagtgagaaaaaaataagtttcttttaatttttctgggaataaaacatacttctctggctatttggttgtcagaaacatgctactctataccactctataccattcaaattaaggataccaagtttagagtccctgtcattgaaactctcctatgatgataactccccaaacatttatatgctggatatttagccatgaagaagtttattctgtgaaattcccagttttgtatatcattggaggtaacattgtttcttcaataacataactgttttgtgtcttttcaaaatcgtcattgtatggtaaactctaaaagagtacttcctgttctttagttacaattttacattgtatgtagtacacatttggggcagctttccatagctattatttaatttcaaactcagtataactcagtataaataaatgttagctagattgatggttctggttttattcctatttcattttcaaggtaggaaaattaacattggcttacagtattgaagaagtaatttttccaattacatggaaattgcagttttccttctcttactacagtcactcaaattttatacaaaattggggcctagcctgggagagttcttggcttcaccaggagataattcaagggtgatctggtgatcagagaagcaattgttattgaacgggtactgcttcttgtggagcaggactaactcataggcagtgtgccagggctgttggcacgtgtatttatacccacttctaattatatgctaagtaagaggcagattattttgaactttctggaaaatggtggggagtttccagaatcatataaggtaacttccaggctgttaccatggcccattgccatggcattagtaaactgtcatgaggctggtgggagtgtcattatgttaatgagctgtgaggacactggaggttgctttcctcacagtctcctggggttgctggcctcttcactgcatgctattttgaccagatcctgcttttatcaaggtgttggtgaccagaaaaagactcctatgggcctcctacctcgtcctcatgcaagtaaactgcctgttttacctgggactttacctgggactacattttgtgttctcttagacatccaacagagaaaattccaacagttcagccatattttgtatagatagattacacaaatttaatagctgaacttttaaataaagtcagattaataggtacaagtccagggcctgatatggccacttgctggcaattgcttgtttaatttgattcatggagacagccaagttggtcaatgtcaaacccaatattcaccctttgacctaaacatatatcctgtgttggtcaaattaattgtaagatctgttggttttccttttaatcattgaggacaatatgtgagactctgtagaacttcacagaatcgactggcatgtctcagcttagagtttcctgatttacatcctcagggtcaaaaggcatattttatgttaaatgtccatgccacactcctaatttagccttgaccaactccaaataatctactcttttaggttagttgtaattgttatatttcgacattaatattaagactttattctttggtttcttttttaataggagattggttaactgacttgaatttttcactgggtttatattttaattggatacattaattattatttgtgagtttctactaacgttggaaaacagagggacttagagccatttcagttagagaggataagatttcagtactcctaggtttaaatgtgtgtgtgtgtgtgcacatgtgagtcctaatgttataaactgaatgatttctgtgtgtttaagaaatgtgagccattggtcctaggtaaagacaatggtaaaagcaagaactctccaagttattgccttacataccacagacattatggccatatatttccacagaacagacaccagtgggtttttgttgttgttattttattgaatgacttgaagcttgctaaatgactttactgtcttattttatcagtatttaagctgataaaatgtccctctaggctttgggaagtcaagctatctatttttaattatttacaatttgctttaagttaatcttcccaagttgttcctgcattgcttatctgattttctttcttagtttatctacacgatcctaggaaagaaggccctatatctatgaacagacacctgcactgtagaataaatactaaagtattaccttgaccctgcactaggatgaaagagactatggaccagccaatatgattgtccatttaaacaactaatattagcacaaatcaagttcagtttggtgtcttccattaaactcattcatcaaaatagaaaatgtcatttcagtaagaagcaaaatatacccaagaatatttctacagtccctggtaggtatgattacaaatatcaacaaattctccacttatctggtcggtagttgatgctactttcacttactccactgatatagttaaggtcttttggccacaactacaaggtatggattaaaaagttagaaatcataaggattgtttctttattctgcatgtatgatgagcctcccaaagttattgactttaaagttctcaattgtagtattataagtcacttctacattttgctaagtttaataatattcttcaatttctttaaaatgtattgattaacagctgaatcataatttttgttgctctgtttacttgatgatcaaggccaaagtccagtaaaaagcgacaggaagtgtatattcaggttgtagatttagcatttctgttagatgaattttgtaacctacagtttacttaacaatatataattaacattgttccccatatgattaaatatttttctatattgtcatattggtaagatatttcagatgttttacttttctacctatttaaatatatttgtgtagtaaatatagagttaaacaatttaaattatttactgttagcaaattcctaaattcctaaaaattgattgctgtttccaaggacttgtacaattttgaaaaaaagtacatatacataactatatgtgtgtgtatataagtgtgtgtgtgtgtgtgtgtgtgtatatatatatatatatatatatatatatatatatatatatatttgctctttttccagccaaatatgttttagttaattaaatttcagctagctggttgtaaagttggctacgttctgaatgcatagcatggcaatactaggagattttatatgtatatacatatatacacacacacacacacacatatatatatatttaacagtaagatgacaatgacctcatagaagtgataatagaaaataagaactaatacatcttgtaaatgaaaaatagcaaaaatatatattgagaattatcttggaaatcatatgaagcttctcttctatgatcattaattcattcacctttttaaaaaattatttactgagcacctactattttccaggcactgtgctagatgactaggatacaaagaccagtaggccattatctcaactttgtgtctgtgcagaatatgtttacataaaacagattcacttctataaaatggctgcaagagatgcctgaatgaagtgtctctagagggagtgagtggggaagtttgtggaggctttacagaaaaaatagtatttgatcgagctctactagtgtaagtaggaatttgtcaaaatgcaaagatatacaatgcaaacagtaaaaggtgtttttgtttgatttgttttgtttttaatgaaatgaggtggtagtcagaagtatgttttgtgtctaccttgaatgtggagtcacccacaccttgctaagaagttcagtaatttgtgcaaaaagtgagaaaaagtttttcaataaaggagtgacaaaatgtttgtacaaggaaagtacccttaatggactaaagtagaggagaaactggtggcaagaaaacaatagggaaactgttagagtaggtcataggatagaggccatgtcttagacgtggtgaaaatgaagagaagctgataaaccaaccagcttgttacgctgcccagttctctcccctccataaagccttttttaaatcactccagctgaagccaatctcaccttttgcgctctttgcttgtacttcctcttaacacccactttacattatcttaaattataatacgtatgtctttgtctcatcagcttacaggacataaggcctttattcatcttgtattccctttagtgttggctattgtatatactatatagtagaagcataatatttttaaatattttatatttaatatgatatttaatgattggtagttgtaacagcgtatttggctcagtgataactattatagcattcatcacattatatcgtctccctgacaacatgggatcagactctgtcatcagagtttatggtgtattcatggttcttacattacataagagaaaaaaacatagagaaaaaaacattagaggaaaaaaacaaagggcatcttgcatttgagaaaatataggttttacttttactacttaaaaataaaaaatgttagctatcctgtcatttatgtaatctgatataaaacctttaacttctctctatatagtattgtgatcattgtattaaaatttcccatgtttccaaaaactccacttaaacatttggaaatagttaacaataaataatgtgtagatgcttcaaagatttgttttttataatgttattcttcacgtaataattttcatatatatttatccaataatttaaccctagctaattttatttttaccttatttatttatttatttatttatttatttatttattcatttgaaacagaatctccttgtgtcaccctggctggaatgcagtggtgtgatctcggctcactataaccttggcctcccaggttcaagcaattctcctgcctcagcctcctgagtagctggaagtacaggtgcctgccaccacgcctgacaaattttcatatttttagcagagacagagtttgaccatgttgcccaggctggtctcaaactcctgacctcatgtgattctcttgccttagcctcccaaagtgctgggattacaggcatgagccaccgcacccggcctctaactaattttataaattaaaatttcagtgacattgtgtccatgaaacaccaaaactcaattatattatttcaaaacatgttataatgccttacggaacagcagcaaaaataggggtcaaagcattttgactattaacatgactcttttgttttgactttttaggttacacttgaacacaacaatttgtatattaacacatatgccatatttaaatatctgaatgcaaaagggttctacaataaggaggagtactttaggctccttggagaaaattttaaaaaatgtattttatgactttttttcactataaactaaacagcaaacaaccatactccaataaagcaaagtcatgtcactaaagttactcagctatcaaacaacttttcagaatcaccagaactgaaagtaacacgtttccatgtgtatctattgattgtctgtctttcccactggaaggtaatacacttttttcaaactgtctttatactcccatagcctgttaaatgactggctcctagaaagcaacaaattgtttgtgaaatcaattaataaagtaaataattatttaatcaattaaagtaaataattatttaatcaattaaactaccactgtgtttaccaacaatcctcaaactttaatgtgcatagaagttatgtgcagaacttcattttaaaatgcagatatctaactcctgcacacatagattctaattcagtaggctatgcagtctgtgactgtgcatctaacaaggacaccagtgtttctcatttggagcaaagatcactctttaaaaatattgatataaataacactaatgagatcaagaaaacttcttgattcagataacctttagcaaatctttgggcaattaagtgttaattgattgtgaataaagagggtcaaattaaatgagcactgcatgtactattaaaaaaaaaaaagaagaagaagacctaaagtgaccatggggcactctggtaacttctctgattctgtgcctcttagatttgtgaggtcagcatgagtagaaggtaaaagacaaatttggtaatatggacagattacaggacagcctatggatccagtgttccaattggactgcatttggtgtcactatcccatggttcaaactgagagaaaagcagggagcaaaaaatctaggacagatagcacggtagcatctcaagatacagaccatgcagctgtactgacatcaaaaaacggcctgagtgtgacatctaatctcaagacaaacctgtcttttttcagttcctattttaagctgcctttttcatgttagtaaatgggaactagggaagtatgtgctgttcccagagttagatatgcttttgaggtactgcccattgtggaaagttacatctaaaacatttatactttctaattcaccataaaaccttttaaaaatactgtacaaatttatggactctgagccagttctactaaatcagtatttctagggagcacacagtgggaatccatatatatgagctatttaggtgattttgatgattgaccaggtatgggagctgtggctttcaaaagctttgatagatatttcattattagaaatattactgtgtttataaggcgtcagtcctcttccccccatctttagccacacatttctgcctctgacacaactcttctcctcatctgttgtcttagtagccttctgtccaaaattatcttgttgtagatttgctttgttattctatccctttcctatagtagcactttcctgtattcagttttccatcaattttgagtctaagacttatttttctatcctttctttctctctgaataacttatatcctaaagcacattgaaattgcatgtcatactgttatacataccccaccactctttttaagtatatcctcattggtagtacatcagctgggcttaatttctaaaaacaaaattagggcccgatggctcaatatttctgaataagtaaccaaaattgttattgttataagaatgtaagaaaagggtgacaaaatggtgaattgctttaacaaacggaaaatgagttcagaatgaagcagaatgcctaagacattttacatcttgacttgttttaacaagattctaatgctttgtatttcatttatagaatagttatagcttcccattggctctgtgctcccatttactcagctactgtaaataatagccatcagcaaagcttttgaaatcttcagatgaaaggaacttaaattaaggaagcttcccatgtgcatcccttcccccacaaaaaaggatgctaagaaaacaaagaacggggagtacaacggaatgattgtagtaactgaatgcattccagcttttgaaaacgataaacatttattttctgacctaagtgttgttgtttttaatttttttaacttttttttctcagttgaagcaggcgatagtggatattatcttaagatatgaaagatattgaaggaggcagtatcaagtcagttacactatgtggattaatgttgcagtagtttctttctttggttattgccaagctagttgctattttcagagtattagtcacatgcttctgtacctgagagtgaaatttttcatttccctctaaagatgattcattttgtttcttacaggaagaactttgataataaattccagtgtacttttaaaaatgttcccagggacttaaaatgaacctgcaaatatttaattttatattatctttttgacatagtttgcttacataatctacatattttgaatagatgattagaccaagggagcttgcagtagataaggttaaaatcttaatgaagattaaacatcttcttttaaaatctccttatattattactgttgagtgacagaatagatattcaatcctttaagccaagaatgtataatgggactggtatgtaataagtaaacttgggaagcataactggaaatacagaagatactgaacttacataacaatgtgtctgaactttaaacgtttttgctttccacagtctggctttctctcctgcattgtccatatgtaaagatgacttagccaaagctcccaagctcccaagagttgacaaattctcccttccagggattaacccaaaccaaattataatatcttaatcccaattccaagttcctaaaagagagaatttgtgactgagagaagaggatactcttctccctctgccagctaagaagatgtctgaagagatggcagctacagattggcccagaaatttagtcaaatcaccctattattcatgttttttttttttttcttttatagacagagtctccctcggtcacccaggctggggtaaagtggtgcgatcatggcttactgcaacctctgcctcccgtgttcaagcaattctcctgcctcagcctcctggtagctggaattacaggcgatggctaccaggcccggctaatttttttttttttttttttggtctttttaaaagaggcagggtctcatcatgtggtcaggctggtctcaaacttctgacctcaaatgatccacctgcctaggcctcccaaagtactgggattactggcatgagccaccatgccaggtgatttttttttttaacgtaagacttataattgaaaacaatttcacattcaaatttttaatttaattaaaacaacatgaaatacaagtaaataattttggggaagaaaatacatttatataacaacacatatgtctaattttattgatcagagtgacattttaaaatgttttttccagatataaacaatgactgttttttgtttagtgaaatagaaatttaattcttcttctgcctataaaaaaaattaaaataacaagatttttttaaaagaatctcaaggtatttttgcacattgagactaatgtgaagaaaatcattttcagaatttttattgtgaaatacaaacatgatttttttttctgtaaagcatattcattaaaactatgcttggaaattaacatttcagcagaaaccacacataaaatttcagtttattaagacaaaaaaactagagagtttgggctttcttgttttactaataatgacattctgttttattttctgacaagtttactgacagggctttagaggtaacttaacagtatctgtacttacctgtcagccaggaatgagtcactcctgaatttactaaaaatgacatcatcaacatggtttaataatgaaccttggggaagattttatgatactgtgtgacacgagaccctctcattagtgccataggtttcattagtacatgtcattttttccaacctttgcagcattactggttgaatacagcatattctgaacatctctacatttgtgacatctcttaatgtcacatttctttatttttacaaaagctgtttatagcttgttggattatctaaacatgtttaaaagatgaggaaatactgtaaagcaaggaaaatgagaaaaattcatagatttgcaggaaaaaagaaagaaaaactacacagataacattaggccagggaaatgcttgtttcctgttagtcctgatacccgtggaaggcaaacttctatcagggcatgagcctgtgattcaggctagggttctaaacccagctttgccagtaataacctatgttactcttaacctttcttagattcatttttgatatgtgtgatagaggatgaaaattctaggattctctttgattagcactgatttttggggggggacctttgtgaatttgtcttttgtagctcctcctccttccttccctttcttctctttcacaaatattgatggagcaaataacaaatgccctgtatcataatgggcattgcagataaaatcaggcacctcattttatatatgtaaagatagataatataattaccatacacaagtagattcagtcactccaaagttacatttgactctatagaaaatccctttgggaatgaatttaacaaagtctggatgctgttgtttatttgcagttaacaagataatgaagaaaaattgtcagatttgtgatttaagtacttccatttatattttatgaattatcttaaggaagcaaaagatctacattttttttcaaaggggccagaattaaaaatgtccagtacaggtttagtcttttaaaagccaatgcaagtaataaaggttgtgttaaattaagtccagtccatcattcgtcattttcaattttaaagctaacatttaccatgtgctagttcaagccaactttacaaagcctgtcactgtgatatctaatgtggtgaatcccacttgagtttctaatgtcttctcctgacatttcttcaggagtgactgatagtgccacaggtccagatggactgaatagtggggattgatactgatacaaatgaagcttagaaacaagaaagagttatggaaaacacatcttagtgaaagatcatgtcttattctgatgacttgtttaaaatacaacataatttttccatgatgttagagagataacacatttccatgtatatttccataaatgtttcaagtaaaaatgggtaaataagcactaaaagatatcattcacatgcacacagttataaggttatatctgcaaaatttataactatagatatcacatcaaaatcaaaattaagagaacagatatttttaaaaaccttcttgtttgtcaggtggttactgaactacttgtcatcataggactaatttgtctttctaaaggtaaaatcatgacagatattaagtgtagaatgaaggtaggagtattcaatacattttgtggtattggtttagacaccaggaaagctcctgggaaaattccatatgctagtgaaactataaattgcattgagtgtttattggtttctgtcatggtatagtaggtattggttagtgatttttttaaaaaggaaaattcatttgtttgtagctttcatttctcagttatgtgttttcaggaaggtgcatttgtcttatgaaggtggtataaaggaactactttagaattcagttctcatcacaaacaaatatcttaatgtaatatatttattttttcccagggaagccagagaggcatatgatatctggtgaataactatggcctaccaatcgttaaataaaatggacacaatttacttttacttcttgaaaaaaattttccccatcaaaaggatcattaattcaaataaaattcaaagtggtgtatttaaaatacacacttttcttctagtaatctcaaaatcaacctggtttgtacaacataaaagatgtaaactctcaatcatatgaaattttctttcactgcattaatattcagtgaagcttgtgattttagcaaatctcttctgctggtttagagggaacaacaaaatatcaggcttttagggtgtgcttccaatactgccctgggtagacatggggagaattcaggtcatagaatttaatgactttttttcaaaagcaaaacacatgcacactaataatttaaataacctttcttgtcaacaatagaaatatgtaacacagcaatagctgattaatagcaaaattaatggtgtaggcaataattgctaaaggagttcacaagaaaagattgctttactggagaggtgagatacacattaatgcaaagttaggaattgagctgagaaatgaagaatggaaacagggcaggaaagtcattctaggattaagaagtgtgagaaatgcccacagctaaggcagagggataagaaagtaaaatgatcgtttttaagataagaatgagcatggctatatgaagggtatctgtatagagtagaaaaactagaaaattagcttagagtcaggatatgatgacttttgaatgcctggctatgtgattttgtctttatctcttaaatcagaatttcacagagcacagtcttcaaaacagtagtttcataagatgtgatagctattcctcggggatgcagtaagggcgtgagtgagattttgaagttcaaatatatttgggaaattctcaatgaaaaaaaaaatttcctataatacaccttcatggcgctatggttgtattaatgtgcattgtgaaactccaagaggaagacagagaccagatgaacccccaaacacatttgaatgtgaaatgtttttcccgtgaatcatcccacagcgtagatgtgtacatagaacaaaacttaggaaatactgttttttttgtcgctgttgagcaggaaggtgaagaagttttattggctctattgtgtgccaacagtttattagagagtaagaatgtagagatacataagaagtacacattatcttgaaagagctcatagtgtagttataaacaaaccccccaaaagtgtgacagcacttcatgcatgcaataataagactccaaagggagaggcaggcatactgtagtgtttaggcacatggactttggatccagaccactgatgcttgaattttggttccatcactaaccagctatgtggtattggataatatactctcctttctgtgcctcagttttttcacctgtaaaatggacaaactaagaccaactccagatggttactataaagtttataatgcatataaagcatgttaacagtctggtatgtaataacttctatgtaaatattcagttattatgtagtataaaaactttataatataaaaatataataatataatatagaaaccttataaaattgtaatcatattataaaaacattaacatataaaaacataaatgccttcatgtcttccagaaatatgaaataattctacatttctcaaacatactatatgaagagttaagagatgaaagatgaggctggagagatgtagatgttttactgaaaagtttgcactttattgtgtaggtgaagaggagtcaaggaatgattctaggaagaaaatcatgatcagatttataatttcaaaaagttattctggtgacaagcgaagaggctcttgctcttgcaacacatgtttaagaaatgggggcctgtaccaaggctgagtcaggtaaaatggagagaaaatatctagtccaaaaatatttagggaatataattataaacccatgatgattgaagggatgcgaaggagaaggaagaattgagaatacatgttgagtttgtagctcgaaatactaaatgaaaaatatcatcactaatcaattttggagaacaaaagaggagcagaatgagatgtgggttaggaacagtgcaggaagacgaacagtaagattaaattgttgtcctttcaagtttgaggtcctaatggtacatacagggggatctacctaagagataattcagacatatatctcgagccatggagcaagattttattatagctagaggtaaagattggtaagtcactactataccacaacatataacatgtaaagacaggggaaatgatgagaatgcctacacagaccatatactcaagacaggaggaacagcaagggtatgatctgagaaaaagaaatacacaacaaaaagtttaagactcgaattatgcaaatggtgttttggaagttgtcgtatgctctattaatgttcaattcaaaatgggacttccattgttccctcaggagtcattgtgatcaacactcccctgccccccaacagacacacacacatgtgcacatacacacacatacacacagaatccaatgttcttacttattgacggacagaatcagagacagggtactctttttccctccttcttgacattattatatagatttgtttcttcaaataattccatagtacatatttgaagaccactatctaccaaacacggtgacttgaatatgcaatatgtggagtatttaaattacatgatatgagcgcaaaaataccttaaggagaaaaaggtattagaaaaaaagagacaatgatatgtcaagtattactctgtacatgtttcttaagaaggagggaggctggaaggtcacgctaagagcaaatgcacatgctgctctttctatgtaagtctcagggtcattgctacatattttaataagaccaaggaaacatatgtgatttattccaatttggaaaacagaatgctgctgggaaatgatgtggcatagtggaacaaggcgttggtgtcagagagatcttagttggctttatagcatcatccctttcttggtaaagaactttggaaaagatatttaaccactgtgtgcccctattccttcatatgaaaaaagatacaatgtaatattcacctcagattgtttatcaatttactagctgatgatcatttggctattatgttatatactatggctctatgaacattgataaacatttttgtagacatattcatatttttcttcataaaatatctgtttgagattgctagataatatacaaatgtttaactctataagaaggtgccaaaccactttcccaaattttttgccgcattttgcatttctgccaacaatgtatgagagtctagttgctgtaacatccttgcccaaatttgctgtggtcaacttttgtactttgagtctaaaggacgtgtagtgatctttcattgtggttttaatgtgtgtttctcttatgattaaaaaatgtaagcatcttttcatgttttttggccatactttttttttggtcaaaattatgtttaatcttttgaccatttatttgattgggttgtttgccttataattattcagttgtatgagttcttcatgtattctagatacaagttcttgttctttatctaatacatgttctgcaaatattttctccatctgtggcttgcttttcatcttcttaacaaagtcttcctaagacaaaatttaaaaattttgatcaactacagtttatcattttttgtttcaaaatttttgctttttaatcttattttggaagtgtttaccttatccaaagtcacataaatctatgtttttcataattttttgatcttggctcttatgtttaagtttatacttcatttatagttatttttatgtgatatgagataaaaagtcaaggtttattattattcctttttgcacatggatattacatccaactattgtagtgacagttgttgaaaagatcatctttttttattaagcatacatttgccatttgttgaaaatcaactgaccaaatgtatattggtcaattttcaaactctgtattgttttccatcagtctatatgcctgtctttatgacaacatcacactatttttacaatgtagcattatgttatgtctttaaatgaaataatgtaatttctctaattatgttcttattgtttaaaattcttttttggctattataggttctttgggtccatgtaaattttagaatcagtttgtcaatttctataaaaatatgttgaaattttaattgagattttattaaatatgtagatcaccaatagtagtatcttcataatagtgtgtcgtctaatccacgaatatggtatatctctacatttatttatgtcttctttaattctttttcttattatactttaagttctaggatacataagcacaacgtgcaggtttgttacatatgtatacatgtgccatattggtgtactgcacccattaactcatcatttacattaggtatatctcctaatgctctcccacccccctccccctaccccacaacaggccctagtgtgtgatgttccccatcctgtatccaagtcttctcactgttcaattcccacctatgagtaataacatgtagtgtctggttttctgtccttgtaatagtttgctccaaatgatggtttccagcttcatccatgtccctacagaggacatgaactcatccttttttatggctgcatagcattccatggtgtatatgtgccacattttcttaatccagattatcaatgatggacattcgggttggttccaagttaggaaaagaggaagtcaaattgtccctgtttacagaagacatgattgtatattcagaaaaccccatcgtctcagcccaaaatctccttaagctgataagcaacttcagcaaagtctcaggattcaaaatcaatgtgcaaaagtcttctttacattcttacagcaatgttttgtctttttcaatgtaaaaatcttgagtgttttaataatttatctctatacatttcatgtttttagatgctaccataagtggtgttttttaatttaaattttcagttgtccactatccttaaagatcatttatatagaccccatgaggaaatgtcattttttttttcatttttactttgtttgatacctggtcactagttcaacctattcttttgtcatgactttttttctagaactttacttcagatccagattttggtggcctcaatacatttcagttcacatttaacaatgatacaaaagtttaaaagaagaaatatttcctttataactatagttttctatcaaattaggaaaattaattggaaaatagataatgagagcctgatatcagggcactcagatctacgctttgagtgactatgtgtatatgtgggggaaatataaggaaatacataatttaaaaactttgtaagaagaggaaggatgagtaccaatatgcagaaagtatatgaaaatatactagaaagaacataacaactaatatttgttttttactccaaaactttcacagtacattcttgagcatcatgtaatctgtcagctatgttacttattattttacagatgaagaaattgggtattggaaatatagtacattttttaatattatggaaatagtaatcagtgcctaggccttgtgagtcttagctcttttgactagatgggtttcctctcagtttacctagataggacttttgcaactcatgtacctaattgcatctttcaagatgtatatgtggatgtatttatccctggctaagcaccatctagcaaccagatggtcagataggtaagctttcattaatatatattcacttcaaacaatattgtactaccttttattttttacttttgttccatctgctccaaaagtatcttaaaaagaaggcttccctagcattgttcaattttctcataaacaataaagggactgatttataatagcttaattggattatagctaaactttataactgagtcactgagaagttacacatttaaatcaaacaaacaaatgcaaaataaattcagagttattgcattaatataagcttcacacaggttcctctcttgaaaattcagaatggttgtcttatgattgggttattctcaatcttactcttaagagtctcagttctgttcctgcattgtaaaggtcttgtgccatttccttttcatatgtattgcagagagcttaagaatatcactatactttatgaaactggcaattaatctgtttccaatactttacttttgtatttggactcaaattcattatttccacctttcttactcctttaaaaattacatatattgtattacatcagtcctcttgttcctccatatgttttccttttctgtttctgcttttttcctttcagcctgaaaataattgtctggctgactttcctctcaccctgagcttcccaccctgtgcggtcatcaagactttttgtattgctagcttttagtaaggctacacattcactgaagctgtagtgtttgaaatatattccagaatgctttctccacacagtttgggagctgttaattttctcaggaaatttcatcagttttgctttctggtagaatgttattctggaacaccagcccaaactcctaatgcttccattttaagattttttaggccacgctaaagcagcagccctttaaagtctacagcttccaggaagctttgccagcactcccttactggcagatcactttactccagatcacttgttcttgtgttcacatgttaaacacaaattctcagcttttagttagttttgttgaaatcttaactaatgaaaatgtggcagttgcttgcagtagaattttgatattatatgtgttaagtagatattgtgactactagcaccaccttcccaatactgtaattatgaagaatgtttatttaagaagtaagacatttaaaagaagattcagtattcataacattgatataattgatagtggctaattaatagaaatccactaagcaatccattgaaattataaggaactattttagcataataaaacattgaagaattagtgaagactatggttagattatctacagtaccaaatattaatatttcatttagataaattattttttaactaaaattatttttcagcagagtcatcaaatactaactaaactataatttcttctgggttaatttgttcacctatgtctacctttgtatattattagaaaaaaatgtgtggttaatttttctaatttttgatatataatgtcaatatttgtgttcaaaatatatgtacatatgcatacatacttatgtatacacatacataaatctagagaaagaataatctcaaacttttcagaataacacatgtgaacaaccagattatatattttttattatagcttagtaacaaattaatcccttttcatgcaaattgtccttaaaattctaaagcagcattgtactacagtttataaaaaaacaccaaaaaaagattttgtagttgattggaaaagagaaatttatgttactgcttgttagtagacacttcctaactgcatattttaaataaatatttcttgttggctgattaacattggcttactaggaattttttttttctatggaaggcttagatgaatcaatgtttccgagatgcttttatggcattagcatgtatggcactgttttagtccttaaaccaattgattatgtttcagatatttcctaaggcaattttcttttttttttttcagaacatgtacaataagttaatctattaaactgaagttcatttttttcctcttatgtttagtctgatgatgaggttctaagtctctagtgctagaaaaagaaaacagaaaatacaaataaaaccttctactcatggataatttcatctcactttatcattattgatgcttttttcattttgagaatggtataagtgtgccatgctttaaaacaaacagtgacaaaaaagatgcactataatagttaatttgtatagagagtgtgattccagaggcagaaaatttatgatactctatatttgaaaagagtttaagtggattatcctacttttcacctggatcaaaaaccatttgagattgttccaaaaaattttcagtcaactgtcaaaaagtaattaccaattgtccaattaccattactcccatttgactattttgttattatggatcatttaattaacatttattgattatacgtatttcagttttcctctgcaatgcaattccttccataattattggtgcatgtttaactgaatggtcttatgatagagtaattactagaaccttgtatcacattttgatcttatctctcataagcttctctgctacatttcaggcagtctcacagccatgctcagtacttatcaaatgtcatgtcatctccgcaaatcactaatttagcattttagtttgtagcacaagttggattcttgaagtaccctcacccatacgatcattctttcattttgttgtcaccactttttccttgattccattgtcatcggcctctcttcatcccttagtttgattgttgaaatatccacatttaattattcttccacttcatcatgtcatctggtgctttcatactaccatcatgggcctttcctgattcattagcttctctcacccttcccttctgccttcttttcaattcttaaccagcttagattacatggatcatcatgtcaataagtacatgtcaatatcccaatttcccttgccccattagttctggccttccaatcaagaaaatcatcaacccccaatgaagtcaactatctgtgttttctgtcctatgtcagtgcagcgtagcttagctagtaacaataacaatgtacattaaactactaccactataactactttatatttgttagctttgacaggactatcaacattgccatgtaatcatactatgttttgtctctcctaccctctgaaaagattatttcaagcttgctctattctctacaaaactccaagtccctattactcccttcattctgaaaatgacctggcctgaacaaaaacaaaaacaacaccaaaaaagagaagttcttgtaaaagctttcaattttatatgggagacaaataaagttacagggagctcttcaaagcaattttcttaaagtggtgctgtcatacccccgcctgcatctgcactatccactccttatcccagagttattaaatccaataaaagtttttgggtattctgcctactttaccacaacttccttcttgcaacactgttttatttttttctataccaaggtaaatttttgttctgctcctacctctctgcacccattttaacaaggcctttgcttgcccatttttctctacttttctgttgaatgttgggatcttctaggctcagtctgggctctcctttccttttcattctgtagtcttctccagaccaactaaattgatgaatggcattaggccaaaacctgtcattcatgccagtgacccatgattatatctccagtccagttctctcctgacattcagaggaatatattctttatcttctagatattgtcacagatgttcagaagcacatcaaattcagctaagtccaaagctacacaatactacacccctaccttccttgtgtgttccattcttaaagaaagggacaggcatccatccgtttacaaaatcagaaaccgagaagtcattctgaacgtctttgtttcttttgccctttatccaatccactagcaagccatattgatatattttacctccagagatatctgagtaactgtttctccacatttctaccattatgacacccaagtacagctgccatctatcttctcttgccaacattgcttcaatagtatcaataatgttctctgtaacctgcccatatcttctcttagagctctttttttatacatatataacagccagagagagttttgaaaagctaatattattactaacctgtttatttcttaaaaccattctgccccacttcgttctccagctacattggcctttaatcagctgtttaatgtgccaaacctatatctgcctcagagcctttgcacatatttttgcctctacttcaagggcacccctactcacacacacatagctccattgccaccacccttagctatcatttttacatagctcaaaaatcacttcttcatagcaatctcccttgacattccagataagattagtctcctgcaattgactttcatagtattacatatatgtttttcataaaagctggtttaacaagtaagtgtgtattgatccaatgataaaattccatggcaaacaatcagttcaattcagtaaacatttactgagtgcctactatatgcctgacccagtgtattgctctcacaaccagagaagacagccacatcttttaaaataaggaaaattatgctttcaaagaaaagtacaaccctcatttcaactgactgaatgtttatcaagtacttatcatatgcaagatacaagggaaagaaactctctctggagggactcatagactagcaaaaaaaaaaaaaaagcaagtactttaaaaataattataatcagttatacatgatgcaggtatttagaaagccttgtttttcctttgaggcagagtctcgctctgttgcccaggttggagtgcagtggcgcaatctcagctcactgcaacctctgcctccagggctcaagcagttctcctgcctcagcctcccaggtagctgggactacaggcatgcaccaccatgcccagctaatttttgtatttttagtagcgatggggcttcaccatgttggccaggctggtctcaaaactcctgacctcaagtgatccacctgcctcagtctcccaaagtgctgggattacaggtgtgagctactgcagccagcctagaaagcttacagatcagaaaagctcaggtcagtcctgataaatattttaaaataaatacctcttaaatagataggacatctcattcctaactctatgttatcacagaaaatattgtgcccctcaggcaagaaaaagtttagtctgtggaaatcaaatttcaaagagacttatacagaatcatacatgtgctttttcctggttgttagaataaatctgaactaatcatgccccatccccctcatttctcctagcttttcattttttcagatgactgaaaagatttattgagaccttacggctgctcactgcctaataaagttctccctcagtcatcctgctaatttggttgactggtctatttttaaaaattagcagttttcagaaacagcctccagtattgtggctgtaaaaaatctgttgagaagaaataaaaggctaaaacaaaatttaatactgtaagcaagtataaattttttggaatgatatacgatcctgtgttgtggcagtttggtccccgaggcaggaaagaaagcaatctggttttctgaaacattcaaatttctcacctaagctcagctaagaatacatcattatgggaagcagagtggaaacgcaccattttatcctttaatttacagtgtcagtgggaacagcacaacacagagtcaagagttcaaagagagaaaaagatctggcttatggtggatataaacttaatttctttgaaccaggagtctaggccctgctgtgtagatttaacaataggcattctagacttcttttaatggccctttattttagaaataggataaaatattcatgttaaaaaacccactaaatatccacttggtaaaagcccgattcaagaaacattttttgttggataatcaagtattttacttgttttaagacagaacaacttcagattgtccttcatttaatataaaaggtcaattctggtttctacctcagttgtgatattaatctctccatttcattctaaatcctattaagagagtagaagcttaactttatcatattaatgccaagatctgggcaagcatttatctagatataaacaaggatatatgcctttcagaaggttatatcctcattgtgataatgaagaaaggggcttatatgttaactactgtgattccacaagacagagtgtttgggaagccccctttcacatttttctaacctgataagcaagaaaacataagaagaaattattttgaaatacaaaaaaaaagaaaacaatgaaaatgtggctcaagtataggctactttcagcaaccaaactgccttgtactggacctaagaggccatctgctgttccaatgggtctcaaaccaggcggtttgttaagatcaccttgggcaggggttggtttttagaaatactcattactcagatgaccccaacacagagatactggtgaaattttctgggtggggaccctggcatgggtgttttttattagttcccaggtggtgtttatattcagccaggcttgagaatcactggcatgtctgactccaattcaccaatctatcaattaagcaaggagcaacattcaggttaaataaacagcttagagtatcagaggctcaactctgagaatgccatgtagccctcatccgtaccccactccatgagtggctgtactcttttatttactcaattgttccaccaaacaaatacattgttttgatattttaactattgctggaacaaagcattaagttattcaagcaggcgagaaattcagtggaaaaaaatcatgtgttaaataacttgcttggctaaactgacagttggtttctgctgaatattgagtcaggaaacccttacccaaatcctctgttgatgaaataatatatcactgtaccactgaatctctctgtcttttaaaatatatatatataattgaatatgagcaaatctctgcatttatattttcttccaaaaaagtactgttcctgttgtcaaattggaacatattgtacttcctatatatatcacccacaagtcatttttaaacctggatcactgtctatcctgaaataaaaggtctactactaggaaggggcggctttatcctcctccattcctcaaagcttcaaattcccatctgctatgcattgctaaagggcctggtgatgaatttcccattgcttttgcatttaaaaaaaataaaactaaaagaattggtcaaagaaaagaaaatcctttgtctatgacttatatgaaatctaagtatatttagaatatagtccaatctcatttgtactggcaatgtgttacaagtctttttgtatactaaggaatctctttgtaatccatttgaccaagcagcaggatccaatatgagaccgctcttggtgctcctccaaatgggtgcaaaaccactagagcattttgattcacaatgtggggaagatgttatatatgtaaagcacacatatatgtacatgtgtatatattttacatgtacatgcatgtatgtgtgtatatatgcatatatacatattacacatgatgtatatagaaaatctggcaggctagtaacccagtgtatcctctcctgtgaggacacagaaaaagataaaaaccaaaaacacgataaaaagctaatggtcacaacctatagtaagaatctaaaaattccactaacaatcaggcttttggaaccagattaaggaaactaaaaatggctggcctaaataaacttcactcccactgcccctcactgcctgacaaaaaatagtaggaagatattatttttttctttctttttttttccctcccttcatcttactaactagagaatcaggtttattctacaaaaaaaaaaaaagaaagaaaaaaagaaaaaactgaagagctgttcagtttttccatgatggctctgaatttcctagtttctaaacctgtttcttttttttaaatgctggcaaaagtgaggtacatttgtgttgttatgagtactacatgtgattaatctatgcaaggcctttagttagtgcttagcatagaatatttactgtataattattaacgattaatattgcactgcaagaagcatactttcataagcagacattttactaatttttacatctactcagagattaaaaattacagaaaactgagataagccacaaatttataaagaaaagacccactaccagtggttcaatagaacaggctcaatagagcagtgcctggtagggtggaggtgctcaacaattatttgcagaattaatgataataggtcttgatagagagggaaagaaaaaagaaagagcttggtgatggtgcgtgttgaaagagcagttttctgggtactgtagaagttcagcttgctggagacaatcatacctcagtacagcagagaggtactgggtgcttacttgtcaagaacagtttcagaagggtgcatatccatcggggtgaggagtagggggaaggggtgtctatgaaaggaatctgctcaatctgcaagtagagagtaaaatccgtcatttgtctcttgatgagtacggaggctggataaattttcattattggagtataggtaagagggaaaaaaattaattcaaactttttaagaaattataaagaccaagggaatagaacatcattttgaagatgattgctggcaaaatcatacctctgaaaagtattaccatcagaatcccgcattattaatcattcgacatacataaaatcatgagctctatgtgacatcggcagagacttgtaagagaacaaattgaactgtggagtgatattgctgtaataataacaatatatgtaacagttacagtaagaagtataattatgattattaataatgtggcaagtacgtgtatttgatcctatcaaaaataaaatgcatcaataacggtaatgattatgtcactgaaatacagttaaaattatgaaattatcttgcaattgttatatttcctaatcatagcatatgcaagtcaagtgcctgccacttctgttaatgtcagatatgactgaggggtgatgctcaactatcaataacagcaacaatgtcagctgtcctttctatgtgtattgagcattgttaccactaatgtcatggcaattctaaatgtagataactacctcttctctagagatgatgaaactgtggctctgaaaggtcaggcaatttacctagagataatgatgcaggaaaaagctgtgtctgtggccaggacacttctgcattttcactgaagtgacctgcacacacacaacactctctgaaactcaggtttctattttgcataatggaaacatgaacacattcattgcagtgctattttgaagacagaatgagaaaggcagtgtgaaagtgtttttaaacatttccgtgctgttggatcacactctctgtgatgacacctaagcatctgcatttcccaaagattcataggtgattgttaattttcagccaccattcggaaatgccttttgaagagaatctggcatgagccactcagtctcacttactcccagagtttgatttatatagtattctcacttttagttatggcaatacaaatactagtcatcatttcaggctgttctctcaaactttgaatcgctaggctaattacagcctacatagcaaaataaggcccctccatccacaatcctggcatggattagcaatgttggcccacctgctccctgaaagaaaagtgttcggagctggtggactagtggccacttttcagggagctgggcagttggagatcccataccagaaggatggcagctgggaaattcagtatagacccagcaggatggaggaagggcagaaggttgttcagtacttcttccttacaaaatctttaggaaaatcattaagtttatgaaatgctaaatatgaaaaaaggagtgaaggggtggatcctctcatctgggcctgacatatgtagcagggttgaaatggttaatttctaatgcagatatgccaaaatctgtacctgctttctataagttgtctaagtatcctcatgagtcttaccattctggctggtagaaaagaacataaagttctcaagcttcttttaaaatttaaaactttttgttgtttttcttgaaaacatttccaaagaatctcaagaaactctgcaatgaattaaaattccaaatccaactttgagctgttttttccttttcttcttccttcatccacacagttatcctcaggagattggcgaagtcctcctcttcctggcctgtcatctgggtttgcgctagttccaccctcaagtggaatggtggttctcatcttttctgtgggcatctggcattggtggctactgaggcttttttatcccacttgtttgtatatattctgtattagcagctccaattgctgaaactatccactgggagaaccataatatccccatcctttccatcctgttttctggactctacctcttctttcacagatgctgtaaaacaggctcagaaccttcttccgtctgccctccacctcgctctgctttctctgggctttctcacccacagcccaggcagtgtggttattccactgtctgtgaaggtagctccaagggcagccaactggccctcaacacagctatttttcttgtacccattaaaacactgcaagattggaaactttcttctactccgggagtcaagatagaatatcagagtaaagtcatcttactgtcgtttttcgtctgcttaggttgttccttgtttacagggagcacacttcaaggcagtctgtcccaggtcttattctgcattgagaccctcttcagacatttctgaactgctgctatatagtgtcactgcctgctgaatatgggacttctctcagcagctcatgatcaacatatattgcaccttgataagaaagaagtaaattgcctacaacagggctttcccagacttatttgttcagttttcactaccttattgttttgataccaaagggagggcttggtgtctgacttctggcttcactcttctctgttccagccacctttcctaaaccagaagggcattgataaacttcaccttcctgtattatgaaatttccctgattagtctcgttgccttctccaaatgtatctttcacccttcttttaacttgggaccagaacactgggagggttgaaggtgaatacaatttattcatcagttcaaagctatctaaaagattttccttttacattagatttcatgcaagaatttaggagaggcagttctttggagatgtcagaaattaattgtcactccacatcttcagctatctcccaaagtaagagcatgctgccctcttaaaatcaagacgcatagtttatagctaaataaatgaatgcttggacattgttgttttctcccataaagctgtgtatcgtgtctctgaatggtctgaatgcaagaatctaccccatttaaaatgggacacagttgaaactggactaactggtcttcttttaccttccttgacaggcaggaattatttctgtctctggaagaaaccattacagtcatactgcattactggctcttgtagcagaatgatacattttattgccttgtttactaacccttcttgttctggtacgcactgctggcattttaaaatttggctttctatccaagccaaactgcttcttttagtggttttctttattttctatcagagcattttaacccaactcgaacaaaaccagatataaaacttttgaatagagagatcctcacaacctttgtatgacaaatgtgctttgtttctcattaggtttagctataaggtactgtctctagttcttctaaagggataaaaacataaaattggtagattatcctataggccactcagaaaatggctaattactttgtaattttctctaaatcctggctatcacagtgacattgacaaattattttcacttttgttagattgatgacaaatttgatgcttgttttaatataaacttgaatataagggtagtggttaagaagtgggccttgaaatcagatcattgacattcaagtctcaacactgccactgttgggtctgtgatcctgggcacgctaataatgtctgtagtaagattaccatctacaaaatgtagataatatttaccacttgatagaattgaactaaaacgacatgagataaagtatgtatagaatctggttcagcataagatctccatggaaagagtgaatatgttatctaatggtttgtcagatacaatttgcaacaactaattaagatggtgatatcagcattaccatgtaaaccaatcaccacaaattaaagtggtagaatattttggtcacattcacttctgttaaaggtcgtaaacctagttctagaagccaagaacagattttgtaggaaaaaagacatatttgatatggagctgtagagtttcttgaagtgtctcttgaattgtattccctgattaataaacagtgccttcctacgcatggatttgatttcatcttctacttcatactcagagtccacaaatcccctgtaagacatttgaacctagctactagaaaaaataatatgaagcataaaaactaatgaagttacaaataaattaacagcttacttgacaataaatgtgaagtcaagtttagtctacctcttaatctaaggaaaattagtaagagacatttttgtctgcacagctttgacattgagctatgtttgtgctttcatgcaatgcagattttgctagtttatttccacagttaatatctgcctctaccatagatttggcctgaaaaaatatttcaaggaaaagtttactaaaaagggtaacaaattgatttcattttatagtgaaacttcagaatcatttctctcttcctgttctttttcaaaggggtacatgcataattcgtttactttgtattgcatatttttatattctttttcctctccttatgctcttcactgctatgtttatatttatataacaggtgcaaactgagcatataatggagtgaaaaatgcagtaatatggctcaccccttccatctgggttactagaaatgcagcttgccaactcacttccaaagtacagaatattttgccacctaggaaagatatattggaatgaatataaaaaatataacatgcacatgcacatgcaaacacttatgtagccaaggccacagatacgtgatgcctgcctgcgacaatatttctgaacagtcatttaatcaacaactatatttgaggaattaatatgttcagaaatgtgacatacagtgatgatacacttgtaataaacacaggaattctgccttcgtggtgactccagtgccagtatcacccatttaatttccagctactattactaagtacttcagcaactattttactatagacattttccaagctgaaggtctctcgcagggttttctctgtaactcagttctactggaattctcccattgcctcttagcacagcaacactgtactgtaagcatgctacgaagacctgttctctggttgtagactgcaccattcgttgaagtgacattactctcttcatgaatgtgctagacctggcccagttgccatgctagagcacgttttcccctggcttgcggggaataagcaaattgaccttctcaatcattttgacagctacacctttcttttgttgttgttgttttaatttcctcttacatttctggattcttctactttcctctttctcctatgttattttcccatttctatcttgactctattttttttttttagaactagttaattttattttagaagtaaaggaatattacaaaaatagcacctgttaatttccctctttatatcacaattatcctaggtgtatcaataattaattgtatttttaaaaatgaataagaaaatatcttctaggtctgaaattggaagatcacataattaaacttgtatgtagttataatgcttcactaaatggaaagaagaaacaaaataaaaattaagctgaattccttaaacatataatatatccttaaatttaaaatatattttacaaactttgacctcccaaagatagaaaaatctatccaaacttcatttgtataacattctcttatgtctcaaagatagggattcccatctattagagatcaaatggaagaaagaaataggatttcttcatgttccaacagatttatataactttgaaaagattacatttttgtgtttccaagattttgatggtcaatttaatttggatttgactcttaaaagtttaactgacaaagctaaattaaaatgtttaaaccacatttccacattttcttcctgccaccttagaatgcactactccctttggagactgttgtaaaagccgatgtacgttttttgtggggtttttctttgtttttttttttttttttttgagatggagtctcgctctgtcgcccaggctggagtgcagtggcgcaatctgtcgcccaggctggagtgcagtggcgcaatctcagctcactgcaagctccgcctcccaggttcatgccattctcttgcctcagcctcctgagtagctgggactacacgcgcctgccaccatgcccggctaattttttgaatttttagtagagacggggttcactgtgttagccaggatggtctcgatctcctgacctcgtgatccgcccgcttcagcctcctaaagtgctgagattacaggcatgagccaccgcgcccggcccaacgtactttttattggcaagtttcctttgcatttctaatattactcctggtgagggggaaattctctaaaggaaatgtcttcattgtcaaatgcacctgatgaatacagaaaaatcctagactggtgttttaagttggtcatgttttctcaagctttctttgatgtagacagtggtttcagagtaaatcctccagtgtttctcgttgtcttccttacagtttgtttcatgtttcctttccctaagccagtgctattttactgttttgatcatacgccactatctgtcaacatttcatacaaacctataacacaaaaggacaccaaattcctaggatatagcacgtagtttatatctctcaccctttcctcacatcccctgccattgttcagttacaccctttgtaagcagacccttgacagtttgcccctgtggcctgcactgtaccattcaaatatcattcagccggtcagtcaacttgatgaattttaacatgagcctcggaataacagttttttagtctttacattagaacattcttcagactattaacatctgcagaggggaagaatggccataaaagctgggcatatcaacatttcaaccactactattaacagtgccaaagctctggtatcaagtacaatgaattgtgaatagactattaaaagctgacagcaaattaatatttgaaacaaatataaaaatttaagaatatgaaaacatgagaaaatgtttatccatatttataagatactttgtatcaaggaattatttaattctagtaaaaaaatgtcaatatttttaaatcaaaaatcaggattcttgttttgttttctactagaataatttctcattccattgctgctgtgactcttatctaaattgacaaaaatgcctacatctctctctctccttttcatctttgacatttatgaaaagtcgttcaagactatcatttttgtagtgatagtatccttctgtatgatcataaaattgtgactttctattgtgtataacaatagggtacatatatagagtaaatctggcaaactctagctgattcaattggtttacatcttatatgaaagtttggggaataggaaaatgtatacatgtaaaaaaattcctgttaaattatcagaactataattttaatttgaatattataatcacttgaacataaagtacatttaccatattccatttgatggaataaatataagacatctgccaactcattctttaaaaatcaatgctataattgtgattccaaaaaaccaagtcaacacataactactttagttaatcatttgatgactactaacaatacttactcttctattgtttaagatctaacatgagccaaatgcaatggaacaatcaattccaatatggtgtaataaatgctataatgaaacaggtgcgaatactatggaaacagagttagaagatgactaagtgttaactaaggtgaaaccatagcattagggaccagagtaggaaataagcgttaggagaaacaagtgaagaatgtttcactcaaagagacaccatgactagcagtctgaaagaaagatcatatttaagacactggatatttgtttgcttttttaataaagttgatgtagatgtggcaagtggcagatggcaaaagactgaagaattaaatagggtcagattacaaagctttaacttatgataaggcactttggactttatactaaggtcaatactaaagagtaagtgaatcagtgaactttggctctaggaggaaggcaagaccagcacagtgcataacatttaggtattattaaagtaatcgagttcagagatattttctgaacaaatgagcagcaatggttatagattttcaatcaaaagaaaattgaaatcaatttaaaacttagtttcttttaattctgggctgtgataaaatacataaataccccttaaatatgccttaaaggtcctttatttttacctctccaattgttgctctttgctactcctgattttccatcacaaaaccccaaaataaggaattgagatgttgccgggtcctaaggaaataagtgcattgggataattgtcaagaagttgggaagaagggagaggctcagtcctagagagaagaaaactagttcagtgttgtatcttttgaatgttaggtttgtatagaagagccaaactcacggtgtggtacacagacctctagggggtccctaggacatttcagggagtccacaatatcaaatctactttcataatattattaagatgttatttctttccaagatgttgacctttttactgatggtgcaaaatcagtggtgggtgaagctattggcagttaaacagtaatcaattgttgtagtcattgtattcatcacttacaataaataaataaacaaaaaacagttcacttaacaatgcccttgataaagaagtaaattactaattgtattaaatgtcaacccttgagtacctgtctttttaatcttatgaccaaacggaagttacacaaaaatagcttttgctgcatgcaaaccatctccaggaaggaggaagaggtggaggaggagtggggcagggagagggggttggagaggggggaaggggaagaggaagaagaagaacacctgtgttattgtctcggttgtgagttgaactcgtcagtttttccatggagtgccattattgtgtgaaagaactagtgagtgacaaactatggtgatttagatttgggtatttgacagacatgtcaatattgaataagatgaacctctcacttcacagaaaaccactgatagtatttgttgccaatgataaaatttaaatgttcaagtaaaaatcagaaagttggaaaattagtgtctgccaccataagcttgacatctaatagagactttcttgatgagattggaatgacgttttaaaaaaatatattattttgatttagtataatcaaataagtcaatatttggaagatgcacataacatagtgaactaatatgttcaaaatgatctatgcatgatcatgcatggataaaaaatccattcaaagagaatgctataccagcagattttaatattacacagttctgtgttctgtgttactgacttaagagttctttgtattagtttcttagagtctgcataaaaagtacaacagcctgggagggttaaacaacagaaatttgttttttcacagttctgaaggctagagatttgagatcaaggtgctagcatgcttggtttcttcttaggcccctctccttggcttgcagtcttcttaggacttctccctgtgtcctcacatggccttttctcttcgtgtgcctccctggtgtctctccttcttcttataaggacaccagttctactctagagcgcaactattatgacctcatttaaccgtaattcccttagaagccctgtgttcaaatatagtcatgtttaaggataagacctcaccacttaaggtctcgagtttgagaccagcctggccaacatggtgaaaccccatctctactaaaaatacaaaaattacctggtatgcaccagtaatcctagctactcgggaggctgaagcaggagaatcacctgaactgacagagcaagaccctatcttaaaaaaaaaaaatctgattatagatttcatgttgaaatcaacttttaagaacctagcacttgttcaattttggtatagtatcaaagaagaatgcttataattacctgataaattattgaaattcaacttcctttcccaactacatattttcatgaagagatgttttattcacatacattatcaaaacagcatatcatagaaaaattcagtgcagttatgagtatacagccatcttctgtaagccacacattaaatttgcaaaactttacaaccacaccactattccactatcctttttcttcagagatagtattatttatcaaaaagtgttacgtttattttaattggtaaaggaatttttattatttttaatgaatgagttaataaatttctgtacaaatatctaatgtggcaaatatcaataaatatatcacacataaccttaagctctttgggttctcaataatttctaagtgtccaaagagttactgagactaatatgtttaacatctgcagctttaaaacatcagcttggattttgactatctgtgtttataacttttgatcttcctgaagatgattcatcaatgtcaaagcacaagtaagaagaaattagtaaaaggtaaagaggcctgaggaatgcctgtatttaaaaccagaaggaagagaatgagctggcaaataatgattagtaatacctacctttttaaagtactatactaggctctaggtacacagaaatgagcaaaacaaatgcagcccatgccttaacgtagcctatggtccagtggaaaaagaaagggaaaacaccttttcatggaagaccagaaaaaagcaatttcaaggagggagtagtgagtatcagttattgcaggtaattcagttagatgaggacagaaacatggtctctgtgacatcagggagtttagtgaaggtgggcttgctgaaagcagtgagttaagaatgcacatgaattctccacacgtgccttttcagcattcaggaatggatcatctcgcaattcttgtgtcagatgagaagggatagttgttcagagccattggagaaaggaatgcttcttgattacttagcctcagtattattttttgtttcccatactcctaagatgcatattaaccatgaattagcaggacttgtacttttacattatctaacccagcatttgaattatatctgttgacagacatcaaaaatatcccacttaactgtcccttatgtacctctcctccctttctcttgctgtccctctcttttctctatctctcacacacactcacatttgcacgcacacacatccacgcacataatcttccatactctactgtttctgaaaccttggatatgtgtagtagtagtaggattatcgcttcatgcaacagcataaatcactcgatgagttctaattcctaaaacaagtagcttctggatgaatctgcatttaactccattaaatatatgctcatgtatcctagatatgtcttctgaataaatcagaacatgaatattttcaccgtgacaaaccttcaaatatttgaatattgtcattacttgttccttgagtatttggtcccccattgtaaatatcaccgtttatttcaaacagtactcaaatgacaagattttcattactatatccatcctggtcactcccctcaagacatattctagtgtactaatatctccgtaaagattgccccagaatgacaccttgtgttttcaggtgtgtttatagtagtatatgtacattgggattcttgtgcttcttgacacagacacttcattgcttttaataacctaagaaaacatcatatcagtgtactgtatttgtctagcattgtgtggataatgcttagttttggggaggcatgtggtaaaacaggatacttattcatactttttatgtgtttgcatgtatgtgaatacacgcacacacacacacacacacacacccctcattttctgaacgtaacttaaaaatagcttttaagagaaatgaaaacatagctttttgccaagtggcactactgctgataattatgggtataatttgttttgggttttttgtttgtttgtttatttgtttttttgagatggagtctcactctgtctcccaggctggactgcactggcacgatctcggctcactgcaacctccacctctatggatataatttttatcaaagggaaacttccctggggttgccttgcttggacacccctctctgtccactagagaattattcctctcatctgcagtctcttccttttcagtgtgtctcctgccttactttcagatctatcattctaggtccaaatcgactcacttcactgcaccacttcaaaacccttcacggttgcccatcaattgcaaggccaaatctcaactcctcatctgacttccatggccttttacactctggctcctgctgctgtctccctccttgcttcaatcacacaggatgtgtggctctcctacctcttgctgtgacttttcagacacacaggaaggagatttggggaggttgaaaaaggtacaataatccatatcgtgtggacgctttttcaaattgtacatgtccttctcactcttctcagagatttcatatttcccagcaggggtgaagaaccctgttgagcatgactgcagcccccaggcactgttaatactgagagggtgccacgtcccctagctgtatgaaaatagataaaagatggaacagtgctgctctactgtttgctgtataaaatccaaatctttctttagaattctactcaaatattaaggcttctctgaagctctctctgtctcctattatcaggagttatgtagcacattgtgtttggttaaactatttcagatgactatgatctggccattttggcccacaagaaactcactgtaatatgcttcaatctactggtagatccatacagacacatctcactgcattttaatcctttgtttataagcctgtcttgaacttagactgttaccccttggtgtaaaaaatacatcgcatccctgacaaccagcactattgcctggcatgtagtaaatgctctgtaagtattgaataaaatgatatttcctatcaaaagaaaaacctaatatccaataatagtcaaataatgatactttgtagccatgaaaagtgtaagttgagcattaaaatcatgaacaacttgcagtagtacttatagtctaacagcaagtttaaaatatgcaagaatgtttatgcaaatagacaaaacatgaaataaaagaagttttagggtgagtgatgatgggattatttttctcatttacaagtatttttaacttattgtacatagcaagtatgtctcatactattcactcactaccgagggaatagcatgtcttaaatctttgtacctccttgcaattagcacaatacatgtgtgttacagatgatcaataatgatctgttgaatgaaaattttaagtgccctagtgtaatgtaagggaaatcatagtcagaaaatattttgttaagggacctcaatgagccaaatccaaacttgctttattgaattaagaagcactggtgaaagaagtaaaaatgggtcctataccattcaccgtcttactcccagacctcacaacgtatatactaagcgtggttatgaggccaaacttcctaagacagtttgagtaaaacacaagaggcatctatgggaggaaaaatttcaagttcttgttgattttgctttttgacttttttgtcccctttgtggtgtgggtaaaattatcaaaaggataaaagcagaggtgcctatgcctagtgtacttccatttctttgagtgctggcagtgtacagttttcttagatacctagagcagcttaagaatccactcttgacccctgcttgtcagcactctgtctccgctccagaatgaacagaggctatgtttctagaaaagccaacttcttctttgttgatattttctttctcatgtcttcttcctccctctatactaattttctctgctgtgaagctcgcatgaattaaattgcagtgaaacgtagtggcaactgcagtgaaagaagaaatggttaaatcaagaacttctattctggttggagtttattacttccttgtctttggacagtggcctcttgtggggacacaactgagagagctcgtcatagctcatgggtcccaatgtggtgctttgacctaattagtttattttcactgctgtgtaaaaagatcctagaggaaaaaaaaaaatagacttttccaggtgtgagctattaccctaaaatagcatttcccacctgcactagtctgtgatcattgtccattagtagatgtcagaggacacattgtcttctatccaagactcataggattggaagacttgaagaaaaaaaaaagaataatggtatattttcatggtagaaaactattcctatgtaatctgtaggaggaaaatataaaaaacctatcttgcacattttaaaactagcatatagaataacaaacaataaattttatttatttatttatttatttatttattgagacagtctcattctgccacccaggcttgagtggagtgcagtggcttcatctctactcattgcaaccaccacctcccgggttcaagtgattctcatgcctcagcctcccgagtaactgggattgtaggcgtgcaccaccatgcctggctttttttttttttttttaatttttagtagagacagggtttcaacaagttggccaggctggtcttgaactcctgacctcaagtgatccactcaccttggcctcctaaaatgctgacattacaggtgtgagcaactgagcctggccataagcaataaattttagacaagctacctccattctttccagtttacattatgttttagaaagccatttttttttaacatttaaaagtaaccaggtacagaataagaaaatcatctcattttctaagggaaacagtataaagcaaactgtaatgatgattaaaacaaacgaataaccctattacaaaattaattgtgcatttatacaattcagaatcaatcaagacttagattttacattaacagtaagaaaaaaaatcaaaagagatctgaaccaccgaacagaaccataatatcttctggcatgtctaaccagtggatatatatatatatatagccagtctcaatgaagctcatcttctctgccttttctcactctcccattccaatggagtatgtttgtttgtttgagtgtttgggcaattgatgtgtttttccagttcccctagtagagcttattgcactgttaagccactatgcagtatattaaggagaattagatcccagaatttagaatttgcagccatgtggtaccttttctaatcagatgaaaatgtcaagaaattggtctaagagtagagtatgagagccgaaatgctgaatatcctcaatttcaatataaataaagatttgagaattatagtgtttgaaactaaagatacaaatagtaacaaaagggaagattttaaagctttatttttgcatttgaggtttataagctattattgctactgtatattttaaaaatatattctttccaataaaaatattggccatcattcttgttgccaagaataagaagaatatttaaaaagtgaagtatgacatggagtaaacaaatattttcgtaatggactttaatatgtactcatcattaagaaattaaagataatccgtaaataaaacaatgacaatataatagtttagagagttaagatttaggaagtagtagataaaataattatctgtgttatgcaaatataatccttagaatgcaatatttgattaataggagttgtcctatatgtcattcataaacttgtagcagagagaaacctctgcataagctcaggtgttcaagtatgcaagaaacacagttttctgtattttgctcttgctaaacttaatttgtattctgggccctggtttcatcaagtggcagaaactcaatctcagtcagccctaactgactatcctccaggactctgtctacaaaatgccaggtggggggccatctggccctcagtgtcatcagccacccctgctggcacccactgagacttcctgctctgtggtcactggtccttgtaggttgccactgcagcctccttgtcctcattccaaggacacattaggccttctggctctatgagtatttttcactggagaaattttgcttctgctgtactgcttcaggctaaaggcaactctgtcagctgtctcagcccacatgcccagtcaaactttgctctttgagagccccaattcatcaaaggttttagtcattctctttcagtatggagacttgatctatggatatcagtaaagcactctctttctcagtgatgtcacaaatgtctagacatttcatttttgctgctcattttcttcctcttctcagcctatcgaactttgccctggagagaaagcaaatatgggaaaaacaacttctttactaactatgaattcttccaagtaattttgcatttttgaactcaaaatctaataggtaattttatttctgttgaattttaatgtatcagccactactggagacaatcaatatacaacttttttttttttttttcagtcagaatcttgctctgctgcccaggctggagtgcagtgactcgatctcggctcactgcaacctctgcctccgagatgcaagcgattctcctgcctcagcctccggagtagctgggattacaggcatgtgccaccatgcccagataatttttgtatttttagtagaaacaggtttcaccatgttggccaggctgctctcaaactcctggcctcaggtgatctgcccaccttggcctcccaaagtgctaggattacaggcataagccactgtgcccagccccaatatagaacattctaactgctgtctgaattaggggaaggccataagctaaaaaaaaaagatactaagtgcagaattagcattgataatataatgataaaccaaccccctagagataaatgtttaggtagtcagataaaattaattaaacctatgctaatgtatttatacatatgatactgaacagtatagtgatgtttcacttatttccatactggatactgactgatatagaatatatgtttctagatttgaaacttgttcttgtagtaaccatttgaaaaaactgaaaacatcagcatcacaacagaatgaagctctgtgtaatcaaattctgaaagcctaaagaaatgtgatctgcctttatccaataataaattttgaagtgcctctgagaattaatgcctcttggatgatgctccctaaaaaccacttctctgacctgaagaattagatgttggagagcagagattctgggttgcagtacatgatgaaggtctggaaagtttggcttttattttggtcattgaagttaaggcacatgctttggaaaccagatgagtggctgtcatttttggcaaatgattatgaaactgaagagactttagagaggaccagcccatatcacaacaaaggtgttcataggcagccttgtcatttttctccaagaaacaattttagatatttggcagcgcatgatcaagtgcttaatttagtacccagaatctcacaacatagatagtattagtaattgagaaaaatttaatccaggtattatcaggagttggccatggggatgtaacagttttcacaatcctctcttgtaacatcctgtacttgctggtatgactcttggtatagcctcctgataataatgtgttcactgcattcagccttaaatggaatcattttatataggccaatttgagtaatattttccaaagataaaggcaataattatgtgtagaatggttacactagagaaataactaatagtaaatagattgatagatatatgggatggatagatagatggatatatgggtgtaaatatcaccttcagaaaataatttgataggcactaatactagtgggtcttttttgtggctgcttcatggtcatagtaataaaaccatatgatgtacattacaagaattcctgcatattaattaaatctaaaatgacttgtcatcataatgtcacacatgaaaaaatatattatgggaaggggaaagtagtgatctgccaggatatctttctttgattcctgtggcattaataatcagattttattgtgctcattcaacctgacccagcttgtttcttttcattttcaattcgtgtatatagttatttaagttataaatcatgttatattattttaagcaaattttcccataacattcatgaattacttaattcacaaatatttattaactttcttattcatgtcagaatcctgttctaggcacttaaatcttgttcagcatggctgaatcttagtttaagaaggtcaatagtggaatagctatactgatgattctttgctctttatatgaaatatttggacgagaagactaagcctgtgctttattaagaaagtagtcatattttgaaagagactgagctttgcattgcctttcagaagaaattatggttctttaaatttatattatatgttccctgtaagaaattaattaaattagaatttttttaggctctagagcctaccaattaaactaggatttaaattggttttcactcagaatatcttcacctagtgttctctttgttctgaaatatttaatcgaaatagtgatgttaggagaaataattgagatccaaacacagaagcactttttcttttatttttatttgaaatgaaataattgcacatatttatggaatgcagagtgatatttcaacacatatatatggtatgtaatgatcaaatatgggtaattagcatacccatcacctcaaacttattatttctttgtattgggcacattcaaaatcttctcttccagttatctgaaaatatacaataaattattgtggactgtacttaccctacagtgctgtagaacactggaacttatttcttacatctagctgtaattttgtacctgctaaccaaactctccatatcctctcctctcccatatccttcagggtctaatagccacaattctactctctacttctatatgctcatcttcttatctcccacatatgaatgagaatatgaggtattgtttagctttatgtgcatgacttctgcataatatactgtcttgcaggctcatccctgttgctgtgaatgacacaattccattatttttatgtctaaatagtgttccattttgtatatctacactttatcccttcatctgttgatggacatgttggttgtttccatattttggctattgtgaatagtgctgcaatgaacatgacagtgcagatatcagaaattatactgatttcatttcctttggataaatatccaggagcacgattgctggatcatatggcagttctatttttaattttttgagaaacctccatattgttgtccttaatgccttactaatctacattcctaccaacagtatatgagttcctatttctccacgctctcaccagcatttattatttgttttctctttatgataataaccattctaactggagtgagatgatatttcattgtggtcttgacttgcgtttctctgaatattaggatttttaaaatatatctgttggccatttgtatatcttctttggataaaagtttattcatatattttgctttttaaaaatcagattatttagggttttgctattgagttttttgagttccttatgtattctggaaattaaccctttgtcagatgcataggttgcaaatattttcttctatactgtaggttgtctctgtactttgttgattgttctatttgctgtgcagaatctttttagtttggtgtaatcccatttgtctatgttggcttttttagtctgtgcttttgaggtcttatccaaagaatctttttccagaccaaggtcatgaagcattttctctgtattttcttctgttagtttcatagtttaggaccttacttttaagtctttaatccattttgagttgatttttatgtatggtgagagacaggttctagtttcatttatctgtatgtggatatccagttttccaagcaccatgtattgaagagtgtcccttccccaactggtaagctttcatatatccctagtttacatctttccataatgtctcttctctgaagatatctcctattattttattcttgcaaaataatctctgtaatatcacaatctatttttcaataagccagttttcagaaatactcaaaatttgagactatcaattatctctgtctatagtaattcttcagttggttgaacagtagttaggaaccttcttgctgttgattcatcttctaatacccacacagatgtgggtacatgaaaatagaacaatgcaagaacacctcacattaccatcacaactgataatttcatggaaaaaaaaaataaaccatttccttagctttggaaaagatgactagttaatgaggtactggataattttatataaatgtttaaattgagcaccgttctgtagaatcaaagagacctgcatttgcatcctgaatttttcttttctagatgtattaaattgtgcaagttatttaacttttctgttacatagtttgctcatctatgctagtaaaacaagcctataggttattgtgaaaattgaattagtatgaaattttttagagacatgtatatggcacatagtagggcatgtatatgtatattccctttatttgtggcagcaacaaatggatacaatcttactcatttaattcttctggaaatagctctttgattttgaggctcatttttcaaagtcaggattatttttaatgctgagaatgaatggcagagtgggctttgtttgcatttttattatgtaaagattaatataagctttataatagttgtaaaataataaatgccttgtaaaaataaatgtgtatgtaacagacaactcagagaaaatgggacatagaaaactctcttttatgtaacatgcagttaacctgtagaagattttcctgtatctagttagacaactaactaattgctgagtgagttaaacaattggacagatatggaattaacattaatagggaaatatgactgtgctttagggaatatgcttatcggagataaagaatgtgcttaaaatttatggttatgccacactctgcccatggctgtaaatttctttctagcaccttggctattgttgtgggtctgtgtgaactactaccaagttggcagccagctaatatccaagaaagttttctctggtctccacccattatcttttctttttggttaactgacatccagggaggctcacttgacctgagaacaagaaacagtttttagtaaaaagtaccagacacaggcatatacttgtttcctactgaaacagaaactatattattacaactcttgcagagtctacagaggaaattcagaagttcctgaatcaggggactgactaccaaattttcaactcacaaatagaatcccccacgaactgccctacctggagttatccattaacaattaaagaactgaagaaaagctttatggtctggaatctcaaggctgctgtccatgagtctaatccagccagaacatatgctttgtgtgtccagcatgataatttttgttaagaacattggttgtgaatgcctttaaatgaggcatgctctgcctagttttacggcagtcttcactgaaacagattatcttaagtttgtgaatttgagattgcaactcctgatataaaataacttttctttaattgaggaagaaaactagaagtagagactttacagaattctataaaatacaaaatggcatgcaaaagtaagtggtgacctaaaagtcaacagactgaaaaaaaaaggaaaataacaaattatatttgaagcaatatataaataaagtattgaacatcatgatttatgtagttagaaattatttgctgggtgcatttaacataacacataaaatgatatttacagacacccatctaagaagtcacacaaaaacattttccagaacataaaatggttttgtgattaggtccaacagcatgtgaaatgtaagccatcaaagccctttgtacaaaggtggccagtgtggttggcatggtgtggccatcatttccagcccttgctttaaagcaaacaggaaggaacaattagtttcaagctatttggactttaaactattaataaaagtaaattaaatttaaagaagaaatttaagatctacatatgttctcataatcactaatggctacttcactttacttcgttctaggagatagagtgcaagagtttgcatgcaggtatgtgcttgaatttgtctgtgtatgtttgtcttactcattccatcactttcaagtgtttctgggctggtgccttctagtcatgaacaacctaagaaatggagtggtgtcgactttgatagagaacctggggtgtgttctccactaatcaggatgagctgtgctactcaacttgcatttgtggcacttgctttcccactctgtccctcaaggcaaagttactgtgacagaataaagagtgagatagaagaataaattctggctttgaaatattagatatggtttcctccccttttctggtttcaaaccctcagaaaaatttgaaggtttcactggataacaatctccaagaaataacaataataaataataataataataataataataataataataaagtaattgctttacgagggataaaaatatgggtaagacattggagtctcagcctctttccatggagacattgacattatcataatttccttactatttattctcgtggtttataaatctctcctcagtgatctcctcattgcaggttttcccccaacccaatcatcttatgaatgaatgccaaattcatcttcttgaatcatatgattccttatttacaacactttcaaagtctgatcatgccattcctcaattccaatactttcaaagacttctcatttcctacagttaagactcattttttttttctgcgtggcatttgatgtccaatacctaagctcacttctctcttctttctttagtaagccattctctccaggttttctcaactggagtgcttttggcttttctagggggacaacattttgctgtgtgtcactaattacagaattattagccttcttggcttcagtgcagttaatgccaacaacacttctcagtcattgtgacaaccaaaaatgctcccatcaacttctgaaaccccaaggtggtgtgctttactccccttcaagatctgctcttgaactttgtttgccttcctgccttcattccttgctcctgctgtttccttagcatgaaatgtcactccctcacatcttcatacccttatccatgatgcattaatgaagttaaccttgatccctagttcaaagagatttcttcttcctgaatggcaaaggtgattcctattcactgagcgcttaccacatatcaggcattcttgtcaggtgctttctattgcataatttccacttaaaattgtgcttccttgctcatagtgagttgtgctgaaatttgctcactttggaaggacaacacctccctccctctaccatcttcctcccaccagagggaaagttagaggtgaaatataggatctttagtattgttagtacttagctttcagctgtttctgaggtacaaagcaccctttactaattttcataaagtcagtatatggacttagctaccagctagatttgtctttttctttcctcatcttctataccagatcagtgtgcccttacatcaacatctatatctgatctatcttcttatttcctaagaaccccagcagagtacactgggctctcaaataggcctcaaaaatatttgctgtaaaaccctggatactcaaataatgaccaatgtattccaattttaagtgcttattttaaagagtaaagatgtggaatttcaaaatcttggcttttgggacaaaggatggctgagaacagcttaaaaccttaaaactaaagatatttaatggcattaatttcaactttttaagcaaatatataataatgctatacactaaaactaacatgaaatgccaggaaaagtttaatactttgaggatgttaaggtgtaatgattcagagaacataaagaaggatgattgcacaattcccattaacatcaatgaaattcatatggtaaaattaacacttacctcagtggaagcacgacctcaactgtcattgggcatgttacttttcatggtgtgtgcttttctcctttaatttcaggcaatttaattttctgcccacttcacaaagaaatgtcaggctgaaagactagagcattgatgttgaacatctttcttcacacatggtacttacagtaaaattgattttgttatcctcgatatcactaaataaaggcaagaaatgcaatattctttcatataaactcacctttgaaaataggaatttgaagacaaatgacagtcatattcataaaacatcttaatagaaatgtgaaattttaaaagtaaattttaagaaaagtaacaagtaaattataataaaaagtaaacaaataagaaaagccattgttgaaaaacagtaatatttttgtgttcctctaaaatttcaggatggactacatagaaattcaaaagtaatgaatacatggattctgtgtttctattaattttcataagtcaaatagagaataatggttaggaggacagtctctgaatctagactgttcacagattgggtctaccagttaccacgtctgtcatcttaagcgagttacatcatgttgctggacctgtttccttattgagtaattgtaaatactggaattactccttcataagattgttatgaaactgaaataaattaatttaaaacacttttaagactgcttagcacatagtgaatggaaaataaatgttcattatgtatattatcttatttttaacatgatagagattttattggaagaaactaaagataaaccaacagttatcacactagtttcactgctatgctctttcaaaatatatctggcatgattattatttttattatatatgaaggaaaaggaaatcaacataacatgtatgttatataattatttttgaggacttgatttgtaaatctcagtaaataaccaagaatggaacctattacttaatctgtatgaaatgttttatctacttacccctctcttaacccaagacagcttttcaatcaagctgcttgaggaccatttattatgaaattttgcatgcttatcacctaatactactggcttggcactagtaggcactcaataaatatttgtttaatccattaacctttatcaaaacaaatattccaatttattcatatatcactccatctagccagtgcacccaagcatccttaaccatgtcctggagtcttttctcttttgtcttttttatctgaggagcagtctgagcttccctacctcttgatttgtttgcagtgctgctagtccaccctaatctctgcctgctcaaaacttctctcaatgcaattcagagagatagagtttagcactacagtgacttagatgtatgttgaatttgatctttaaataaatcatatgcatcttaagggcacagatgaatttgatgattcttttgtgacatcttgcagttgatccttaacaaataattattagtagataacaatcaacaaccaatccagtgtttattcttacctgccatgttaatctctccatttgaatctacttgaattattctctttttgtttcagtgttggagtgtaattgttccagcataaaagaaaggaagatttccaatattataccatattataaacacacacacacacacacatacacatacacatacactgatacactcatacatacaaacatatacattcacatatatattttcatgggaagttatggcaggattttaactactgattcaggaacactaaatgagtgcatatttcccctatactcatagatgaactggagattaattcaggttaccctgtactcaagtttctcttgttataggggaaggcggatggcagagcaaatactttggagttcactatgggtctaacgtagctaataattagttgtaaaaatcattaagatggaattgacataatttcacttgcaattctaacatggcattttgcatttctaaaaacttgatttagctggaccggagtttctaaagaattacttcaggagattcaaactttcattcagttatgaaacaatgcagtgttttactttataaattataaccaaatattttataataaagatagctgacatgaattgaaggagaaactgttttatcctcattttatatatgaggaaagtaaaagcccaataagttaaataattactcaagaaatggataagccagtactcaaacttaggaagttggccccaaagcccatacttatactatactgacactactgacagatatcactagttacctaaacaagaatccatgccacccacttcctttgtgagatcccatctgtgtgacattcacgttcttagtctctctaaaggcaagaatggatatataacctagttctggccaatggaattagaagaaatgccttctaggtctttcattttgtaccctggtgaaaaaaaaaaagaaaaaaaaaagaaaaagaaaaagaaagacttgttaaagaagctcagttttccccctaattttagacattgatgtgtgaagatgtaatacttggagcttccgtagccatattgtaactgaaaagaaggtcaagaaaattatagaagaaatgactcagaggccatacatttttaagcatctgaaccaaccctgtacctcttttcttatgaaagtcctgtctgtgagaataataaactttgttgcttattgctatttttttgtattcttacctgcagctcaaaactgcctaacagatgaaaatacgaatttctaatttctaagacattttacattttcagtctataaatatgacattttatttattcttgtaaacataattagtattctcaaatgaatatttctaagcatcttaaattcttttgggtttccaaatggatatgattatatttttaagactgatttttttttattttttattatttgtttttctatatatgctttattctcttggccagacatggaataaacacaacaattttagtttttgaagttcaggttttactaaatatttttgagattagataaccaccttgattcatgaattattagtttgaaaatatgatttatattgcattgagaaactggacccaaaaaaccttgattttaaaaaaattattatcatagtttaagttctagggtacatgtgcacaacgtgcaggttggttacatgtgtatacatgtgccatgttggtgtgctgcacccattaactcgtcatttacattaggtatatctcctaatgctatccctcccccctcaccccaccccacaacaggccccagtgtgtgatgttccccaccctgtgtccaagtgttctcattgttcaattcccacccattaatgagaacatgcagtgtttggttttctgtccttgtggtaacttgctcagaatgatggtttccagcttcatccatgtccctacaaaggacatgaactcatccttttttatggctgcatagtatcccatggtgtatatgtgccacattttcttaatccagtctatcattgatggacatttgggttggttccaagtttttgctattgtgaatagtgctgcaataaacatacgtgtgcatgtgtctttatagcagcatgatttataatcctttgggtatatacccagtaaacggatgtctaactaattttatgagatcagcatcatcctgataccaaaggctggcagagacacaataaaaaaaaaagagaattttagaccaatatccctgatgaacattgatgcaaaaaccctcaataaaatactggcaaacagaatccagcagcacatcaaaaagcttatccaccacgatcaatttggcttcatccctgggatgcaaggctggttcaacatactcaaatcaataaatgtaatccatcatataaacggaaccaaagacaaaaaccttgatttttaaaatgtggatctatttgactttttatttcatgtaagaatcactgttaggaatatgaaagtatatttcagcttaaatatagtgacattctgctaccctatatttaaattgaacctaaattaaacttgtattaatcagtatctgtcacatgaactctaccagctccctttcacctaaacaaacagtcacacacaacgaaatagaaatcttttctcagccaggcgcggtggctcatgcctgtaatcccagcactttgggaggccgaggtgggcggatcacaaggccaggagatcgagaccatcctggctaacacagtgaaaccccatctctactaaaaatacaaaaaattagccaggcatggtggcaggtgcctgtagtcctagctactcgggaggctgaggtgggagaatggcgtgaacccaggaggcggagctttcagtgagccgagatcacgccactgcactccagcctgggccacagagccagactccgtctcaaaaaaaaaaaaaaaatattttctcctctttaaagatttcatcttcagataaccccatacttatccacattaccctactggcctttctctgaccggattgaagataagaattaaaatcatttaaggagattttagatctatgtaagacagagtaatctgttcctagtttgtctgaatttgtgtttgttttcataaaacattggtttattaggagagaaacattttaaatatttgaaaatacatcttcatttaaagctaagagtttaatttcattgtggtaaactgggatgtgaagacttagatttattaacattaatagaagcaaatgcttaatttctaagccattaagataatcattccttccagagaatttcagttgaagatcagaaagtccttagttaagcctgccactcactctataatttacttacagtgcctgactacctatgacatcaaagtacataatgctacagcccatttcaaatacaaatctttaatgacaaagtgacagttgcagccttctgtaaataaaagcattgagcaaaactcagaggtttagatgtatcactgcgatcactctttataatatgaaatattgaagagaacaaattgataagaatgccaaaggcaagacatcatatggtgtcttctgaagattctatttaagacacatttaaatacatgtgtttgactccagtgaaggaagcatttaactctagtgaagatcccatttgggagttgaagtagcactcattctctacctaagtacataataggggttcagtaaaaatttactggttttcaccgggcacagtggctcacgcctgtaatcccagcactttttgaggccgaggcgggtggatcatgaggtcaagagatcgagaccatcctggccaaatggtgaaaccccgtctttactaaaaatacaaatattagctgggcatggtgacatatgcctatagtcccagctactcgggaggctgaggcaggagaatcgatttaacctgggaggtgaggttgcagtgagccgagatcgcgtcactgcactctagcctggtgacagagtgagactccgtctaaaaaaagaaaaaaattactggtttgtattacatggggtgatggagtggaaaaggagaggggatgggttgggaaaggtgtagcctcaggaaaactagcagagaaggagtactaagacctcacagacaatggagaaaagtccttcatgaatttatgtgggaaagacactaaacaactatgtatgtacaccaatggaaaccctgtattcagctgcagcatgcattctaaagtccatgccacatgatctgacttagaatcattaaaagaagacaaaggaaatacaatttggccagcataactatgaaaacatttaaaggagtaggctttagatcttgtttgggatagagctaatttcctttgtctcatatttccataaagaaatgacctactgatctactgcccaagagagaacaatattaaagtgaattaatattgttgctgacgcctctcctactcagccttcccttaaatgcaggtggagcgattacttattgatgatattaaggaacctgatgtccaatggccatgccacaagaatcaatggaatttctttgcgccaaaaataaaaaacagtcctctaattcctggactcattttccctctccttccttcccttctcctatccttccctttttccttctgtctattgattcttcctcaagcaaagcatcacctaccctcttacccacagtggtccatttggtatttgaagtaggatccctggatccctgagttttccactgctgcatgtaacaattacaaagccatactttatctagattgttatatggcccctgagtctgcctgcaatttggttagaatctataggaggaaaaaggtcaacagcttgacttaccctaacgtccagtaaatcaccaaatgctaggaagcacgagttattaaaaaatatatatatattaagaataactctgttgacagagtagggcttttgagtgacaggcatttttgttatataattctttgcagaagaagtgagaaatcaataaggccatgtagcttatttagatgtttcttataaacaattaaaacaatacaaataataataaacactattgattgaatatatactataggacaggcactgtactaggccctatacatttattacatcaatttttccaaacaccttcaagctataggttgacaaactctgattcctaagtaatgactacggttttcgcagacgtaaaggcaaatgagtgacgtaaggtttataaataaaaaacacatgtctcacatgatcttacctcccctccatgcctatttcaggctttcctcatcaattgccgcacaatcactaccaatcaatctgcactgaccaagagagatgaaatttattcaccatcctggtgctgttgtaactcgtgtgttctcaactcttgatgtgctatgctccagtgtcactgaaaattctagaaatctcaccagcttagaagaattttcaaacagcaggtcacagtctaagctaataggtaccgattaatcaagagtcaactttagcactcttcctgttttgtgaactgtttagatagtctataaggctaattattcaaactacaacagaaatcgataacacatttttaatgaaaaaatatttttaaatttgatcactttcttcctatttaatcttgttattttacagactatgagagacaagaaatacaagtatatagaacatatgagaatataatggaaacataattgaactgcataaagttttaaaattgaagagctatcaagcgtagtgacttagagcacaggctttggtatcaagtagctctggattcatgttctggttcttcctttctgcatccttgtgcaagttacttaatctctgtattccttaacatcttcatcagtaaaataatcaatgacagccattgcatacacttggtggaaagattgagtgaaataagatatttaaaaggcacttacactcggagccaagatagccaactagacacagccatttggaacatgtgatgctgagggactggaacatcaggtagactggcagattccaagcagatcttcagagggaaggcactgggagtggacagagggaggatacagacactgggctgaaggggaagggagctgggaaacctgcacaggactactgagcaccaggacctgttcctggcctccagcaactcctggggaagaagtgaatttaatagatgaggagtggcttgctctcacaatgaacctctggaatctgggcagcaagaagccctgacgcccccatggactcttgagttggtgatgagagatgcttagagcagtgctgagagcaggctccagctagtgaagagcacagagggtttggtgtgtcaacgttagcagtggagcgtggccagtgatacccatcgcccaaggctcaccatgttctctaggagactttagccatggggtaactgtaggaactaggtagagcagggcggtcatgcccctgagatggagccagtaccatctgagcaccctctgtctgctggcctctcctggggccccaacctggccattcctgctaggcagcatggcctcagatgctcaaacggggtgctcctcaagagtcctcatcgtagctcctttgccagtgactatgcctgaccattggagagctccagtagaccagcccttgacagtgtgtgccagtccacctgatcatctctctattgcagcctgcaccatgccactttgccagcacacactcatccaaagccactccccaactgctttgctggtgcatgtgtgtaggcagaccttgcctcttctcccccaccactgtgcgcatgtaccatgtcataccaccactaccagaatgagcacaacccagtgccctcccccagctgatgtgtgagcactcagccataacaccattgttggcaggagcacacatatggactccagagaccctgtcccctctcctcactccagtgtttctgccaccacagtgaaccagctcatgacactggtggtcccatcctccctgtaccaccaacctggtaagtgagaacatgtgcaggaatgctggtgaccccacccaatcctgcactgccactgccaccattgcgaatgtgcatacaatccaccataaaacgatccttagcaaattcaaaaaaccaaattcataccaaacacatgctcagactacagtgcaacaaaaatagaaatcaatactaagaaaatcactcaaaaccatacaattacattgaaattagcctgctccttaatgactttgtagtaaacaatgaaataaaggtagaaatcaagtaatgaaaacgaatatattaatactagaatttctcggacacagctaaagcaatgtaaaaagggaactttatacctctaaacactcatatcaaaaagttaaaaagagtccaggcacaatggctcacacctgtaatcccagcactttgggaggccaaggtgggcggatcatgaggtcacgagatcgagaccatcctggctaacatggtgaaacctgtctctactgaaaatataaaaattagccaggcatggtagtgggtgcctgtagtcccagctactcaggaggctgaggcaggagaatggcatgaacccaggaggcagaagttgcagtgagctgagatcacgccactgcactccagcctgggtgacagagcgagactccgtctcaaaagaaagaaataaataaaaagttaaaaagatctcaaattaacaacctaacatcacaccaagaactgaagagacaaaagaaaactaaccccaaagctagcagaagacaggaagtaacaaaaatcagagctgaattgaaggaaattgagacataaaaatccataggaaagatcatgagcccaggagtttgttatttaaaataataaatatgattgatagaccactagctagacaaagaaaaaagagagaagagccaaataaacacaattagaaatgacaaaggagagattacctctgaccccacagaagcacaaaaatccctcagtgactgctacaaacatctctgtgaacataaactagaatacctagaggaaacggataaacatctaaaaatatgcaacctctcaagattcaaccaggaacaaattgaatccctggacaaaccaataacaagttccaaaattgaatcagtaataaaaagcttaccaaccggaaaaaaattcggaccagatggattcactgccaaattctatcagatatataaagaagagcttgtaccattcctactgaaactgttccaaaaattgagaaaagggactcctccctaactcattctaggaataaaaggcatccaaatagtaagagagaaagtcatcctatctctattatcagatggtatgtttctataccaagaaaacctcatagtctctgtccaaaacctcctagatctttataagccacttcagcaaagtttcaggatacaaaattagtgtacaaaaatcagtagcatttctataaagcaacaatgtccaaactgaaagccaaatcaagaatgcaattccatttgtagtagccgcaaaaggagtaaaattcctaggaatacagttaaccaaggaggtaaaagatctctaaagcaagaataatgaaacactgctgaaagcaatcagagccatcaaaaacaaatgagaaaatatttgatgctcatggataggaagaatcaggattgttaaaatggccaaactgccctaaaaaatttatagattcaatacttttttttatcaaactgtcaattacattcttcacagaatttagaaaaaaaaaattttaaaatttatgtagaaccaaaaaagaacctgaatacccaagttaattctaagagaaaagaacaaagctggaggcatcaagttacgtgacttcaaactatactacaaggctacagtaaccaaaacagcatgacactggtacaaaaacagacacatagattaatggaacagaatagagagattacacactactggtgagaatgtaaattagttcagctatagtggaaggcagtgtggcagtttctcagggaacttaaaagagaataatcattcaacccaacaatcccattattgggtatatacccaaaggaatttaaattgttctaccataaagacacctgcacacatatcttcatcacaatgctattcataatagcgaagacatggaatcaacctgaattctcatcaatggtatactggatgaagaaaatgtgatacatatacatcatgaaatactacacagacataaaaaatgaatgagatcatgttttttgcagcaacatggatggagttggaggtcattatccttagcaaactaatacaggaacagaagaccaaatacttcatgttctcacttaatagtaggagctaaagactgaatacttatggatacatatgtacttcagggttaagggtgggaggaaggagaggatggaaaaactacctattaagtactatgcttattacctggttgatgaaataatctgtacacaaaactcctgtgacgtgcagtttacctatataacaaacctacacatatacccttaaacctaagcaaaagttaaaaaaataaaagcacttagcatggggtctgtacacttatgggaaattattattattatctattattgttgattattactaaaaaacagaagttacagcatgcaaagccttcaaaccatgaaccgtataaagaaggtcagcaggctcctcagtgttttccttttcaacttagcttttatctaactcacatgcatgggtttgactataaaatttcatttgaatcaagaataatatgatactttatattttaagatgattggtctaatgaaagactatttatctagaagtaatgactaggtaggtgggtgacattgggcaatttacctaacttctctaccatgaacccatctctatgaagtaatggcatcagtttggataatattgaataatctgtatggctgtcaaggtatgttctttagttgatattatttggcattgatttggcactttaaacttcaattcatttgtacttatctttgagttttacaacattaatacctttatatcaatatagcaactagagaaattcaactatttatttctgttttcctggctaattttctacccaataacatcacaataataatgcaatttcattactatactgattattatactagctacaaatttgaaatcatatgcatgataataacatgtataaagcagcacagtaaaaatatacttactctgctatttcaccttttagactgtgttgcttttacagctggcattgagtgtctgtggcttttccaggcacagggtacaagatgtcactggatctaccattctagggtctgtaggactgtgaccctcttctcacagctccactaggcagtgccccagtgaggactctgtgtgggggctgcaacctcacatttcccttccacactgccttagcagaggttctacatgagggctccactcctgcagcaaacttctgcctggacatccaggtatttccttacatcctctgaaatctagatggaggttccacaacctcaattcttgacccaggtgcacctgcagggccaacaccatgtggaaacttccaaaacttggggcttgcaccctctggagcaatggcctgaggtatacattcgccccttttggtcatggctggagcagctgggacacagggcgttaagtcccaaggctgcacacattaggggatccccgggcctggcccagggaacctttttttcctcctaggcctctgggtctgtgaagggagggactgctgtgaatatctctgacatgccctggagacattttctccattgtcttggtgattaacatcagctcctcattacttatgtaaatttcttcagcaagcttgaatttcttcccagaaaatgggtttttcttttccactgcatcatcaggctgcacattttttcaaactttcatgctctgctccctcttgaattctttgccacttagaaattccttctgccagataccctaaatcatctctctcaagttcaaatttccacatatctctagggcaggtgcaaaatgctgtcagtctctttgctaaagcacagcaagagtgacatttactccagttctcaataattttttcatcttcatctgagatcacctcagcctggattttattgtccatgtcacaatcagcattttagtcaaagctattcagcaagtctctaggaagtcccaaactttcctacatcttcctgtcttctgcgccctctaagtctctaggaagttccagactttcccagattttcttacctttttctgagccctccagactgttccaacctctgcctgttatccaggtccaaagttgcttccacattttcaggtatctttacagcagtgccccaatctctgtggtatcaatttactgtgttagttggttctcacactgctaacaaagacatgaccaagactgggtaatttataatggaaagaggtttaattaactcagagtttcgaagggttgtggaggcctctggaaacttacaatcatagaagaaggggaagcaaacacttccttattgatatggtggcagcaaggagaagttcagagcaaaagaggagaaccccttataaaaccatcagatctcatgagaaccaactcactatcacaagaacataaaacaattgagatgtttggtaaaccaagcatgtccctaagctgccaagaaatgtacccccaaatatgcagcagaactaatttcataaagaatgtgtatctacctcaggagacagaaggaaatattaagtgtccgtgcatcttatatactaactcgttatactatgttttttatgtaggtccttgtagggagacttccaggtcacaggtttgggtctaagacacaggaaggctgaagaagcaagtatttaacatttttacctttacaaagacagtttttgataccaaccaagactcaatagatgagagagttgtcacaactagaaataaattcagattctaaatggtcagaatagataaaaatgtttaccaactcatgcccaccataaccacacactgtgtgtcaagtcttgtacctacccacagaaaatggaaatgagcagttcatattccttgatttcccaagtaactgtctagattgagggatgctcaaatacaaaatttgaatcttatgtgataggggctatgaaaatataaaaagagaatccaaggctgagaggatgaaaatacatgccagaattatttgagaatcatccagttattaactttaaatcaataatctgaatggagcagtcatcctgcatagaaaatccttaatgtcattctttaatcttttctttctctcatatatcatatctaatcccccaggaaatcctcttgactcttccttcagattatatccaaaaaataataattattattattatattattagcattattattattatggaaagacagtaggagaccaggtaggaagtaataattattatattcttaaatcacatataatttctaggaaacattatttcctagtaatatcagtatctaatatattattattatttttattacttcctacctggtctcctactatccttccataagagtttactcaaaatgaagcatttaaagttgaaatgcatatacctcagaaccttccaatggcctgcaaactctcccagaaaacaagcccaagcacttaatatggcctatcaggcactacaaaatctggcctcagttgcctccaccattaccacttccccctcattccctgaactccagccacagttgctcccttgccgttcttccgacataggatctgtgctcctgccttactgcgcttgttcttggctcttattgtgttcttatctgttccctctgcctggaatgctcttccctcaattatctgcatagcatgttccctcactgcctttagtctttactgaattacacttttttagtgagcccttccctggacaccctatttcaaatttgaatggctgcctccgcccacaacttgacatttgccatcccacttctttgctttagatttttccataacattatcactttctagtcttttatatcatttatttattttgtgtgccctttgtataactcctcctttaacatgtaagatcaatgaaagcaaggatttttgttagtgctgtgtccacattgcctaaaatagtaagttcctggcatatagtgaatactcacaactatcgtcaaataaatgattgaataataagcgtctaccagttatgtgaacagaccccaaatgaaggataaaaacacacagaaattctcctttcggctttactttttctttttgtgccttagaatttattttcctagtaatttcagtatctaatatttggatgttgtatttctatcctcatccctgtgaactcacagtccaggaatccttcttcttcttcccaaagtaaatgccagtgtaaagacactttttgtctgccaaatatcagagaacatagaagaaggagaaagctgagagtgcatcttgtacttgtttctttttcaatgccttcttccttttacatttttttcctactaatgattctcatcttcaaatttaatgtaggcagcaacataaaagctctaggagaaggaaatgctttccttgctccaacttgaaaagagagaaatccttttcctagctatattctagggtaccaacttcctccataactaagcatgtttttgttatctcggggtagacttggttgagctccccttagacagtgttattaaatgtgtactatagaccagacactctttaggagttttcaaagctggaatgtaatttaattcaaacaacaatattacagttctaaattattatccccacattacagtttataaactgaagttgggcaaaaataggaaatgtgcctaaggtcatctatctagagacggagcttatatccaaactcttgtcagcctgactccaaaaatggctctttttccactttcttgcatcctgattacaagtatctcttcaagcatcaggtcttctttttcatcatttcagtgttattctcagcccccaaaggcatccttaggttactaaaaacttaaagagaatttatttccccaccacggcctttttttttttttttttttacattttaaaattggaatctagaatataaaccacagaaacaattatccatttatttcgaacctgtttagggaggtaagttacgaaaagagataaaaacagcttgtgaaggtatcggaggcacctccatactgatgctcattttattctattagttaaagagaaactagaggcagtcacactaatttgaggttcagcctgcccctgaccactttctttctatctaaacaaaaagaaacgcgtggaagacaaaaagatctaagaggcttggcacacttctgtacaaattcaaccaagaaatgtagttctctttcttatagaccattagaataaattaataccttcccagatagttaagggagacttttttgttgcattgatatattacttggaaaaaaggaaaaatgtgccccttgtttctacttcatgctttattgttaaacctctgtctgccttttgttccactgtcaccctgtaccttggatgttcctagatgccaaaattcacaagacaatgtgctgcctattgttaaacatatgcctgcctccttggttgccactgtgttgacattagtacctttgccccgagcacccagcttaaagaggtttctgttgcagctcagctcctacaatgatttgtacctattgacaggatcgcagataattagcattggtggcttgtcagctgccactgagatcactctgattctctgtggaaaatatccacaagagcagacactttttcactagggtttctagagcaaattataattacttcttttttcaaataaaagaaaacatttcttccatcactactgtgtcttcaagcagtgaaaaacaaatggtatttcagatatttttccctccatcccctagccacgtttcattttgaagacccacagattcttacaccaatgccctattcgagactacatggctctgtttatgagcttccttttcattcatgttatttttttcaccatgtgtatgatttgagacatttagggatgctgctaagtacttgaggtgctgtttgaaattgacagagacttctactaactgtcagggttttctaagaggttcaggctgctttttcaaagaagactaaaaatatgtatgtagattaatggaaattgtgttatttttgcaatgtagaatgctattttcatttttttaaaaaaaaacagatttctgttcccatttaattctgcttgtgtcacctttctaaaatcataatcttcccactcctgtacttgtatttttccattgcagagctaacaaatcagtgtgtatgcttagtaaatgcaagaaattttaaaatatactcaagaaagttggattcttacattcattcctctttaaaaataaccaacaaattattttcatcaatatacatggagattaaggcacttagatataagaaatgtcaaacataaaattataaaattaaattcctcttacaatgccatgggatgtgtaagaagtgctaacaggtttttagtattatatctctctttagtgttgtattagtatctcatattgtatctctctacaaatgatttcattagtgttatttccttagcacacttcaaagtgattgtcccataaaatccttccccaaaaattggattcttttttgttttttttttggtatgcaatggtctaaagagttaaggccttcaacatttatttaaaatttgatatctgaagttgaatcttataggcaaggttattaaacttgagaaaattaataaaaattgagtatcatccttttttaaaagaagcatgttcaacataaatgcttgccactcaactctcttgtacaaattctagattctgagtttcattcaactttgccttgagagtaaatttacaggtaacagtaagcatattaaagagcacagatattgaaaaccctaactatgatgggtttctggccaagaggaatattaccatttctgataattctcttttaacagaataatatttatgagtacctaaacctttaaaatgatttttaaagtgtaatattaaaggaaataaaatagtctataatctctgccctgagccctatcccttggctgaaataatcatttaccttgttaccttatcctatattgtgataataattcctatttttcatacgccttacaactcctttccatgaaaagaaataaaacaagtctgtaactactataaaggcataagagatgaaaaaataaactttacaaataagaaccataagacaaaaatcataccactacagttgatttttatattttcaatgaagtgtgcaaatattgaatataaaaagcaaataacagaatactaataatcatggttgtactctgctttaatcctgttttccatatacctgtttatccaaacttacttttctactatctgtatgtcaagcaaagataggccatgctgcagtaacaaatcacagcatctcaaagcgtagtataacataagcttattcattctcttttgaagttctatagagattggtgaaggtagcatctaactttctagattgtttgagtatccactttttagatgtattcttcccccgcccttacagactaagatggttaaaccatgacttaattttaaaccttggcaagtatattgcatttttcaagacaagaagtatgtcctttttttttcaattttgatgacatagtatggaagaatgtaataattaaatctctcaaagtaaatgcaactgataccctccttctttaaagttattttaagaactttaatttttcacatgtataatctctaaagttagatgcataggtatataagcaagcattaaatttttattcattaacttttgcaaactaattggtattgaaaagtattgccagtaatacattgtgttaagtgtaatttttctacacatttgggtcactgattctttcacgttttgatgtcacttagtctaacataagtggcatttttttaactgaagtgcctaatttgtatagtgaaaacaaaattattcagctgtcagtcttttctctttactcttgggttgtaaattataggttgaaatttactagcagccactgtatttgatttgcagaaagaagcaaaggaggcatctttgatcgccacatcttttaccatttatatcttggtttatcaaaattgaaggtgacatcgcagattatattattcctagaaaaggctgcaggttggaaaagccataggtttggctttctaccatagaagggaaatctttgaatatagaaaactgtgcatgtttattattgaagggtaagaattgaaaggtagatagaagatagatagatgattgatagatagatagatagatagatagatagatagatagatagatcgacagatggatagatgaatagtagaataccctgactggctacattggataaataaaatgtttcttagttttgtttttttttttttttcttgcagttgagccttttgctttccagaagagcatataccaagccaccccaaagcacatcacaggattgcctggtttccccctagctatcatttagactatactgctatatcaaattgtattgtcagggtttttgcctctcggtgagtctgttcgtgcaagctagttggatattttgatttgactggtcaaggtaaaaaaaaaaagaaaacctacatttccagagatccaagacaataagatgactaattaatgtcacgtgattttaaaattcttattcatttatttgttccttagatgttatgtgaataatacacaatatctgtctttgggggcttaaaagctaatggttgaagaagcagacatatgtagaagtcgtaatagctctatgaattttaggggcagttcatttgctgaggtgaaggagatagttggagcaggcttagtgtattcatttctttattgatgcctaacaaattaacataaaattagcagcttaaaatcaacaattagttattatctcacaatcctctacatcagaagtctgagtggatttgactgggttttctgttctgggtctcagaaagctaacaaaaattttggctaagttcagctcatatctagaggctcaggggaagaatgcacttatatgctcattcaagctaatgacataatctagttatttgtggctgtaggtctgaggtctttgtttccttgctgccttgcggccaagggggcactttctgctcctggaagccacctgccttctttctcatgtattcccgtccatcttcaaagccagcaacagcacttggagcccccgtgtttcaaatatccctgacttcttctgccaccagccagagaaaattttcaacttttaaagggctcatgtgattaaattagatccatctagataatctccttattttaaggtcaactggctggctactgtaattacaacagtaaaaccccttttgccatgtaagataacataatcatcagagtaacaccagcggcaaaggtcatggaggacattccaaatttttgcacaccacacttggagaagtcttttttacagaggtaggtaggattgaaccccaataatttggaggaaaggacagagacaatggggcatggaaatttatgtcatatttttaaggatggtgggaaagtccactgcgcttgtctcaagacaatcaagtgatacttatcttgggttcttatacagtttcatagattttcatttctatgtagcgaagagctaataacataaggcaaaatgtgtaatcggtgtaccaaaggctgctataggatcatagagaataagcaccgagaaaaaaggcatctgattcagccctcagcaatggttggaggtattaggaaaggtttccatgaagaaacctgaactgaattcctattaaataataggaatatttgtcaagtaactagatggagaacaataaatggaccatgaaaaaaaaagaaacaaagatcaaagacatgaaggatttagagaagaagaaagtggcaaacgcaagaagagtttcagtgaaaacctgatgtctgatgagattagtttgcatgtgttcagtttgaggtgtttgaaacaaagaagtggagctgcctagcagtcagatagacctgtctgtctgtctgtctgaaaatcttcagaagtagagctggctaaatatatttaaaaattaagttaaactaaatgatgtgagcatcaccttgtatttgtagtatttaaagtcttaagtatgaaagaattaccccaaagaaaagcataagaatataggagtgagaatcaacttgctatagtaaaagagtaatgggaagtaaagagaatagaaatatgggtggagactactgtttccttaagcttgacctggagggaaatgagtaatacaatattagttttaaaagggtagatccactagagaaggatttctcaaagccagtggcaacactattgacatttggagataattatttgctgtgtggggctgtctaatgcattataagatgtttaacagctatctctgagccctaccctctagatgtcagttgcaatccccaaggtgagacaaccagagtgtctgcaaacattgcccaaatgtgttcttggagaaaaaccactcctggttgagaaccactgctctataagatgctcatgttaattaggcaatcaataataccacagttagcagaggataagactgaatactgtgagtgatccagtggggaaacaaaagcatctgttgaaaatagaaacgttcaatgaaggagtaaaataaacctaggaaaagatagagagtaatactgttcacaggatttgaaaaaaactaaaataggttggcagccagtgatagcatagccaatgattcttttatcgttggagatcaagaaatgaagccaagtgtctttttttctacctgaggacaaccagcacaatacttccaggtatgtcctggatcccagcctttcttgcaagcctttcttgccttctcgagatcattcctttagcaatgcttcctttactctctctctctcattaacaaattgcccctctctacagctcatttctataccaaaataattcaaaattctgagaaacactgcttgtgcccaccaacattaaaggtatatgcattcatttcctattgctgctataacaaagtttcccaaacttagtgcttaaaacacaaatttcctctgttacaattctgatatccagaagtctgaaatgagtcttatgcgtctaaaaccaaggtacacaggagtcctgcattccttctggaggttccaggagagaatccactctctcatcttttctaacttctacctatcacctacatttcttggcttgtggccccttatccatctccagagcatgtcatttcaacctctgtgtccaccattccatctccatatgtctttgtctttcttgcctccatctttgaaagacattcgtgattccattgggcccaccagaataatccaaaagattctttccacctcaaaatccttaactttatcacatcttcaaagtcacttttgccatttaaggtaatgtaggttccaggattaagatgtgaacatctttcggggagccattactaagcctaacactgtatattaaaaaggaaaactgtgacaatatgatgagaataatataggtcagagacataggttagaggaagaagagttagacttggacgacatttcaactgaaaataagccaaaccttggttgtgatatatggaataaaagagactgtcctttccatcagtttcttgattctcaagactaaactagaacagaatcagtgtccttaagagaattgtgctggggtggttggtattcactccattttatttacatttttatcaatttactagaaaatctagctgcttaatttctggtgcatttggaggccatcaggtgttctttaaatgcagcctctcaagaaaataaagtttcatcaaaaccatctggcaagtctacatttacaagggaacagagtggcagacccaacctgtttgggatacatatttcatgcaatatggtatcaagttaggcaaaaatgctaccaatctcttgtttgaaaatggtcaattggaggtcgctttattgctgcatgttctattattagctatataaaatttgcagtttgtttactcctttttgtcatctgcgttcagtttcataataagctatacacaacacacgttctactaagcactgacacaggaaagaaaacaattgtaaccagaagtgggtgttgatgcctaatacatgtaaatgtagcaagaaaccattagacaatgaaagttagctcccagatggtggtaccatctggaacataaatccataaaggtacttctgtagtatttttgtaataaaaaatcaggccttactgagaatttttaatagccacttacgaagttcactgttaacattagtgttgataaatgacaattatatgtatatatatacaaagttacattcatgaaggtaggctctggaagctttaggcctctgttaaaggaaaagtgtatcataaactaattggtctctaggagaatgcttgcagctggtttagtaattgggatgtgaaaaattttaattccatatagtatagaaaacaatgtttgtatataaagacttttctctttgttttcccgtttaaatccctccaaatattaactaagtatttaattttattttacatactcattgcacagccaggtgaataagaaaaagaattagtaatttattttcagctttaaagtaaataacaaattaagtccttctgctgtaatgtgattttctctacagtgggttggaaaatgagaatgacttcttctgaacatcatcataaaaggtgtccttctgaacatcattatgttaaccatgatgtagacccgtggcattccccagacagtatggtagtaattgttctctctacagataatttgcacaaaactcccaaatttatacttgtgatattccttttggaaacaatacaagtgacatcaatttagaaacttattttctgtaggctatttttagaaaattgtattctttaatggatatttaaaaggccatagcaacaacaagcctatctatatgccacgattttatttacatatttatgtattttttaacattgaattggttccactgttgctgttttgtatggaatgagagttgaagaacttaacggctgaattttaatgtgatctgagaaatgtgcaataaacagcagacagattgatttcctggaaacctgtcataatgcgattgcacaggatataggcccagctccaagcttattcttcattgattccctgactgcaagcagggatactgctgaccatgaaatcccccttgtttccatattagaacttatttaggaaacatgacatttgttgggagataacagcagattctggaaagatctttgtggttatggtgtggatacacacacacacacacacacacaacacagtacctctcatcctcagagtgccactctctgccttcaagtccctatatttgaaaattaaattgaaaacttactaacttttgatccattatgcattttattggtataaattcttcaaatgtcaagcatgagtaattcacaaaacagatgaattggatcctctcatttgtgaagctcagcacttcatctttgtcgtacctctgtaatggaataggtttagttattagctgaatataattttataaagatgtgtatttgaaagtaaaatggaattcatgatttcatccacgagtggcatatttaaattctgctcacagcgaagtgttacatataatttcatcttggaattttaaacatctttagtagatgcacggatttttagcattaaatatgtcctgtgtgttcattcttagctccccagtgccagaaacatcaacaaaaggatatgggagagtctaacaggactaatgttgttagagaaatcagcattagtcaatgctctgtttcagtagcagaggattggaagctcaggaaccagttccatttctgtctgtttttgtctgccagatgcataggatatgtccccagaaaggtttagtgggatatgacagagtcgaaaaccaaattagcagccctggactgtgactgtgaactggggtgaaatagatcagcacaaatttctcccatcttccctgttagaccaattgtgagtgtttttctgtttgaaatcattataaatctgaaacgagtaggctaaataaaaagctaccagactaactgcatgatactagtgtcagtttactcaaatgcaagactaaaaaactatcttctggttcataaagaacattgaaattttatctcctattagtagcataaaaaagtcacacttagtgtgttgtttcattttatagattaagaatatcggctgagcattactcttaagagttgagattatggctagtaatttatctctgatggggtggaatacagtataatttcacttatttttttcacttgcttagtactgagcatagacatgatatctaaaattgctttccttttagttgcaagaagattaatatttattctacacttgcatatgaaaattggtacacagtgtctcatgttccaagacacactcagtaacaaattaataaagttcaaggcttgaatagcacctttcacccctaccactagacgctgtaactaatcaaagtaaagagagaaaatttagttctaaatgttaaataaatgagttgtacaccaatgaatgtttgacaactagcaatgtccataagtctggagcatttattcttgtagactctacctttcattttctactctgctatcaagcactttaacatagtgtgccttgccttctcatctaggtgagctagtatcaacgtcttctttatgcagattaatgttttatgtcctagatctagtgccattatatcatttttcctaatttaaccatacaaaggatgttctcctcctcccagagttccttattcaattttcataaactttttaactatctgctttgttgttgtttgtttttgttttcagagaaaatagtaaattgaaatgaggaaggaattaagtgacctttaactaccaaagatttagagagttggtgattctataagaattagtaactattctagaaaaggcatagaacaggaattattgtatataaggagggaaagagagggatggatctcatggaaactcaatcaacttgctataatattatgtatttcatattacatgacattatatttaaaatatataatataagtaaatcccatcccaattttcacttatgaattgaattaatgtttcagttatgaatgaattaagccagttgctaagttgtcatagagcttagtaacttcccatacaattccttttaactcaagaaaaaaatgtgtactctgggtgtgggtaatattaaaatcattagatattataagtcaataatgaataaacatgcaatacaccttggttggttaatatgctgatagaaatttcaggttactgggctgtcaccccaaattctaggcaaactatacttaactattatataacatgtaagtaaggaaattcttgagtgaaccactatgttttaatatcttaggaaagattacacttcttttcaattattacttcttggggatcaactggaaacttaagttattatctttgtcatcatctttccttgaattgcagacagcattaattttttcatatgtgatattaatcctcaaaataaaggtaactcattgtggcagatgtgcaaacagcagcaagttatgatttgcttgactggaatatgaattatacattcctctaaatgtgtaattggagaagaagattttattaaagacatctccaaatgatctctaaaatagtacatgcaggaaatattaatgccatgggtctggaatcacctacatttgatattgcaggcaaggtatataccttttttgacttgggtagcattctaataatgagtggacagaaatttgagctctttactgtcactgcctatttcacttgtagcctatttaatctctctaagactttaatttactatcacctcacaatcactgtcctcagggtctatgtcatgaggagactgatgatgacaatattacattatttctttgaaaaataatcctgttggacaggattctgaattctacccttaattacagagtactagagtcaacatcaaacatgctttttattactttctgatattgagtattatagagtattggagcaaactgtaaccatatggtaatactcagtaaaacaaaatgtaagaaaagcaatgacaaatttttagaggggtgatggtatcatgaatggaaaaaacctcaaagaacaactagactataagaatatttattatgtgtcaaagattatctcagttaactgtcactttaactcttactgttattatctccattttagaaataaaaagaaaaaaccagattctggaagatgaagtcatttacctgaggttatattccaactatatagtttggggttacctaaggttatatagttggaatattacctgaggatatatagttggaatataacctcaggtaaatgacatcatcttcctgaatcttgtttttttctttttatttctaaaatggagataataacagtaacagtacatagtacagttggaatataacctcaggtaaatgacatatatatgtagcagtggggcagggcaggattcttgctaaaaagaaaatgctggaataatgtgaacccagggatgggtaaatagcagaacaggaaaaatggcagataagagaatacctggatttagagctcattgtgctatggtggaaactgcatgggcttccgaataacattgttctagtagtgaatctctgtcatcagcttgctatcatgggcaatttactttatcaaaccctaagttcttataaagtagtgttaatatttttcacctgattgttatgagactttaaatacacacacacacacacacacacagttttttgtttgtttgctaacatttggttggttggttgattggctgttttgtttttttaactttatggaggagacctggagtcttatgaaacactcaagctttgcaacagactaaactcagtgaactaggctcttgacacttaggaatcaccagaacacagaatggtatgaacaatggcagatcgaggattggcaataattgtaagtttgtgaagacaaagtggtggaactagggaagacatataggaacggctccagccatggacgtggaaataagcatggggctgaaatccacagcaggagaaaatgagggaccatgaagaattgtgagcagttaataaagactctgaaacagaaactaaaataaaattcacctgtcaaaatgtagacagtagtggataggagttcaccgatagcaaggatggctggaggctgaccctggaatgtagagctttctggtcacaactggccctgagagcttggaccataaggaccagcagatcagcccagctttcagggtggaaggagtgtccagctcagctgcaacacccacagagggagaaaaccatggttctgcggggcatgtgagagacgagggtggagcttgtgattgtgctggtgtagcagtgtataactttcatggataaaaatattcactatgttagatattcttccctaacctagaataagattcagagcagtactggctttaaccacagcgctcatcgtcactctcacaggaaataatgtgtctggtgacagcaacaaaaagcatcattatgggagaggatttcggtccggttttgtgtctcagactctacactgtctctgactgaaggggtttcctccatgatcatttggctgagtctttctagtcattcagaacactgctcaaatgtcatcttctcaaaaaggccttctctgatcatcccacctaatactatctcttcctccacccccagctattcttgtgtcaggatagcaaatttcactcaaacaccaactcctgcttagcagcgatgtaatttttttgtgtgtgtgtcaagtctataattaaccaggcctccgtctggtgtactctatgcactggataatgagaaaaaaacaaataaaataaacttttaatccaatccaaagtttttttaaaaaaatgaaaataatcgtgacagtgtacaggattattcaactttcatggataaaaatattcactatgttagatattcttccctaacctagcttccctccctaagcaaatcactggatatactgggagagaaaggaggtttctgtggccaggtagtaagaagggagattcaggagtcatgggaggaatcagcaacttaggacttcagggtagtgttctttatccaggtagttgctgcttgtcctgttgtcattcttgactgaaacctgcagtggtgtaattggtaatgtgatctaatggtgcgtcttgcaggagctctacttacctcagctgtgacttccctgtggcactctgtggtcttgctgggcttctttgtcagccccagcttatgtggagtactgtcctctctaggaagccacctgcccccattctctttggtgaggccctccgtggtgattccccagcatagctctgaagtcagtgggcactgtggacaccacatggcagctcaagcatcccactgcctggccattctgctctgccaagcttgtgtgaaggtgcatgtggggtcatctgaatggtggcttcttttcagaattattctttttgttgttgttgttgttttgagacggagttttgctcttgtggcccaggctggagtgcagtggtgcgatctcggctcactacaacctccgcctcccgggttcaagcaattcctctgccttagtctccaatgtagctgggattacaggcacgtgccaccatgcccagctaattttctttttctttacttttttttttttttggcatttttggtagagacggtgtttcaccatgttggccagcctggtctcaaactcctgacctcaggttatccacctgcctcagcctcccaaagtgctgggattacaggcctgaattaattaatgaggtgtagaagcaggagcactctctgcccttcctgtttctttgatttatctaacaccctctatctaatactatcccattacctcagcacgaatgccctcatctagcttctccagggaaagatcccaggacacgtaaagcttatttgtttctctatatattgtcactttagtctttgctaagcagaagcatgatcatcttcatcatcttcttacctcaaagttttcaattttttttttaaagagatggagtcttgctatgttgcctccgaactcctgggctcaagcagtcctcccacctcaccctcccaagtacgtagaactataggtgcacagcaccacgcctggctaaggccttcacttttaacaattaaggtcctgtttttatatatcagaactgagcaatttatatttcactctatgtgaaatgttgctataagaaatcctaactgccttcagacctttttgttcagaaaagtcttgtgttcacaaaggcaaaggaaaaaaagggagggttgatcattttcaaacattatgcccttaagaaccaagaggtaattatatttctcactatttaatttagttctgaacgttgaacataagcacatacagatacattctagtgtatatgtatcaagagaatgataaagttaactaacatttgttgagtgactaccatgcacattgtacttttcatcacttcatttcatcttcccttaagtaaggatctatatagcaatcttgcaaaatgcttaccttgtagtaggctaaatgccctatccctttctttatttgtaacttaaaattttagtaattttttaaacatcaaggcattttttttatttccattttccatatctgatgttcacaccaatcctgttggtataaagcaaggttgctagtaggtctctgttttacagacgaaaacaggttcacagagcttaaatgactgattgcgatgtcaaataacaacatggtggagctatgaatagaatgcatggaaggaatgcctttttgctcctcatttgcaagctgcctcatgttaacaattatcatatggtcatgtagcattatagtaagcaatagaaaattaattgtgcccatatacaaagtgtgtaatgctgtggcaatataattctgaatattactcttaacacagatcaccaatttggttaaatttgtttaaaaataagccagaagaaatagaatattataacatccccactaaatcacttccctgttcttcaaatcacatactgacaattgccagaaaatgattatggtaagatgggaaatagatgaagtttcaaaggcaaatacctatcatcataatcaatccttaaaaatgcttctgacttctattagaaaataatgcattaggttttaacatgtagttactttgtaagtgttttcccttttgagtttctatgaggccccagctatgtaagtggttgcatgcacagagggaaaaatgaacctggctcaaattctcctaccacaatttcctagttgtgtgaccacaggcaagtcacttaacctttcaacatctcaatattgaaacctttcaacctttcaataccttttctcttctgtgttattagtctctatttgatgggctggttatgaggcttaaaacacataaaccaacttacaatgtgcctggcacagggtaagcaattcttagccattactagagtataagctgctgaaaacagaaatccttgtttttgttcagtatcataactccagagtcaataacagtgattggcctagaaaggcactttcaaatacatgtcaattaattagatacctagtgtttaaccaagtaagcaaagtaaccaagtaaacattgtggcgctaactagccacactagtcatttcatattatgagccctctaagtcaattaagacattaaacttgacctcctcttattcatattaaattgttgttttcccactatatgatgtatgtgcctgtgtgtgggggaagggagaggggaggtaagtggcaaatattgcttttatccataacctcacgaatttcatcttactcctactttcaaaatatccattatactctctctctttccaaaagagatttgtgttgactcatattataggacaatgcaacctaataaaatggtaataggaaattacagccaataaaaggaaaagaaagaaatatctaaactataagaggagctgctgggtttgagcatcacaattgactctaagcttttgcaccacccttaacttttccaaatgccagcaagaaaggttggcctcatctcttgactagagtggtaaattaggtagtcatcaccacagaccattttttagaagtagttggattgttctgcaacaccagtgtatttctcactttggcctagcattggtgcataatggtaagctacagatatgtaaaagagcagtgacagaatagcttggatttgtttagaaatgctcttactgtgcactgttattttatactatgttgactagcttactgtatgcttactatgcactgaatagcttagagtggcattctgagcttcaaatgaagcactaccatttaaatttaagagacagagaagaacaccaagcaaacgctaatgtaaactatggactttgcgtgataaaaatatgtcaaatgtagcttcctcagtcgtcacaaacataccactgcggcactggatgtccactgtggggaagattataatggggaggagacaagaggcttatggggactctttgtactgcttagctttgctgtaaacctgaagctgctctaaaaatgaatgtttattaatctaaagaaaaaattctgaataatttacaaaatctattgtaaaaaattacaaagggggcactcatcatactaccttcatgtggctatagttttaattgtctttttggtgcttgcttttaattgtctctttttttgcttgaggttcagtaaatttatatagtaaatattaattggatgaaaaaaaagaagagggggaaagagaactatatagaactgcttacactctaaggcggttggctgggagaagggtctgcagtcaagcatgctacacaaattgggacagtatttatctgaacttgagttgactgaagtaagatagagccagctaaatagttcagcaacacatgttggatatttgtattccatgcttgcaaggtaggatcagcatgagtatctataattattacaaggcacgcaaactgaagtcaaaactggtaagagttgctttctttttaaaaattattgtcacaaacttctcaatttatttctcatcaccagtgtttttctcttcaaaattctttgaatggattctatccattatatttgaatgctaacaatgtaataaagataataataataatgttattctaaccattcattcatcatgcattacacattaattcaatttggagcaaacatttggagtaatttggagcaaacatacacaagaaatacactttataaagtctatttgatttgtaattactctgttaggttttaggatcacccctaagtctagcccaaataagaaatatgttctaaaacatttgcactaaagtatactagaaggataatagatatggtaatgtcatatggtttgtgacacttttaaattgtcctttatcgcccataaattttcacttacgtcacacatttaaattgactttatatcacccataaattatcacttagtcatactacctataccattgatatcagtaagttctgataatttttaggcaaaaaaccttgtcaatgaagtagcattttccttggaaccaagcactgctagtatcatcttttctttattccaaaggcccatagaaagagtggaaattaacttaccttcagtgtaaataatgaatcatgaaaaaagattgatttttccagtgtagtatgaaaaatgaagaacttttttaaagatttaaacctctaacaggtggagatttgcataaatatttttgaataatataattatacctataagaaaaaaactgagttgaagtaaaaagccctactaacaattcatatgcctgactctatagcaattcctttactggcctgtagctataatgttttctatcagactagagggacagggtcttttatctctttcttagacaagctgggaaaataaccatcctgaagattttgtaagtatagccaagtaaaatagaaggaaaacttgattctctctaatttaataatatggtaaaccattaacattttcccttgattatgtatttttacacaaaggataggaccttagagtgttctccttggttcaaatgataaaattcatttgaattttataggaaccagggaaataagtattttctgcacctttgctgtagggaacaattgaaataaatgtattgaaattcatgactcacacttgactacaggcaatatcaacataaaatgcatggttgtagtgttgcagatgtgttgtgaggcattatgcttatagcctcatcagctagaaacaaaggaaaagcaaaatctcctaactttttaactaagaagcttacaatgtgtcctccgctaccttgggatttgtttttaagaaaaaaatataaacatatgttataaattcctgagtttttaaaatttcaaatatggaacatactcttagagtttaaaaaggtaatatttatatttcaattaaacatttagaagatcattttcatcttacacaaattttaccagtatacatgtttgattaaaatatttatatatatatatgtttgacattaaggtgaaaattataccaaatgtttataaaatttcagctttcttgtataataaaattggcttaatattttaaaaatagatatattatcaaactttcaaatctctggtttactatttactcatggaaataaaatggtgttttctttaccttgattttgaaatgctttttaattttagtgagtttgtgaactgataagaaacttggtatggtttggtatggtggctcatgcctgtaatctcagcacttggggaggccaagatgggctgatcacttgaggccgggagttcaagaccagcctggccaacatggcaaaaccccatctctaaatatatatatatataaactatacacacacacaaaaaaaaaaaaaaaaaaaaaaattagcctggtgtggtggcacgtacctgtaatcccagctatcggtggctgaagcacaagaatcacttgaacctaggaggccgaggctgcagtgagccgagatcgcgccactgcactccagcctgggtgacagagtaagactgtcaaaaaaaaaaaaaaaaagaaagaaagaagtatgagcttatagatttacaaagaaactagaaatgtatttaactgcaaagaaatgtttattccttataatgaacttataacatcaaaatatatattattattttcaacagtttttttatggtatagatataaaaaagatggtgaaaatataaaaaattatctatttttagggaatattttaaaatgtaggctagagatttctaaaatgtttattctgataattctcaatatgaattttctgtctggtttgcataaataccccctcttaacggagaagtagaatactcaaatatagaggaaatatgtaagccattattacatgggggcaataggagggtgaagaatactgataccagcccccaacagaaactcctgtattcaataatcaagaattttattcattaaaagactttaaggtttaaactgatgagattaccatgatttttgacaatagagatcagttttcacatggcaaataaatgagcagattgaatattgactatatgtaatgagttctgcatctgtgctaaattattcttttaccacactgaagactcaatggattaatctatgcagaatggattaatgctgttattgcaggagagggttctctggagagtggattcctgataaaacgatcagttcaggttttattttctctgtctcatgcatgcacttccacttcctgttttccaccatgggatgactcttgccagatgccagcaccacactcttggacttctcagcctccagaactgtgagcaaaataaacttctgttctttataagttacccagtctgtgatactctgttatagcagcagaaaataaactaagaaagaacatcggtaccaagaagtggggctgttgctataatgaatacttgaaaatgtggatgagactttggaactgggttataagtggagactagaagaatttggaggagtgggtttaaaacagcctagattgccattaatggaacatcaagtatgcttctgttgagtattcaaaagaaaagaaaactaaggaacgtctaaatcttcttagagattacttaagtggttgtgaacacaatgctggtagaacgccataccaatgctggtaaaggccagtctgagaaggcctcagatggaaatgaggaatacggtattgcaaactgaagtaaaagctatccttgttgtacaggagcaaagcacttgggtgaattgtgttcatgcctgagggctttatggaatgtggaacttaagaatgatgaaccgggatacctggtggaagaagtttctaagcagcaaaccatgtaggctgttgcatggctacttttaaccgcataaaatgagatgaagaagaaaggaatgacttaaaggcagatttttataattaaaataaaatttaagtggaaatgtttggaaaatttgtggcctggccatgtaaagaatgaaaaggctgtttaaaaggaaatactaggtattattgaccatttactaaagacagtaccagggatagaagggatcaaggtgctattcattaagacagtgagagaaagacactgaaggcattttggagatcttctaggccactcctcctatcacaggtccagagttctaagagggtggaatggttttcaggggtgagccctgggtgccctccattagctcattgtcaaggcccatctcagaactctgctccctgcattctgaagcagtgctttttagcttcctcatctttgacgcagagggacccaggtgtagttgaatccactacttcagaaggtacaagctgtaaattttggtggtgtccatgtggcactaattctgcaggcatgcagaattcaagagctatggggacatagctacttcacctagatttcaaaggatgtcacaggtagtatgggggtttaggaagaaacctgctacaatggcagagccatctcaaaaaattctcattagggtaaaactctgtggagctacaggaacagggctactggcaagaacacagagctatgaggtcaccaacatgcaactccaacctatgagagctgctggatagactgagtccagcaaagctataggggcagggttgcctgaggcctttggggtccatctccagctccactgtatccaggaagtaggacgtggagccaaaggaaattattttccaactgtaagctttaatgttgtttttcctgttgggttttagacatacttgggaccagttagctctttctttttgcccttatcgctgcttgtcataccattttattttggaagtagataacttgttttagcttcatagatcaaaagctgaaggcaatttgcctaagaatgaatcattccttgagtctcacccatatcttacttagatgacactgtagattttggacttttgaactggcactggaaccagttaaaattttagctctattgggatggaatgaatgtattttgcattgtgagaaggacataaatattgggggccagagaagaaatgatatagtttgaatatgtcctccaaatttcatgtgttggaaacttattctctcatgaaacagtgttgaaaagtggaaactttaggaggtaattaatccatgaaaacattaatgctgttatcatgggagtgggctagttatcttgggagtgggcccctcagaaaaagagagctctcatgcgcttgcttcttcctctcaccttccaccacaggatgacccttgacagatgctggcaccatgctcttggatctctcagcttccataactgtgagcctaataagtgtttgtactttgtaaattacctagtctgtggcattctgttatagcagcaaaaaaaacaggctaaaacaacactttaagaattttttttctaataataattgttgctagcactatgttctgaaaacaataataaattgcttatgattaattgcgtcacttattactcatgaccctactattgaccctgactactcatgacccttattattatcttcatagtgcaggtgagaaaaccaaggcttggcaaggtgaggggacttgagaaacttcacaaaatttctaaaaggtattgttgggaatcaaacccagggaagcctgacatgaaagcataggttcttaatcaatgtcctatagggcttttccagataaaggttttatgctttatcgattatggactgaacttcaaaaacactcaattagcctttcttcctgacactatcagagtctttaaaaataatgtgttatttgtaccagatcgtgaaaggtatatggctttcaacaaagggaatgttgaagaaagaaacacacaaaaagggaaacatggtgatttagagtttgtacatatcaagtttgagatgccagaatgacatccaggaagaaaagctcaataggcaactgaatgggaatctgggtccctcatcaatttaaaaggtcagagctagacatatagatctgtgagttgtttgcatggaagtgataggtaaaacaatagaaatatctgaaatagtctgcaaagagaaatcagaagctaaaaaacaaggctggtgaaggattcctgaaaatatctgcatttggagaaagatggaaataaagaactcagcaatggtgactgggatgattcatcgaagtgagaggaggaaaatcagaaacatgaagcgtcaaagtaaccaagagtaggaacagtagaacaaagaaacagtagaagaaaatgttttggagatgtttaatagggtaaaggagtcagttgttgaaaattagaaagatactgctaagcttaaagaaagcaatttcagtcagctagtaaaatgaacgactgattgtgttagagtggttaattaagatgaagaattagacatgtcgagtgtataaaattgtttctagaagtttgaccagaaagagaagcatgggtatgagcaggtttctgagtgggaagaagaatctggagaagattgttttgctttgctttttaaaattagtattagcctgtagaaatttgagtgtgtgactgctgaagagaaaaaaaagcttgtcaaagaaagactgaatgaacaaacctggagataaataaaagacaaaagagattgatgaggagcaagatcctggaagacgcaaagtgagaaactctcagcaaaaagcaggagaggtgagatttaagtgtgagaaggcagtgccgccttggagataggaaatgcgggcaggactcgtgagggtacaggacacattcatgggagtcatgaatctgtttcctttccagtagttatgatcaactaatcataagtttttacttttagatttaggaaggatttatagataggactacaggtgcatgacactgttcccagctaattttctattttttgtagaaatggggtgccactgtgctgctcaggctggtcctgaagtcctggctcaagggatccccttgccttggcctcccaaagtgctgagactcacagggatgagcctctgttcctggcctctgatttattattatataatacaaatatttttatataatataatataatacagaacctccaactaagagatgaaatctgctatatctatggcccctcattttactacagaaacttgtcaaggttttaatactaaaagtaaagctaccaaaatgatagctttagaggctcttttctttctaataaaataaattatacaaacacacatacattcctatcttaagattcaggcttatatatattacacgcacacacacacacacacacacacacacacacaaagaatttcttgtgtaatgaagaaaaacgtaaattgagagattatccagcaaaaaattaaaagtaaaatttttgcattttattcaacactaaaaacttgtttgttaatatttttagttttaactgaagtaggaagtaatccttcatttaatgtaatttttttaagagacagggtcttgctttattgcccaggttggagtgcagtggaaccatcatagctaactcttcactgcaaccttgaactcctggactcaagtgatcctcctgcctcagcctcttgagtagctgagactacaggcaggtgccatcactcccagctaactttttttatttttagtagagatggggtcttagtattttgcccaggctggtctccaactcctgggctcaagtgatcctccagcctcagtctcccaatgtgctgagtttataggcatgagtgactgcacccagcctcatttaatgtaatatttgcagctattaacatattgttacaataatgagtgagtttagtatgatattaatggtgaaattactgagtttgcattctggacattatttctacaacttgtaaaactcttacctagataacaaatcttaaaatgcccagagttaattatcctggagtaagaatatctcaattgtcccctcatataatgccaagaaggagttgactccatggtaacatatcaaagtttagaatggaaatacaattcctactctgcaggtacctggtaatgacatatgcccggtttttcacaaagaagataaaagtgtagtccttgatttgctcagaccaaaaggtgacctcagggtgtttcgcagatgacctgactctactgaattgcctatggacaaaaaccatgtactagatatgtagatgacagtagaggatgctttttaagtcatactggctaaaaacatttttaaaattcagaacaattaccacctcatcataaaagcctactctagctattctttctaaaatattaactttcagacccttcctaatgggtcttatttattattcttcctagataaactgcacatataacatattttttgtttctcttttctgtctctcttctcaagaaagtaagctacatgagagaagggaccttgtggtggtgtttactgcagtatcactaacacctggaatacagaaagtgtttgataaatattttaaatgcataaataaatgcatgaacaggtctgaactgtttagaattcactcacccaagagttattgtgtttttgatgtatatataacattaaaatatgtgacaggctgacttttaaatatatgttatttgatggtgaaaactatacctcatatatttgattgctatatatataatctttggtgggcacaacccttatgcaaattaatactagggatttttgatgtaagtgaagatatatgattagctctattgtatcctgaaggcccagaaggattgtgataaaataaatgaaaacataaaaccagggaggtcaaagagaatgggatggaaaattatgtatgagaaatatagaaattttgaaagctgaagaggcaacctaggagtggtagctgactttgtagaactaaaaacaatgaaacctgagccttcagggggtgggagccaagaggacgtaaggtgattcatgctgccaaaccttagaaaaactcaggaattgtagctaccaaattcctgtgagggtgaaaaagtaaggtaaggaagattgattgaaaattaagataggggttagttagccagccaccaagggtacaggggaagaggaccagaggtttactttcctaaaagtttgaatcacaaagccaatatgcacattcatggactccagacccaggtagatcatcaagatgaaaacaaaggggatgcattaaaatttccatgctgaaaaatgagaaattacaggcctttttctctgtctggttgacttgtttattgtcttttttttttttcctagtttgaatagcactggacttaatctgagtcagttacagtaattgagacaatgcaaggggaatttgtaaaatactactacctaccaaagctgtccttttaaacgtatgtgtaataagcccaaaatatatgggactagagcttgaggaatactagatgttaaaaaggaaaatcaatgttagctttcaatcccaatttaaatgaattgaactattaaaaaatcagagctacaaaggaaacatgctgccacggaacaatttcagtgttcttgactgacataagcaaattggaactataagaaggatcaaggctgcaaatggctttgaaagccataaattgtaaaatcaatatgctaagctactggaagccaatgtgaaaaacacagtgcaggagcactctcaccatcctgcctggctccccccaatgcctggcatctgcattctgtaaattaaatttcaacaggtttggttttcttgccaaatagatctactgctcttactagaaaaaaataatgttctttaagtaaagatttttttttaaaaaaagagggatacccttaatattaggacaagcaacaatttagctctcgatatcagaaactgagctaaataaccaaagcttaggatagaataaaacgaacaacaatttaaaaaatggaataacaagaaaaatgaagaaagtgaaagaaatgggatagaataaaaaagaaattgagaagagggagagaaagagagacacagagacagacacagagagatggagggaaactctgggaaatagaatgaaataaaatgccatcaactatttgcagtaaagctgaggctcataggaccctctttatatcaggatcaatagtgtcctgaggttgggtgagatctctgaggttttgtcttgttcttctccctctgtctccctacccaggtgggaggtccaaatgcagtgaccatgtgtggtctccccaatccctctccttccagagcagataatgattcatgtgggaagactagttagtatttggacacatcaccatcactatccctgatactcttaaaagggcaaggtaaggaaatattgaaattacatctcatcccattgcctagacttcacttcagctcaggctgttttcaaataacatagaagatatccaaagattctacataacgagtaaaaaaccaaattcaaaattagttatgtacagccaggtgtggtgactcatgcctgtaaccctagcactttgggaggcccaggcaggcagatcgcttgtgcccaggagtttgagaccagcctaggcaatgtggtgaaaccccatctatacaaaaaaacaaaacaaaacaaaaaaaaaactggtttggcatggtggcaggtgcttgtagtcccagctacttggggagctgaggcaggacaatctcttgaactagggaggtcgaggctgcagtgagctgagattgcaccactgtactccagcctgggcaacagagtgagaccctgtctcaaaaaatgaagttattcattatgaaaaaacccatataaaaggcatgaagtaaaaaggccaagaaaacagtaacaatggctttatttttatagaagcattaaaagtatattttatcattcaaatgtttgtaaaagattatattatttaaatattaaaatgacatttggtgatataaaataagatgtgctatagatttgttttgttttgttttccatccctctgcttcaggacgaatgtgctcttgatttggaaaaaaagttacctccattctttttatttaatttttttctttaagtaaaattttaattgatgtgtgatacatagaaagaaaaatgcaaaatgtgtaagtgtacagctctatgaattttgcaaagtgaatatattatcgtaaccacaacagtaaccaaaacattaacactatacaaaaattcttttgtggcccctcacaggctatttaacctctttcatgtttatttactaattctgtgtccccctttattattcttttctaggggtttaaaatacatcctttcctgaattgtctttttggttcatttttttttatttgaaagaaaaaatttaaaaatcttatttatttaaatgaaagtaatatacatggaaaaaccgacacatcaattatgacttaatttgggcttctagcctactagttaaactacattatattgtctagacttttgaaaaaataaactcatattcaatgagtttctccaaggaacctgtccaattttctcctaccatttcagagtatagaatgttaaatcattaggataagtagacaattacagataaatgttaacaagcatcacgattagaattaccactctgctagaaataaatttagtttttttgtgtatgtgttaatattctgtatgttaaacatgggccaaaataatactatgttcccattcagaatagtttatatttgtgaaactaatatcatcttatcatctagaacatgtagcatacatgggaaataattcttacataaaaaaagccttgtatgtctgtagatcagtctgttattataactctataagtgaacactcttaatttgatatatgtatgaactagatagatgcataagtcatatacaatgtattaatatgatatatgtaatacatatacaatatacaaatttaaaaattaatacatttaatagaaaatatattttttgattaatgaatttcttttgaaacacacattcactcagttgttggagttataaatgttaagccacaacttctaactgaaataaaagtcatcataatatgctctaaatgaataactttcacagaaatcctgtgttcattacaaagatctccttgtgttcctgatggatcctccaacttgctgacacagacatgttttataaagttattttttcatattgcatttacagagatttccatagagattaaaatgctttcatttaagttactattattcactcactcacgtcctatcaaaagcagtgttaatcttgaattagtggtatttcattcagttaaagaaaacacttgacttcatgccccatcctgaaggtacacagaggcaatatctgagttttaaatttataaatatgtgggtcttggaaacttgaagaaattagtgcaaaatacttacatttctattgtgggcccgccatgataattctagcataaatagagaaaatttctgaaaacattttggaaattttaatccaacacctaccctgataggtgggccagccagatgcagcaaaaagaaaatggagaatggggcaagtcatcgttgtcactccaaaaaaaggaagtgtcctcattaaatgaagctcaaagcctaggctttctcagagtggcctggaagtctgatccctggaaggcagaccagaatgactgtcttcatagcaaccctgggctgaacagcaatctggccaagcatattaccaacaaaaatcagggatttcagtaatacgttagtatcagtaatttggatggaaattaaattacaacaattttccccaaaatttccttgatatttagcgttctttcagttatgaatctaggcaacaaacccattgctaatcactatacaactataccattgtatcaattgtattgtagtagttgcaaatatcttgaaatttcatttaagctcatcactgttttgtgatcccagtagttattagaccaactctgagaacttattatataattcgttgataagcatatcacagttttagttcttgataaatttatagctgaacttcagtattactgtttttgtttttgttttgtttttgtaatcttacatattttactatatggactttagaaccctattaagagaaggaatgcatagatttcaccaaaataccaaaggtgtacatggctcatagtcaaggcactcagaatgcagaccacaagttaagcagcagcatcatatcacataaagtcttaaggtgcagagtgatattcatggcatacctgtgtggctctagtcagtaccttaagcactccctaggagattgcaaacgtgctaatgtccacaaagggattgggagtgattgggtgaaggaattatttacataaaacacatatggatagctcaagaaataatatttctctcctttgtcagcattagtcgtcagcacctggtacaaaattcctgctaaagtaagtaaacctgtcatctcattgctgaagttataacgagattttgggaatcacagcagaaagtacttcccccagaggtcatcctttcaaaccaaaaaatgggatttagtgaatgattagtgactgctaaagatccagtgactgaagaactactaccatgctttcacgttgctgagacataggggagaaatcctgccacccatgcttctcatataggagcattcaattgtacccaaatcctcaaaattaagcagaaaattttgatcagatagatttacagttagattctgagtcacatttaagaaacatgaacaagtattacataccaagtgttggggttcactaagttgaagataccatgaggagcaagaaaactgtcttgctgggtaagtccatattccctaaaatttaagtgtattaattaattttgtgactagtagttatcgggtgcctactatgcacaaggaactaatgtgttgttcctacgaaaatagtggatatgtatgattataggaattataatatcatatagaaaggttttctagcattatagaaaagtttttcttgtactgataacatattgtagttggtagtcatcatgcataatcgaaaggtaattttctttagtagaactatatgtgttaaaatgtttacctaggctgatgaagatactagcctacatttgtggtacataacagagcaaattctgtacagagaatcacaggaaacagtcatatctaagtattaaaggcacagggataatgttaaatcttagcaaaatatgtgtgggtgttagtgatataaaagctaattttaaaaaatgaattctgaaaactgtccaatttcttcatttttatttcaatcttaattcacatttcctatatttaaaattttagaggcgattatgggaagtttgaaagtgttactacctatttatgtgattagtgcaatttggtaattaatgtaaataattaccatctagcaattgtggtttgttatgttttaataagatatctagaatgtaaagagattttatgcaacaataacatttttaatttaaatctttaaccatttaatttaaatctaatcaaacttttaattgactataccttgcaaactgatggttgtagttccctgttttgaaatgaaaaaatgttttctttgtgtcttgtataagctgataccggacatcagtgtttgcctgaccgtgctatttcatggccatcaatcaaaagaaagtaattgatttctctggatcttggaacacttcacttcccatcactactcattcttgtggaatgagaaactagtaaaaagtgaaacacacacacacaagtctatgttctctgtggtaacataaaaccataacttaatatgttatttagaaagaaagtcttaaggtaggtgaatttcttgaagtcacttttagacaaacttttgagtaccacaccaaaacttgatgtaatcttcctactgaaccattgtcttccatattgtgtgtgtatagtacatacatgtatgtacatgcatactcatatgtacatatatgtatatatgccttagtctatctgggctcttatcttttaaataccataagctgggcagcttataaacaacaaaaatttatcgctcacagttctggaggttaggaagcccaagatcaagacaccagtatattcagtgtctggcaaagtcccactttgtagttcatagatggcaccttctagctgtgtcctgaaacgcaaagcagctctctagagtttcttttataaggacactacagatgctcctcagcttaccatggggttacattcctataaatccatcataaattgaaaatatcataaccttaacaagcatttaatacatctaacctacccaacaacataccttggcctagcgtgccataaatatgctcagaacacttccattagcctacagttgggcaaagttatctaacacaaagcttattttataatcaagtattgatgatcatatttaatttattgaatactgttctgaaagtgaaaaacagaatggttgtatgaatacttgaggtatggttcctattgaatatatattgcttcccaccattgtaaagtcaaaaaactgtaagtactgtcatcgtaagtaagggtcatctgtaatctcattcatgaaggctccacctccaaagcctccacctctgaataccatcaccttgggtgacactaatgccttgggggcttagaatttcaacatatgaattttgagtggacacagacattcagaccatagtaatatatgtataaataattcttatctatatattagatatatagataaatagatctatatcatatatatatatatctcctaaagtttctgttcttttcccacacacttccctactctattatcccataagcatcctgtaaagcaatgataaatattttccttcttttcttaacggtttaagaagaatttttggtaaaaggaacatgctaatatctgcaaaatatagagctgtataattgaattatgatactaatcattggggatataacaacgaagaaagtaatgtctttaccctcagggaacttaaagtttaatgggggtaaacagatatgtgaagaaataatatgcaatttcataaagaattcttgcaaatccataagaaaaaaacaaccaaatagaaaattgacaaaggacataaataggcatttccttttcacagaaaaacacagacaccagaaacctataaaatgatgctcaacattatcagtaataaaagaatacgaattaagatcataacaggattccatatgacacctgcttgatttgcaaaaattcagaattttaacaaggccaagtgttgctgaagatgtgaaatgatgcacactcatatattgctcatgggagtggaaactggtaccaccacttttgaaactcttgcacatttctattaggagacatgattaaaagtattcataggagcataatccacagtagtgttaaactgcatatatctaaatatgtaattggtaaataaatcacaaaatatttacataatggaattttaaataagcagtaaaaattgctgaactacagctaattatattcaactgaataaatcttataaaatggtaaagtcataaataaatgaaaagtgtcatttgataacaaacagaataatatttttaggaagtttaaagataggacgacctaaacaatatattaggaaaatatgcacatggagtaaaaactatattttaaagcaataaaataataagtaaagcaaagcttagcatagctgtttcttctggtggggaaggtggaagatggagtacagaagcagcaatcaggtggcttccaagaccggtaatgtctaggtgttaagttattttgatgagttttctgatgtacagtttatcatgatgccttacactttagtatgcactgcatatgtttatttctatatattgtgacaccatgtttgaaaggaaacaatttaaacaaagtcattttgtcacatggaaatgactcaaaaatagcaatctttagatcacattacagaagggttgcagttctactgaagagagaaatcacctggaaaagctatgtgtaggtcagactaacattaaagatagtaacatgttaggcatggatcaatatagaaagtcatatcatgtcttatggacacagtttttatttaccttaaaaatatgtttatgtttctagaaaaagcctctttaaacaattctaaaaatattcaaattctctattaaatagccctgctgtgaaatccagatgattttgtaatctgctaaagtatggctggagatatattctaatgcaattcaaattctacagaaatttgtgtgcatggcatactattttatttttcagtgttctggactaatgcatctttatggaaaatgattatatcacagcattttaaagtagataacatgtctgaaaatagtcaaaatatatgtaaatcagtatatcaaataggacctaatggaatcatttaaacaggcttattgaagcttgacccataattgtgattgtaccagtgtgttgtcaattttacttcccactgctagttgatcaccagaggacataaatagccatggagtgtataattggtgctgtgttgccacaagtagttatttaaattcagcttctttctactcccctgaaatcatgtgcattaataataataaacctggatgctttggaaatataatcaaatctttaaaagatgtaaggtttttttaatattttttttcctaagccatactaacctgtaaacattctgtgtttacattttataaaagctaacatttaagcctattctataagagtaggtaattctggttgtttttaggcactgcactgttttaaaaattactgagatcaaacatttccttttttaaaaggtattagaaacacactgttggatattttaaagcaggatagaatgacaactttttttttttaccccaattcagtatgatctagctctttgatgagacttactttatcattgtgagataagaaacaagcctgtcaaaccaatttgctaaggtcactgtgtccctttcaatcaagaaagttggggctgtaatgttactgacccagaactatgcaggttgtgcattagcataatggctgatcaacctaatgcattttaatgccattaacttttccccatcccctggaaggaaaagaaaatataaaaagttacaattttagatttgtcattggtagattatctttttcctaaatttcatagactaaaagtgagtgaaggaagctgcatgcacttattctggctaaagtccaaattgagaggtagattactgaaaagaaaggtgaagacaacagttcaaaatatctcacccatgccctgccccacctaccttaagcttagtaggcaaaaatgaggtctcacaaatagtaattctgtctttaatgcagcaaaaatggttaagaattttctgggctttgaaaaagtaaaatgtgtatctatcatatggttgtttaacaggccacattccggggaccagtagcaagcatgtgatgtaagcaaatgctgggaagaggttgaactaacatgagaaatgggcaaaaatcccattaaaaaaacagattactatagacaagcagattcagaattaatgcaagtaagatgagtcattatcgaaggttgttgaaattaagagggcaaaactattggctatttgaagcaatagtttagtaagaggaggtagaagcatccactctgagtcagaaatctttctcagcaaaacctgtcctgtaaacctgcaacactctccctgaagaagttgccctgatgagtttggagcaattggatctctaagcctcaggcttactaggtagattgtaacctctctctatactctttttgtgtcttccttggttctggtaaggccacagttggagtcagatgagaaggccacctactctaaactgactccaggttgcaccaatgtggtactgccacctacttcttgaagcttttcttttatatatatataaaaatatataattttttaattttttttgagatggagtctcgctctgttgcagaggctggagtgcagtggtgccatctcggctcactgtaagctccgcctcccagtttcacgccattctcctgcctcagcctcctgagtagctgggactacaggttcccaccaccacgcctggctgctttttcgtatttttagtagagacggagtttcaccatgttagccaggatggtctctatctcctgacctcatgatccacctgcctcggcctcccaaagtgctgggattacaggcgtgagccaccgtgcccggccttcttaaagcttttcttaattccactcattgattgtggcctttctcttttccaaatctctgttgtactttgtagtaagtattatactccagtttgtgttataattagttttgttttacctttactaaagattctagctttcccaagagttggaattgcagataatttgtatactcatgctgtactacctactacaatggcctgttgagctgaatacaattcattattcgataccatgaaaatatattaatctggcttaatgattatgataatggcatttgagtttgtctaggttcttcttaagataaagataatttacaagaactgtcatgtctgagactataataacatcctttctctgataagtgttatgtgtagcatataaaaatagtaattaatcatttccttttttaactagactgaaattaaaaataaaggatattggtaacatttagagataaaaataataagcacataagaacacccaattctatcctgagctctttaattgcattattattggctgtggacaagctttcaatgtccctttcatttgatgtacattttaagtatttatcttacccttaaaaatcccttggagagtcaatatggccacaactgggaaataaaatattcttggggacgcatacgtgctatttcttagtcttggaagattttctggaagaggtgagtccttggaacatttaacaagataagttttagcaagttatatttcataagattagttttacatgtttatttaagttagaactttcaaatgatagagatttatacttccctaatttcaggaggcaagtatagctctgctccataaagtgctgaggattccatgtaccttccagccatccacttggccatcctaggtctagtctttgttcttatattgcaagtttgtaaatgtagcttcagccattacactcaatgtccgttcagcaggatagaggcaaagacaatttaaacagttacagaggtcggagcactagtatggtttaaggaagggtcccagaagctgacacacaggacatttctaattgcattttttgacctaaattaatcacatggtcacacaacacaaaacagcctgataaaatagtttcacttcagatggatatatgtactcaggcaaaactcaggtgttttacttttgtggaaggagtgtggatattagaggacacctagcagcctctgcaaaacacagtacgcattaaaataaagtatttaaaaaataaattaatggaatgacaatagaggaagcaacaagatcttaatgatttttgcaatttgtaataccagatttatttactgtcacttaaaagagatatccatttatcaacattttaaaaactatcaggtaacacttctattgaaatagggatactataccttacaacggacagcagatcccagggcctattggaaaatcatttaataagtaaaatagtagcagtatattaaggccaggggcagtggctaacagcctgtaatcccagcactttgggaggccgaggcgggtggatcaagaagtcaagagatcgggaccatcctggctaacatggtgaaaccccgtgtctactaaaaatatgaaaattagctaggtgtggtggcatgcacctgttttcccagctactcaggatgctgaggcaggagaatcacttgaacccaggaggcagtggttgcagtgagccgagattgccccactgcactccagcctggcgacagagcaagactccatctgaaaaaaagacactcgactgggcgtggtggctcacgcttgtaatcccaacactttgagaggccaaggcagatggatcacctgagttcaggagcttgataccagcctgggcaacatggtgaaaccctgtctgtactaaaaattcaaaaattagctgggcatggtggcaggcacctgtaattccagctactcaggaggctgaggcatgagaatcgcttgaacccaggaggcagaggttgcagtaagccaagatcgtgccactgcattccagtctgggtgacagagcgagactccatctcaaaaacaaatacgaaaaagtaaaataaaataaaataaaaggcactgtggaaacctgagcatgttagcatctatctacaggaattaaatgttgtccgtgagaattaagctgactgatatatacaattttgtattttgtttagggaaaatgaattgcactagatactattttcagcatgatcacttgaagatataagtaaaatattaatatattataatattccgttcataggaaatttttcttctggtctagcataagaaatctttgatttgacttgcattttaaattatgggcaggaagcagttcatatgcatgattcttgtattataaattatattctaattgcctaacctgtcaagtttctatactgctaaatattcaggggaagcaaagggaagaaaacctcattatatacagaactgtatttaaatgaattctctgataagggaaagtttacaaagccagcttctatgaacttatggaaattaatgagtattcaaaaatatatttgtggttttttattgtaaataaataatagctcaattataaaacaaataataaatcatttgtgttagcctattcatttcattttatatttaaatttccaaaataagacagaaaaccacgtatttttttcctattttcaccatcagtaacaacaagacattttatttctattttgtgcactgtgtttgggatttctgcaaagtacattaaaagaagcattgagctgtatttcccaagaacttaaagtcattttcaagtaataattttcatcatggaaattcttataggtagcatggaacttttactcatattttctttatctagaatacttttctcagtctactccaattccctttgctcctgtcgtgcctccaacatacaccctttccttaaagcaaatcctacttaactttcaagatccagcatacatgtcattgccaaaatgttttatgctgtccccacctagaagccacgcctgcctctttgcccttcacataggctatatgatagattaaataatctacttcatctatcatatagcacaaaaatgtttttttgttatagtacttttatcttcatcttatttatcctattagatgactcatttcttgagcaccagtctctatgtgattaactttggtaccaccattgtccccacctagcatggggtgcccagcacatagtgaatgctcaaaaaatgaaatgcaatagccatagatgcaaaagagaaaaaaaagaacttaaatcaatactatctttaatttgcatcttcatgaaattatatatgtgggctttcttagtcccaaatgttttatttcctctgagtgttccattataataattttctcaattagaaactactgtaggaggtcagaaattctctctaatatgaatttttggtatgaatcaaaattttatttggactaagagcatagtccagaagtgggaagtgattacttattctgtggcttacaaaatttcagaaaggaaaggcagagataggtacacactgtgcttagcatataatcttcaccaatcatcttttacataagtaaatgttcatgtcccttaggtactttgcattgccataaatattttaatagtacctattcttttcttttcttatgtaataaagtacagtgtgttttgggggataatctaacttgatgttatgccctcactattggggcattatcgcaaaattcttgaatgtagtcacaatttttagaaattcccaggtatttgtacttctttgaaattcttcgtaagaccactatttgggcaagatgttgaaacactttaaatatctagggtgagtcaatgcaaaaaagaaatgaacaaaccaaccaatccaataagcaacaataacaacagcaaaattaaaattatgtttgagttatacaacattataaaaaatgcagaatttcaccagttagataacttgctatttttgcttcatttggttgatcaactttgcttttctaaatatgtgtctgggagttatgatttaaattatatttatttatattatatatttaaattaaattatatttaaatgtatggtttaaatattattgagaatattctacctataatgccaatgtctatgagtaaatatttacttttgattcactttccattctattgtactacaaataatggttaaatcctatatttgacttctggctagaatttgtcctttttgtgtgaaaaaaaaatacaatgtctactctaacaggcttcataagaactcatcaaatgtataccctaaagctatattttgagggttttgtttgtttaagtaaggttacttactctagaatctgttagtccatgttctttgtttcttggctataccactctttatgctttgacatacatcatcttggggaacagactcacggcacagtaatgaccttgccaaggaccaagaagtgtttcttacagaattataatttcttgtaactcaatttatgtgattactgtgtaaaacagaacttgttcagcaatgatggatggcaatgctgcaggtattgactgatctttagaaatatttatatgacaggtcccttaagattttgtacatcgtagaagagaataactgcatgcagaaaagatgagttgtgattgaggttcctgagcaatgcaatttattatcatatttcttccatgcccagtctaaaagctgaacatttgccaatgcaatggcaacaagcagcatttaaataaatgccctcttccctttcagagcatcaccttcacaagaaaatacttatagttttgaaaaacataaactgaaattatttgtaaaagtgaagaatatatttaaaataaaaatctgcttgaattatttagcttgtagacttaacatgtcctttgataggttccttgcctgggaactgcagatatgcttagacacacaaacgtaagaaactcgataagccaatcctgacaattctactttgtttatagaatttcattccatgctctagggaataatatatttcgcactgtattcccctgggtgtttcaaatttttaaaaatcttcatttttaaaatttaattttcgttaaatattcatttgggtgactagaagaaaaatgttttgactaagttaaagtttttcagaagcatatactttgatattgtttcctccaatcaattaggcatggcatagacacagaaaaacaatctgtagaaagaatacagtgtttttaacaagttctttgagtcatctggacaatgagatgtaatcagaaaacatcttttagtccctaatgcctctttaaaatttattcagtggaaagagttctctagccaacggttggaaatgtgggaagcctatggctgttactgtgtttaagtagcaaactcggtcccatataatatccaattctgtatatcaaaaccctgatttattttttttttccttcccaagctgggtcctgctaaaagctggctgttagcttagagacaatagggtattgcctttctcctctccttcccctatgctaagctttcactcctttctttcatccttttgttaactaagatttctggcctcaacagggttgcagaaggattaagaggagagcagaggggaggggtaggacagtttttactagactggcaagaaggctctatcttccctaggtctagcaggtatttaagctctcttatgagagactggggactgtcacctatagttctcttggtctagatgaaagtttctctagtctagttggttgcttactccttcagcaacatccaggaactcagcaatacatttccagctttggtgtgcagtgtcttgccccttcaggtagctctgtggaagaagactgcatgttcttttcttgaacaaaactatgagtatgcaagctaattgccacacgtcggctactctgctaaactccagcaccaaagcagttagggagcttctttgctactagatttcctgagtaggtgctggactctaattttatttgtatctaccaacttcagaggacacacatacaggctttcccagtggtaccattgaatcttgtctctcttgatgtgaggtgaagtgggaatcgctcttccttcttccttggtgggaacagttagactcacagcacaattctgtccaggaaataatctctgcatatcttgtacctcagatttactttcctagctattttatatgtttgaagtaggtaaaaggaaactggtttttcagtttttatttacccagtttgaagtacttgcaaggaatgcccactaatctgttatctattgccttagggtctagactgaaacatccatttaagaatcttgttaaagtaaatataatctactgaacttcagccttttagtagttcttttgcaaacatcctaaaatggatcaaataagaaaaaagcaagggaggtggaagaggaagttcatatgttggaagcatattgtgtgattttgctacagttttccattttatttatgaaacaacaaatgacatttaaaatgtggcattaaatgctatggttaagataagagtgaaagtaatccatgctaatatttcagagtttacatttcaaaatttgagattacaaattagtctctagagtgagagagagagagagagagagagttgaaagccatggccaagaaacaaggaggtaaatgcagagacttgtatgtacttttttcagtcactttctaagtctcaaattcttttaaacataagtgttccaaactttctgtctccctttgcaacatcctccctcatattatttttcatttttccaccacttctctttccttgacccttctgcattgtgtcctttgccttcgttatttatttatgaagatgatgaaagcttgcccacgattctgctcataattcctcagtatcctctatatttagttccgtctcgatcccagagccccagctctttaaaactaaaaagattctagatgttcatacatacacgtcagtaggtctactttatatgaagcctgtggcttattcaatttggggggagtcactttacgcaatagaatacaaaataatgaatataaaataaagttcaaggcctttggaagggaccctttcaagcaagggaccctgaagtttcattagcttcaccgcaaatccgcctctgcatccatatataaaaagccttgaaaaatcttttgctcctttcttgtatcgttctaaaacagtcataattagatagctgctttgctatgctttcccttaggttatataagaataaataatgaaagagatttgttagttcagatcttcaagatctgattcttaagtgggtgttaaatataaaagctacatcccagtaattaagtaactctttttggtatgcacaaatatattatagtgtacaaaaacataattttggctcattcaacaccctcacttatataactaataatggtgccaaagtggtattactatgtctcttaaaataattctttagttcaaaacatgcaataaatagaatgatttttgagttatcagagagtcccttattaggctaacaaaattacttcaacacagtgaagcgtggaacatgctagctttcttttgtttcattattattttacataaaccttaaaattataaactcaagtatgtggatctatttttatcattcattgaaaaaaagcctttatactgcttcttattgtaaatacctaaatttacaatgcttgtccttcatcttatatttgatggcagttaattgttagttggttttaattatacatcatagtctttgttctggagacaatccaaagagtagatcatcttggtgtgtaatttactgaaagtttctaggcagcctgccatactaaagaccatgtggtacaattgtcattaaaattagaaaaatattggtatacatgtttgaattaaggattagagggtggctctataaattatggaaagctctgcaaagtattaataaggtttgagttcagccaaagcctaatttccaaagatctttacaatacacagatgcattttttttgtacctgtggtaagtttttggtgaatgttgcttctgcttgtagaattccagatcactcatgaatatcggtatactcttttttagcacgtgagtaggtgggtaaatattgttagtgtttggatattggataagacacttagaaatattgttgcacttacaaaatataaagcacttttgcttttaaaaataaagggcccaaactctggttaatattttctttagttacaggtaacagtttttcaaatttaaaaagtgctcagacagtatttaaagacatatatgtattctcatgaaatataaaagaactgctctgctagctaccattgaataatgtaattaaacactattttatttttattattttattttcaaaactcagtaaaagtatgtcaggtgaagactggcgtgaggtggccaaagataacaacattctgtaaccttctaaatagaagatgagtcctccctccctcttccccttaacatctatcttaggaatcttcaaaagcaaatctcagggcagagtacgaaggaaaaaaaacaagacggagaaacagaatttgtatttcctatagtaaagcattcagttgcaaatgaaacactgcaaaacttaagggtttttctttattttagtgttatgccaaagctatattcttttatagtaaaatataaggaaatatagagaaacggcatgtttgtaataaaataacaatgacaaaaaagaaaccctgtgtatttgtgtttgctcaaatcagattttatcatgtcattgaaaatgctaagtttcaggggtcttttaatatgatctcttgcccatggacctgttttagctgacacactctccagctttgatggttactctatgggccttgctaaacccagagagatattagaataagctatgaatagctgtacagtggtaagaattctggactcagagtcagtgcaacacataaataagaaaaaagtactattagagaagagtagggtcataaggcctgacctgctcacttctgtctaattttacataccattatgtggctgggtgcaagttgttcttataacatacaatcccctgtctaacctttttgaaaacaacacatttgacattcaaatatattttattttcaagaaaattaaatacatttattatttaatttaatgtttttattattttgtattaataaaacaattttaaaagtatttattgtattttcttccaatactttaaactgtttgttaattttaaaccatttaaggaaaaaacacaatcttaccttccttttcaaagccagagggaggtgcaagctgtgatttttgaaatttttttttcttctagtttaaagaggaaatacatagagagtaggtatattaaaaagtgagtagtatggaactctaacttcatgtaataaatattgagttcgatccaagtgccaaaaatatgctagatggtgggtacacaaagataaatatgaatcatatccttaagcagcatatagccaaagacagtggctggttaattagattagagcaccatacgaaatgatgctgagatcacagattccacttatggaccaattagctcctctttgttctatggccatagattgcatacagatgagatactttcatggttttgtgcatttttactctatctcttgccaaaaagaatttgaaagagcacacagcaaagacaaacatagtactaaaactctgtaaggtaacagaaaaagcttttgagaccctattcattagaccaaacttacaaaacatttattttcatttcagtctatggaagtcatggaaacaaacgtactgatgaacttagtaatctggaaaatatttaaagctgtcaaatggttgtagtaaagaaagtgaacaattccctaattcatttgttaggaagcgagtgataaatatagaatctagttttcatataacggatgcaatacaaagataacactttgcagaattgagatttcttagttgtagctaaactatctgtagacagaatttttttcacaatagaatttctagttaagttctctctaatttttttatttaattactatccatgttgtttactgaagtctttagtagtcatccttttatttatttattttctgaagaaagcccacaaaaaagaaagagccaaggattgtatttctgactaaattttatagggtacacctgtgcatttacatgtatattatttattacatggacattatgataaattaactagttaatttagtcagttcagttgaacatttattcaaaatggttattcagtcttaagtagaacacaaatgatcatagaccacattcttcctcttttaatcaatatattaaacattttaaggaaagagagtttttcttagtctggttcttctaacacagacttcaaaaggatagcaggatggagaagctagatatataacatatccttttatgaataggatttatagtactttacaaaatttatggagagtggagacatctgttgacttttctgtgttaacctatgtggcagagacttctagttaccctcactacctgttctcttcttcactactaatactgccttgattttcagctggacttatggctacatgggtaaagactacctctttcagccttccttgcagttaggtgtcaccaagggatagatttctggcaaatgggatgtaagcagaagtcttgaatgtgcaatttataaattttccttatggaatgtgaacatgcccattgctcttcctccttcgtcttggttggaatgcaaatatgatgactactgccgcaacaactatcttagaatatgaggtgaccttaagaagactacatgttatgcagtatcaagatagaatatgtctggatttcctataccctcaggctcctagtagccctacacctcctgaattttcagcctttgggtgagaagaaataaattcttatctaacataaaacactgttattttagattttctttgcttacactaaaacctgataattaaacaacccattaaaaacatttctacataatgtgactgtattatttcctatgtttaagttgatttttatggcatttcataaaaaaaaagctcactgggagggtaaatgccagatatttgaaagtttattctgaagctatattttcattaatttaatgataagcttatcttctttagagttaagaggtattaagagtctatattgccattttgatcattttaatgaatttcaaaggctttttttttctttattagctgccgtgaaaactaaggcacatttacaagattttaattagtgtattattgtgaaacaaaaccaatcagcagaaagaattggacgtgtttttcttctttttaaatttgttactttagaacaaaaattatttcttataattaaaaagaatcactttttattatgaatatcatgttctttgctgatgtctagagtttaatattctgttagaaagctgccttctaaaaatcattgttacatatttctgttatctgggagttgaaatttccagtcagaaacgggtatataacactttctgaatcttttgttattttttgtagcatcccagatgagatgatagattttggtttcatactcaaaggagattgccagaaagatgttttcaaggaaggtagctgtagatataattctcccatttattctgccctctgactataacacactacttattcgcattatgatgaaaagaaataaagtgttttaaatattaaatcatatcttccaaaatgattgctctagtacctttcactaatgttctaaaaggaagccaaagtcaaaatcaatgggaaaaaagtgcaaatacctcaagtttcaaaaggcctgttttaattcttcactgcataatgttaatttatttaaaaattggcctgaataatatgtaaaataatccttatggattatagaaagcctattttgccacaaatatgacatattttttctgccaacattgtggcatctaccgatgctgtcactgaggcaaaatagatgaatccacttttatcctccagatacacacttttagattggaagttgcctttcacgattttttttttttttggacatcctttttaaagaaaggagtggtgaacagactgctttgccctcagctgcaccatttccagagactggtgctgattgcaatattagaaacaaaacgtatttgtgaatatgcaagtaatataaactaccaaaatgggaaggaggtattactgccaacagttttcaaagcagcatatagactatattaatttaaaactgattttacttgtaattatatttataatgtaagagtgttaggtaactctcacaaccaatgggaactgaaggagtgatgactactaaatgtgatgtggtattctggatgggatcctggaacaaaaaaaataatattaggtaaaaaacgtaaacatttgagtaaagtatggacttcagttaataatagtctatcactattgcttcattaattatacaaatgtgccataagaatataagatgttaataatggggaaaactgggtttggggtatatatgtatatacgctctggaatctttgtaaatcttcaatacatgtaacacaattctaaaatgaaaagtgcattttaacaaatattttattacattatccagagatagatattcaaaagtaatctcttatccggggttgaattgccatttaaatttactagcttcacagagctcaagtttcttacttcttttggcaacacaccacagcggttctgtggctttttaacagtcaaatgctgtcttaattttgttgttgattttgacatttattttatttgtacatggaataagagctgtgccatgagatattaagttgctacaatagttttgtgttgtttacttcaatgcaactgaaacagagttttccgttgcaaaattatttgccaattcacttctattcatgtactcgaaatggattttgccttttgttgtgaaaataatttccacaattccttcaataaggaatacaatacctaggaatcaatgttttgataccatctattataggataagctttggttcattcttctagccaaacacttgccaaataatggagctatggaatagccgttgtgcaaatactctctctacatcattggacatctagccacaagaccctacaggaagcaatcccttttccccctgtcatttcttgtgcttcagtattttaagtttgatattcacacttccttatgtgacacaaatcccctagtacatgcttcgctagcgctaatattcttgctgagaaggcttaagtcattcctaaccctaaagactctcctgtcagtgaaataggttgattatagcatattaagtacaacatattctagctgtcagagacactagatgctgttctaagcactctgcatacattaaagttcatgtttaacaaacttcttggcattgacactactattagctaaattgtagagaagaagaaactgactccagaatgttgaattcacttgcttaagattaccaattatgaagtagtggaaggttttgaacccctgtagtctgacttcaaattcatgtcgcactttgcctctcagaatcttgtcaatccaatgaagatgtggaggaaaacgctatttaatgaacttaaaacctaaattcaaactcaaccttagctaaaaagtctttaaaacactttatatacatttattcattaataaatgtatacaatttaattagatgccagtctcctaaagttttcttaggaggagggtgatttgatatcatttttaataactctctatgaattacacagattctctacctaaggagcactaaattatttcccacattcaaaactatttgactactgtagctgtgggtatactgatttttagaagggtttaagatgtcaggcataacattcaccaattacgaatttagccttcctaatcagttttttctacttcagcttttctcctctgtcaattctccatgcagcagcctcgtccctcctccttctacccccaacccctggccacctcccctgccccatgagtctttgaaatccaaagccaatccaatacccatgtcttcctacggcttcacatttcgtagaaaaacccaaatcctaaaatactctgcatggcctcccatgacttgacacctttccccatctctctctctctctctctctcacacacacacacacacacacacacacacttctcagagcttctaactactgactccttaccagccaccctagtctcttgctattttttgtacatgtcatgaacactacaagtttgttccattttttggagcattttttgaatctggagaactccatggttcactctcacttccttcacatctcctctcaaaacatcgtcttatcaaggagatcttcccaaatcttccctcaccctacccacacgaattcttattaccatgctttgtttttccccaaaagacttaacactatctaacatatgactctacattaaattgctcatttgttttttatctgtcttgtccctaagaatatgatctccttgaggacagagactggttttgtttactagatatctctagcacctggctcacagtaggcattcaacagatatttgctgaatgaataattaatgaacaaatccaaaaagaactgtacaatgtatgaattgtgtagtgagatacatgcaataattgtttttattctttggtgatgtatacatccccagaatgatttttacataatttgaatacagtaaattgttactttgtcattttctgcaggggaaagaatgttgttttagattctaactgtgccacattttatcagtgggacaatacttacctttttcatctttttgatattgttttcttgactgtaatttgaggataatagcacctatccctatctcgcagattttaatgaggagaaaacacttagaagatactaatttagagttatatagaaatattaggctaatatacagctgtgcatcattgagagcatttatgctcctcacaaaacggaatttcagcccacttgtattatatcaaaatagcaccaactccacaccacttcccaaaactggcacaaatggaatttctccagttatgcttccttttcattcagttcttggagcaatgtgagataaattgcctttgtcctaacccgaatgtgtgaattaccaactagcattatttattcataccaatgcttcccttcattgacactgaataattgagagttgattgtgtttaggaagatcaacaatcccatggttcagttcacttttgagagcagagaactcaccaaccttcaaaagaattaatgtatttcaaaaaacacaatgtttaagtgcccaatttttagctacactaaaaattggtaattatattaatgaaaaatacagattaaaaattaagaactggtagaattataagtaataatgtggtaagtatatgtacagttgtttattttgttttaactattacatataaacatttattaaatataaataaaaacatttttagtagctattatggtcaggttttttaatttttttgtttgttagtaaacaaaaaaaaaagtcattgaagctattggactacattagcatcacatcaacttctcctaactttcaggagttaggaaaaggtagcaattatagtcttaacaattcactttagaatcaaataattaatcattcattgcccatggcactaataagtcattagtcttgtggaggctcattatgaagagaaatatgtagacgggttcatttaggtaatcctttctgaatgttgatgaagttatttgtagatgatacttgcatgttaggatcaattataacaaattagtgagggattttttctcctttttcataaaggcagggaagatagagtctgtctaaactaactaagaattatagttttaggatgcctttgaggtttcttttttctttttttttttttttggagacagattcttgctctgtctcccaggctgcagtggtgctatctcagctcactgcaacctccagctcctgggatcaagacattcctgtgcctcggcctccttagtaggggggattagaggcatgcaccaccatgctgagctaattttttctatttttagtagagacaggttttcgctatgttggccaggctggtcttgaactcctggcctcaagtgattcacccactgcctcagtctaccaaagtgctgggattacaggagtgagcccccgcacctgtccttcttcaaggtttcttcacatgtgaagtgaataatgaatggagcaattttttgatgaaacacaatttttatatcttaatctattgacctgatcagctcataaaattctaataactgcacaaacgtgctgaagcaggtttcgacatatgtacctgaagcatgttttcagacatgtacatttggaggcttttaaccttaaaagactttgaagtcaacaaatacacgtaatcaatgttgacattttatcattatttttcttctcacaaggaaataatgtgtttttgatttatctaaattcatttaactttttaattctctatcccacttatgatacagatttaggttgtatctatgtgaaaattaaaatttttacatttttacacatttagatactctattttggaaaacaaattattggactgatttatttcactaaagtgatcctccagttacatttcttggaactgactagttgttttggtttagaaggatacatttaagtaggtgagtactatataaagatatgaaaaaaccttgttatattttaaatagttacaatagttgagagtttggtttgttgatttcgttttttgtttgttttttacttttttttacttttctaattgtcaaatttttgttttttgcacatgtaagtataacagaatgtgtcattctggtaaaattcacatttaatatgaaaacatttattttaagaaaccaacaaagccacttaaaatatccatccaaaggtcctacaaattaaaactactctatagttcaggaattgttttgaagacaatttgatttaaaccatgccactactctagcaaaacacacaggctaacatttaatgtgttattattaacaatttaaacccactaatgagcacttaagtgtgaattcattaataataatgtcctaaactttgcccttagatgctcacatgtagtttccattgaggtcaatgggatatatactagaaggactaagcaattgatatactgatttattttttatctatcacctactaatgcttacaaggtataagttcctggaaaagatgtggcaaatctgaattatataagttaaatctgattttcacattcaaaaactgaggtgattaaaaattttgctcatgaccagtgacctgcccatattcttacctgtccacaccaaaaactcaaaagacagttacaatgctttgtaactatcaaaaatatttttctaaaaaaactgtcaaaaatacaggaaatcagttgtgaggcagaagtcatcgttcaggtttctcgaaaacagtatataaattgcaaatgtctgcatacaaacaccccacaaatacacgtcacactaagcccagggaattcatatccagatccttatggtttaaaccaaatattatagtagtcaattctaatttatatccctatctaatataagtatttataaaatgtgtttaaataggacatttcagtacacaatcatgtgaagttttttggtttgtttgtttttttactgatttttaaagtagtatacttttatagcagtggtccccaacctttttggcactagggactggttttatggaagacaatttttccatggacaggagctggtggggaatggtttcaggatgaaattgttccacctcagatcatcaggcattagttagattctcataagaagcatgcaacctagatccctctcacctgtagttcactatagggttcatgctcctctaagaatctaatgtggcctggttcctaacaggtcacagacctgtcctggtctgtggcccaaggattggggacccctgttttatagcaacaaattagatagtgattgtgtagtaccgtaaatgagttattaagttaggaatttcattcctacttaaaatgcattcttattttgttgcattttttaaactttttctttctttgtaatattatttaataagatgaaggtcctccagcttatactttgcatttttttcacacccaaaatgacagatataaattgctctcactcttcccattgggttaaccaccctccagcccagttgacctattcatcttccctatacttgctcctgctttcctgcttctgccacttcctcttctgcttttctcaccttcactgtcacctcacatcaaagtattccttcatggctcagtggaaacacatatattttgtgaagccctccctgatctctccatctggaagggaatattcctgtctcatgagtttttattgctgtatcgggcagaaaaacagaatccacaccagttgtattacaagagataatttatattagaaattgtttaaatacatgtgaaaaggttaaagggaaagaggagaaccctaaggttatgaagaaatagtagttgcaagaagatatcacctctaggactgggagaacagaaagaaaagattgggagtattagaacctacaatctctgaagaaggttcccgtggagctgagacccacacctttggagggatatgttcccctgttaatgcctcaggaactcagagactcctacagagttgggactcaccaccccaaaaaagaggcatcccagctggctggggcttgtttccacctctgggattgagagaaaaatgaactatggagctaatagatgctgtgaaggtgacaagcatgtggtgatgccgaggtgaggttgataggagcaggaagccaaacgttgaaatggcagatcctttccctttccttcagccaagtcctctcttcatgagataaaactaatcaagagtcagaagaagaagaaagagaaggagaaggagaaggtctgatagcacaaaacaaagtataggagggtagatttgacccatgagagaatatgtaaccagcaccttagcattttaattatacctcttctcagcactttctttcttctgatgtagtcttctgtattatattatctcccatcagtctctaagatccttgaaaataatatcttggtaggattcatattttgatcttccaaatttcaagtaatactgtttaataagggaatatatgaattccaccaaattaaagacttttccttttcaattacaagtactgaatgttttattataaaataagagcattagaaaattagttttattcttttattcggcactgcaaataattttcctgggattttattatgtttattacaatacacgtatccaaacaaatacacgccaagagagtgtcctttttaaaatgtatcttttattatctgtccatataattacatgtatccgtccatataattatacagatattgcttcaatttcttgaaagattgttgtttcttagtccagtcttacttttttctcccttttccaataaaagaaagtgacagcagaatcagaaagacaccctgatggctttctaaatccgaatgaactgaagaaagaggcttcataggctaggacatgaaaaatctggggttcacaatgaagatctttatgttactcacatccagaaatgacttactggcaaaagtctgtgtatttactgccggactctccaagtgctgaaagtggatcatatggggttggattggccaaactccgttaataaaaatttcctgaatttaatttgatagaaaacgggaaatctactgttgacccaggattgaatatctacatatatgaaaatacaaatacataaactcatgcaggcttttgtattatacttctgagctttttaatagagggaacatgttttaatgcatagaaatgttttacgatgaaatctttctgtaacaattaatgtgaacaggctctagagaagtgttgtgtaaaactacataaaatggtggacatcctgaagttgttctgaaaagaattcagcattaaaatatattgtcaaaattttattttctccaaaggaaactatttgatccagtaaaataattttatgttcagcatgtcaagttctactttacaaaataatggtaaactaggaattgattattcattttacaaattattgactatgcaattacttttattaaagtaacctcattgtacatttaaaaagcaattccatttaccaaaattggatttgcacacaattttatagttagtgatttttttctgtgaatttatctgtgttgagggacaatcatagttaaaactgatgagagtcagactttgttaatgatatagtcagtatcatttttagataaaatgagtagtattttattcttagtatattgttgagtcagaatcttatattctatgactatttctgtaactgttgttcacaaaaactatacatagctaaagttcaagtaataattaatatcagtaaactgtgagatgtcaaaaagtgattagtattcgattgctacaataaggagtgcaacataatggtgaaaaagtataggatttaggttaaaatgcaatctttttcacttacaagccatgtgaccttagagaaattaattgatctgaacctctcagtgtacaaagtaaggaaactaatatccatctcttaaatttgttatgcagattaaaaatattagtagaccaactgcttagcacattacttcaataaaggggagctattttgaattttaccactactgccaaatttaaccatttgttttcatctatcttcattttataggtatacatgcataacttattaggttttcattttaggagtgcactttgatataaaacctcctaaatttcatgccagttgtcaatctcctactattctccttacctgaaagcatgatgtgcttgtcatgtaatacatcgtttgaattttacactggcatgtaccagatgtcttcttagaacacataagcatgcattttcttctctgcattccctacagttaccctttctgggccacagtactttcagatatttgttgataatgtgttctttgcgatcctcatggcccaagattatacagttattcatacctgaagaaagagttgttaaatagggatctgtggccatatctctacacaaagtgaacatcgggtctggggaattaaaaaatgaacaggaaagcacacttgtggcattgtactagaccctttacacatattatcttatgatcagaatgtattattattctgctatacatttttctaaggcaaatctattctattatttccatccagagatgttttcccagtaaaggagatttgactgactatatagtgttaagtcacaataatttttataatggaaatctttttaaaaatttgagacattgtggtaaatattcacaacttaaacataaagttacctaaaaaatgaagcaaatagcttaggtatgaaacaaaagatgttaaatcaacaagttcttgcaatttctcccatgaattatctggaaaattatgatgattcttcatttggtagatttttcctaaaattatcagtacactaaatcatcagctagaatgagattcaagaataaagttaggtgtacagtttatattcatttattttataaacacgttgatatgaagttaaaaagcaatgttagaacgaatctaaatttcattatagctgctctataggtgagaaatgtggaatataagctaaagaaatagcaattgaagaactgaaacaatagtttgtttcaacatgatcactttttgccataggtttaccaaaatgtcctcactttaatacccggaacttgtggttatattggatatgtcctttacatgacaaaagggactttgccgacgtgaaaaagattagggagcttaaattagggatgttatcatgatttatacaggtagacccaatataatcacatgagctttcaaaagcagagacctttctatgaagaagagaggaaacagagagaaagtatgtcagatttgaagcatacggaggcctagacatgttgttgctggtttgcaaatggaggggcaatgtgatacagaatatggtggccttggcagtacgtggtggttcccgcctgtaatttcagcactttgggggccaaggcaggaagatcacttcggatcaggagttcgagatcagactagtcaacgtggtgaaaacccttctctactaacaatacaaaaaacaacaacaaaaacttagccaggcctggtggtggatacctgtaatcatagctacttggaggctgaggtaggagaatcgcttgaacccacgagactgaggctgaggttgcagtgagctgagatcacaccactgcactccagcctggatgactgagtgagacttttctcaaaaaacaaaaacaaaaacaaaacctgcctctaagtagctgaagagcagctgccggtagctgacagccagcaaggaaacagggacctcatctctaccacagtgaactaaattctgcccacaacctgtctgagcttgggagcagattcttctctagcatcacacctcataattccacagagtccaggctaacaccttggtttcagctttatgagaacaggagcagaagaactatctgatcccacctgtgcttctgacctagagaacagtgagataataaattgtcttttaagccactgactttgtgataatttgttatgtcagcagtagaaaactaattatatatatttccccaattctctttcatatgaaagtgttatttcattaatatagccaccataatttaatggatattttccaataggcaaaactttcaaaacaaaatgaaatctatttttatgtacttggggtttttacactcgagcctgatccatttgcttcatatttatttaacatagttcctaaaattcttacgtgattgaagctaatgtaatatttatgcaatcaaagttaatattaagacatataatgattttgtcaggtaagccatgaatataaattacaaattatcctaattattaaatatcataatatttgcatgaagaaaatattttttcaaaagtaatgattgctgtcattaatttggtgagtatactttcacaatgaatatattaacaatagttctttatgataaataagtaatactagccatataacactgagataaaaatatttacatcatgaaaggaaagcacttgtttacatgatattgtctaccatttatgtgtaatatttatgtataagtagcagtggataaggtatttaaagaatattgtaatttcagtaattctatttgtgataatctatttttatgaaatactcctaaatataaaaaaagttacacataagaaaaaataaaaaaagttacacgtaagaataccttttactttgatatgtcgatattcattgacttctgcacaaagtgagagaaaactatctcactgtatctatatgtatgagaatagaagtcttcattttaaaaatgtttcctgaatgggatagagagataaagagagtccttgactttgagcaggttagaggaaatacacatgagaaatggtgaataaaaggaaaagaaatagcaatggaaagaaataaaaagagtatatgagctcagggacgctcctgaagaagaatagagaatatataatagaggcaaatggatacacctgagtgaagaagtgtgatagtaagcagattatgagacatgaggcaaaagttgacaataagttgctagtaaatgaaagaaaagatgaaatagagacagacagacgagagacacaaaggtttgcatgtgtgcattagctaaggtaatcctagctgttattacaaataatttccacatttttaatggatgaacccattagtttctttagacctgatgtgtcaaggtgagtggctttcttccatgtagtgattcaagaacccagatctcattcatcttgtggttctaccaaactctgcattgtctctaatgagacaaaagagaatggagaaagtatactcacttagtaagcaatctgtacatatgcccttggtggaaaatagtaacaggaccaaccctggatgcaagatagagtaggaattgttgtctgtaaagtacactttagaaagagagtcattaaaggacagtagttttctgcagattaagccctgttaaaatcatattgctgtacatgaaagcaaaacctatagtcttagcaccacagcataaaaatactataaatgtagtgagaggaaaataaatatattctaatttaaaataaccttaaaatgtataatattcagtttcaaggaatcataaaacctaacaactttgttttcagactgcaatgtaagatgtccaatttttaaaaaaaaaattattttagggttatattacaaatgtttttatttttcaagtatgcctctcattccgaaaatgcatcttttacctgtgtcagatttattttgtgagcctaatcaaattttatgggatattttattcttccttgggccttcaaattttaatgcattatttttgattaaatattcagtatatttaagtctacatattaagtcacattcagcaaaggtgtcgataaacttgaatttttaaatacagtcaactgtcattttgaggtgttcatttctcagtctctaaattgagcgtaataatatatgtccccttacctcatagtgctgttgtgagattcaaatgaagaaaatataggaaagatattagaacataaaaactactttataaatgtaactatttttctctttcaatatgttccatctataatatatatgtgagtgtgtatatagtttgtatacatgcatacacatgtataaacacacgtatacttgaagtgtacttgtagtgttatagcaaaacacagaaaaataatctattgggtaggttgggagaaaactctgtgtttttgtactgggagttgtgacatttctggatcctgtatcatcagctattcagttgcctgaaggcaaactctgcacccagtgatctctcaggttgctgtccaactctattactctctgaacaaataaagtcataatgatatggaattgcatttcacacacatttgcaacaactcaccctttctagtctcagcttccaatctgactttttgtggcttcagctctgggcctccctttatggttttctccaccactcttcctaatcaccctctcctgtaactccatttgtcccttttgtcctcatcctgttggcaggaagtgaaattattttctgctgcagtcctgtatgttagctttcatttgagccttttagaaaaggtcttgtgtaagcacgattcaaaaatcaaggtaatctacccagttggacacaaagtacagtattagaaaacaatgcacaaagactgacttctcaaccaaggacttatggcgtgaccctgagtgaatgatttaatctcctcaggcttttgctaagggaattactttagttactccttccaagatagagatatttaaagatcaatgggatatgtaaagtggcctttggaagaaagcagaggggtaaacaagacttctcacatcctctcttttcttttacaaatgagcactctcttgtgctttgttatgattaccatgtaagttgttcactttcaaacactgttacaaatcctcagaaaagtaattgttcagcaaaagttataataacaatcctgagaatcattcctgatagcccagaaagtgtaaataaaagtcacgaatattcagattctttatattctaaatctccaatttgatagagctactttatgacattagacaaatcatatcactgccaagtcctaggttctatgtttctgaaatgtggtaaatttagtgctggtttcatgaataataaagtgaatctctgtaaagtgctcactttatggaaatactaaataataaagggattccttgcattctgtcaattttcagtaatgcctttgccttcgttacttagacatacctgtcttttgattcctattctcaatttgtagtattttttactagactgggcaattgaagcaaccagagatagaagacacagagcccatgtaggtgaacgatacagatgaggtgggcaagtgtttccagttaatcaaattttgcagttttaaatatttgtagaaggttaccacctgttcttaaagtgagcccatcccatttcagagtggtaaaccattctgtgattgtgttgtttccgctatccatgtttagacactaacttcatttcctagaagctaaatgctttaacattaacacttagtagcctaactgtgctagttttccctccacaaaaataattttatgcaaaaatacatggaaacaaaattctgcacgtgtttttaataataaaacagatttccagataattcagaaaaaaagtaatttcattaaaataataaactttaaaatactaatataatattttatatttagtagtttatatatatttaggtagttttttaaatggactaagtcatccatttaggtttaatataattttttagagttgacatgatttttatatcacaagtttaacattttgaaacaactcagtgagaagtggaaaaaaattgctattctcgataagccaaaaaaaaacatacacacacacacacgtacacacatatatgcacatatacacatatatagtatgtatatacaatacatacatattatatattgtccacatatatttatacacagatatacacacacacacactctgtgtgtgtgtgtgtgtgtgtgtgtgtgtgtgtgtgtgtgtgtatgtctttggcctatcaagaataacaatttgttatatatgtgtgtatatgtattttaaaatttatttatatatatatattcagcaacatatatatggagtaaaatgtaaaaaagtatagaatgttcaagaaaaaaattgttaaaaatcaatattttttcacatataaaaattagagattcagcaatgtctaaaaaggtcaaaattaggctgggcatggtggctcaggcctgtaatcccagcactttgggaggccaagttgggcagatcacctgagatcaggagttggagaccggactgtgcaacatggtgaaaccccatctctcctaatatacaaaaattagttgggcgtggtgggatgtgcctgtaatctcagctactcagcaggctgaggcagaagaatcgccggaacccgggaggtggaggctgcagtgagccaagatcacaccactgcactccagactgggcgacagagcaagactccgtcaaaaaaaaaagaaaaaaagccaaaattgaggagaacaactaaagatgtatactaagaataataaggtaaggagctaaagataggagtagagtctgatagcaaaataaaatgtaggagtagagtctgatagcaaaataaattgtataactattactttgcttttaaaagtttttgtttcgattccatgctaacttttaaaatatatttttaaaggctttttctttgatatttagtcttcagacagtattaatatgactatagccattatttgtttaaaatgtaatttcattttccataattaccattgtaactattgtgcttttaccttagagtcatcttaattcacaataatgacagaaagataattgctgaattttgaaaattactaagtatctgaacaaatataataaaggtcattgatattttagctcaggatatactttattcactcattttggcaattttaagttagcttttaattattctaacacttggattagtcaataccctaatgcacattctatgaagcttaaaatactcacaagagatactttcttgccaacaaattgtttgggttagctaacttaggataccaaacatctcaaaggaaaattaataaaatctgctttcttgggaatgtgttcaacgtcgggataggaaagatattttacaccacgtctggctctgaggacctcacactcttgttttacttggaactcatatttccttttaatacttatagatctctatttattcccaattcagactttgcatctttagtcattctgaattagtgagttattattatggtttatcttgaactatattttagcctaaataacttctgcctcatgttggttcctgccagtgttcctatcattgttttagataaaataaaataaattcccaggctctgtgatgcctactaactctttccccaaatgtttgtttgctattgtgttcaaattcaagttgccaatcacttgaacattcttagatattataattataaactattctttggagaagaggctttaatgtttggagctgacaatggaaattgagatgtttacattctaagcctaagtcatgaagtataccagggcatgcaacttacccgctttgaacctccctagttataaatagttctgaattcttaccttattttctggaaatgttcttaatttatttcagaaaacctacttgtattcagaatgctatggctgtgtagttttaaatcagcataatagaagctggtgtaagtgaaataaattcaaaattcctgcttacaattctgagggcacaattaagtagctggcaggaaatcccagtcttttccccaggtggccacagacttggtgaattcatgcctttgcaagatttgaactgactcacaaatctctctatccttcatataattctccaacaataactttatacaagcttttgcttgctaaggcaagtgaacacaatgtgcctagcgtaaagccatttatccattcaataatcatttactaaatgaattaatggaagaagtaaacctgtaataaatgcccagttgacccacaccacctcagtgaagtcaaactgagacttcttatgtttgtttttaggtacacaaccctgtccaaattctcctttagaaatattttcaatttccttatgttaataacatcattgtaacctaatggtgttatatgtgtcagtactgtggattctggccaagcatgtttggttactgttctccatctttccttccctctttacaagtgataatcaccacctacaagcatgggattttccacactcgccaaaacttttcccacagtataacataagtcactcccttttatcttgacccaatgccctctccccaggtcaggttctttagtatgctgacataagactgtgaactatatattctgttttatgaattttcatgtacaattcaccagacatcactttctgaatctgatttgattcataattcaactgatctattttgattttgcattttagaaaaacagcagagtgtagaaggagaaatggatcttaaatcaaagggtttcagatgaatctcaactaggaaattcatgtggctttggagaaaaataattccattaaactctcctaaatttgactcctaatatacagaagaaaaattacacatgaagttaaaaaagtaaggatataagctttatcttataatgacctacttaaggaaatttcttatgatcttcttttgttctgattgtacccaacaaaagactccaaatataatgatcagtatcccatgcactccaaaggagacagatggaattattttgagaaacttcacaagaaggaacctgatattctgttgatttattttttaacatattatgttgccaataaacaataaaaacaactaagaaatgtagccttgcagggaggaatgatttaatttcattattaaatgccaagttttgataattattcaatgtggaaaaatgtttatctacatatataattgttttacataagttttaaatgctatgatactcacactggacacagttctatttttcaatatagagaactctgatttttttcaatctttctatttctattgacatgtcattaattttcagaaggaaaataagctgaactaaataactatctggaatccattttgataaggtaatatgacttccttataactggaatgacataaaatatttgactttaattcaataatcacaacaatggatcattttaactttcataaccaatagagctcatgataatatattgaagtacatcagattcattgagtaattatgatggcactttatcagatctgcacaatgtactggcggaggagtcacatcaatatatttaccctaacatatatcgttacacagtatataataaattttctattttatggtgttctgggaactgagggaaatgattcaattagcaagaacacgtgaactgggggaaattaaatcaactttaataaaaacatctataaaacatgttgcaagctaagtatagtggtcattagggacctcattcctggaaatcaataaaacatttccagggttatatgtttataacttcttgcatgttggttggactcagctcaagggcatccttaaaactgcgagacacctgaggactcctgactttcggtacactacatctctagtgaggttgctaagtatacattagccctttgtatggaactgggcatgagaaagcttcccagcaagtgaaatgtgaatttaacacatcattggtaggtaatgcagacagaaagaactcagtaaagattttgtttttcctaaatgcccaagtggtcagatcctgctgctcgttcatgattatgggactgtggatagtttctattacctctttgtatatttgtgtatttttttcacttttctaaaataactatacctttttaattgccattaaaaaaaacaaataaataaattcatgtacattttaaagaaagcaaaaatgtaagtataatgtctttctttactgcctcctcactcttcccaaattcctcttcaattctatttccctacatatagggaagtataaggacatgtttatgaaatgaataaatggacgaatgtatacatatctttgcaaaataggctaagtcatagatccctaggaacagacagatttgtagagcagggatatttagccatctgttttgatcacaaagagttgctgtgacctaattgtggaaactgataaaataagtacatttttaaaatgtagtcttgatttttgttattgtactatacaataagctattacaacaattcatatatagttacttctttctgtgattttattacttctctgctacaaagacaaacattgtcccaatactctcaggcccacagggaagaaagaatgattttcacagtagtttatacaaacattactctttaaattggatcaggaaagcttctttataaacgacagcagttatagaattgagactctcaattgtaatataaaagtaaattttaaaattttcttagctgtgcggaatgatttagcgtttagaatgggaaggaaaagaacttgttacatatatagaagagttttttaaagtgatttattatttaaaaaaacaaattgatgacacattttagaagattgcttagcaatagattcttctagtttggagttattaaatcaatccacttaaaggtacactttgcataacatattaatttatggtgatgtaagatattatgtgtcatttagaagtaaactaaattgagataggagtcagtatccttttttcaggactctgttcttagtatactcagagtaaccagcaacttttagtacatggggcagaaattagctaacccagtagagataacacaaagcaaataaatgatacacaaagatgatacacattttgctgcaatgattacatccttctgtgtaaccatggctacagtataacaaaatttttcattcccattttggaattagctctttcctagtaatgcataatgataatacctgttccatttaccactttctcaatttctctgtctcttaacttcaatgtgctgacctatgatttatataagagaataaggctataggattttttggacctccaaattgacaatcatgtttataaacctatatagctaattgcttcctacagttattttttctactagtaactaatacatgattaaaagctggaaaagtatatcttatgaattgatgtctcttaaaaaatatttggacaaattctctgcttaatatttttcctccttggctcttggtagctttcactacaaccagtaactctgatgaaggtagaacagagcaaatggaagagtgaatgtttctctgggagcatcttgtcctatttggaaagtaagccgagggcatgctttctgtctcctttcttgcctacccctcttgaggttcccacaatctcagttgtattaaggtttgagattagatagaattgaagtttgtgcttaaatgaaaaagatggtcttctaggagcttattcagcaataaaactgagcactctgaaatattggaatgtaaaagatgccaggatttcagatgtgcttgggccatttcaccttcaccctgttctcctcttctagaaagttttcatggcagcattccagctgcgtttcttccagttgagtttgaaatgccctcttaccttggctaaatttcaactatgtcagtaaaatcccaaagagcaaatcaagctagcagcaaaagtgtctttcctagttgacccctgagtacgagaagtcacactctgccatcgggattatttcatagtcagttttaatgaatacagtcattttcttgtgcataggcattcagttgttaactgaagttgaaagtcactttaaacacctgtctccttggactaaacaaaatccacagcagcacctgtagagtacactcctatgctctagtgtgaccacaaccagattcaccactctaaaattccagagactagcctcaaaaaggagtctatccatgttcccctaggaatgatcaggccaggcatggtgtctcatgactgtaatccctgtattatgcgaggccgaggcaggaggatcacttgagcgcggagctcaagaccacactgggcaacaggatgaaactctgtctctaaaaaaatttaaaaattagccaggcacactcctgtggtcccagttactcaggagtgtgaggtgagagaatcgcttgaccccagggggtcaaggctgcagtgagccatgatcatgccactgcattccaccagcctaagcaatagagcaagaccttgtctcaaaaaaataaaagagagaaataattaataagatgtactgttcatagcacaacagattgactattgtcaataatagcttaattgtacatttttaaataactaagagtataattggattcttataacacaaagtataaatgcttgaggggatggataccccattctccatgatgtattgcatgcctatgtcaaaatatctcatgtaactcataaatatatgtacctattatgtacacacaaaaatgtagaataaaaaagaaagatgaggactaaatccactatgcaatacaggctcaattacttcagcttctatagaagcccattttttctactcctgaaacagattattcagagcaggtgctttctcattattacccaccatccttctttgaagtatatatctaacattgtcattgcttccaaagacatcatctattaaaaacttaaccactctgctctttcataattctcgggtagctcatgaatatcttccaactattattagattcttggtcatttcttctaaggagcttgtcttttatcctactgcatacattcactcgggttttccctatactaggtcaacactaatcatcaaacgcaacatgtccaaaactttattttttgtattttactgtctacctcttattatatttctacctcactttgtttgaccattattcaaataataatagaataatatcaaccattattcaatcccacaagtacctgcaattcgttgacactaccgtattattattattattgttattatttttactgtctctcaccccatttaacctcacttactgcccttttacatcgctcaggttacacgattcatcattataatacttcctggtgtcctccctcatgttctttgcctgttttttctgtatacaactcacctgtcaagtctcagctttggttaaatccatttctcctcttactgccagcctatatgtgagcagctgaacagtgttggagaaaaccagcagttttaccaatggatgttaaatttatggccacagatttatgtttcaacactgctcagaaatcctactgtatttctctagtcaattcacacttctaaactatgaagcaactacttcataccttctctcctccaacatcgtgtctcctccccactcctaattcactcagctgattaccttgatttttatatccctttaaaaaaggcaattcaattataagtttataattcttccaccaccaaatctactaacctgcctttacccatgcacttccctattactctttcaatagatgaactgcctccaaagctattgaaatctagcaacttaaactacatcccatctgttccatgcacttaaagtccttgtgcttgccattaattccacctttctcctgttcttatcagcataaaaactttctgtaacactccccatcttagaaaagacctcctcaaatattcttctccagctgccaccctttatagagaaactgtttctatttatattactgtttctattaccttgtttctcgatatttttaccatcaggctttgaagcccactctcctcttgaaggttctcttttctgggtcaccagtaacatcaatgctgctcataccagcggtcagttctcagacttcaccttatttcgtatttcacttttattcaacacagttaattactcctttacaaaagactttatatacttgtcttctatgccaccatggtttcctggattttgtttgatttgtttgcatattttttagtttaatttcttgtttctctttttctttccaagaaatgctgtggttctacttacctcttctctctttaatctacattttttctctaggtgattttatctagtcttgtggctttaaagattattgtgtaatctctcagtcctccagattcaaattctcctctgagtttcactgagctgatcattgattggacaggtcaaacagaactctgatgtatgagttgaggaggactaaattctatttttaaaatttatcattaaaaatcagaagcaaaaatggtgattctagctgaatgtatgcaataattctaatgtcaatcatattgtagttttctctataatttaaatacatcatttcttttaaattaaaaaataaaatccatgttttcattctttaaatatagtgaatatttatacatgtgaacatgtgatatagctagagagaaatcaaacaaataaatacacatataaacaagttttaaagaatagacaatgaactttaaaatcagttaaacctatagtttatttttactgcatattttaaaacagttaagcctatagttataaataattattttatatatcctaatataattgctagtataacatgaaagttgttataataccctgggtctaaaattttgtattttgtaataaaaatctatatgtcaccaagtcagttttgacatatacaatttgaggaaactaggatcaagttagtacaacaaaaacaaaatgaaaatgccaaactgaaataaaaagatcatgtattccttcaaatcactacagaaacaaaagataagccagattactaaaagttagttgggaaatgataccaaaaaaccattaaaatacaaatatattaaaaagcaagaagaaatcaatcagttatgaaaataaacaaatggaataaaatacccaattaaaaaactatatgcatattatctgagttatatgtaaaataaaatagctataaaataactatgaatagtcatgacagaggcaaatgctcacagggaaatataaaatgaagatataagataagccgctatgtagtcataatgtcttattatattaaaaagaataaatgcatatgtaaacacacatactcccctgaaaggatataaagtaaattttacagtagttctctgatagaaatttgacaaatgattttactctcttccttttacttctctgtagttaattttttttgtcaatagtattatttaacatcagcaaaggttaatatcaatacactatttaaataaatcactgcccactttcaaaaccttcagtctcaaatcatttacagattatttcaccttaaattcaaggacttcaagagtctactccacatctcaactttccaattatttttttgacctctctgttatgtgaaaacttttctaaccaaaagagtctacattatgatctttagacatggtgtacattctcaccttttgccgaacttgtaataccctcaaaagccagctcaaattttattttgtccatgaagcctttgagattatcttaacatttggagatgtcatcgccatagtttctcatagcatttttaatactattgatctggcactaggctaaggatttctaacatttaaaaaaatttcatatgtgccctgtttttatggtatatgattaagaaaatagagcaaatatgctgcatctggctcagagctctacatgctcttgttaatggtggtactgctcttaaaaatgataatatgtttgtggactaacataaatttattactaatgtaatggatatataactctataatgtatgggttttatggcaaagtactgctggtcatattagttggataattggatcaaccttgcctcttcctgcccagatctgtacatgatgccctccgtcttgacacataaatgattccacagttttttccttgtggtctttcagccataataatggaagctagtagcttgaatatcaattacataatattattttggttaaataatgactggcacagagtaagtagttgtctccttttgaaagtgaccagtttaaagaaggattgatagttatcccatccatcagagaatggtgaggccaagaagcttcgctaacccccagatgtgtttgatgcactatgtcatccacaactgaacgattttgaaaaaagtctgttttatttaacaacattcatgaaagtttagaaaatggatattaggaatttttttgtacaaatctacacagggcatgtttaaataatttgtgtagatactcccacctcaaagaggtgaagtctcacttctgccccttgaatgtaggctgtgcttggtgaatcccaagagtagagtctgaaaaggggcaggggctgattttacagtggagaagcttgaaaaacattatcttatccatgtgatcaaggttaacatcctcagtgataagtcatgttgatagctcgtaccattgcatgatgtaatatgaataatacttacctccttacctacctaaccctccttacctaacccggttcatcctccttacctaacccggtgtcagtctaaccacaagacaaactcaaactcagggacattctaaaaccaccaaatgagtattcctcaaggctctcaaggccatctaaacaaacaaacaaaatctgagaaactgccccagtgtagaggaacctaaggatgcatgacacctaaatgaaaggtggtgtcctgagtgggatcctggaacagaaatgtttgcattagggaaaattaactaagtcccaccaagggtgttttttcagttgatagcaatgtatcaatgtcaatttcttaattgtgacaacctatatactatagtaatataagatgctggcaataggcaaaacagagtgagaggtacatacgaactctctgtgttatctttgcaactttgccataaatctaaatctactctcaaataaaaaaaaggttatttaaatttaaggatgtctcttgtactgtctgttataaaatactgttcaatgtttatagaaaatactccacataccacaagtggaatgataaaagaaataattttgacattttgtaagtaatatttttaaatgaaaagtgtgctggttaaagaagaatgtattctagaaagtcatcctatcactccagcaaaattgttttttatgtatagtctttgattttaaagagttgtaactgatacaaatatagttgaaatacatgtctcaataaataagagggaaagtggatgaatctcaataaaaccttgctattatagtaatcttctggagaattatgggctgctctatatcctttagatgtcttcattctgctacggttaaagcatgacttacttccatcattattccttctcacaaataacaatatatacacattctgtgcacttttctcatctgacatacatagcttcagaacgtaagtttattctgcttatttggacacttttagtcataaatcatttattattattttcctgcctaccatttcattacagtttctggtttctttgaaaaaaagtaactataggtagactatcttacagacccttatttaataggtgtttcgtggcaacatttagttgaggacatgtcactggtctcttggaaattttggtttggagctggaaggtaacatcacttaactacaaaatttttatgtttataaaggaaaaaattgaaacagagagcgagaggtcacatacttaagagtacatacctgatggaaagaagttcccagaagcctgcctcccactgctgtgctgtcatgcactgctcacaaagtactattcacaacagttgtgttcccaatgtttgggattttaacaagactatttgaatttctagttcttatcatttcagacagcaatacgttgatattttgacaaaaggggcaaccgttctaaaattgtacccagtgttatttgtcactgaggataggaaataaatgaatgtgctatccatagcaggatgaaggcatccagctggagataggccatgatgctcagaagacccttgcatagtccataatgctagattgttttcgtgtgtgtgtgtatgtgtgttgtgggggtaggcagctgcaagataattaaaagaaatgcaagccactaattttggtcttttattcagtctcctgctagaaatcaccaggtaatgtggccactagttaagctagtcatccatttaaagcatttttgaagtagataataataggcttacctcagagatactgtgtcgttcagttccacacaaccacaataaagtgaatatctgaataaagcaagtcacgcgaattgtttggtttcccagtgcatataaaagctatgtttacactatattgtagtctattaagtgtgcagtagaactgtgtctacaaaaacaatatatataccttaattaaaaaaatatatattgctaaaaaatgttaacaatcatctggactgtcagtgagtcttaatctttttactggtggagagtcttgccttgatgttgatggttgctgactgatcacggtggtgttcccgaaggttcagtggctgtggcaatttcttagaataacgcagcaatgaaatttttcatactgattgacacttcttttcactaatgatttccctaatagcgtgtgatgttgtttgatagtattttaccaagagtagaacttcttttacaattggagtcaatcttctcataccctgcattgctttatcaacaaaatttgtgtaatatcctaaagcctttgttgtcattgcaacaatattcacagtatcttcaccaggaatagactccatctcaagaaactactcttttgctcatcaataaaaagcacatcctcctccactaaaggatgccatccttcgatcacaggatggcagcaattcagccatatcattaggctccacttctaattctagttctcttggtgttcatgatacatctatagttactttctccactgaagtcttgaactcctcaaagtcacccatgagggatgtaataaacttctttctttttaattatttttgtcagatctgataatgattcacaatattttctttttaatttttttaaatttttattttttccagatcaacttcttttaaattcctgataacatcaatatttgacctcctgcaaatcatgaatgtgcttaatggcatttagaatggtgaatacttccagaaggttttcaattgattttgccagattcatcagtggaatcactctctatgtcagctataactttacaaaatgtttttcttaaatagtcttgaaagtcaaaattactccttcatctatgggatgcaggatacatgttacgttagcaggcataaaaacagtggtgatcttcttgtacatttctctcagagctcttgggtgaccaggaccattgtcaataagcagtaatacttagaaaagaaactttcttttttttctgagcaatttgtctcaatattgggcttaaaatattcagtaaaccatgctgtaaacccatatgctgtcgtcaaaattttgctgtttcatttctagagcacaggcaggctggatttagcacaattgttaaaggccctaggattttcagaatggtaaatgaacattggcttcaaatgaagtcaccagctgcattatcccctaacaagaaagtcagtctgtcctttgaagacttgctgctagacattgacttctcctctctacctatgaaagtcctagatggcatcttcttttaatagaaggttgtttcatttacatagaaaatctgttgcttagtgtagctaccttcatcaattaacttagcaagatctggaaaacgtgttgcagcttccatctatattagcacttactgcttcaccttgtacttttatgtcatggagatggcttctttccgtaaacctcatgaaccaacctgtgctagcttcaaatttgtcttctgcagcttcctcacctctctcaggcttcaaagaattaaagagagttagggccttgctctggattaggctttgtcttaaggaaatgttgtggctggtttgatctcttatccagaccactaaaactttctccatatcagcagtaaggctgtttcactttattatcattcatgagttcaccaaaatagcacttttaattttcttcaggatcttttcctttgcatccacaacttgactgttttgggcaagaggcctaggttttggcctatttcagcttttcacatgctactctcactaagcggaatcatttctagcttttggtttaaagtgaaagacgtgtgtctcttcaccttattagaacacttgaggacactgaataataatttcaatatcattgtgtctcagggaccagagagggcaaaggagagggagagagttaggggaatagctgatagatagagcagtcagaatatacacatttattaagtttgccatcttatagggacacaattcgtgacacctgaaaacagttacaatagtaacatcaaagatcactgatcacagattacagtaacagatatgataataatgaaaaagcttgaaatattttaaaatttataatgtcacatagagtcacaaagtgagcacatgctgttggacaggtggtgctacctgcacctataccacaggccactgggacaactatgattgccaccaaaagctgcatggtcatggtggggcaggagggcctggtctctctgcctctgagggatggcccccagctaatagcccactctctgttttgagctcttggggccaccagcactgggcactgctggcagctgggcttttgatgtagacccaccctgaattaggttcttcttccccatgttttatacagatggaccagaagccaccttcttcttcccctgctagccaggggctctacacagactaacctcggccctataaagaccagccaaaccccatgggcaggaggccgatatggaccagggggctttaccctgactgatgcactttatgagctcggtgagaagggccctgtattcacctccactgctcccaggggctgtggatatacaggctggaggactgcccaggctcccacctgtttatttatttaacttatttcagtgttttatagtaaaggaaacactaaccaaaaagaaaatggtgctcattagtcctgctcaatgcaaggctgccgcaaatctgtaatttgtaaagtaaatcacaagaaattgagatatataataaattataagtaatatgtatccattatatatgttattataaacacatatagactatataaccatattatagctaataaagcaacaataagaagggttgattataaccaaaaagtcaactagatagaaaattgatagatagatattacatagcatatgcatacatatttatactttctcatgaacaattaaatcctagtattactgtttgtttcagttgatttgcatactgccttgggagttcagagacatctctggcagccagctggatttggttgccaaaagctttcaaactcatggaatcaaagtcatctctgaagagagctttggggcttatggtcagtttgctgatttcttgcaaggatatcaatgtctgcaatgcacatgatagaaaaacagggagctcactctgagcctgccagaacagtgctcacaaggcatcagagccacggaaggaacactgaaaaacgaggctctccacggcacttgctggcgtccctcctggaattgacaaggttatgactcaagcatttcacaaactggaacccattaatggagacacaggaacaacctttagctattaagtattttaaaaaagaaatttattgtatatatacgttacaccatgatgttttcatacacatatagatagtgaaatgattaatatattctagcaaatgaacatatctataatctcttagttaccaattttttgtggcaaaagcacataaatctacttttttttagcaaaaaatcccaatcccaatacagtattattctcatgtgattcattagttccctagacttactcatccaacatatctgctactttgtatcctttgttaacttcaaatagcatttacaataactaggtatcccagttaactctgaaatcttaatatgacaactcaatgatgcctgccgtgccagagacgaagagggcttaaaatatggaaaggcaagggctagcttactcttgaagaaaattttcttcaacaaaattagccaccatgcctggctaatttttgtgtatttttgtggtgacggggtcttaacatgttgcctaggctggtcttcagctgctgggctctcaagtgatccacccgccttgacctcccaatcttgttgggatgggagttagaaaatgaaatagctagaggatcaaattaaataaagtgtacttgtaacactgttcagcagcaagtgttatataaaaagtaaaatgttatttaagcttaccttatgatataaaattattaaaatatctttcagactctctccacgattttccctgttttgatatgggtatataaacttgatatatctataaatttacaatatattttatgtctttaagtttcatatctcaatatagttacttaaatattatccagatggtttgagaagacccatagagagcagcttttcatcataccttgttgatacactagctttgactatgtttttaaaacatgtcaaaatttaggagtgacattacatttttcttaattagagcctcagacatttgaatgatgccaaaatcttagataaatatttgtatatgcagtgatgctcacatttcccaaacttcttaaacaggtcaactgtaagagaagtggtacccaaggaagctgccttctagaaggattgctgtgtctacacaggcaacttccaaccgctataatggataagtcgatcaaaataatggatcaaatttatcaaaataaatgttcacatgtttgactggtttctttgaataggattcactctctataaaaaaaaataacaattttaagtactttcaatgtccaaatttgttagtttctgttatataactaaaaaatattttgtaagagtgtaatgttaacttactgacttgatagtttcagattgactaggctattcatttttaaatgtcttttcaatttattgaacattattatattattaaaaataattcaggatatgaaaacgtagaacaatatcattcctttatccttctccccaccctagcccatgctctatttcagatttccctccagcacttttgtaaatatagtgaaaaaatagtagaaaaatacacagtcataaaatagtccctgttattagattcaaaaatcatgaaagtgcccattgggttcccattaagtttttaaacctagacaccaaatttctgtccttattttaacttaaatagatggaagagagagaactctagctcctttgagttactactgctatataatagatcagttattcccaaacctcactgataatcagaaacaacactgggaaagctttattaaaaaaagaggtgctctgattgactatatttattaagataatgaaggagatgaaatttttttttccatatagaccaggtcgtggattccatctttaatgtgagtctttctctacctatgcaaatacccacactaaaagtagctgcaacaggaccttgtgaaagaaagaccagagagtttacaagttcaaattccaaaatcctaagtctggagaaggattttctatgctcatgcctgagactagcatgttccaagcacaaaaggtccttcagttggctgccaccaagacagaccatggtcaactcattttccagctgcctttttggctgcatgtctggaagcaccagataatctgagagcaggaggaggatcttggtctcagtggattgcataagcatggtgtgataattcttcagctcaggatcaaagagaaatgggccatattatgtcactaatcatcaacttgtatgtatatgtgtatgtttaataataaatttgtagacacccagggcaattcatttgaaagtagtttataacctatgtcatattcaatcttctattcagcatctttctttatgatgaagaataaatcattataatgttctgaatgtttacattaaacacataaaccattttacagtcatttattgatttaatgtttctacgacctattttattaaatatttttaaatactttgatatcagtaacatgggtcaagtatttgcttaacacaagtgggtaaattaatggtgctgtaaatataacctgaaactttagatcatcaggactttgtcctccagtttaaaggcaataaaattaatgacactgtcactgtcaattttcagatgataatatcaatatattggattagattcaaatgtattgcagtgtgtgcttaccaaacattgagtaatttgattgcatattcaagtggtcaataatttttaagtaatttagaataagttttttaagagggtttgggagaaacaatcacacttgacactattcatctggctcatttttatgtcaccttattagggtgaatcagttataaaataaattgatttattttattcttctccaagtgtataagttttcaactgtattgatcctacataattgcatgtaaaataataaaattacccttataagtctcccaacttctctcacatctacagcataaggagtgtgacctaatgctaaagtagctcgaattgaaatgccctaaccattcatccatgttctatatagttcatgtcaacctgattcccttttattatgagatttgtcctctcagtgcctgatccctcagggaaccaattgaattcttttatttctaaataattgaggagacaatcttacattttccaatggtctattgatagccactgcttcaacttggaaacctgagcacatggcttggaagagatggtgaataccaaaatgatgtctgttttaacaattccttgcattacaatgtagcaaatagcaactatttattgctcacttgctatcagtcaggcaatgtaataaatagttctgtgatagcagtccagcgaggtaaggattattcttgttaactggatcatttgacccaacttactcttacggaaagtcaattttggtaattttgcatccagaaaaagataatacacactcctacatatgcacacatacacacagccctcatacagtattgacatgtattatagacattcactaaggttttattaaggagataagtggtttccattgcatgtttcgtggaatttctttaaaaatccaagcaacataacctcaaaatatatatatatatatctaaccgatgttatcttccagattctttctctgatatgccaacatcagtccctatggttttgcccttttttttcacttcctctctggctacttctgtctccttctcactccagttttatgacctccagggtttcctcatttttccccagcagagcatgcctgtttttgtcttctttggttatcctcttactgcgtgtcgattttccaattaggactaacaactttccccttaagagatacacacaaaaaaaagagaagaaattaaaatattttagaatgattttctctgtcacatttgcactttacagataagaaaaatgtagttaaaaatgaattcctgagaagtcaagtagcttgttcagctggttaaatacttaaaatactattttaatacaaatttgaatgggtgattatattccaaaattttgtttttttctaatatgtaacattgtcttactgtggtacaaattatgtctaaacctatgagctttaaaaaacagagactattgtaatgtatgtacaatgtgtgctttatttgaaacccctactgattttcaaaactagtctattccttttatctttcctttttaagtaaggagtgcattgtccatatgggcacctactctgcaaaaagtttggagatttgttttcagccaatctgtcttctgaatagtagctgttattggacacaactgactctcatccatttctgataagaacccaaattttcagcaattattatcttctatgaattttttgattatgtgtataactgggatagaccatggccctaaccaactagtctggaaagttgtgagagaatagacatggaaattactacatgactcctgagaaagcaaatactgatgattactgtctgcttccatgaccaacttgaattatgagttctgacaagaaaaaacattagaattaatgggaaaatgtttattcctctctgaacaggctaccaagaaaaaatgaagatgtttttattgagacaggagtatactgtagaaaacaaatttcttaaaagagttgaggttatatgttaaggcaaattataataggttaagagcagcaggaagcaagacagaaaggtaattacagctgagaggattaatagaaattattataaatggctcatgctcggattatattatgtgagacatagaatcttatcttgtacatagttttgagcaaagatgtcatttaatttacatctgtactctaagattttatttcctaaaatggagttataagaagtactatcatcactaaaatatttattttatcccaaattgaaaattatctaaggaaagaattttaaaagtataaccattcataaattaataatcactatgcaatcacaggattctggaattattttcattagcgattattattaacctaaaattagcagtggactcttgaccttggccttgcaattggttgattcttaaaaatgtatgaatcatggccacaactgcaacaatagttcaaacacaatcaaattctcatggcatattttgctctttgatcttggtaataatttctgaccttgataatcattacacgttttcccacaaattcattctcaatgacttttgctcatttcttaattcttcagtgactgaaaaagctaattcattaatgtgggagttcaaaatcacctggttttcttgggaaattaagtgataaaagataataagagatactgagtctaagactgctgagaattcccttattttaccttggaaataagtgcaagtctgattattaaaaaatgaagttaacttctacttagagaaaacctctgagaatattcagtactagtagttccttcttgctcctgaaaatgactttagagatcttttcacatttctgtaaactccttcactctcttcttctcttatatattcaaacaaacattaccataggtgtaaatatttagattctaatcctaaaacatgtatttcaaaggaaaaatgtcttgcaaaagaaacttgatgtatgctgtcaccatgtgcagaaattacttctgtttcccacccatcaatctcagccattctttgtgcctaccactacagtagataggttctgagaatgagatagtacaagatcaaacaaagcagatagctgtcttctcagtctaatatcattgatgctaagccaggtcccatagaaaagattggagagcctcaaattatatggagttatttgagtgttaaagtatgccttattcagaaataacaaaatgaggattaaatatctggagaaaggttttcattatgtaaattatatgagtaaaatcttcttttctgattctgttaagctctattcttgaagatgaaatagatcccaggtcagcaatgaaagttgttcagggaaaagaattggaacaatctctgtgataaattagtcatataaataaaacttttttcatatttaatttttctcattgatctgatttaaattctaggcatactctgtgtatctcttgttgcagatagcaggtcagccagcagagagttggtagactacaaaatgtgatgtaggggctaacaagcataactttagaaaaaaaggtagaatttgtgggtgttgaagcaatttttaaaaaatatttggagggagttatagagaaaatgccattctgaaaataaatgaagaatatggtataacttctcattcagtgactgttgttcaaaaaaaaaagaagaagaggaaatccgatttgaattaaatcttcaggtcattaatttgtgaattcatgggtagcttcctaactctgagctaatcacataccaaaaagtttgcttaaacaagaaataaaatgatggtgtataaggagagattgctcaagaaacttaaattaaaacctgcaaaactaaaatataaaataacattcacaatacatgtaaatgcttaattattttcctaattatattgaaaagataaatatcaaatggttatcacctggtttctgtctacccctccatgggacacaaaattcaggaaagtaatgatcttctttacttttgaaaatcaaatgtattaatgggtctcaatatatgttgattgaacacggttctaaccctgatactgtagtgtatatggagtggcaacgtggagataattggaataggaacatcagcgtaatgctgttctttccttgaatttcagcaaagggatctactttctaataagaaagaaataattttatattcagtttttaaagtgactcacatttatcatttcatggccctatcaataaccttgtgaattaagagaaggaagtctcacttatttgtatttttgaaattagaaatccaagactcaaaacatttaagtgatttttccaaaatcaaaagactactaaatcttagatgcaacactagaaaccatcaagttcttctgccatacccttccatatacattcatgtcctttatttgtattttttataattcttctatctcctgggaaacatctcctcacacaagatctaaggccttggaaatatttaaattacgatttggagagttgggttggcaaattcttggacaagaaatcattcatcaagtacacaaattataattatctacatggctaagaatgtaaaacacaatatagattttaagttatatttagcatatgagagaaattattcactctacacatttgtacctgatataatgtgtatttcatgctatctgcaatgtaatatcaaatacaaatacttgtctttaaaaattgtgctctcatcatttggattctcggtgaatataattttaatttttctcctctgtctcactatgcccatgagatctagattatgttatcaaaatcagaaatgttaacagctgtcttacaactgatattcttaagtaattgtaaactataaacactggcactagattcaaaacaattaactaaaaataaagtataaaatatatgtagaattataagaaatctacctgattgctctgtaattgcttatatttaaattttccttctgttaaataaaaacaaatcttaaaaagtcaaagatagagagataaattgtgagtgaatcaaatttagccagccttggaggtacttgaccaaaatcccttgggcttgcatcatgaacttcaataagagctcaatgactgaaatcattctccattctactctaatgttaactgaagaggttctgcctctgatttaactctctgtaaaagtcggtttttgtaggtcatattgtccctgagcctccatttactttttgaccctcactgcagaagaatcttcacttctcctattgctctggcaaaatgacaagcagaaactcatagatatgtttgttgtggtcctaatagaagcaattagaactctctgttccctccaatttctctctgttgttgctattaaagtgtccagtacatccaagggtgatataggtttcacagtcagcctgaggatgtgaataaattatttacccatcttaaaaaaaatgttctctacttaaaataactctaggcaactaagaatgatgctgttcttctatgtttaattttaagtgccagaacgactaacaggtgcttcctacatgttctttgtgttgtctgtgctatagaatgtcatcacgtgattgatgtgcattaatattgacttgagacttgagtaatatcttaagaacgtgaggcagtcagctttcttcacctttgtatgtcttagagatttctagatacagcctttctcaggatagaaagaaacggcagtatttcagagacagactctgacctcagagtctgtcacaaacatgttgtatatcagagaccaagagcccttaactcctgggaactcatttgcacatttctatgatgaagcagttgttctggctatatgatctttaaaggtttttctcatttctacaaagaaaaaaatgtttctctagccagtaactaaatgctccagagaattgcctgaaggaagtggctagtaggatttccaacagaacatgggtttatgtgggtaatgaagatccacttcaggagccataggaaaaatctagagatgtgttcaaaacagccatgctctctcacttttgtggaaaccgacctaaatcacagtgttagatgaaagagaagaaatacaggaagatagtcttatttctgactggtgaaccaatcaaaaccactgcagaaaccatttccttcttttccttcatcggctactagggaagcaagtagagttcttctttagtttaaatggcattgtcaattctatgcagaatgagttagaaaaatctaaaagccctgcctcctcaaaaaatggccttccctccagcctgccagggtaatcacctggccaacctggaatccccaaagggattgatttcttctcaatcaaacaaggaaggtcttgcctcccaaaagctctcagtgcaaaaagaggattccacgacagtacccagcagtacaatgtgcacatttcatatttgtcaaatgaatgaattcaacagaaatgaaagaacaggggctcttgtagctttccctcaggaagtatgttatcagattcaatcaccttaccacagcctgatgaagggaagtgatacacacatagcattttagtgagttgcagggaggaaaatggaattgttattggtggcgtatccatggctgatgaagactgtaaaaagggatggaccagagaggctgacaaggcagatgctgagcatcatacaaaagtgagggatacactttgggactgaccaaagagaggtgcatagctcattgactctgtggcaccatttttgtttcaatgcctgtttctgtttggctctagcatttagatgtaatctttttattggactttggattcaaataaaagtactctgatgtaggaattgaatcttaacaagattggtatctgagtgaaactgaccccacatccattaagatgtcagaagccagagaaacaagggctgacccttttgaagagaaagcagaagttgcacatcggatttagatgtggaaattttgaaaggaagacacattcaaactgtattataattgagtgatgttggaaattagcaagcatgccattttaagggggacctctatcgtgttattggatttaataaaacattactttctgctctacagatcagtcacaaggatttatagaaattagctattttctattgaggacatagatgaaagatgtagaaaaattgaatgtgaggtgaaagcaagagaaaacagaaaggtgaagagagtcattttctctaagcataataacacattcctgcccagacttcagtctttgcacactcagtgtttgtgtgttgattaacactgctgtagtttcatctgttattacttaactgacatgttgctgcaaattatagctagagcacagtagtgggttacagatacaaataacatttaaaataatttctttcctttatacctagagaaattgtgaactcaacagcaggttttccctttactctaaaagcatccatcctgctaactgagtaaaatagctgtttttcagttcatgctgagttttaaatgtaatgtgttataaggtgtttattctctcaccgattagatcccattagcattaatgggagttgcctgaacaagtgctccatgaagtaatgaaaatatcatcttagtatgcttttttgtgtaatgctttatttcagagaaaattcttttcttaacctcagctattgtaggtgccacatcatttgttgtactgtcagattttttaatagtattaacaaaatgaaatagaaatagtcataagagcataaagataaaggagagttgggaagaatagatcaaagcatggataatttagcaatctcctccaagtgcagagccaatctcacatgtagctggagttagaagctgcctctatagagggattttaggttcgttcagcactcatcatctcaccaccctgccacccccactccacgccataaccaataattacaggttctgcttgctctagtgccttttttttggttttaaaactggagttaattttctcttcttttttaaggtttgaatatccctagaaggacagtgtattttcaagatagcttagtgaggcatgcagtgaatagaattattatttctattttaccaatgggggaaaaaaatgaggtagcacaacattcagcggtaagtcagaaattgaccagagattgttatctcttagcccagtgatcagaataaaatggttggaattgcccatcaccccatttcatattttgctttaaataaggagacccacaagaagtggtcaaaggaaagatgcagaattaatcatgttcagttggccaaatatcattgcaggctgatatacctgcaaatttttctaaatagtgcttgatgttatttgattccattttatgtgaagaaacaggaaatggttttacaagccagcactttgtagtcaaccacagaaggctcaggctgtttgtattcacacatgctcttctaggtctccagggagtcatttcaggataaaacatgccttcatagctccctgcctctagagcaagaacagtttgcctttatgtttgtggatcctatcagtttgagagagaacaaattctgagggaagaggcaaagtaatatgtcactttcatatggactttcccaaataagcacatgaatggagttggaaaagcaagccggaaatagcacttctcaaatggaaatacctcattttaaatgatcaaattggagtgttaggatcagcagtggacattctccaaagagaagattgtgttatgttgaaagtccacaatgaaagagaagtaaagaataaagagaatttgcaactatttattgtagagaaccaaccaattggcattaaagttcaatatagcctcatggctttctttttctattcatttagaattttaaataaatgcgcagagctctttctttttataccattttcaagagagattctctggggaataaagggaatagaatagttacttgaaaatatttgaacaatttaagaaaaaaatgattcccaccattttaagcatataaaaattctctacttaaataaagtgctatacaattataagccatttctttctattaaaagtagtttcctaagaacccctcatagtgagcagctcaacatatggatatataattcacaagttttctttgtttgttcatatttgttcagtcattggtaaatagttattgtgaccttccttgtgccagacagtatcctaggtattggagatataattttgaatcattcaaagtgagtggagaaaatttgagattgcatttccacctggtagtgacattgtacctctgagtcagggtttttcatgaaatggaaatcatcacattttctcagtgcagagaaagatatactattgcatttgttttattccaacttagctttcatacttaaaaaaaattgtcacaaaatactgttgtaaaagtcaaatgattccttaataggtaaaccatgagaggttcggatttatagcattcttaactttcctgctatcaaactgtgcctatttttaaaagtatagcaatgtatgatagccacagcctgtaacctgtgtatctagtcattcatccatctaatattcatgggatgttcattttgtgccagccacttgctgtgctcaggaactcaagaaatgaagatgaatgagacaaaagcctttgcctctagtagcctctggagttatagcactttctggaggtcatcagaaaaaccaggagacagaatgctagtgcttgttgttgcaatgcatttctcttctaccctcaggcatcaaggcatcccagtttgacaaagaatacaggaaacctaatgggaaatcaaatgaatatatctgagaaaatagattgcaataaatgtcttcccccaagagaaacaaaagtatcttataagaatatgcaaatcctagtatgaagttttccttataatcccatatatgtgattaatagtgagacccaaatatattaaaatttcaatcatattgtaccacaagaatttacaaaagttattttctattggattaagagaataaccattgtgtttatttactggatgtgaaagagtaactaatagtgagaacagatttctaaatttcacacattttacaaattaatactatgttttcctgccacttctccctgtaggggaggaagtatatattttctttctacctttctagtttcttgtctgggttctgtaacaaaatgcagattaacaagagaaaagcatacaaatgtatttgatatgagttttatgtgacatgggggccttcttaaggaaaagaagacctaagaaaaacctgagtgtttttgtgctaagtttgatgaaaaatgaaaactcatggaaaaatgtgatagaacaaaggagtgtgagctaagagcagtaacctgagagaaacgtagcaaggcttgttcatcgggattcctcctggtgtccttgcatcttcagagataagggtgcccttcccctctgagtgtagggaggttacctctcacacgagggtcactccaggagaaggtcagggagtcctgcatacacctgcaatttcttaaattgattcagcttgaaatagtcactatgccaggacaccatatttttgggtagcatcttctaaagcccatcactactcctttgaatgtttcactcttttgtctatagtttttaaaacatttgtaattttttcccagctttattgaggtataagtgtcaaagaaaattgtgtgtattcaacatgcacaatgcgatgttttgctatacatatacaatgtaattatcacaatcaagctaattaacgtatccatcacctcacatagttacttttttcattggtgaagacacttaaaatctattcttttagcagatttcaagtatataatacattatcattaacatgttcctcctacaaccaaaagcctgtattctttgaccaaaatacctttatttcctcctcccgttcagatcttggcaaccactaatctaacctgtttctatgagtttgacttctgtagattccacatctaagtgagatcacacagtatttgtctttgtgtgtctggcttatttcatctagcataatgtttcctaggttcatctatgttgtttcaaatagcaggatttttttcttttattaaggctaaatgacattccatatctgtagctgtatctaagatagataaagagacaaataatcacatttttcttatccattcatccactgatgtatacttagttgtttccaaaatcttggttattgtgaataatgtacttgttttaaagcaccactttgtttttacaactaacttgttaggtcccttgactttgtggctttgtacctagaaggtatcttgcaataccttctgtatactgtgtatttcatatactgtttctgctgctacagctgctgatgaggttgataaattatcatctccatctatttctaaatggagaaacagcttgcatctgttgagatgattgtaggtcatcctgtgagtacagagattagatcactcaggaaatgaagatgattctcataatacttattggctgaagtgagattttaaagctatggactggaattatatacaggagaaaacgagatttctagcaggtttttacacccacatcatatggctcagaaactgttgtgaattgggcttccatactaggcattgctaatgttccttctctccctcaagtaaaaagttattatgcagatcagttagacaaaagcttggaggtgttctgggatcatctcttcctttgacttcttgaccttggtaagcaattcacatcctcaagggcctatatatttaatgtacatcacatgagaattaaaagtgttttgtcattactcccattagggttaacctattttcctgctgacctggagatgattcaaagcccaatcttggccacaaatacacaccaaatattaaataggagtttaggattcaaaaggcagcaactcacatagtagttaagaaaacttactcaatcatatcttttagtgtaaatatgatgatgttcttcctgctattcctggccagtttcacaccatttcaagtataggttagagcagcggttctcaaacattaacttgcatcagaatcacctggagggcttcctaaccacaggttgctggcatccagccccagagtttctggtttacgtggtgctgagaatttactttttttttttaatttattttttttttgagacggagtctctctctgtagcccaggctggagtacagtggcgcgatctcagctcactgcaagctccgcctcccgggttcatgccattctcctgcctcagcctcccgagtagctgggactacaggcgcccgccaccactactggctaattttttgtatttttagtagagacggggtttcaccgtgttagccaggatggtgtcgatctcctgacctcgtgatccgcccgcctcggcctcccaaagtgctgggattacaggcgtgagccaccgcgcctggccgagaatttacatttctaacagactgccaggagatgctgttgttatgtagtctgacgaccatacattgagaagctctggattagagaaaagtctcataaatctatggacttagccatagaattataccgttagctgctgattcctccacagatggttccacctttccttctttgcagttacctgagatttctcaatttctcctaatcccctttcttcactcccatactcaaaggaaatggatctaagaatgaaatattgaaaatctatgaagtcctgattggtcccacatttagctctatggtactctgctttcactataatctgaatgcaaatttaagtatatagtaaagaacaattctgttctgttattacatccacccagggatctgcaggtcttttatcttctgattcccacacagggacaagagtgcctcatattcccagtgtctgctgacccctagtggcttgttatgcctcctactacacctagattaatttttataaactaaactcatagaggatttgggtttggggtgattgtaacagtgaataattcacaatattggccatcatagtcaatctggggagacaaacatattcatattttttcctcctttgaatatggtttttgagacagggtctggctgtgttcctgaggctagtcttgaactcctgaactcaagcaatcctcccatctcagcctccagagtagctgggattacagggacatgctcctgcaattggctcttgctttgaatattcttaatgtaaagtaacaattgattgacaaagctttctacttcttgaaaataaaatctgtcaggtcaacttcttgcaaattcagcatagtgagttctctacaaaatccaactgtttgctcaagatttattttatataactgtagagattaaaatctgagtgtaaaagcagactttatgtggttccaaagatgtaatttaaagacatatttaaataggtacacagtgtaaatcaaatgtgaagataatgacagttatttcagggaacatttaagtcagattaagtttccaattgagctgctcaatatccctgaatatgaacagatctgccagaaaatttgctggctatactacagcacagagttgttaaatgagtatacttataaataaacaaaatccagagagatattttccctgatggacagaaatgattcaaattaaacaaaatgcattaaatatgccatattgcttatatttaaaaattataattttcaatgtttaaaacacaaaggagtttaaaactgagaaaaacagtattagaaatgactggtacttcagtaattcttgaatcaaacgtaaacttgaattcttgacacatgtaagttattggagagtactgattatttatacaaatgtttctatgccatcatcttgtgtattacttcaaagagattgatattaggtgaaaaataatgccaaaaaatccctccaacactatttattgcccttccgtctctcaatgcgtccgaaatgaggggcatagagaacactaaaatgaataaattcccctggtgagccaaagagaataaatagtcttcacaatgaacaatctttgtattaagtgttggcctgatcaccccacagtacaaacacacagaaactctgacttcctaccagattaaggtgacccagccattctgcatgcataattacagagaagagaactcaataaagagccttctctcaagaagcacaggagaagtcagctcagggaaggcagagaggtcttactgtgtgtacactgtttcaacatttaaggatctctctttagatagatagattactagccaggaatttgcttcccttttatccctatttcaaagtatttttctggcaggttcttttaagatctcatcagatatgtgggtatagtgctttactcactatgacattttacatttttgggaggcagaatgaggacttgctactaagacacaagttgtgaagagagagtatttattacacttttgcacagagaaacagtattacctgaaaaaaaatatgtacctgcaaatgacctagacttacaatattaataacagatttacctctttaagagacatgaaatataaatcactctaaggaatttgtgatgcattaacattgcataaagcagggttaccttggatggagatttgtctctctagtatcttcatttcagttggagattttgcaatgttattcactaatgtttcacaaatgttatagtgcatattgataaaccaacaatgtgaatctctaaatatccagctcttgaagtttacaatccaggattttatctccgaactttgtaggatggctgctagtctttcattttttctcaatgttgcttactctaatcaatgagaaatgcttatcaaaacattttgtgtgttacttagaaaaagctatacagatagatttcttaattgatacataacagatgtacatattttgggggtacatgtaatagtttaatacattcaaataatgcataaagataaaatcagggtaattgggaggtctcttaccttaaatatttatcttttctttatgctacaaacattataattcatcttttcttgctattttgaaatttacaagagattatttttaagtacagtctccctatgatttattgaacagtagctcttcaaatatgtaattagatagaagaaataagacctagtgttataagtatctttaacatcatatacaaaatgatggtataaaacaattcatatagttgatatttcagtttcacttccctgcctttaatcatgctgttgggcccacttgaaatatccatttatttccctcctcatgtaaaaagtcaaaattcaccttttccaaggagttctccctaacctgtcaacacctatagttttcttctttttatgactgataacatacccactatttgtgccaacaacttttttactacattagatctatattgttaattgatttacaggtctctccatctgcagtgtaggctccttagaaggttcagaactttgttttctattgttcctgaattccagctcatggaatggtaacacttaataagtgctcagtaaaaattatctgaattaaatttaatgtcaacatccagtgtcatcctagtttggctggcagatgtagagacctctaagaagtaatgagcaactgaaaaagaataattcttacatagtggttcctaaataccaaattccaaactcctgaagaaatatatgatttgaaatgtacaatagtcctaattggctaactttctgcaacctggcagagaaaatttacaatacaggcctcttaaatttttattaatgtttcccctgatatctttattattaataattttttcacggatctccaactttttcagagacctttcaaaattgtcatacaaatttttatggcatgtttggttatgttttcatatagcttgaaaatcaacaacaggatacgcctccaaccaattatgatctgattcttataaggtaaagttttatttcaggcttaaataaaagtaactagaaaactctgcaagggcaagaatataaatggccctgatgaatcacaaaaggagaggcgttgcaatcataggtactgggatacaacagtaagagagagactaccatcacacccttaaattatagcattcttggtgttatcagaagctccagaaacctattccttctacacacaaacacatcctcaccctaactgttcacccgcagtaatggaggggaacattaataccttattttcagctcagaattaattttatatatctgtgcataactggattccaggaagaactaaatgggatctgtaggatgtatgtgaacaactaattagccacaaagtttcttataatatcttcatttgaatgattctttcattgaaaataatggtctacatcctatggtgaaacagattgagtcagctgttccctctctgagcttttcaagtggtgagctgatgaatttgtcctttataggtgggataatttgggccttaaattcctgtgttttttcctttttaacagttgcctgtttccttaaaatatctactctccttgtctgtgtatactcaacctagcctgatgagaagcaaactagaatatctaggaaattattatatccaacagggaataatagtataaaaggagatgaatggtccatagcatcattataagaccctttggtctacaaattatctgagtatataaaatattgataagtgaggtagccaaagttcacaaagtactgtgtgtgtgtgtgtgtgtgtttctgtgtgtgtatgtgtgtgtgtatgtgtacgtgcatgtatgtgcattactgacaagcagacttaagcagtggttgaaaaaaattggaaatgttaatacatccctcagaagttgaagcaccttttatgagaatatgattagctctaactgcataactgtgttctttgatgaaatgataatcataccactaccacaagcaaaacttgtattttctaataatttttcaaatgactttcatggtgataaccatttaactacgaccattgataatagatagaattagccgagtgtgttgtatttgccaggcattgtgcacacacaatctcacttttcatctaccagacaattccaagtggtcaacaactacacttgcagagtagtcagttcttctcattctgcagatgagaacacaaaggcttaggcagatgagcgaagcttctgaagatcatccaggtagaaaatggaaaggcagagactcagggctgaatattagccaccaactagaggataggatttatgctagaggcagttctatgatcatttggtatctggttttaacaatattttctgaattaaaaaattaggaaaatagcctgatgggaacagcaatttatactcaggaggaaatgaaacagcatgtttgaaattctaattctattggataattattacaatataatagtttatgcttttgagcacagggcagattccagtctatgatacagtgagctgccatacactagagtttggctttagttaaatgtgatctttgaaacatgatacataagtcttctgcatcagaatgtgagttcatgaattgattttctcttaaccaagagaaaattaagcaaggccttaatgaatagtaactttgatttcctaaggacatattgtgagaaatccaccgtcctttggagcagaaagttctcagatgaaggacaatgctaacgtaaaatagatgatttcatgttgtattcaaaacaagtttctatacactgtggtagaactggaatgactttcctatttctctactgaaatcataatgtgaatgtttttcataaaataataattttaagcaaacagcatgttggccaaaattgttgggtcgttctcagttaaaatttagcattaatatgactaactcataagtaattcaacattgatataaacactgcttagtttccacagaaaaatatttttccaaagtcccagaaatcatttttgcagttcatttttattacacaaaagcttgctgtatattaatcagcagaagaaattttaactattcagtagttttaaaaggctacatttaagacttgctacttgaagtggaatgatgaatcaaatttgatgtaaaatattttgccttaaaaaatcctccaatgaaataatcagacggaaaagcgacagtaaaatgtagaacttgtcatttttaagagccaatatcatcttaaatgatagggattcagtttctatggagcccttcttgggctcaagttcaacactttaatgtgataatcagcttaagctaaaattttttgcacttttggacagaaaggtttcgtgtttgaaacagatgcaaatgaatgctaagaaaggagaaatcttgcagaattcaatttaaagagctaccttccataaaattctgtctaccggcctgtctcatcgaatgaagcagcaggcagggaaaccaaggttatcagtccagtattctcctgcttgaaattttctacaccatgtgttcctctcagtgtctcacattttaagcactgagtaattgctcaaatttattggaatcataaatgttaaaagattatcgagacaattctaatccagtttgctaattttagagaagaaaatcgaattcagagaagttgtatgtgactagctcaatgctacaaaaatttgaccaaggtaccaaaatgtccaattgttatactgaatgttgattagtctgtaagttagccattagtactgtcacattactgcgattttgcaaacagtaaaactaattaacaaatataccaatatgtttgtgatcaaacgatcaatcttttgaaacagttacctcaagaggatatagaaacagtctagtaatttgcaaaatgttttaagtcaccttttcagaaccagattttatgacattaatccattaatttatttatgacttaacagcattgagagcttactctgcattcagcactgcaaataaagaagtaaaagatggtatgttcttgttcttatggacagcaggaaaagtaaagacagatgacaggagagatgagtagaaaatatggtaaataaaattggaagattgattagatataagctatgcaagtgacagcagagaaggagaaggttattaataataatttacatatactatattaggcactgatctaagtctttatcaaaactaatcctcaaaccaatcctatgaggtataactattgtcatctgtattttacaggtgaggaaacagattcagaaaggttgaaaaacttgcccaaagttacaaggctgggctataaacccaggaagatcaactatagagtccacattcttaaacattaagctacctgattttttttttttttttttttttttttttttgagatggagttttgctcttgttgcccaggctggagtgaaatggcacaatctcggctcactgcatccttcgcctcccaggtacaagcgattctgctgtcccagcctcacaagtagctaggattacaggcatgtgccaccacatctgactaatttttttgtatttagtagagacggggcttcaccatgttagtcaggctggccgcgaactccttacctcaggtgatccacctgcctcggcctcccaaagtgctgggattacaggcattcgccactgcacccggccgctatctgattttgatagactacttatgaagacttgagagtctaagcagataacagtatttctgaaataaattgggtatgaaggagtagaagttggtaatgaggaaaggaaaaagatggtcagtttctttatttggacagattcaacgtatctgttaatgagtcagcatttgtaaatattcatcaaggctgcagacatctctttgaaagttataagcgcaagaggacaagaggtagcagttaaaaatatgaatatggccaagtttcctcagagagcatattgagtgagaaatggggttccctgaagtacaaacaccaacatttaaggaaatatagcagaaaataagacaacaaaattaactgagataaagatgtcaaaaggaaaaaataataaaacatgagaacgttatatgaggaattcaagaacaagggcatgtttcacggtattgactttaaagagaattcaagaaagacaaggactaaacattgggagttgataacaaggaagttattccagcaaaagagtaaaaagctattctgtggtatgtagaagcatgattttgaggtggtcaggagttagtgacaagatgacctcctttgaagaaactttattaccaagtgaaaaaaataagagtgaagggaagcagaaaaggatttttttttctgaataatcacatcttcatgtttgtataaaagagactgcatcaagttgatatctcacttttaaatgataaacttgaattgtattcacaaacaaaaaagtctcttaaggggaaattatttgccaacatttgagacatttaaaaaagtatgttgcaaaccctaagattaattccataaaataaaactcagatatattttagtaaatgtacatagcaccagaaactgcacttggctctaaaggtcaataataagcaaatacagacacagttcagaaatgaatttttgttaaacaaagataatatgccaaattactataagataatgaaagagagcatatttcattaataaattatataaggtaaagtattttttgaaaagatatttggcagctgcaataatatttagaaaaagaaatgcttcaatctatctgcaatacaattaaatttggattagaaatgtcatgcaatatggaatttgtatattcttggtttattttagaccctgattaagccatatcttgtttatcatagttagaggttctaatgttattaacgtttcttctaaaataggattctgacacatctataagagaaaagcttgatcaccattagacaaataagtaaacattccccctttccattattataaagaatatgcacattgtaagttcaagaatagtttagaaaaaaaatactgaagtagtaaagggcccataaaacccttcctcttgtattttctatctcagattgcaacactgttcacttaattacccaacatgttagaaactgtgctataccttcatttccccattgcccgcataaatcactactcccattcagttctacttgtgtatacatgaagcctagctatcatctagatttgagttatcattttctttagtcttagaacaaatcaaactgctttcaattctgctccgtctcaatctcaatccattccacagacctagggatcattctgaaatggaaatcaatatcttcaatgtcttttgatcatcaacagatggaagctcaagattctcaacatgattttaaaaagcttaatgatctgactcatgttttcttccatctcaacattcaggccaaactgaaccctcacagtatttcaaatactccaggcagaatcctattccagcctttgcagaaactggcccctctccatgtaataccctatccccatcttgccaacttctttaccaggctaatgcctactcttctttcatttgcccagatagatatcttctatacaaatcctccctcaaagccaccagattgaattaggcatttctcccaaagttccccttgaagcctttacttatcccatcagaaaatttataaaactatgctgaaattgcctctttacatataatctatctacatgaggcaacttaaagacaaagtgtttgtcttctttacttttagacatataccagcagaagaataaacaaataagaaaaactcatttctatatataatataccaataaatttggacaaataactttccacaagcctttgtttacacatctgtaaaagcatggaattacagaaaagagaaaaaggtataataaagctagaacccatcagtaataaggcaaattttaatatatgctatattgttgaaatttttgtagtaatgattccttgtgaaagcaatatcacagataaagctgcttttacaagcagcttgaaacagcaacgtgatattcttcttgtgcagaactccatattccagatttgagctttcctatccacattttgacagtccatcagtcaaagaattccctgcagaaaactacaatagtaacccaagaattactgactagttactaagagtttgcttcaatagattagagctgtttgaataataaagatgttacccagcaaatatataaatacatattcttctgcaatagaattcttaatatacagagtataatagaataagacaaccttaaaaattaacctaactctttggagatttctacatagaattgcttgtgggttgtattcattttaccaaaaaaagtatataaatttaagggaacaaatctgtgctatatgaaacatgataaatattaagaattgtgtttaataattcttatgaaattatataagcgttaaacatcttatctctaatttctgtgcctaataattatatagagtttataataaactatacaatttatgttctcactcctagaaattctgagtcagtactctggttcaaggcagaggaatttacattttaatgagcacctcaaatgattctggtatatgtttcaatcaattcacactttagtatcctctccatgaaatatgtgcatctttgtttcttattttagttaatatactgttgaatatacctactcatgtagagtaacatttgtagatacttgtaatgtagggaaggggattctcattttccatattcaatttgagttccaatgatattaatagattttcttagattttaactagaactctacatattaggaataggtagctacagaacagacaatgataatgatgttttcacatgactgtttgccaaatactggtattaaattagaagatggagtgaaaagcactgaaaggcacatgagaagagctgttctgccatgcttttctgtgaccttaggcaaagtatttctgtgaccttggacaaggcatctaatggctgtggaccccaagagccgtatctgtgaaaatagattggagttgtttaaaaagtataattgtattgtgtatcttatgtaatgtagtctattcataacagaaaagagagggaatgaaactgttagggaaaataatcattctaggatggtaccaacttcttggtctgcatctttagtaaagggaatgatggcaaggccttatcagatactcacccaatagataaaagtattagttcataatctagttgtgtaacaaggtttctctgaaaagctgaattaggatccattaagtgctaacaaagttgatttagggaattctggatgtaagagtaattctgcatgggtgtgaagtcatagtccattctctggacacagagattccatggtttttaaaataaagtgcatatctattaagtcagtgaaaaagtgtcatgagacttctttctacagtgttccttctttgaaagatagaagatataattgaatatccttgcagaggatatacctgagaaggaatttgcaagattctgctgctgttctagacttgggaaatacaagtatgaatcattgacaaatattttaactttcaatagtcccacaaggtgagagtgattactcagtttttcagtgatctaacacaaggattacataattgttttctgattcctgaatctagaagtcatcctatttatcaagcaaaacttaagagacttaataatgagttctcccagaccacaacgcctatcttcagggatagctgatggttatcataaatagaaacgacccccaaggagcttctggtaccaaaaatggtgcacttgctcagggacttgtacatttttttctacctattactgacatatgtatgtcaactctgccacattggcattaataatattttaccctgaaataacagagttgttcatggattggggaatagggaaatgattaatagggaaaagagaccttgatctcattattctaaattgctttaggtaaaacagactggatattaatacatcttttaaaatatttgtgtcaccactttttgtgtgtgtgcgcatggatattttgcctttttttttccttttaagatgaggtctggctctgttcccaggctgtagtgcagtggcacaatcgtggctcactgttgcagcctccacctcccaagttcaagagatcctcccacctaagcctcccacgtacctggggctacagacacatgccaccacacctagctaatgattttattttttatggacacaacagggtcttgctatattgcccaggctgatctccaacccctgggttcaggcaatcctgcctccttggcctcccaaagtgctgagattataggcatgagcccggtcttgtgtcacctctttagcaagaattcccattactatttttgtaagggtcgctaaggctcagaacagttaaataaattggcatgacagaaatacagatatgtaatatatatattgtatatattattattatggtttctaaatcttatcccccatatatttattatttttgttaagacactgttaatttttaataactttttaagttatgtatctttcttcatatgattttgatagagctttaaatatatttacgtttatacctaaaactctcacaatgggctaagttgctggctcatttgttaagttgatgattatgctttacaaatgaatgcttttaaaaaacagcaaacattttgtctgtgtataaacctgtgttgcatttttagaaatggaaaatcatttttcatcagaacatctattatcagatttatttatttgaaggaaaaaaaactcttatgaaagaatccccatgttcctgctcctgtggtgcttatcaacgttcaaggatcattgaaactaacactattattttcccttcaacaattgaaatgattgctgtgtttttgcatgggagtagaaatgtttttctttgttaaaaatctataaatattaccatacttccagtctgtggacagtcatatgtaattatatattcttaatataatttcctagtaatcccaaatctcagtagggatggtattctgtttatatttgttgcaacatctccctccacttaatacaaatgactgccttgtgtgtctttattgttttgaaatccatgtatctgtcatcagaaaaatagcctaggatggagccaaatgaacataaatttgtcaacattttgaaacttgagctgcagatctctatttcaaagggcaatgtggtaaagtacttccagaattttagctaccaaggtgaggacatcccataaacttctgcaatcacctatttttatatgtaaatgctttcagagaaacacaaatatctaaaatgagcaaatgcttttatcctcccagtataaaacattgcttataattgcttcctgacatgataattatgcagtatattattttcattaagatttgtatttttttattaagatttatatttctgcctgcaaagctagctacaaattttaaattttgcacaccaacatcatgggtgtcatcatgccagaaaagaaaacgaatctttagggaataaaattagatatttgtagataagatcacagtccataacctcaaaccaggtaggcacacaattctttcatctttctctctatttagatatactttgcatcaatgatgcatgtaatattcttgaatttaaccaatttttgcacaaaagattaatttagcacttccttatgtgtgtttttggtaatagccttagaagaaaaatgtttgtcacaaagcaatttccaatttaaagcatcaaaaaaaaaaattcaagaacacttaaataagccttttctcaacataaatagaggaactacatttaatgactgtgagacagacagcaaataaactctcttctaattctgaagattaatattgtagtaaattctgtggagttgcatgaagactgctgtatattaagctaaaaaattatcagccctaaagctccataagtattttgtgattagttaaaaattattggaccctggaactgctgatactaatgaaacttaccagattcctatttatacttagcaaaatgtacaatttcattattaggataaaagaccaatcaagaaaaaaatatcttcttgaacttcaaataatttaattgatatataggaaggagaaattaagggattctattttctttcaaagtacatttgtatcttactttagggcaaagttgtattaaaatcaaaccccaggacttccaaaaaagttacttaaaatatgtggcaaatgttccagccatggaaatattgcttcaaagtacaattaataatcaggattagaacaccttgcctttgtgttgggaaatggattagtgcatgggttctgagccagactgcctggtttctaacttcccttgatttgttccctttagtaaattgctaaacctctgtctgtcttcaatccccttatcaataaaatgaaggtggtacttcatagggttgctttgaggataaaacaagttaatttagaaagtgctgtataagtgtttgctatggtgaagatgatgatcattattaatttggtatttggaattgattatttcataagggcaggggcatatcttttttttaattttgtttcccctcgcaattcttagaataaatattcaataattttggctgaaagaatgatcagtctttaacctctggtcgccctatcatttactagcacccccagcacttgcaaagggtaaacaaacaggagtagagtgaaaaataaaatgttaatgttaggacatagttatgatttcaaactgatctaggaggaagtttgcaaaaacaagtacatttatctttaaatgtacccatactatgcctattccttctacataaagatatttctgaggtgaccacatcatatcttccagttgtcatcttcctcggcacagtgtaaccaaagactacaaataactgaatgctctggtttcagacttccttgattaatgacaagaaaagcaaaataccttccactggagtattactaacaatacaatttctaatggttaatcattgcctctgaaaattatctaattatttcctgattgcgtctccttacttacataaagtaaaacttaatatcccaaattatttgtcttattttggaggattttatattggtacaagtcaacattaagaactcagaagaaaggaagttttagccttctgcctatttacaagcctgcctgtgcctgccccaccaaaattcccagaaaacatgcaaaatgttcctgaatcaccaaagagaaaccattaattgtttaaaaaacaaaactgactttggatcaataaatacaaaatactgtcataaagaaaactttctttatgttttccaacctagtaagtgttacttaaaaaaagcctgagtcagagaatagtaaagaaagtaaacaatatttttagcttaaattacctttccagtaaaacacagtataatatttctctaagatgcttttgtaaagtctgtttataaactgagattctaagatagaagatagttaaggttgatttgtaattggctggcagcttgcacaagaccacaacagtgacaggttgatggagctgtaatagggacaggggatctttcggacacagattgatttttatttgacaaatgctaatgatgctcaaaacaaaacaaaacaaaacaaaaaaacactgaagcactccaagcagtgttaggtagcgcattaaggatattcagagaagtgtccgtgtccctttttgtgtaaatatttatttttattgattttcctcttcttaacattgtgtaaataacttctgtttgaacataattttggaatatctgcacaatagaaagaaattagatgtttgcaaatagacagttgagccctagggatatttggggttctcccttttttaaaatatttgtatttcacagagtgaaataacagaccctggagactcctgaaagtgggatgatgggaggcgggtgaaggatgaaatattacctattggagacaatgttcactgttcaggcgactgggaaagctacaacccagattttaccactgtgcattatatccacgtaatacaactgcacttttacctcctacatctataaaaagttaaaaaaaaaaaaaacagcttgtgatcctctgtaagaaagcatgcttacacttgccttgatagctgcatatgtattgaacctatgtagtatgaaccaataaaaaaagaaatgttttaataacaaaaaagtgtatttcagataatcttcgtgtaatttttgcatttttctgtttctctctcaatggcaattaatttttcctaaatctcatcatatcctcttctatacccaggtataaataacatattacctttcttattaaagatgcttctcaggtgaaggactcaactactccattatttagtatagttttatttctataatgattctctcacagtgtcaccttcatcttcagatttcttaaaagtccagtcatcaggcagtatttttctcacaaacataacaccaccagccctattcttaaagctaagggtgacctttccttttctgtccaatatccaaagcggtataaacagttggtgtttcttaaatatgtcttgtgttaataatgttataaatgcttgaaaaataaaagtaccactgtgatactaacagttccgcaactttgtctatatgaggagaccctgcacgctgctcaagtctccgctgtcttaccatttctgtgactataatggctcctggtagccctcagcttcccacaactacacccctacgagcttcactgaaacagatcgtgtaagtacttcttcacagctgcacacattctgatacctatatggttggtgtacagactacatgtccccagacatctgttcctagttcagcctttactatatttagcctttatttgtgacttatccattgatctaattttaaagttttgaattgtagagagaagccaaaatatgaattaaagagagaaaaagatagaaaaatattatgaagtctaataaatgaattaaaaccaaaatccaaaaattgttatggagggaatcttggctccaatttgatgccctcaagttttaggctctgtgccttccacatagcaatgattcaataagggttcgtgaaaggaacagagggagagaaggacaaggcagaaaccttgctttccctagaatctgttactgcattgaggatatcttacctttccatgcttctcacgctctattctagaaaaacgtgaagaggaaacaatataagtttagatttttattttacataaagcatcaaagcaagaaattactccttagggcccctctgcatgtttaacatatgtcttctctttaaaaaccgcataactctttcttaatgaagcatcttccacaatatacattacctaaacatctggctaagtaaaaccaattatactattaaaaataaaccaggatttgccaacaatatgatccagtagtgtagtcttcctcaaagtcagatatttgtactctaaacacaattgtgtggaatcctgattggatttttcaactagaatactttttcttctttcttttctataatatcatttaatctctactttcaaaacctgattagaatggtaaaactaggaatagtgacagacagtgtaacaacagtaagcagacatgcctagcttgctaactgggatttttccagctttattttcctggctaattcctttattagcattgtgtatctgatttgctttcatgtgcgtagcagctggttaaatgaaaagaacgattgccttgatccttgccatgtaagttcagtcagaagcctaggatggagctagtgcttgccttttcccatcctaactatgaatgctttttttttttttcaagtaaattaaaatacagcccattgattatttaaaaattgtgcaaaggccatctgttcaaaaaatattttcctacattaatgtgaaagaagtgaatgtgtaggtacataggttgtagtattggactgcagagtgagttcaaaggcaatgcattctatattttcactatttacaaaaacaatgcagaggtgtatggtttctacacagattattttttatggtttattacttataaaaatgccttatgcgtatgtcaggcaatacattgccttacttattgtgacatttgatgatttatcaccatttaatagtttgagaaagtgtgaacataatatatatatatatttgagacagagtctcactgtcgcctaggctggagttcagtggcgtgatcttggctcactgcaacctccaactcccaagttcaagtgattctcccacctcagcctcctgcgtagctggaattacaggtgtgagccgccacacccagctaatttttgtacttttattagagacggggtttcatcatattggccaggctggtctttaactcctgtcctgacctcaagtgatccacccgccttggcatcccaaagtactagaattataggcgtgagccacagtgcccagctgagtgtgaacataatctatataaccagtttaataaaatagtttgaaatggaatctaaggagggagattaacaattccaaacacacacatatgcacacccacaaacatgagatatttttctttttaaaaatgctgttattctcttgatttgtaaactatttacatgtttaacataaaacactctttgattttgataaaatatatttgttagaccataaaaatcctttttagattatgtgaccttcaaaataaagtgttgaatctggaattttatggtattttcccaattacaattctcgaaattctacctttaaaaattccgctaaaacagcaagatttgagtattttcatcttccatagcagttaaagttgcacataggagcaaaataagtactttatgtcagtaattttagaatgctttacttttttcttttttgtgttttatattatacattaccacagacattaacaatcagatttcagatgcgattgtaaaatacatattcaaaatagcagcaagtattgttcccaatgctcaggttggactaaaatgttgaaagtctctatcagagatatggaaagaaacaaatttccaagtttagcccatccgaagtttctatagcactgcagactgaaatgaggcctagccctgaaacaagtgtttcccaacttgcattttcccccgttaagcttacttgaagactcctaatctctatgcactaaagtgggctgctcctcctagtagtccagaacatttaacatttttcataacaagtgaaggaaaagggtttgggaaatagatcttcagttggcaattggaaggatatttcattcattaagaagttgtttagtgctatcaatatgacagtttggtaaatgcaagaaacctaaaagggtgaatgtctttatcagaaaaagagacatttgcataccagatatagtcacaaagtactaactttaataagtagtcaagcaagataccagacattgatcaaagcaccaattctataatagcccactttaataaattacagttgagaagttattctcaaattaaaagaagaaaatttagaatcctgtgacaaatcctgtcttcacttttctgtataccattcattaaataacttaaaattaggtattaaaaatacatgtacatcattttaacaagtaagtctctgcacttttgtccctgtgctagtattagacacttaaaagaagactaagttaatgatccttttagactgaggaaaaaatagaactaatttgaatgaatcctagaaaacgttaaggtttaagatccttgactttttcttgttctttcactaaataggtaaaggatacaattttatttttctacagtagaatctaatctaaaatgtggcaaaatgacattgttgacagttgtttataatccagttaaatgtattttgggtgtatattgaccatggtagcttgaactcaaccactgtaaagtgtctttgaccatgcaatgaacagaaatatttgtcagcagccaagccttggatatcatatgtgaaagatgatttaaaattccaatggcaatacttgacaaggcacaaatgaaagcaaaaataaaggtaaatatgtccaataatgccattggttacaatatctgctaaagcatacatggatttaaaaggagagaatcttaacatttaataagaggctattctacacaatatcaaaaaactaaaataaattaatcataaacttctagactggtggttctcaaacttagcttcacttcaaaatcatctggagcattaaaaaaaaataccagtgtctgaatcttactctcagggattgtttttgttagactgaggtgcagcctgggcgttggaatttttatagcttccaggtaattctaatgtgcaccaaggttaaaactcaccattctaggttttttttctctctctctgcctactcccctttctctttcttcaaatcacttttgcaacatcaacaaaacaaatagctgttgtttgatctttgggcaatctatgtatgatggttttcagctatttttacagctatttttttctatgtaaacaatgtaaaaaatacagcttttttgaattattttaaaatttcttacttataaataaatatgatccttaatgtgaggacaattccattctttacacttacaaagacatataattaaaaaaataaacaacgactcttatagtgtgtattagagttctctagagggacaaaactgataagatagatattcgtatctaatagtatctaatagatagatattagtatataatagtatatatgaaagggtgtttattaaggagtattgactcacatgatcacaaagtgaggttccacaataggccgtctgcaagctgaggatcaaggaagccagtcaagtcccaaaacctcaaaagtagggaagccaacagtgcagccttcagtctatggtcaaaagcctaagagcccctggcaaaccactggtgtaagtcctagagcccaaaaactgaataacttgtccagtgttcgagggcaggaagcatccagcacgggagaaagatggagaccagaagactcagccagtctaatccttccacgttcctatgcttgcttttatccgagccacactggcagctgattagctgttcccacccagattgagggtgggtctgcctctccaagtccactgactcaaatgttaatttcctttgggaacaccctcccagacatacccagaaacaaactttgtatccttcaatccaatcaagttgacagtcagtattaactatagcgtaaattctccttacaaaataattccagccacccaaaatttgtacacctggctatatgatgctcagaaacagcttacttaagtagcttacttaagttttgggtgcttaaatcaaacgaatacgttcttatttagccctgaatgtctggctatgtttggtttgaccagaagtaagctggtgactctggtatcattatatggataagaacactcttcacatgcccttgcaagaattttccaattctgtccctcagctttctcatatctaaaataaatgagtttagcaatgtctaaggttcttaaaaattctcaggatgtacactttattttttcacactcgcaattttgctgtgttacaaaactaagctcatgatgtagacaaagttgtatatcctgattctctcacaactctatgccattgctggttttgagtgttatgcatattgtggatatagaaaaaattaccccccaaaagtcaataatcatgctatctcactacaaccattttgatatagtcttcttcagcaatttttcagttagattttatgcatgcacacacacatacacacccacacaatatttgaaaaataattttgtagtagcaaagatgaaaaatttttgaatgaattaataaatattacaaatagtactaacaccagcaattaaatatttagtagaatttcttatttaatgttataacaaaaatattttacagtgccatacaattataaaccatatttgaaatgctacataattttccattttacaaatgattagctcttgccctactgctaaacatttaggttgattccattgttttaattttgtaaataatgttatgtagaacgactatatatttgcctttgattatctctaattatttccatgagctcacagagcatgaaaatttttaaagtatttttattcatattgccaaacaagtacaaatttaaacttcctctaacagaatgttaaaaatctcacactaaccaaaattgagtactattttttttttcagttgtatgagtgaatgaaggatttacttctaaatctgttttcttcattcttccaagaaactgtatcctctatccttaggccaatatctgaaggtgagaagaatccacagatgattacagactgataaagactgatgtgcttattgcttactgttttactcttttaagtaaagtgaaaatatgaagatatacaaaaatgtaataatgatttcttaaataaataataatggagaggctgggcgcggtggctcacacctgtaatcccagcactttgggaggccaaggcgggctgattgcctgagctcaggagttcaagatcagcctgggcaacacagtgaaactccatctctactaaaatacaaaaaatttgctaggtgtggcagcgtgcacctgtagtcccagctactcgggaggctgaggcaggagaattgcttgaacccggggggttgaagttgcagtgagccaagactgtgccactgcactccagcctggacaacagagtgagactctgtctccaaataataataataataataatgggacatttaaagatcaatttaatattttaagaaaaagctaaatgaaaaatctgagaagaaagaaaaaataataatattactggcaatatgaattaaaagcttcaaaagttttcatactttgaactcatggaaatagaggtgattaattattgcagaaaattattttcattttttaaaatttacttaagttttattcataacttgctatgaatgtactgattgtggaagatatctttcctggaacacacatcatttctacaattctataagggactttctcatacctccaaagataagaatgaagatctgcctgcctaccatatcagcctgtgtaagagaaactaagttaactctgcctccctggactcaaacgacaacaacaaccgcaaacaaaccaacaccaaaccgtatttttttggttttgttttgtttagagatggagtctcgctttgtcacccaggctggagtgcagtggtgcaatctcggctcactgcaacctccgcctccggggttcacacaattctcctgcctcagcctctcacgtaactgggactataggtccctgtcaccacgcccggctaattttttgtatttttagtagagatgggatttcaccgtgttagccaggatggtcttgatctcctgacctcgtgattcacctgcattggcttcccaaagtgctgggattacaggcgtgagccactgcgccagccaaaaccttggtatttttaagaaaaaatacatttttggccaggcatggcagttcacacctgtaatcctagcactttgggaagctgaggcaggaggatctcttgagtccaggagttcaagacaagcctgagcaacatggcaaaacgaagaaggagaagaaggagaagaagaagaagaagaagaacaagaaggagaaggagaaggagaaggagaggaagaggaagaggaagaagaaaagaaggaagaaggaagaaaaattagcctgatgcagtagcatgtacctgtagtcacagctacttaggaggctaaggtaggaggatcaattgagcctgggaggtcaaggctgctgtgagccatgatcaagccactgtgctccatcctgggtaatgtagcaagaccctgtttcaagaaaaaaataataataatatattttagttaagattgtattcattcaaaaaaatccttttccagagcaaagaaaccccaacttaaaatttaactcattttatactgcctttaaagtgctaatctagcacattaaaacctatcacttctggttgccccatgagttcatgagtctaccattagccaattaatcacattctgtcctcaacaaagtaataagatatgtcacttaagaaataaagtttgtccagcctagcgaacatggtgaaatcctttgtctactaaaaatacaaaaattagccaggcgcagtggttcacacctgtaatctcagcactttggggaccaaggtgggaagatcacgaggtcaggagttcaagaccagcctggccaaggtagtgaaaccccatctctaataaagatacaaaaacattaacctggcgtggtggtgtgcacctgtaacccagctactcaggaggctgaggcaggagaatcacttgaatccaagaggcagaggttgcagtgagtgaagattgcaccattgcactccagcctgagcgacagggtgagactgagccaagattgattgcgccactgcactccaacctgggtgacagagcaagaccctgtctcacacacacacacacacacacacacgcacacaaagaaaaaagaaataaagaaataaagtttgtaaagatatagatttctttcttataaaataaaattttttcctagatattcactccaaatcaaacactttaataaggaagtttttccaaaaatatacagagtccatatgtttctaatgttatttaagttaaatgaagaacatatattttaaccataataaaccataaataaactatagaaagaggatagagataaaattgggcaattttcctctgctttacctctcctttttttttccttttaagcaataaaataaaaataaaagtgactttttgactatactattattattcttttctttattctcagatttatcttttagttttttcttaaaatattacattggtctgggcacggtggctcatgcctgttatcccagcactttgggaggctgaggtgggtggatcatgaggtcaggagatcaagaccatcctggccaacatggtgaaacccacctctactaaaaatacaaaaattagctgggcatggtggtgcttgcctgtaatctcagctactcaagaggctgaggcaggagaattgcttgaaccagggagtcgaaggttgcagtgagccaagatcgcgccactgcattccagcctggagacggggcgagactctgtctaaaaataaataaataaataaataaataaataaataaataaataaataaaataaaataaataaaaattaaattgtcctttaaaatctcccactgtttcttttttttaaaaaaaatcattattacatttttatatatcttcataaggaccttggaatcaagatccattttttaaaatagtaaaacattatacaataagcacatcagtctttaccacactgtaattatctgtggaatcaatttttctctgttaagtatggtagagcccaagaaaagttgggcttttgttaggattatggaggggattcactgcatagagcatatgttggagagctggtaatgcctttagtggtctaagctggccatcctggctccatttctgatactgagaagtctgtggttgaggattagtctcagatctctcacacttcccttgattatactgatgcctatgcataacatttcacatgaaaatcccagtctctgtcccatcgctcacagatattaatcagttgtactagttcaatcaggatttatgtatcagcacagcataaccctcttactctttaagatttgtcatcaggcattaggaatttccaatgggggaaaatgttttcatagagtaagaaagacactaaatggaattttagtgtttgggagaacaactcgttatccaactaagctattaaacctatttggcttagccctcttaaagcataaccctttaggtttgcctaaaaggagaaagaaaaggagaaggtgacatggtgctggaaacaggcaaaccgtctctcctcttttccccactttcctctctcctccaccccatcttcccttccaccttctgctccacaagctagcagacagcaagacaggccggaaacttgaaaactggcagaacccaccaatcagaatcagggtactgcatactcaagtgataattattcagacagtcctgcattgtttacaaacacctgcccctgtaccaaatgtctaatgttctcttttgattcttgaacacatttacaattcactttttcttagaacttgtgttctgttaataagaaagatatggttttattttatcttgtaagaaactattttttatgcttgacaagctactttactatcttatactttctgccttgtaatatgaagttggaatctaaaaaaaaagcccccaaaactttcataacttgtttttattatgaacttgcttttattatggcacaatgagcaacttctaaagctagtgagtttcccatccctaaaaggagtcaaaataaaaggccaaattaccttagtgtaaggatagttgaacatggattcttaaattcagtagaaaactggactaaattgtttctacattttatttcaactccaataattcatttaagccacctattttcaaaattgtttgagataactttcaataaaatatatgtggttggtcgattcaagtggaaattgaaactacaacttctgagaactcaagattataattatgtctaatataaagtcttattagaagatataataacgaagcatacccagctaggcagagttttctaagcttattcatacattctgaacaaatttgccaaatatgactagtgtcaacagactgcagattttagagccagttgaatgttcctctctctaaaagcaagtttagtttgtttctcgctttcctatagaaaccttattgaaatatttagtatctgagtttgatggttttatatcataggacgttcttagcagacagtatcttgcacccagtaggtagtatgtgtaagtgtatgcattgaattgaatatcctagaacagacagtccttatccaattctgtcttcaaatgtcttacctcattctgaagaatggatataaatcctgatgaagtcctaattagatagtaaaagagggatagaataaaacaataatgagcacagatagcaacagtctagtgcctgtctgtttggagagaagcaatcttccacctacattattttctttacagatgaaaaatgtagtttgtagctttagtgttatgttcaaataaagattagggaaggtgaacaggcagcaagctaattgcctggaatctaaaattggtagatcttaataattttttttttttgatggagtcttcctcggtgcccaggctggagtgcaacggtatgatctcagctcactgcaacctgcacctcctgcgttcatgcaattctcctgcctcagcagcccaagtagctgggattacagacatgcaccaccaaacccagctaattttttcatatttttaatagagacagggtttcaccatgttggtcaggctggtctcaaactcctgacctcaagtcatccacccgcctcagcctcccgaagtgctgggattacaggtgtgagccaccgcaccgggccaatcttaacaatttaacaaggtgcaaatgaaaaagaaagaaaaccttcagtccttttaatatttaagggtaatctatgtcactcttcatctacaacattcaatggaattgcttccagtcttttctcattagattttttcagaaccttggcctgtggtcactctgagccccagttccacagcagtgttaatcacttcctcctcgctgtccctaaaagatcccaagacctctccattgtgattttttttaaaaatcaagtaacccttctcctactagcacctcttccattttcctcctttctagcaaatctaaacgttcccaattaagtttttctctccttttttttgaccattatatatactctcctcattcttaatattctatagtcaaactgtgctctccttctgtactgataactgttttaaggacacaatgatcatttgttgattaaattagtggttgttttccttcaacctcctgctgtgttttctactattggccgctttctgctcacaccacaccttagattggtgtagaatttgtctgctgcaaggccttaggtctctttgaagtactctgactacccctcctctgcctctttctccatcctcccattccataaagtgggcttttccctcaagatatagacccaagcaaatctttaaacaattatacaaaaatatattctaagatatataattaaataattctccgctgataccatctcttcatctcttggtcagtttttgttttatccttgggcccaattatggcccagcaggtattttattatttatatcattcatatatttttcttcctttccagtctcatttttagctactacacacctatagaactctcagaaggactttctgtagtttctttagcttatgacattagtttctcatcctatctggtttgcattgctctgtgtgtgtgtatgtgtgtgtgtgtgtgtgtgtgtgtatgttttatgtgcacatatcttgtttcctcagcttccctatcagctcctgaaggacagaaagtatattgtacacttacagtgtaaccagtagttctggcagagtctcttactcatagttaagatggtatagatacttgtaatcacgaggttagtggataagtactcagtcactgtcaggagcatggataaggaatacagcgtagctctttatccattgtttcagatctccactcagaccaacacatcctacagagcaggacccaccgacacattcatcgccagttttgctaattcttcttgatgactattttcatttctatcccaaatttctattcaaatattgattttttcctaatgaattttataatgtggatataatgttagtcagtttttgaaattgaacaacaaattgttgatttggagcatgtatatgtgtgtgtgttttatattagtttgttagagctgacatgagaaagtaccatatactgggtactatgaaaatctatttcctcacagttctggagaaaatgcagagaaattgagatcaaggtgtcagcagagttggtgcctgtgaggtctctctctggcttatagatggcggtcttctcccagtgtcttcccatggccttccttctgtgcctctctgtgtctaaatgttctcttcttataaagacaccaataatattaaattatggtcaccttaatgacttcattttcacttaattagctccttcaaggtcctttgatatctccaaataatcaccttctgagatacaggggttaggaattcagcataggaattgtggggggggggacaaaattcagcacataaaatttaagtagcaaagtaattgtgtgaaaaaaagcaatatagaaagagaagagagacattaaactttgaggaagaaaaaaaagaatcacaaaaatgtaatcagtcatccaccctaatgtctgaagaattcagcagggaaggtgtcaaccacaggacatcagggaggtcacgggactcaacactgccatttcagtgaagaaaaggaagtagctaatgtatccagtgaaattccaaagggtgttaatcatatcagtttttattcccttgagaaattctcttgaaactgaggtaaacatctggaatgcacaattgacagagacatatggagctcatgctgtaataatataaatatgctttctatcctctttgggggcataagttacattttgaattatgtcatcacacatatgctgcccttgtgtatcagcagtttagcattacatgcagatctaaaactgtccctaggcctgggtcatttattgattgtgttcggtcatggtttttactgatcatttctagtctcacattcaggtggctctttcagcgcattttaaagtttccttgctgctatccctgctgttatttcttaggtgactcatgttgtaattttccaaactgactgtcttcacagtgagaggaaaagcattcacgcagctaaaatggattttatgttcaatgtcattctaaactatcagtgaaaaaaagttgaacaggttagcatttgaaacaggtacatggggagcattataaaggggctcatttaggaattagctacctgcagaacatcttcatgtcagaaagattcctcgaactcacagaagcataatgggactcacagcaatactaatccttagtggcaatcctaaatacatggacccactttctgccatatcactatatgtgacattctgcagactgtgcacactcacgtgctcacgcacacacacgcatgcgcgtgcacacacacacactttgggtgaaagatgcaatattagttaaagcaaaaaaaatcataaaatatgcaattgtattgggtttgtaaaagaagaataccttattaattatcatgattgacattgaaatgaccaaaaaaattcaacagtagaaaaagaagaaaaatagggaaacatgattttttcagtatatttgccttaattagaagagtgactttttccaagtggatgatcattctctctttggggtggtggcatataagaagattgagtttagacagggctttttctaactctgaaggcatctcgtagttcctgacacacacttaggtgtgcctctcttcttgagagttaccaagtataataaaggcattactaacacttgctttttgtgcctaaggggagtgtagagacttttttttttttaaagaaaatctcctgggaaatattatatcacaaaactcacctctgtgaacaaatgtctttggttggatgattctcaaggaaatgtggacggaagaacagaggcagagaaacagaaggggatggggggtggagtgtgggacaggagatagtgaaggtaaagaaagtcatcatggttgacaaaggagtttgatatggtctgatttgaaattctttaagcagatgagaaaagggaggtgcacaaacttacatacttcctaggcatgtcttgggcagacagaatgaatagaggaaagaatgcagagaaacatatggtgcttggacatagtagagaaagcatgggtctgaattcaggtagataaaaagagcatcagtttgcaccatacattaagtaggtcagagatcacacattaggtatcaaggggagaaaagagagtaggaaataagtagagggcaggtgtcatccatataaataggtaaagaatgaattccaggaagcagggaagggaatcaagaatctgggccagggcactaaagagaaacaggatcactgacacatctcagtgctcagctgtttgaaccagggacctgtaccaaaagtaatatttgaacgcaatgataatgaatcttaatcctgtaaatgatcatctctaggaaattagatgatctttcctggtgtctgtgagccaccattgtctattcatttagtccacattaatgagaaaattctccaggtttcaccatggaaaattggcagcttttgaagattgatccttcagcagtcatatggctcagtccagctcagtcagtaaatcctgagctcattctcataatcctttctcaagaaaaaatgctacggactacttgacttgatttctatagattgttttttctatataggaactatgtggtcagatttttataaattttaggtatcatacaatataaaacacacagtagctgtatactcacacacagacacacacacacacacaaacacacacacacaggcataaagtacagatggctacagaatgatgataacattgcaccttcttatgaaaagcgcacccatatgtcctaaagttaaattagtgctatctaatgatgtttgaccctcatgtattttttactgaggtcttttgattctcatttcctccatttaaataatgaactcctcttgtttttgtcaaatgacaaaaaaaaatttagtcacacataaaattcatcaaaatctttgttcattatcaaacttgtaagataaggttaacattattatcaaaaattattataaaggaatcctgtattctgtaattgatcttgcatcaaaaattgacaggcacaaatgaaggatttttgtcactttaagcaagtaattctcccttttctttactgtatgagtccgtattcttgcacattttgtagactgtcaaataagcaaagacactttattagtgatttgcagcattttattgttaagattttcactgctttctcaacggtttcctgacttgcagaggatttttttcttcttcttctcatttcctaccagtgtagcattttaagtaggtgttataaatctctgccaaaggcacattcatagccctgcttgaatagtttcatttagactagaactacccttacttttcaagtcccttcaagatctttatcatagtgaaataacactttgttttcattaaaggataaagcacaactttataaaaagcccccaaagtaacgaatacagaagatttctttaatttttggagtagattcaatattaaatcttattattaaattaattttaaatgtctacttgaaatccaaatagggattttaaattattttttaaatacagaaagggacatgtatattaagtatattttaatacatttactattttagctctataaatcactcttgatgactgcatgctgtaaacatttttcacagaggcaaacaaaatgctcatgtcttctttggtaattttagtcaaatgtgctctaatagacttgtgacaagtatgtttttccctaatccaagacttctaattcaggccacaaatattacttcaaaatataccaaatccagcagagaagtatattgagctggagtttccagaagggaaaagtggagatagaaatctttcgcaaattccatttacaaccttgccaagtagatgccaagaatactaatctcttgaaaggtgtcataacttttcaaaattttagccggaaggcagctatatagtattcttcttgatctgtttcatgatcagtcagaatggtttattcatgtggttataagtgaccagggaacacatctcctaatgacttacaggattttttttttccagacgaatagatttcctaacagatatatcttttggggaaaaaaaatcaaatgtatcagacataagatgacctttctctttcaacatttcttttgtaacatcagtcactctgttctcttcatataatgatgaaaaaccaccactttcagttttataaaagcttctatcttcacaatgagccattttcataaagcattacactgcctttaggataaatgcatgtggtgcgtgttacagcccctactgtgtgctgatgcatttattctttttgctttaatttttagtgtttcaaatgatagaaaaaaataatataatagcgttcataaattcaacaggcacctcctacaggttttgtggtagaccctaagatcacctgaagtctggaacctatgtttagaatcctggggtcttttgcttatacagtatgttataaatatgtttatattcatgttcatttgtaaagcctaaaatgtcagtcagtgaaaggaactctcttcacccagtaaatgacaaaactacctgtttttatcttaatgcatgctcttctctcctcagttgaatatttttacagatataattcgtaggatatgtttctgtggtatttatgtaatacaaatttacattatatttaattaaatctttacccaaataaagtgaggaattagtggcatcccttggctttatagtctaacaggtgtgtgtgaggtttaaaagttcctatctcattttaactgatattttgtaatcctaaattccagaattaaaatactatgaatgattttatttaccctttcatggggcatataccttgatcattgatttttattgcagccaggaataatagagggaggcaactgtgcagtgtgtgtgtgtgtgtgtgtgtgtgtgtgtgtgtgtgtgtttccttgagtgggttgctcagacaagaatctaggatcagaatctgagatcacctactttgaacccataatcttgaaatagaatctaatggaaagctgcttgtagaaagataagcagagcactattcaccctgctgtttactggggaggatgaaactcgattctgtttcacagctgcatttactcccacctcctcctgacatctgtgggctaagggaacacaagcttgtgaagaaaactgtgttcagtcaccaattacaatgaaaactctaaaagagggtggaggaaggaatggcaaaataggaacaggaacaggacaggaacaggaagaggactgaattaattttattccattgcctaatgtatatttttaaattttccttatctgatttctttaggcttgggacataattgtccacctgcccatctgacagaattttactcaataaatgcctcatatagccatgtcttgaggtttcagaacatcatctcttgtgctaggttgaataaaccaaaattactccttaccatggaaatgtgtgttttcataaatgaaagcaataaaacattaaccaaaaaagccagaccggaaagatttttctgaggacacaggtcaaagtggacaaatattatgtaaccctaaatttggagctaacacacgtttattattttacaaagctgaactcagtcatgcaatagctatagactccatctttctaaggttagaaagtaggtgaatataaataggaataatagaattataagtgaatagtagaattataagtacaccagaataaatgtgtactaggatatgacagattcaccatgtcaaataaatagcagaagtgaatgataagtatgcaaaacacaagaataaataaaaatttaggcctaaaatttaatttttaccattcttacaaaaaatacacatttaatagacaataaagtatacacaaatatattaaagaatttggtaaggtgtagatgttttttaaactttaggatcaagaacacttggcatccatttattataagtgtaagacttgtcaaggagacagacagagtcgctattgaagtcctttccagctcattgagcctaaaacccttaaatgctgggacaaggcagctggcagtaaaataattttaatgatcattaactttgctattttgatgtctattttaatataccaaatttgtcttttatgagttcaatttatttttaagtaatttattctctaggaaaaataaatgccatacttttttaagtgaagaacagaaatcttctttctatatgaattctatgaatgaatttatcatatctggactgagactttgggcaagtctcctaacctcactatgtctcagtttattcctatggaaaatggggttaatggtagtgctaacatcataatgttgagagggaacctgagttggaacatgtaaatgctcaatgaattactattattattattgccactttatgcactttcagtcagaaacagagctctaaagttcaagtcttgcttgtattccttaattttcacaaaggctcgttatttcctttttttgtttttgtttttgtttttgtttttgagacggagtctcgccctgtcacccaggctggagtgcaatggcggcgaactcgatctcggctcactgcaacctccgtttcccaggttcaagcaatcgtgcctcagcctctcgagtggctgggattacaggtgcatgccaccatgcctgcctaatttttgtatttttagtagagatggggtttcaccatattggccccgctggtctcgaactcctgacctcaagatatctgctcactcggattcccaaagtgctgggatacaggcgtgagccactgtgcctggctagggctcttaatttcacctacttcacagtggtttgcatctccctttgatcagtcataaaaaagatacagcttcttgccagaaattgcatgccccaaatccctgctgttaatccttaccaaagtctgattgtggcaaataatattaataagaaattgaaactatccattcatttattaggggaattctggatgtaagggatgcgcttccaggagtgaaaatgtcactggattttcagatttacattttctttcattaaatatattgcaaatgtaattttgtgtctgtatttttggagagagaagttccaatcagagctttcatctgattctcaaaagaatatgcagtcccaaagccacatcttttgtgaggcattctgagtattctaattttatcctagcatcaattcaggccctcagaaaattatatatatatagctgtactggcttgttcttttctagaattttttactgaatcacactttagtgctatggatttcttatctagtttcagttgtattcattatgtagatccttgtctaggataacttgttatgagaacttcatcagagaattttttttatgtttcagtatcagagaaagttatgaaaaactgtcttgtgtttatcttttagatggttgaatattttttttcttgggctgctagaaaatctatactgcaggttttctgtgttaaccttattctggattaattatttttcctactatgataatgcttcatctcaatttcccacacattttctttggaaaagtaaaaaattagtagcttttttcccagtatatatcacccaacatgttcaatgtctttcagtaaagtaatgcttcaaatttcaacctacataatttgaattagaaatgaaacaagtttttacaaatttggtgaatgcttatgagataattggggatttggggtttaaataacatattggtacattcatagtttgctgtattctgaatcagtgttcactaagtatcatcggtagtgaaaaagtggattggcctacagaaagaggcaatatgatttcatagaaagtgtcctgctcatgaaattagacttactctagtccaagctctgcagattcagaaagaagtttatcctctccgtggctagaagataataacaccactacacctattcacctcacaagactgtgttaggataaataaagtaatgcagtggaaagtcctgtgaaaggcactatagaaatacaatgtgtttatacccataatttgaagtacatgtactcaactaccttgcttcatacagaatcataaccatgctcaaccttatacttttaacctatggttaaagagctctcaagcaatataaatttattcagtccattcagtctccttttactacctattagttatataatattgggctagtctctgagcctccccattcctcaatcttctcacaagcttgtgaagaaggataaataagataaagcaagtaaaagtgtggtacttgccactatgtgtgaaatacagtaaatcttggccattattattaacattaattccttcgacgtaatagatgttacaaatcaaaaacctatttcattaagtaaaaaatatgtacactatgtgcaaatggttttatagaatagcaactggtggctgccaagactttataaacaatatttaatgagattctaggcgctgattaaaatgtaatgaaaaaagctttaatgtaaatattgccatgctaggtatcctagtcacccagttttagtttaatggcggtggatgtagttgagagcctttagtgaggcagccgctaagtgattgtgctgtctagtatgtttagtcaccaagtgcaggatccagccacatgcgacaattctgacaaaacaccatcctgcaatagtagagacatgttttgtttgtttgtttgtttgtttttctctaacataaagaagcaaataaggctgggtgcagtggctcatgcctgtagtcccagcactttgggaggtggaagccggtggcagatcacttgaggccaggggttcgagaccagcctgtccaatatggtgacaccccatctctaaagatacaaaaattagcgggcgtggtggtgatcccagctactcaggaggctgaggcaggagaatagcttgaacccaggaggtttcagggagccaagatcatgccactgcactccagcctggatcatagagggagactctgtttcaaaacagaagaagaagcaaatagaccagaatgctctatcagtctatcaattaattatacaatatttgaaaaagttttctttgacaaaatgtcttataaagtcaaaaaagcacattcgtctttcttcatcatgcatcagtgtgcatgcctcagcctttgttcacagagctctttgctgcacgtgtgacctggttggaaacaagttacacagattgtaaagactagtaaatatcagggtttcttggcctaataaaattaggttcatttttatctaaagaaaattaagatatacacttagagtgctcacagtgctactcaaaattttcactagtcttcttttttaatacatttattttatgaaaatatttaagaattttaatatctggtgggatgacaatataatcctgataaacactcttcatgctcatattttataggagaatagagagatatctgttgtcaaaacttacagagaaatatcaaacattataagcaaacagtttttgttaaaatgatcacaaatatggccaacttgaatatcagcaaaatatttgattctataagaacaaatatcaaataggttcaaaaggattctatgaaaaccctatttcgtttagctcagcactaacacaaaaatgaaagaaaattttgtacctatcaaatattctttctcagagcagacgttggaacccaaataagatgcagtatgtgagagctgatccaatcacatactaatttatctcttcattgtttctaagaagtacttgatttagggtagaacaacctcctgattgattcaccgaacagaattgatttcaaaatgcacattcaaggagctaagtaaatttccctaccagatgaggtcggtctacagacattgtccctgcatatattggaaaagaagattatcacagaatcctatcaaaaataaacttcctgtcccttcccactgttattaagaccaagccaagcagttgactatgataggaatgccacctcctagctacaaaccgagctaatagacaggtaagaaaaattcatgcaaacaattttggcagcaagagagctccccaccatgatgatgattaatgattgttctatggcaataactttattggactccgaaatggaatgatggtagaatatatataaacgaccatgcataaataagcaaaaagtgtaagcagaccattgtccacacctagagtacaaatatggccccacagagagcaaagggtagttctctaatcccttacccacttcattagaaggaaatcaatccttttgctggaaatctggcccttcactccaattatccctcaaggatagagagggtacgatttgtcacatattaccagaacagtgctgaacctctactcagatgacccattgaccaccatgtcctgctgcctctgctggcctgcccagaccagtacagcctctgccaaactgccagaggcttggcgctcatctctgtaactcaccagggacttatgcctctcataaccaggtaagtcagagagcagaacttttggaactctgatacataaaggtatgatcccagggatttccaaacctcattgaacatcaggatcatctgataaactcttttcaaaatagacttagagatctcatctccaactgaccaaatataaagttttaagagtagatttcatgaaatctgtactttgaacaagtttctcacagtaaaggcacacactgaacgcacaagtagttattaagttaattcctaggtagatagtggaacccccttgtctgtagcatttcaggttgctttcacaaattaccatagactgggtggcttaagcaacaagcatttatttctcacagttctgttgctgtaagttcaggatcaggatgccagcatggtcaaattctggtaaggaccctctttcatgttgcagactcctaacttactgtatcctcacatggtagggaatggactagagaactctctggaggctccactctcttgacctaaattactgcccaaaagcctcatctatttcaacgtgtgaattttgtagaaacacaaacttcagtccatagcacccagcatacagattggcattgggaaatcacaaatgccacagctgttttttgcctgtggtagaacaacaactacttccttgccccaaacttactgagacagctaaagaagttcttaagcattcattacgagactggaagccgggtactgtggctcacgtctgtaatcccagcactttgggaggccaaggtgggtggatcatgaagtcaggagttcgagaccagcctgaccaacatggtgaaaccccgtttctactaaaaatacaaaaattagctgggcatggtagcgtgtgcctctaatcctagctactcaggaggcggaggcaggagaatcgcttaaacccgggaggcggaggttgcagtgagccgagatcgcgccactgcactccagccttggcaacaagattgagactccgtctcaaaagaaaaaaaaaaaaaagagagagagagaatggaaatcgatgtgtcataagtacctagcattagctctacagagacatgttgcctaagtctcttccatcccaagcatcacatgcatccatctcagttctactaaaatccatatgtaggccgggtgtggtggctcatgcttgtaataccagcattttttggaggccgagacgggcaaatcacttgaggtcaggagttcgagaccagcctggtcaacatggtgaaaccccatctctaccaatgtacaaaaattagccaggcgtggtggcacacacctgtactcccagctactcaggaggctgagacatgagaatcacttgaacccaggaggtggacgttgcagtgagctgagattgcaccactgcactccagcctgggcaacaaagtgagactgtgccaccaaaaaaaaaatatatatatatatatatatgtgtatatatatatatatgtgtgtgtgtgtatatatatgtatatatatgtgtatatatatgtatatgtgtgtgtgtatatatatgtgtgtgtatatatatgtgtgtgtgtgtatatatatatatatatatatacaccagaacttttaaagaaattaccgtgtcattgctaatatctcaaatactgcattgggcttacagatagctaagtccaaacaatctcaatgatatttttaatcccatttttgagggcccattgtgtaaaaataattgaactttaaaatgatggactgagtttttctttaagctacactgtgagttcctcaaaaggtgaaactttctataaatagcagccagcacataaaagacactcaaataatatgagctagaaagaaggaaggaaagcggaaaggagggagggagggaggcaggcaggcaggcaggcaggaaggaaggggaaatgggggaagggatgagggagaaatctctgagtggatgaatgaatgacttcattaatgttgaccttttatttgccgttttgttagtgttaatgaaaccagaccccaatgttttcagcctctttattactgtgatgtcaaatgaatttttccaggtgatctttgttttgataagggcaactttgcccttattttgtttacttagtttcactgtatttctcaaaaatgtaggtaaggatatatccaatttttgtaagaactcttttataattatgttaacttttgggcttttaaaaatgaattaaatattggcccatcactgccagattgttacttatatagataattgtgataccagccaatgtctgcttaaaaagtaataaagcaggaatgcatctgctccagaaatatgagggatcagtttgtgtaactgtatatgagttaaatgttaagaatttgtgtaattgtatatgagttatatgttaagggtgaaactaacattttatgttaaagttatttaaaaattgtgtgtgttgtagagcttgttatgccagtttttgttaaaggaaggggacatagaaaggttcttaatctccgtaaagttgtaccaattgtatatgccaaagacagattttgaactcagtgtgtttgatctcaaagcatacactctttctagataaatattattaggaatctggatcagcattgagaagaatattcacaaatgtctggtaaataaaatctatctaatagtacctgataaatatttatcacatcctgttacggttaccatactgttagttcctgggtaattgttgtatactaaaaaatcagtaagattcagtgtccaccccaatgaagttcatggtctacatggaaaaataaaacaagtgcacatgtgattatactacattgtgctgagatctgacagaaagataaataatcctcgttaacatatttttactaattctatgtgcgaggcactgtgctgaagaatatatatcgatttcacaggaaactcagaaaacttagacttgaagacactaagtgactaatctatgactgaagctcaaaatcaggacatctatttctggcacacttaaacttaattactattttatatttcttcctgggttacaaagtggagtacagactggaataagggagatcagttaggttactacaataatcaatatgaaagatgataaggacctgagctaggaacggcagccctggtggaattggaaatgaattagacaaaagacacttgacagagagaaatgagcgcattgatgtctgattggatgtagaggaagcaaagaggggtattgataaaagatagggaggagtcaaagataaaagtttctagtccaaacaaagaatcgtctgtgttttaaaaatatattccaagaagaaatttatagggaggagaaatgggtttaattttttatatgtttcatttaaataaaagatttcatggattcaataaattagtctttctaatcagttaagactcaggaataaaaataaccgaagacatatatggctagaatgtcagctgatataaatgctatcagctgtggaaggacagatatattatttaattttccttaatgaaattctgaatggccaattaaagtgcatcccttacaagggtcttacatacttgggcatgcagaactttctgaaccttaaagagctctacaattctaattacaccatgactaacaaagatgtgggaaacatcttttgggaaagtgaaacaacctaagtgattcccatcctaaagatcttgggagagtatccccaaatccactattctctttgttttaaattgtatgcagaagaaggctatttgggtaatatacatatttaggaaattaaggccctagtcagtcttgtttcctgagttgacatgttatcttagaaaacagtctgtgctaaattgccacagctgtgatttaggtatcacagcatcagccttctgtccctagggtactcttctttaagtcaaaagtactatctgggcctggagtgggagatttgtttgcagattctaaaaaccgcctccacaagagcatttagcctcccctgaaaaatgtgacttttccttcagagagacaccattaacccaaaaaaactaaaaaaaaaaactaaagaaaaactaaaaagaatgaaaattaagaactaagaacaattaattgttccactgaacaattaagtggtttcaatgaggaaaagtcaattcattctttatgacttaaaatttaatatcatttatttttgtgtaaaaaatcggtagcatcagtgggaatattagctctaatcctacaaggtagttccttttactattgaataatggaaatatattactgctcaatgtttaatgcacttaagtggcaactctatatttgtattgttagattatcattttatatagggaagaaacatggtttatgtagctcttctttatataggattgctagatcatttgataatggtatatttcatttaataaactgccaaactattttcccatggcttccatattctgcatattcacaagccatggaggagttttccagttgcttcactctcttgtcaccacttagtattatcaggtcttggtggggcagggggggcggggcgggtggcattggtttgtttcattgtgttttacactttagacaagtagtttttcagatttttcactcattttaaataattggattgtttgttctgtttttatggtgaataaagttatttgtattgtctgtatacatttctttattgcatattctcttgcaaatgttttctcccaatctgttgcttgcattgttactttcttaacagtcttttaaagataaatgttttaattcttaatgaacatttagataggcaaataatccatcagtttttattatgttaattgatcatgaatttactgtcacatttaagaaatcttttactaatcaaggttacttttgtctgtgttttgttttaccagttttacagttttatgttttacatttaggtagccgatccattttgagttaaattttgtgtatgatatgatgtatagattgaggatcactttttggaatgtgaatgtccaattgttccagcactatttgttcaaaagattatcattttttattaaattgcctttgcacctttgtagaaaatcagttacacagatatatatggatctatttttaaatcgtggttggttccattgatatatttgtctactgttttgccagcactactgtgtcttgaatactgtagcttcataataggtcttgaaataagatgaattctctaaccttcttcttgttcaaaattaattctctaacattcctcttcttcttcaaatggattatttgcctatctaaattaatttttggaataaaattatttgtctcaaaaaaaaatctgctgaaatcttttctagtattgtattaaattatttgacaggcttggggagttggtattttaatggtactgagtcttccagtgcacgaattcagtatatttctccatttatttaggtatttttttgtttcttttattaatgagttttgtgtttgtcaacataaaaatcttgcacattttgctacatttaaatttatgcattttgtaattttggtgctgtttgaatattttttaaaagaaattccaagtgtttcttgcaagtatacaaaaataaaattaataattttcattgtgctaccttgttaaactcattagttctaatagcttttttgtagatttttgacatttttctatgtagaaaatcataaatctgtgaatacgggctattttatttctttgtctttgatctgcatgcctttttatttccttgccccattctactgacctccagtaaaatgatgaataggagtagtgagtgcagacatttttgcattatttctgattacaggaggaacatgtttttctttcacagttaattatgatgttgactctaagtttcttgtagatattctttttctaggttgagaaaattgccttctatttctatattgctgagagtttttatcatgaaagaaagtgaattttgacatttttccctgcatctagtaagattatcatattttctttttttaatttagtctattgaaactggattttttcatttaaagaacttagtaagagtccatactggataatcacaagataaatgtttcatgggagaagatggagcctgtttccagaggtttatacactatatatttatggaatgaaatcagacttcaacctttcaatgacactccataatccatcccttgtatatacttaggagacagataccaaaaagcttttttagtctctgtaagtcttaaagaaattcatccaaatattaatttattaataatttagttctgctctttcaacttcaaaatttagaatactaaaattaaacacagtgccatcaactcttagagttactagatgtgtaaaatcttaaaacgtgtctcactagaataagttctactaaaacccaacttctgtggacagagtattagatatttcagaatgccacatttccaaatggaccttaaacttcattaacttttaacttcagttaatctactaagtgtccattcaaaagaaagccaacagactgtgaaagtaagtttaaaattgatttttcaaaagaaaagggacaaacaatgatttgtctaattaccggatgagcatcattgctcatagtaagacatcatttgcctttatttattagagatttggggaaattgattataaatttccttggtttttaattctaaataacttcatacatgattttcaaaatttgatataatatgctgatataggaaatatgttattgttgtttatgtattatatcaatgaatgtttgttaactgaacaactcaatgaatcagtaaatcaatggtcatgtataattttttactgataaaaatataaataccccattatgtactatacattcctaatttttatttattcctaattttactgcaacactatttaagttttttatttgtatattttccttaggattcactctttatctgatgagtcagataatatgttttaataacagttaataatcactataaacatttcttaaatttttttctgtgcaaacccttatgctaggtgctgagaagaaaaagataaatgaaacacagtgtataccttcatggagttaatatgctattccagaggggtgattagatatataaataagagttaccatattgtaaacaccttaggagttggtactatattttatttactcatatttctgaccattgtgctaaaccaatgcttaccccagaatgcactaacatgcttgatgctgcagtgatagaactcttaaaaaactgggaagggaacacaagggagccaatgaacaattctttatattaataaaaagcctgttcagaggaaataacattttaactgaatcccacaggtggaagaaagatcgaaaggacattcaaagtagaatagcataagtaaggcgttttttttgtgctaaggaaagcagttttgaagacacagctgactctatcatgtaggtcaatggttgtaaaaactggccattgtttataagagttaatcgctggacagcaaatcaagatttagccttctctacaggaagtgcaggtggcagctaaagaagtctaactctatgttatgttgcatattttacaacatgttaaactagcatcaaatgatttgagagttgaccttgaactactgtgacagtcctttagcactgcaaagacaccctgaccaattctttctacctctgcccacaaaaatttgaaatttagttgaaattgtcaactaaaagcataaaactctctacccacactgaactacactatcccttagaatatataaccctttctcacctagctaatttataggttcacctgctcacgtgtgaggccaatatagaattccattcaatgatttttgcaatttgatcagcttgaagatgtggataaaggaaatcttcaaaaataaaactgtctagtgaagataaaagcatataatgtaggatctgcagcagcagccatcattagctattgctcttccctacgaactgaaaaaaagctgcagacttccataccaactgacagaatgattgcttccatcccaagcctctgtggtgcagatgtaaatagtaaagtcatgtaaatagcattaagggaaaatttcaacattctctacatttatcacatttcctcattttagagaattcatgagtattaaatgggttattatgaaaaatgttcattctcagtgatcatcagagtgtggcgaaattcatggtgatgagattaatgtctgttacctctgttttttccacaagtgcaccactgagctttagtgtacatttttcttgtttgttttcctctttgccattccactccagtcacacaggcttcctgcaatcatctattcaatatgcctggacagaggtatatgatgtccagttttctatgacccaacgtcagcattgggaaaccagttatggcgatgctgagcagagagagggattcatgcaggtaacccagattaggacaccccctttcaactacagcaataaaactaaaatgttttatagtatttggagtttttccttaaaattatagagtatcaatttataacctaaaatattcaaaagaaatgtgaagagaatctcctttagaaatgtattcagcctcaagaaataactacttcaaatctcttgaggattgaatgtccaaacttcagaaagacattggctgagactgttacatagttttcactttcttctccagttgtttctgtggatacattttaaacatattcttgaaataaagtagagaagatagcaataaagactcacatacagaagcagttcgtgagagtaaatgtttattcttagaaatctatcgaaatgttcccttctactcctgggacaaaggtgagaaggaactcaacacaaattgtgtgaggaattcaattattaaactagatggaaatgctttaatacagcacaatatttcctggaaaaatattatgtagccaacttatggagcctgatataatagaaataacactactaaataacacaagtaaacggaatgaaaagatctaccttactatactcattgacatgtgacctattagaagttacttaaatctctgattcttcatcttttcatttataaaattaaatcatagtagaacatagtttgctatttcatggatttctatgaagctcaaatatagtagtaataaatgtggaagcaactataagttctttctagctcctcaacgccataggttctttctagcttctcgacctggatagaatctatgagacgtgccccttctgaatcgcactttttcaaatcccccaagtgggctgcacctacatgtgctggagccccagactagaccatttctgtaagttgggcttctagattttctgagcagtaaacagagatggccttgagttcaatctatactatgctctgtatatgcagtggggtctgggactggtgcccagcactgagcttgatatgtatgactgttttgtaatccagggagaagtagcatagggcagtagaaagagctaaaggtcagcaatgagataggcattggatcaaatcctagccctacacttattaagcatttctggctttgacctcctcccctgactccttggggagagccaaacatcatatcccagccttcatcagatgcctcacaaattccaatattaaaagtttccatggtccctgtcatgtgaaaacatatttttgcaagatattcagcatagtgatttatctctactggcaaaaatggcattgaaaattttgcacaatgtaataagaaatgcaatccaaattataccctttgtcccacactggttcttcttaagatctgactactttttttaaatagtgaaaagttggtatgatatatgggttttgtcattaaacagacctggattcaggactgaatctcacctcttgttgcctgtctgtccttaatctttttaagcctcagtttccttagctataaaatgggaatgactccttgagccatagctagtaggatcatttagaaattaaatgtaatttaaaacatttaatagagggttttgacacatttaataaattctaaaatgttagccattgctgctactatgtaagtgagtgtgcaaggaagtcctacctttttggcctttttgctttcataattttaaactaaggctgggcacggtggctcacgcctgtaatcctagcactttgggaggctgaggcaggtggattacctgaggtcaggagttcgagaccagcctggccaacatggcaaaaccccgtctttactaaaaaaaaaaaaaaaaaaaggaagtagctgggcaagtagtcccaggtactcaggagactgaggcaggagaatcacttcaacccggggcgggcagtggaggttgtagtgagccgaggtcgtaccactgcactccagcctgggtgacagagcaagactccatctaaaaataacaataataataataataataataataataataataataataatattactaattaaactaaggtagtgtcttttctttagagaatccaatttagattcagtgttctctctggcagttaaactggaaacaggtgcttcttgcattcctgtgtcttgaatatgcaaaagtttgatttatttttatttatctaattatgctttaatgattgtggaaacagactgaatatttttcaatactgtgttaagtacagaatgtaacaagaaaaatttttttatggtgcatcatctttcatgtaagaactataaaaagaaaaacattcataaatgtaacctcttaatcattctggtatacctttgatgtgagtagaatattacaacctattattcatataagaaaattatgttgcagattattcctactctatccaattgtaattttctcctctcctgaagtgaaagcaatctttgaagtaaacagtgcatttttattgttctgtatcttttaagattattactattaattaataatccacttcaagatgttttcacatcagtacatataagtctgcagcagtggttttcaaaggggttactttgacccccatgctacatttggcaatgtttggaaacagttgcacaaccatgaccactgtctaattccagaacatcttcaccaccctaaaaagaaaccacatacttgttagcagtcactctccaatcctctctcccccaagcccctgtcaatcaccactttactctatgtctctatgaatttgcctattctagacactttatgtaaatgcagtcattccacatttgtacccttttgtatctagaatctttcacctagcatgttttcaagatttatccatgttataacatatatgagtacattgtattcagtgatacagattaataatgttccattgtatgaatataccacattttgtctattcattcatcagtgtatagaaatttgtttccattgggggctattatgataaattctgcttttgacattcatgtataagattttatgtgaatatacattttcaattctcttcagtatattatctaggagtggaactgatgggccatatggcaactcaaggtttaactttttgaggtacttccaaattgttttccaaaatgactgcaacattctacaattctaccagcaatgtgtgagtgttccatttccacaaatcttccccaggacttgttattatctatctttttgattatagtcatcctagtggatgtgaagtaatctatcactgtggttttgatattcattgtccttatgactaatgatattggccatcttttcatgctaattggccatttgtattgatatagtgtggctatgtccccacccaaatctcttctttaattgtagctcccataacgtccacatgtcataggagggacctggtggaaggtaattgaatcatggggacgggttttttctgtgctgttctcaagatagtgaataagtctcatgaaatctgatggttttataaaaggcatttcccctgcacacactctcttttctgccaccatgtaaggtgtgcctttgctcctcctttgccttccaccatgactttgaggcctccccagccatgtggaactatgagtccattcaacatctttttctttattaattacccattctcaagtggcagtatgaaaattgactaatagatttataaattcaaatcctctgccaattttaaattacttttatattgttgtattgtaagtgttgtctgtatattcaaaatacaaatttcttatcagatatataatttaaacattttctgagccatcttttcatttctttgtcctttgaaggacaatacttttaattttgatgaagtcctatttgtctttctttttcttctgttgctggtgcttttggtgttgtatctaacaaatcattgtttaatacgatatcacagagttgcacctatattttcttctatgacttttatgattttaacagtcacatttaggtatttgatctatattgagttaatttttatatatagtacgcagaaggggtcattatttttcttgagcatccaactgtcccagtagtcattgaaaagattgttctttcctaactgatttgtcttggcagctgtgtcaaaaatcaactgactataaatgtgagggcttatttctgaacttttaatcctatttcattgatatgtgtatgtaatataatatatataaaagataaatatataatttttatgccagtaccacactgtcttggttactgtagatttgaagtaatcttaaaaatggaaagatgttcagacctccaactttgttcttgattttcaaaattattttggctattcagggtttcttaaatttctacatgaattttgatatcagcttgtccatttctgcagcaacagtaaaagctagcttgggttttgctgtggattgcattgaatctgtagattattgtatcttggattaattgatattttgtactacagtgactgattttcatgttaaactaaccctacagtcttgccaggatgttggcttacatcatggttacaagactattggtttttaaggctcctagggaactggggagaagagaatgagaacaggtaaagttaaaacaccagaaagctaatttttcttatgcagattaaggtttgtttttttttttcttgactaaatgttgcccatattgttgcaagcctttgggtgatttccagacttctgaaaaattgaattttgacaattttggtcagagttctcattgcttttatgaaggagaggttttcagagggcctactctgctatccatgctgatgtcttccattaatgcagttttaatgaagatattaaatattcatggacattctatttaaaagatctgtagggtaagaaatctacaggttctcaattttattttctggtactacccactatctcataaaccatagtaattttcatctctatttctttatctcagctaaatattcattcatcgtacatacaccatcaaatgtatattcagtgacttctgtgcttaagacactgtgatacccttttaggtagattcaaaattaataaatacagattattcccaatgcaataaataagatgattgtagctaatacacaaattaaacttgataaacatcagaaatgggatatcgatcatgagatttcaaaaaaggatgaggaaagactgcttgaaagaataagtaggggaagatacacaagggctgtggtgtaaattctagatatagcatgagtggtattagaatatgcaggatggaggaagaacattttttagacaaaggaaacagaaagaaaaacaacatggacattaagaaagcactagtcctaaccaggaaaagtgaggtaggtctactaggctgtagcttagggtatctaagagatgtgagaaataagatttaaagattaagctttagccaaaaagtactttcaatgccagcctaaggaatgtgactgttttttttttttctgtaggtggtatagagccacaaaagattacaaaattagacctatgtgccagaaaagtttatctttatatgtgtataaatatttgagagatttaaatcaagttcatactctcatcaagtgtaatccaacaacaggataaatgacagtattataaaaagatgggaaaattataaattaaaatccagactagtgatggcaggatgaaaaaatgaaagtactagactcctgattattttaagacttacttgttttagatttacttgtttttcagaggttcttagaaccaataattttatagcaaatgtgtaaggaccactgaaagttctaggaaataggaatatagacaaagaagaaattactccagtatcctcattttcaagtaaatagaaaaaaatgtaatggtattgccacattttctatttacactgtccttggttatggcaccttcttccagtttcttcagcctaaattatagcatctctggtcccagaaaaatagattattttgtctctcaccttttgtttccagaagaacaatgctgagcttcagtataatattcaatgtacatttgtcttgttttcctctgacgtcccactttagctgtttgggcttcccacaatcatttattctttatgcccaaccctacgaagtggcatggttttattcacccaaccacagtatagtaatcattgacagttaaatatagggttaaatatagcaccaaaacacctcaaacacctcaaaacacctgaagttgaaaaattcaaagtttagacgagaggctgatgttgcacgatagatctgctagccttccaaacactgggttggcttttatgattaaattgtctgcttaaaaacaaacaaacaaaaacaaagcaaaataaaacacaccaagtaactgaccagttaaatggtattcctcctatggagtcaggtttatgtggctcagctatctgtaaaacaagaaaatatgtctctttgtgggatttttccctactcaggctgggatataaccttggttttcagcgggttaatcatctctcataacatggttaactggtagtgcaaaactgttcataatgttctgattttttttttctgtacagttaagaataaagtaatacagttgctacctaatcactgccttgaggactttgctgatgtccgtagcctactaagccgaggcaaactaaggtcatataatttaaaaagcttccatttcccctatgatatctttgagcacagattaactgaaatcattagccaacatttttcactccactgatgagaggcgggatggggttgcacagcactctgtcaacccttacataactattcatactattttggagcagacttggaaacttactaaatatttcttggctgtcagagttactgaggctttgccagaaaccgatccactcatatggtctaaccatctttggggaaggctaatgcatacagtgtggatgtcttgacgtcatccactattctcccgtaattgctatgctgcaaaaccttttgtgtttgagttttgtgaacttttgaaatttgacactgctgattttgtagcacaaaagctgtatcttaaaaatgctcccatctatagtgtttgcagtgatagaacttaagaacagcctatctgttttttgtttaagaaactggctgtgcctaaccaccagatctcttccactcaggttcccagctatgtaattttcaaaacgaaaatacagggccccttgtacaaaaaattatttaaaaatttcagtacagctacagctgagctttcaaccaagtgtggggctcttctaagcacagggccctcataaatccagcccttttctcactcaccctttaaccataagtgaagaacagtattaaattatccacctaggacttaaggagtccacatgctgctcatgtaagcagaaatactgagtgtttggacatacaatgctatttttcgataatttggaaagagtatagtaattattccacaagtaatacatacctatttgagtgcctgctactggctgagtgttatcacatatgttattatatttactcttaacaaaaccccaaatactcaatggcatgcgtgactaaactatagaagatgtccgattttattgcccttaacttgaagctacaggaaagatgatgaaagcaggtgaggcagacctccataacacctcttaggtgacctagccatacttcttgggctccctgaggattacagaaccatgactgaaacatttaaaataagaatttaagaaacattttaagtatatgaaatgatcgttgaaacatttaagaaaccagatatttctcctccataactgaaaagctcaaagtgctagaatcatgttttctgcgagtgactgagtttacccccataccaaaatgaagggaaaatagagaatctcttggactggtggactagtgtttgtctgactccagtatgcacatgagttatttgaggttctcaataaaatgcagattctgattccagtgtggggtaggacctgagattctgattttccagtaagcttccatgagatgcctgtactgcgggtctgcagacttgtacaaggtcctagaggaaacaaataaattcccttcccccaaataaacacgagatagatatactgtgcaatcattattcaagcggaaactaattagctgcagagttttctgttgtcattcacagttatatcatttttaaagaagctacattctctctttttaaaaagtgcataccttcacactgatggagaacattaacagggtactactcatctgctcaccttgtttttattgcttggtaatgcagataaatgtgtattttcaggattctaaatacagcctgtccttttgttctcttcacccacttggctattctcagaacaactccagcctcacatctaccaaaagccatttctcacatcagttctgaaaacgcccatcttgctatcccaaagaaatcacttgttatccaagttttaccttgattgttaagggaggataattgcttactgaatgcagtgtccacagcctccagcagccctcttgaagtcatgtactgcaccattaaatgaaagctggtaaatagacaagtctaccccgatgacaaatatttgggttcctctatgctttatttaattaactcaaaatagtttgcagatattgtttaattattacgcatttcattcgtcagtgtctttttgtgctttttaaaaatgtgaagccacaaacacttttgttataaattcaaaactttgtgctaagaaactgaactgtaaagaaatctcaggtgttgggacatgacctttcaaaggtaatttgctgcagtgtacagtcttaatctgatccagccatgggagatatgtgatttggtgccctacatttgcagggggtgtaggttagcatagaaatgaacttttgctgtcagaatgtgagtggtttttgcgatttttatttgcttagagtaggggtgaagggtgtcaaagtgggagtgaagaaaatggttcttaaaactctagtttgtgtccagaaaaccctgattgaattggtgagattagaaaggaacacatgaatcaggatgcagagtctaaaacctaagagataccaatataaaaagatttcattttctgctctccacgatgaagtgaaaaatggacttcattccaaggtgaatctcctgataaagtgacctttcaagactccctttgactgatatttaaaatatcatcaaaggttacaaaaccctggagtcatcacagggctcttgcctcagcttctctacgaaaaccactaacagatgttagaagagaaatggatgtttcataggaagaaatctttggctcatggtgtttagactccacgggtagtactctgtagtaatagttctgctgaattttccgttaccagaaaaagtgtgtttaagcacaatcattctgggttctccaaactctgaaatgcacttaatccaaaatgaatgcagataattacttcttacaactctcctaatccacctcatagaacatttaaccaatagcactctctacccaagatatgacttttgtgaattgcttactactaatgagcagatagagagctattgcatcattgctaatttggccctgaatttgtatatcaagggttggtgaacaactcaggctgaatttgaacaagtaacaatacttgaaaaaataccataactcatctttccaatccccatgcccacacacttaaatttatagttcacgaaacaaagacctaatgttgtattttggttccatagctgtgtctcctcacaacactttcattttatgtaaagtagtgtttcccattaaataaagcaattaagaatcattcagcagtgaaggaaatagcacataagttgttttgcttaggtactaaataaatgatgaaggaatatgttgaaagatgaaacagccatgtctgttttactgcatttcacatgagacatggataattgttttacaaactttgttgtattatttttcaaacacagcttttttccttttataagtttatatcaaatattcagactattttccacaggcacacactaagatccaaatacccataatacacagggaaactccaggtcttaaagaacgtgcctttcagtcatggagtttagttcctaaaacaataaagcacttcttattgtgaacttaatgaatttttgttattagttcttataatgttttattgtactaagaaaattgatacattaatgaatactataattacgtgagtctcatacagttacttttgtagtcactgtaaggaagatggtaaaataattaaattgctattgattaattggaaaagggttgaatgtgattcccaggccttgtttcattaatcatgctataaatttaaattgtaaaataaaagaaatcccaaatgaactgctcattatagaatagtatgtgtatgaattcaggaaaaacacaagatatccatagaatttgggagaggtattcagtattttgtgtagtagcaaactggatgtttagcctaattttttttttttttttctggtatgatctgggattagggcatgtctactagctattacgcagtgattcagacaaacagcatactatagaaactcaaaagatcggttttcgtaactctctgcttgcagatagttgagtaactaaagcctcaagaaagagggttgtggccaggcatagtggttcatgcctgtaatcccagcacttttgggaggccaaggtaggcagatcacatgaggtcaggagttcaagacagcctggccaacatggcaaaaccccggtctctactaaaaatacaaacattagctgggtgtagtggcgcacgcctgtaatcacagttacttgggaggctgaggtaggagaatcacctgaacccaagaggcgggggttgctgtgggccgagattgcgccactgctctccagcctgggagacagagcgagactccatcttgggggggaagaaaggaaaagagggttgcaaccatttgtacaattaaaaacagttataatttagcatttgtttttttcctctgtaggatgaacagatctctactccttgaattgttccctgcattataccattatgtaactcatccctgatgtagtggggacattctggctggggaggtccttcatttttcttaggtcctttgtcattttcaggagtagtcctacagtcctttctgtattttcttgattgttaagatgcctaaatggtagctcccacttcctcgcaaatatactaaccaaagttgaattccacatttcaaattccagtacatatacatattaactattttttgccaagctctagaaattgctttgatgaaattatgcaattttcgctattattgttgttgaagtctacaaattatttatgtataaaacgatttttagataaacaactctctaacaaagcattttaatctttgttggattttttttttttttttgatggagttttgctctgtcttccaggctagagtgcagtggcacaatctcggctcactgcaacctccgcctcctgggttcaagtgattctcctggctcagcctccagagtagctgggattacaggtgcccgccaccacgcccagctactttttgtattttcagtagagacagggtttcgccatgttggcgaggctggtcttgaactcctgacctcaggtgagccgccctccttggcctctcaaagtgctgggattacaggtatgagccacagagcctggcctttgttggaatatttttaaaagattaaacttaaagctcaatgccttaaacagttggcacagagaactccaatgaagagttattttgaggtttgctagatttgacctcagctccccttcagctataataaagtctatggaactgaaaatccacctcatctagttttatttgcaattgtagaactctgctgcttcattcaattcctttgccaacaatctcctgaatttcacctcacaacaccatctcctcttacacacatattcctttctcacttatatttatatgttccccagctaagcccaattaaaatgcaataagcattggaatgaaacttcatttactaacctaatgtctaccaagagatattaagcatcacaggataagtatggtacaaatgttttatattgatatttttctaatgttaagtaattataaaacattactttgtattaaaatgaacaaggataccttatggaggaaaatgcaacatttgcataatttttaagataaaacaagagacttcaaagaaatttcttgaaggagatatttaccattcttggcccaggagaaaacttagtggaaaagtttgattagtattaggctttctgtgttatcccaggagcttttcttttcaaacaacatacactaacaatttaaatccattcatcatacactcaaagaattcagcgtaagaaaagacatgtacggtagtccaaactagcctttatctacagaggaagaaatggagaccctgaaaacctgagtgatgttttttaaccaagatcacacaactacataccatcagtaacaatatgagggctcggaaccttgagtcaaattcctattctgtcaactacaccagaatgcttcaaggaaatgcttgctcttcttagttttttttattcagaaatctgtacacagaaggaatagttaccagaatgatcagttatgacatcaccactgacagtcctctaccagaacctggcttcaagatcctttatgaatggaatttgaactgacaaatactttgtaaattctactgagagtgcctcagtttctgaaggccaaatggtctaattataagacaatttcacatataaagatttcactatatagcccaggaatataatattaatgatgaggtcaattttattactcttttaaaggataaataaatggcaagaaacattcttcattccaaggcaatatgccctttgtcctcctggaggctgactcttgttctggctttcctagggtgcatccttatttgataaggggcaaccccacctcagagtgacaagtgtcagaatcacctaaagcactgttgtttcttcccaattgccaagattgtctccatgttctttatcaccgttttgttcagcatttctctagcaaattctgcctgtgttaaccagaattgaattctccataaatctccttctttactgctctgctattgtatgaaaaaataggagaaactaaaatgtagcaaacttctctaggacttgggttttctaatattatagcttaatggttgatctgaaactgggtcaaaccacatgaactcttctaaaagaaccgttttcagggagttccatggtcaacttgtgtctggttctgcttttctgacttttaacggtggttttgaaatgtccctcagcctttacttctgtttatccttcactagactatgaagggtatcagggcagtgttagttacttttatgttttcagtgtataacacagtgcaggtcatgaacgcatatttttgttggaaggaagggaagaaaaaaggaacagaggaaaggaaagagggaagaagcaaattaatttactggatttcacaggcttaaaatcaaaacagttctgaagtcaaattacctgtattaaaattctatttgccatttactaactatgtaatctaaggaaaaatcattttaccccactgaccattaattttctcaactagaaaattgagatatatttgtaacaactcaaaaaggctgttatgaggattaaatgaggtaacacatataaaggttttagcatgtcctatgcactattctatatagggctaaccataaacagaactatatattatttagcttttattatcttgaaggaatgtcatgaaaccatttaagaatctgatagaaattgatcatctcctcaaatcatttcatggcttcaacaaactcttcaaacctattcatgtacttcatattaagaaccactcacgaagactagtcacattttttcccagatacagatcattataaatttgtgaagtgaaagcttcttactttgtagggaccaataatattttcaataaaagagtatacaatatagaatatactttgcatctgaaatttagtaaataaaggtaaacattttgtgaaaaatttcctccaaatgtgtgtgtgcatgcctttgtgagtgtgccttgtgtgtgtgttaggttataatgtagtttgcatttatcaggatgggtgacaattcagcatccttcagaccttaaggcataatcatcttagccctttctgttcttagttacattcagttttcttccttctctgccctctgtgttctcagttccaccctgtttccttgatttctgagacatttgagcacaacagacacattagcacaaacaactgatcattggggtcacagtcatttacaaaatggattaactaacccaagtggccacattaatcattgtgtattaaccccatcagtagcataaatgtcacattcagaagacaagatgtatgcatccaaatttctaggtgtgccgcatgggtaatttatattccagagtttcttaggctatcacctgggaacattttgtatgtgaaacagagatagcaaggtgctcctagtcatcacattcctctggatgacattcaaaataccagttgtatgccaggctttgtgtgacagcatgatgtcttagagtgaaattataatgaatatatttcccagatttttgtaatgaaaccggtttaaaccaatctactccatgaacagacacttctcaaaagaagacatacacacagccagcaagcatacgaaaaagatgctcaacatcactaatcattagagaaatgcaaatcaaaaccacagtgagattctatttcacaccagtcagaagggctattactaaagtcaaaaaataacagatgttggagaggttgcagagtaacaggaatgcttatacactgctggtgggaatgtaaattagttcagtcactgtggaaagcagttctctttggagatttctcaaagagcttgaaacagaactaccattcgatccagcaatccagttactgggtgtatacccaaaggaatataagtcatcctaccaaaatgacacatgcacccatatgttcattgcagtgttattcacaacagcaaacacatggaatcaacccaggtgctcatcaacagtggactggataaagaaaatatggtacatgtacaccatggaatactatgcagctatttaaaaaatcatattatgcagctatttaaaaaatcatgccctttgcagcaacgtggatgcagctggaggccattatcctaagcaaattaatgcaagaagagaaaactaccgcatgttctcacttataagtgggagctaaacactgagtacacgtaaatacaaagatgggaacaacaaacaccagagcctactcaaacagtgagagtaggaagagaatgagggtcgaaaagctacctattgagtactatgccgaatacctgggctatgaaattatttgtacaccaaaccccagtgacacgatttactagtgtaaaaaacctgcgcatgtaccccctgaaccaaaaataaaagttgaaataaaagaaataaaataaataagccaatgtactttcttaacatgaaaccagaatccaaataagtgaaatgagtcaagtgcctttcctataaaacataattacacacctgtatacaaaaatattttctatttgtattttagatatcaaagactgtgttcccaagagtctaaaatgcctgtagataatgtgaatactaaattctttattccaatgatcattaatgtatttgtcttcatcctaaaataatgtctcttcaaaaagaatagtttcacactgagtctctaaactgagttacaactgcactaactttacggtgcctctttataaatgtcttacatcttatagatgttttccaattgttaatataattaacactcttttttttttaaagacagccattgtttcacaaagaaaatacatacaattattttagaaaagtgcaggctttgtattgtcttcctgctcgtgtgtattttctctatcatattagtgattaatttacacggaactgttaaaggatttttcagttattgtttaatttagggtaaactaattttattcagcaacactttgcaatatttcaggctagacaaatcaatttaaaaacatataaacaaagtatgtcattgtgatattcagtgtactaagagatttttaaatttttttcaatttttatttttattttttttagagatgaggtcttactgtgttgcacaggctagatttgaactcctgggctcaaacaatccaccccagcctcctgagtagctgggaacacagacatgcatcaccaggtccggctattcatattagacattttagaaaacttgcctaagtaattctagaagttgcaaatcattatttatttactttctctcccaaggaatgtttggaaatatttgagactctgtactacataagtagacttatcttaaatgtttgttgaatgactgaatgaagaatgaaaattattaacatggctgggcacggtggctcatacctgtaattccaggactttgggaggccaaggcaggtggatcacttgtgcttaagttagataccagcctgggaaacatggcaaaactccatctctacaaaaaatacaaaaattagcgggacatggtagcatgcatctgtagtcctagctactcaggaaactgagccagggaggcagaggctgcagtgagccgagattgtgccactgcactccagtctgggcaacagagccagaccctgttgaaaagaagaaaaaagaaattattaacatgttagaaaacaaaaaatgcaactaagctttttactctaacagtaactggcctatcaactaagatgaatagatcttccatgagggtcaactttttaataagctttgaaacacaaatgttcaacatttttaattctatttatgctacttcagtaggtaaaaggaaacagttcactgttcatgcagacacttaagacactagaaaatcaaccactgaggtaatgaatagtgttttgtgcatgcaaacttagaaaatataatttacaggcataaaataaaatttgtaacaatggcaacggaaatgaaacaaccagaatatagtcacatgatatggttccttaaagcgcattagcccaacagcaaggaagccttaattttatttttatattgtcataattattcttggcttatgatcttttgaaaattgaatatctaattataaacttctaaaacaaaaatacaaaagcaagatttgtatcatccctagtcacgatggtatgtggaaaagaagaggctgaatagaatatgttttgcaaataagctactcaagtggttgctttattcaccaagctaatatgtacgctgtatttaaaattaatattttctgtccaattacatgaaataattgtttataatacctcaaatgatgagatgcttaagaataattttgtaagtacaaaaataagtccactaattatgaaaagtaaataacctcaagtaatatttaaaacttgctataatgagttttttatttaaatgctaccattcattctctcatatgaaaaattgacagaattccaactgcaaaaaaaaaaaactcttacttttaagagcactcagacactttcattcatttacaatccataacttccagttcaagaatctaatttggagttcagagtaaatgttgaaggtgggaaccatgtttatcttgttcactgctatatctttagtaggagttcagttaatatattatgagtaactgaagaaacaaaactaaatcaaaaaaataaataaatatggtaaaagcatttgtggttttcatacagaagaacaaaacttcctaccaggcattttccaaccaaaatatcctgatacaaaaggctaaatttcttggggacactgagtaaatttgtaatcaacttattgtccaggaatttagaaaatgattttaagaattaagctaattctctccattgataagaagaggaagaattgacatgctaagtcataatttcttgatccaaataagtgtgatgatactaggcaagtaaagaccatggtatacaaaggtctggatcctgggcaaaccccaactcatttcaaaatttcaactttgtatatgctacttgaataggtaaaaggaaacagcttactgttcatgcaggaactcaagacactggaaaaccagccactggtgtaataaatagtgttatgtgcacccaaacttagaaaatataatttaaaggcataaaataaaatttctaacaatggcaatggaaactaaacaaccagaatatagtcacatgatatggttccttaaagaagaaccatatgggtcgggcatggtggctcacacttgtaatcccagcactttgagaggctgaggcgagtggatcacgagtttaggagttcgagaccagcctgaccaacagggtgaaaccccatctctactaaaaatacaaaaattagccaggcatggtgacacgcacctgtggtcccagctactcaggaggctgaggcaggagaatcacttgaacccaggaggcggaggttgcagtgagccgagatcacgccactgcactccatccagcctgggcgacagagcaagactccgtctcaaaaaaaaaaaaaaaaaaaaaaaaaaaagaaccatatggtatcctgtcacctgggttctctctcctattcttattctcccagtccacttcatagccttttatctgtgcttctttaaacacattgaaggatggggtgccaatttttgcactgtgcccatggtgatatatctccctgtagcatttaacccaagaacccccaaatacaggtcgatacactctgaagcctttgataaatatttgagttatcatgggagcaaaattaaacaatactgacagtgaagtaagcttttaattttttaaaaaaatttaagatctactgattattacaaaatgtttttaaataacctagtcatgatattaaatatctgattttttaaataaaaaatgaagtaggtaaactttgctgtcaccaagtacaaataattcaaaacatgtagacagttggtaatagaaaaacacattctgaggctcagtaacaagaagaggaaacattgcgcgtgtgagaagaaaacaagattaaaggagcaaatttcagtctccatttacaactgtcattgactgatgaaggcagaaagtctaggagtagtatgaataggccccattcctcttttattcatcttcctgaaagcacccaggtacccctgataggtctgtgaagaatggcattcaactatataaaaaagaaggtttttttgttgttgttgttttggtttttttttaatgaaactagccttgtttctcaaagactcttttcttttttctttaattcactagaatctgaccaagttatgtttgaaagtcttacaatatactctatatattgtacgtgattatatggaaaaggagaatgtcacttatcccaaaataaatagtcctctacttaggcaaatggtttattacgatgttatgcgggattttaatcaagttagagctgatgtgtctgagtttgttttaaaagaactcaacatatgttaagccactctacaagaagggtttaattattaaggcatcaacttcaaagttcagagatgcatgaagactaatgtatttggattcataggattcacttttacgagagggagcctactgctgtttcagaatagatatgacaggttttccatcagaccggtgaatgggagtttttatccaaagattttttgcctaagattattaggtaatgaaattaattaattaaccatgcgaaattgttatatatatatatacagtctcataatttctgttaataagtaaacaaacaaataaataaatatataaaatataccgcaactccacataatattcaaggagttatagcagaatcatggaaccattaagctaacgtcattaccatcttctctcaggctttaaagtaacacttccttttccttacacacacacacacacacacacacactctctctctctctctctctctctctcacacacacacacacacacacaaacacatgcacatgcaaacattttatacccccttccttttcctgtatacatctgtggctaaaccaagccactatatgccctttactatcaaacttgaaaaaaattctcctctggggaattgttaattttcagatatcaatgaaatatttatttagtgacttcaatccatttcgtaggagaatcaaagaaacataaagtagacttaaagatttaaaaggttttgcactcaaatttaggagacattttacatgttcaatggaaatgtaatatattaatagtaatataatagacaagtttggacaaaaagaatgtcaaaaagtttaaacaaaggtaatagacatgggtttaaaacctgacccagaagatactggttggctagtgtttaacttttggtattctatttttctggtatgcaaaatgcagatactagttactgtataccatggtcactgccaagattggaaacaagtcatgataaatgcctaacattggaccaaatataggcatttgaatcagaaaataagcgtgtattattattaatggtatttcatggcattaatagttcaatcatgtttggttgtgatctgccctcccttcaccatcccctatcccctacaactttgtttatacttctcttatgacgcttacattcagtctgctgtgattattaaacactgtgctattggtgagctgtatgaaggcaagtgttatgatttgcttgtgtttgtatcctccaaagcagagcttttccaacttcatacctagggatcttgctaccataagatttgattttggcttagcagtataggtgaggttctgagactgtgcattttcaacaatgctcctggttcctctaaccaaactttgagtattaaagttctatagcacttagcacaatgccttacatttgagagatagtcaataatatttatttgattaaaaatataacattaaacacattatttaaattgtaaaatggatgatagaaacaataatttttaaaatatgttcagagggaggaggtatagaaagcattgtggtataagaatttaaccaggtcctgaagaattacaaaaatgtgaatggctgaagtggagggaaagcaattctagatgtgtagaagaatttgagccaaactgtggatggagcaaagtacaaggaatgttcagggcttaatacagccagtgtgactaaatcataagatttagattagataaaaaataattagaaaatgttagttgatgcaaatattgtctgacaagcaatgcacaaagacaaagtttttaagcagagtctgtgaagtaaccgttttgttttaggaaagttattctgtataaaattgtcaatggcaaagaaaaaaatgaaagatgtatggttcaaaaaggtcttaactatacttctaactgtatattcaattaagcttccaggatttaaatttaacaccagtgtaaagcatccttacacatccctccgtttgttatgttaaatcgcattctaactaagactgaaaacaagtaatcaggagtatcagtatatttccctctcgagataaatttgctcatggatttttctactaaaagtacacattaatatggtgcagctttcctggatttagccatctccagacttttcagatctccagcaaatttatttattgcattatatcggaagagagatatttagcacatattgtcattatttttgtatccaataatattgcaattagacagaaacacatgaaattattaaaaacccatggtgggctgggcatggtggctcaaacttataatctcagcatttgagggaccaaggcaggtggatcctttgagcccaggagttcaagaccagcctggacaacataataagaccttgtctcaagaaaaaaattcaaaaattagcctagcatggtggcccacgcctgtggtcccagctaatttggcggctgaggtgggaggatcacttgacccaaggaggacaaggttgcagtgagctgtgatggcaccactgcactccagtctgagtgataaactgagaccctgtctcaaaaaaaaaaaaaatggtggtgggagggataaaaaataagtcaatcaagtatcttccatagtagataaaaatgtgaaaaacagaaatgacattttctcataatacattcaatggtagagcaagcaagcagtcattgcaaagcagttttgattatattgtaaaagaattgacataaattttgattataaatttatgaagttcacagctgagaaaaatcactcactaatgtatatctcaaagtatctaattgcaattttgcctattatgtgattcattgccgaagggaaactagaatgagacttggcccatactctgtagtattaacatctgactatagtatatagctgccataaaattaaccgaggagtaggcctcataagtgatgtctaagattaagtgatttagtgtattgcatcacttagatccgatgaagtagagtaactaattggcagaggaaaaaaatctaaaaacatagtaaaatagcaaagcaaggcaactgccattaacagaaaaatgtaatggtctcattaaagacattgcatgcagtctccattccaattttcacaactctggatttttctctaagctttgcaaaaatattatctactatcatataattttaactttaattcaaatgcaaaataatgtattttagaacttcattattggtttcatacatatgttgcggtgttttatgtacaatgtcaatcatttcaattgatttcttgcccctacttttaaaatctgagatagagtaattcatttagttaaaacagaaaagtcctaaggtccattaactcatactatatatttgggagttattacttgtggaattttacttgtggaaaactcagtagaaatcatggagaaattcaaaagaatattaaaataaggtacatacataaatgtatctaagctttttgaattgtgaaatctgactgaaaaatttatgggataactttcttatgagaaggttgaagaaatcttggatatgtcagacaaaaagaacaataataagaaacttgaaaacctttgaattcagtggtgatataggttttatagtttactatcattgattaaaataaatccttgataaaaaattttgtcctaactttgaaaattggaaaagtgaaaatttaaagtaccttcataaaattacttgggaagaacataattttaaatatgtaagcaaggacaatagtgcactttaaattttggaacattttacaatccaaacaagaacccattttcaattattctaagaacatttatacttattacagtttttgttttaaatttaagattactattaagaatgtgtggtctgcattaatattcgatcatgtacttttcttgaattttcttttttattgcttcataaatacatagtttgtaaatttgcctggtccatttttgtttctacataaaaaaccagattgtaagaagagtaagttaatgttctagatataaaataaaagtatttattcaaaacctacatcatatttaagcattccagtggggaagacatacaagagtagcatggcctcttcttttaaatatcatatgctcactttagatgtagcaatgattcataaaagtatgtccattatcattttgtattttcgagtatgtatttctaatgaaaagtgggataaaagggtgatcataattagttggtactcaccaaaatgattcctgagattaatgagtttggtaacaaggtcatggatgtgtggctgtagtataagtgtcatagtcaatcaacactatttaagtccaacaatagcaaagaaaaatgacacatctctagatcagtctataattgatggcactaatctcttctggaatattggaattaatttcaaaataaatgttacagtagtctgcattgcacattaagatgtatagattcaatatgcaaatctgattcactgcatgaccttgggcaaagtattgcctttctctttgtaagattttcttcctatttttaaaaattagattatagtttcttccctataccattcataatgttctttgaaagaccaaatgaagcccatggcaaatatactttgaaaagcataatatgctaaagaaatgtctcactccaaaaaagtccctaaagaaatcctcgggcctgttttctcatgatccctaagttcctttccattgctgcgatgtacactacactgtcttggtctctttgaaattctctgtgatttttatctacagttggttaagatccagtcccatttgtgcacagtatggtgtccatcatacaccaagaggctattgtatttcaatgttacttcaaagaagtacttagcacagcagaaacctggatgcaactggaaattaagttcaccatttccacaaacccttattaagcatctgtcacgtgtccagcattgtgctcgtcgtgagaatacagagaaggacagctctgccttgtggaatttttttatgtagaagaagagaaaggcaaataaacatatattaatattctactttcaatataattatttttaaaatgaatatgagaataaacatatgagaaatgttattctttgctaaaaggaataaacatataaggagtgtttattccttttatcaatagctatgtgatttaatttattatcatccagttcatgaaaagaagtttcaattaataatatgattccattcaaagtattgatttatatcaaattttccaataatttcctattttggaaagtaaagttcctattaaatgttacctactatagtttatttcagtcctttaaaaattactctttaattcatttgtctatgtccttctagcagtcacatatataagcttcctgatgagctagccttttctattgaattaaaatgacatgttttggtctatactacagtttaaggcaggaggagtaaagcagtggcccaaatagtctaatcaatatttcatgcttatagaattgtatatagcagttataataaagtatctataaactaaataaattatataattatgtaattttaggtgaatttataatacatagaacacatatatggattatatataatattaaaaccatctattaatgtattataaagaggagaaaaaaatccatttatttgcatacatataatatttgctgttaccatcaccttggctgggcgggccttaaggagtctaatattaaggcatcaattaatctacaataattagtaattttttaaatgtttaaatactttgttagaccaggaaatttgacatttaaaaaaaatgcacatgttggttccaagaatcttcagctctaaggaaatataatagcttttttgtttttaatctaagaaacactgatagcaatgaatgttcaaagatatagagaagagaaccagattttaagatgccaattgcattataaaaaataagcgaacactcaaataacttaggcagattctgattcagtctcctctcgtgagttgaggacagtaagcagaaagccaaaggtgcaaaaatctaaactataaaccaaattcatgctattttctgagcagccaggtcacttttggggtgaaacctcagtactcttagttactgtaacaaaaacacaaagtgagcaaatcagtgtttcacagtccagggatcaagggaatatgtacattgccaggcactgaggcaaagttagctgcaacactgccaaccaaatataactgtcctcacaggaaatcccctctgaggtaatcctaatttttcaatgattgcttctccatgtgaataagtcaagatttgagaggaggttcaatatgtaatcgaatgaactaagaatgctgtttctcttggcacatatctgtcataaataagaatacactaatgaaatcagagctaactatgtccctagggtagaaagttctttcccttatgtgcctaggaattctagaggctattgaaggatcctattccttaagcccaagtgcccagttccagccaccgcataaatggatagcaccccaggaaacttctataattaaatccatatttaccacattctccacaccatcccttcatgcagcttttctgaattaattcaataaatttttattgtgttcttactttgtgccaggcactgttttatctgtcgatgaaaccacagtgaaaaggcaaggttagagaactcggacttacattctagtcagggaataaagacaatacataaatgatgagtgatatgagtaatgctattaagaaaaatgtacgaggtaaggggtttacggaagaacgctctgataagatagatgtcatttcatgaatggcttaagggaactaaaagaaagaaccatgcacaaaactgtgggatgaattttttcaaagcaggagaaacaagttgaagggccctgaagcgagaaactgctcagcgtatatgagtattagaaagaaggggccgggcacagtggctcacgcctgtaatcccaccactttgggaggccgaggcaggcggatcacgaggtcaggagattgagactatgcttggtaactcggtgaaaccccgtctctactaaaatacaaaaaattagccgggcgtggtggctgacgcctgtagtcccagctactcaagaggctgaggcaggagaatggcgtgaacccgggaggcggagtttgcagtgagccgagatggtgccactgcactccatcctgggcgacagagcgagactccgtctcgggggtggggtggaaaaaaaaagaaaggatgcaaaacaaatgacacagacgttgtaagccatgcgaggaactgttgattttattttaagtgaggtggaaattaactaatcagacatattagaaatgaattgctcttcctattgaacgatggggtcaaggtggacgctgcaagttagatagcaggctgttgcagtagttcaagtgtgagcagtattggctgacattggtaatgcagttggaatggttagacttgaccaaattctggatatatttggaggctactggatgggctttggtgtgtgtgagagggtgaggaataagggatgcttttaaagtttttagtcgggacaactagaaaaatggaactatattggaacaaataagtggaaattaagggtctggttttgaatatatagagtttgaggtgtggttttagcatctaaatgaaaatggtaagtaagctgttggctatactagcctggagttcagggaagaaattgaggctggagttattaaccggggagtcaatggtgtagatatcgtaattaaaggcctagcagtgagcacaccaaaggaaagaagtcccagggctgacatttagggaagataaataagatggccaaacagccttggcaattctctcactaaggaataaggtctcaaaagacagtgtagataagtagttagcaagtcggtttcatattaatgcaccagacacaaacagtagtgacctcagtacactgaggcaatcactctttggtgagtaaaaattcattaaaattttggaattgaccgaggcactatagtatcctaaagaaagaaatgtgaggcagaatccatagacagtgatttgaaaagttaaagttgctgttgcatttcttcaatgtgaaaaaaagcctccttttttcccccaaactatttaaaattttagatgtcaatttccattgctttggttatgaaatatccagctatgttcaaccaggtccattccttcaggtatatatggtacagaaactgttataccaaaatgttcggattttttatatttcataacagcttattattaattttaaataaaggaattgtggggaaaacatagttaatacaaatatctataatctataatctataaatatctataaaatactagtaaagctccttcttattgcctatatcattagggaattcccagaccattaaaagaatgacagaattgtgatatctcgcttaaaaggtattgagtcatgcttttcacaatttggctttctaagataagtcacatgagttttaaaacatctaagttgaagttttgcattttcatttgtttttatgttaatgtgaaaattattcttgccagaagcagactacaacagtattttaaagaagaaattgaaattaggtatatgtgcctgttaatgttatgagaatcgcactaactgcatctgctaaataagtctgtaaattagaaaatctttggtttagtgattacatcagccttaaggagctgcagtttaaaagagattaaatgtgtttctaacaactgctttcaaaactgttgatagcaaaggaaatgaacacctactatcttaagaaatgtctgaaaattttatcaaggtaatcttttgattttcttgcattcacgtggcattaaattgaatgtaaggtcttataaaataatactgttgcaagtataaatagtattcttatcatctttatctattgagtcattatcaatccaaatatttttctgagatgccattgtacttgtcataaaaaatatgaactatattcataaaaaatgaatatagtgtatgaagtaggccagtattcagatagtcaatttcaatttgaggctcagtgattttaataatcaaagctagtatctaatgttattaaaaataataagtttaaaaaataaaattgtagggactcattactttgtgaaggcttaagataatgcaaatgcgaaagatcacattaaaaatccaagcttttgtatgagcatttttcacttcctaggaggataaacagagaaatcaacattgggattttcctctggcaagatataaaattgcatattctacttgatggaatgctttctaaaacagcatatttaactattttataaagttgcatttctggatgatatacagaaaggaacaactgtcatttgaactgcatatttcatcgcatagattggcttttatatctgtaaatagaaaatgtggacaagtaattttatatgtacataatttattttatcagcttatgataagagcatcaagtacaaatagttcattgttttcaatttaacgtagaaatggggattgcatattcttcattatacaaatgtacagactccattttgaaagtttcttactaaggaataacagagaatgattaaaatgatagataccctatgtggtaagcattgtcctcattgtattaatgtattcagtatgttgtggcttcacagtgaaatcatcagcctagtgtctcaattcatgatgtcaggactcccaacccgattttaggttcttgtcattactctaataccccaatttcctgggaagataaatggatttctatatatttttgtaacctctctgagacatagcatggtttctatgtgattagagaagagcaatgccagtaaattatattcataatgcagcatctgctattaaagtcttttaattttctatttaaaaaaagatggtacagaatatctcataattctacaatttgctgtcattagtatgtaatttcagcagcatatatgcacacgtgctgaacagcgagaaacaagggcataatttcagaaaataaatacttctgtcttgcacttgtaaacaccttgcatctgagaaattgaaagtagtttaacgaaatgaattttcaaagccagagacaacaatctgtaaattacagttactactttttttagagaggtgaagtacacaatgtagagagtaagaaaatggctctctctggagttatttggggaatgaaaagtacatactgaaagtatcttttactactgatatatgatagtctttccattttataacaagattttttaaaacttatacttggacaaaatctcctacaccatgtctgtttgtttaattttactaaaaaataataagcatgatttatttgttgttctctatgtaatggacactatacataaattatcccactaaatcctcacagcaccatgagttgttttactgttttaacagatgaggaaatgggcatggggaggttaggtacttgccccagatcgcacagtgaaaagctggagttaaaatcttgctctgttaccttcagaggtagcttttgagcttagaaggattccatgctagacaagccaacatctacctcattggtggtctagagtctgtttgcaaagaaacatgagtaatctcccaatactggccagaattctctctcattaagttaaggtgaatctccaatcttggcataaggagaggctttaaaacctgcaacaattctcagaaataattccacagttaacacatttacaggcttgatcaaccattgttaatcacacacgtaaagccctgaattatcgccatttcaaatattgagagaaatgtctcatttacttcttggaggaagtaagaatcaagaggagatagggcagaagatatcattcttttttttgagactaagtcaatttgtcccctactgcttttgtaaccaattgctcttttattaggactgcttaaaggagaacaatgccacttgttgtaaaatttctgtttaagcaaagttggcaggtaggcccaaagagattagttcattttgagaagctctttaccaatggagagaaaaaacacatttcaagaatggactgcaatactgagacacaacctgaatccaatgtatttgtaaatatggaaaccaactgtaaggccagcatttagtggatggccaagaaaaagcaataaacgtttgaaagaaaaagacatgacatattactttgacaataaaatacaacccgtgctgaaccatccaaatcataatgaaagccaaatttaatcacatatttatcaagattatcttatataactctccccccaaaacctgtggttgttaatattccccattttacagatgaggaaactgggattaagaaagtttggtgactttatcaaaactatttgcaaactgtgggcccaagattagaacacagagaattcaaatccgtagcccacgttctcaaccatttcgctactctgaatttatcatatattatataaatgagaaaacttactaataactcatgacttcttacaatatggcaacttttgcactatggttaagcaaatttataagcctgaaagagagccaggatcttatgttgtttagagaatatatacaattttaagttgggtagtatagcaaggattttaaattgcagcatttggcaaatattttaaagctctttgagtataatggaaaacaaattttgtcaaacatatagaagatatggtcataaagatagagtcaaaagttctaatcactagctaatgtcaccatgatctaacaggcatttatagaatcttttttcattttagacagtgtgatattgatcaaatcaataaagtataaaatttggagccatatattctaggctcacatttcaacccgaggcaagaaacttgcttcaactctttgagccttagctgcttgaggatgttcaacaagcaaaaaatatgtattgaacaataatacttattacaatgccttccgacaccaatattttatttatacttttatttgagaaaatattaataaaaattttacataatgattgggtagtattatttcacaatactagggaggcttaccaactgcttacttgtcatccctacttgaatgtctcaaacatattttatgctaaatacaaccaccacttaactactccattcaacatgtttcctagcacaggaactggtaccgccatacactcgatactcaatcgagaaccctgggtgtaatacttgtgacctccctcaactcacttgccgtgccctgttcaccccaaacctgttgcatgtgccctagttattgacatacctactatcaccttcatttctcacccaatgcttgtaaaaacttttaagcaacctttcatgttttttcttgaccatctcctttctatcctccactgcacagccaaagtgaaattttaaaattacaaaagtaaccatgttattcttctttctaaaaccctctagtagtattccactggtcttagggtaaagtccaaagtcctgatgaggctcccaagactcttcctcaccttgcagggtaggggtcttcccctcacctcacaggccattctcacctgtggctgctccccagcgttgctgtctagatgtcagcaattcccaaggttctgcctcacaccacctcttcctcacatctcagctacatcatgctgttcccctgtcctgggatattctgtcttcccttggttgatttctatcgatcttcaaaatctactagttgacatcattttcttagcaagtccttttccagtccattgaactagggtagattcttctgctagtaaataacttttacttttacttttcttctgaaaatagtcatgacacttacatttcttactttatgagcttgtctctcttgttcacagctctagctctggtgcccattgtggttcctgatatgtagcaggtcatccataaatatattgatatttcaaaaactgatgtagcagataagtgaagaatgaaataacaatactaagcattcagttgtctgggataggaatcaatatatttcatcttgggaactattgagaggactgcaacattggctgtgggtgccactccaacttgtcaactatgttggaatttcatgtaaatattcagtgcagtgacagtaccacatttccttctatctttagatgcaataagaatattgtaagaactacacaaatttggtagatataagagaataaatgagattgttaaaatgtaaaagattgaaagtacaacaaagatcatgtaatcaggtgagtgtttattacttccttcggagtagatactctgaaacacatatgtatcctaaggaatgtttccatcttttatgatacttgagaatttttctttttaagttttattaagggcaataaaaactttctttggaatgtctccagtgattacgaatatttgatctttaagaacatctttgaatttttaaaccatccaaatttaagaactacatgatgtagataattgccaggataaaatgttatctttgactttgaaaataaaagtagaaaagtaatgaaattgaatttggaggatgagtcttaaagtctccaagaacaattcttaaatgatttcaaaacatttaaaacaatggaataggaagatttcaaatgatgaatattcatttgtttgcctggggctagggatatttatataaaaatctgaactatgggccctaaagctaagtgctgaaacgcaactgtggccttcctgctccagaaattactatcttctgtccaagtaaagtggttcctgtacctccctctgattccacagctattctgtagattgatgggtttatttatttgcttatttatttatttccttattcatttattatagttaacatatatattgtgatcaaaacttatgtgttagagaagggacatataatgatgacctaaaaaaactcagtttgtggggtgggtatcagggcaaaattcacgattataagcacagacagcagaggtgatggtgtgtaagggtgttatggaggtttacttaaaggaagaacttgagctagttgcaaaattcccattactattatgataagtgctcttcctcattatgaaatatttatgtttgcactaaagagtctagagcatgtttccttgtattttaataatgcttcatgggctatgtttgctgtggatgctattattttttgcataattaagtaatgaagcaattagcacagcaggcacatgtcaactagatagtggttaaaatttgtgattaactagaattttttgccgtgcttgccaatattcctcttattaccaagtgaagctgtacttttctcactatgaagagattgggttcccacatatttgctttgcctatataagtggatgaatcttagcaaaaatatctcgatgtgaaagtatgcactgaagagctgtctgtaaagatctgtgaaataaatgactaagaaagaacattaattaggtcaaacaaaaatattaaggaataagcattttgcagattgcctaaattggcagttttctcctctacaatctaccaagtgatattatagctcttcaactgttttacagtatgcctatataccctctgacaaatggacagatactttaaggttaggaacttgcataactatgaatggggaaactgacccttataaattcagactttgtggctccattatgtagacaaactgggaagaaaaggtaattcatccaggctcaaggtccacgtgtaattttattcaacaggcatacattgtgtacctgctctgtgccagcactttgccctatactctgagccaaagatgagtaagaagtgatgttccaaaacacatagtaagtgccaaaaaaagtttgctaaattttgacaagtcttcagaattttcaaattgagtcttcataatctggaatctaggaatattttttcaagatttctgaaggagagtaaaattaaataagaaactggtgagaacaaaaagtccaggcattaagtctaaggattaagtccctcctttgcttcttacttgctagataaatccaaaacttctttgaattcaaaatatgtggataattcctgtcctgccaagatgtaggaatttaaccagacttaaaatagataatggattttaaaatattattcaaatttttctttaaagaagttttatttttaagccattgcaaggcaattgttcacttaaagagcaagaaataactcagtgtaattctttcattgacaccaacaatactatacaaaccaaaaagatttcatttctatccatttctgatataagcattaacctaaggccacaatttctctagccattccagtgcctattctgtatgtggataagtagattaacttgatttaatcactgtttaggtgaaaaagaaatccatctatggtgaatttttattaagtcagaattggaaaatatgttcttcacatttctcaaggtgatttaacagctcaaagtgtcttaaatccatatcaatagtctggcaagtacgataaacatcatagagttctaggacctagcttgaagaacttagctcctgtgtgacttttgctgagaatctgaaaatgaagacccagcggaatccttacctcaaagctaaaataaagtataaagaaaccaacactggaagataaccattttgcaaaagtacaaacctaactgatagaggaaatggtaaagaaaaatcagaaaaaaaaattacattaaaattgtggtcttagattatattggcttaaatggaatacgagaaagtggctgcagtaaaataaaggttggagcaaaaagtttcacaagtaaatttgggattaggatcttccgcagaatttcttagacatgtgctggtaaaaaggatctttactacatgctcacgagatgtttttatatttcccattttactgcctttgcaatacccaaaacaaaataatagagttgtaaaatgtctccagcatggactctccatgattagtactccatctgagctcctactgatttagtatctgtaaggcacactgaaccagaagccaactgagggatggacaagtttgatgtcagaagtttaaaacaaactgcaaatgcacttctaaggatgtggcaaattccataataaatttactagaagactaattaggaaaaagcaaaatttcccctgccatctggggagggatttggatgctctacctaataaccagatatttgctttaccaactttcaagcttgttctctcaagggtgaaattttatgtggatcctaaaatagtgtcttggaaaaaatatgatattagccctaaggatatgtgtgattttcaatttgatgacaaatgattacctccctaagattttgagaataataagtcccatttgtagatagtgcttacatactgagtgggcctacacatctccctctctagttcaagatggaaagtcctctctggaaatcaaaagagtactttcatgcagaaagtattcagacctgcgttggggttgtatggaaatgtaaaagactattaaaagtagtaaagatgtatagattacttaaagttacacctattgttgatagaggggacttgtgggatatatgtggtgtgtgtgtatgtttgtgtggagagagagaaacttttaaaagtgaaaaccaaaattatgcaggttatcactttaccaaattcctcttcagtgatattctcctgcgagtgttttaaagtccatttttccaaaacaaatttatagaatggttttctttggtgtctcatatatactggaaagaacttcaaatgctagtgtgcacacataccttggcattactgaataaagcctgtagaatgaaatactgcaacatctttgatggcattgatttggggaagaggtctcctttttggcagtagaagatagaaaattctatcaatttttctgactttattcacacagtaaatgaaagtgaaaaagaatacctctgaaagagcacagaatcaggaggtcctcttttactatgggaacttaggaaacttctttcaatatgatacatttttatgtaacaaagaacaaagcttaagaaatagtacagctggtcttttatagtgaataaaatggtttcctccaaaagacatgaggttcacaaccatgggcctctgtcccttcattttaaaatatggtactcccagttctagcagagagcagtgcaactccaccccctgggaaaaaagctgcatgttccctttcttcccatttctgttgctcacttaacacagcatgggcacagtagttttttaatagattaatgtcaatacttgtccatcatactgaaatattaaagtcagttcaatcttaggagaaatacaagcaacctttatgctaatattgagtagcatatgagagtaaggaatttgtttaatctaacttgcccattcttaaagccgaaaagtttgtctgccttgtcgtgttacgtgtttgagccgtgtgggtaattattctgtgccagcaagtgtagtgcctggaaatgaacaaaagcttcacacaaaaggatttttctattttccgtgggtagaatttgtaccaaagccttagtgtcacgaatatcccattgtacattttctattttttttttacctaataaacttaatactgaaaaataggaggaaaggaaaaatgtttctataactctcataaatacacatatgcatcataccacttctgacacatccattctgtagacttatagatattttaaatgtatctttttaataacattgaatgctttcaaatattgattattcagcagtatttcttccttccctctgtggttttagcctatcctgtggtgtgtgttgatgaaaagtcttgtaatagattgagccttcactgaaatttattgtcctttttagatgatatatataaatatcctaaatgaaatgttggcaccaccaccaaagtactaaaatatgtcatcatttctctccagcaatttcatattttacctgtgtttgatgttaatgtgaatgttatatttgggctcaataaatatacgttaagaagaaaagtaaatgtcaataggcttcttgaaccctttcattaaatagttgtgttgcatgaaaatacatcataaacataagaggcattgtaagtcttgtttatcaacattatggagtaccgtatatttaaaggatttatatttgcatcaacgtgcatttccgtaaagaacaggctaaagttctaacacaaattcttcaaaaatgtcttagaggaggaataattttatgttagtcattttgtgaatgtggttactactaataattgtatttttaagtatcaaatgtccaaaaaaaaaagaaaatgttcagaaaagttttagtaagtttcttactttaaaaggaatatccagcatttaaaagctcaattcagtgatgtaataatgctgctaatagttcctctatttcatttcattgcattgcatggatattaagcagtgacactttgaagttttattcatcagcccactgtatctggggggcctttctcctggggtgcttctccaagcccacatagaagtccggttaaagtcagtgggagctaggtacccagacttgggtgtaagtctttcctttggtgtaggttttggtgtaagtctttcctttggcttcttgctctgtaagatactgtccagccattggagagatttcattgaagactgtgttgatgatataatttgcattttttgctatacatttctctcaggaggactatagaatgaagacgagagagagctgaggaacgctatttctacaatcaacatagactttcaaattatccagacaattaaaataaaatctgatataagtcctcaaagtttcacttaagccagctgcttagttaacccagcagatccaattacctagactctgtgtagatctggcatcagctcattcagggactgtcattttggcagcccccagctaatcctgtaatattgaactagaggagaacacatggggaaaatgcaaagagatgatctttctggaatggctattttaaaaggccctgtacccctctagtgtccctggagacaggcaggcaagaagatttccagccaagccttcccctccccggtatgattttagaaaccaaactactctgtgaccttgtgtaaatcacattgataatggatagtttctccaggttcctgcctctccttccctctgggtacctagctcccactgactttaattggacttccacctgggcttggagaagcactccaggagaaatgccccccagatgcagtgggctgaaggataaaacttcaaagtgtcactgcttaatatccatgcaatgacatgaaatgaagtagaggaactattagcagcattattacatcactgaattgagctttaaaacactggatattccttttaaagtaagaaacttattaaaacttttccaagcatattcttttttttttttttttgcacatttgatacttaaaaatccaattataaaaaatttcctagaaagaaaaaccagtgttctgtgttatgaagcataaaaagataataaaaaaaaaagaagaaaagcacagcgctttcaaatccacctactaacacatagccttaaaaaccagtcattgtcattctttaacaagattagagctctaagaacttctctgttcttatggttgttaggattttgatgcctagtttaagttcacataacaaaaatattactgaataaaaatctaattaaaacatttctggatgtttgttgttgaaagcctcctttaatagggtttcattttctcggtattcttatgagagctattaccagttcttttgactcttttctatttatatcacgaatacatcccagaatcaaatatattgatcttaacctcaaagaggaatctgtatccagatgtttttcattacactcaacatgtagactagtttttattacataaagttttatggccgggcccggtggctcacgcctgtaattccagcactttgggaggccaaggtgggtggatcacctgaggtcaggagttccaggagttcgagaccagcctggccaacatgatgaaactccttctctactaaaaaaaaaaaaaaaaaaagcagggcgtgctagcgcacacctgtaaccccatctacccaggaggttaaggcacaagaatcacttgaacccgggaggtgggggttgcagtgagctgagactgcactccagcctgggtgacagattgataattcgtctcaataaaaataaaaaataaaaaaaaatatatatatatatgtagatataattaagcttttaaaaaggatgtttcagatagtttaaagggttttttttcctcctttgttagatgttccaccgctttaaggcaggaagaatgttttaaaataataatgaatatttataaactacttcaggatttacaaaacattttcacaaacattatctcatttaaataaactatttctttatgaagtagacattgcagattaaaaagctgggtctgaaacaggttaagtgatttgccaagatttcatgactagaaagcaaaacaactaaggctttaaccatgtgttgtgataccaaaattgcatgcttttttccacaacatgtatcagaatttctgcaataaagatttcaactctatggaaagaacttccattgtatggcatactccagctcccacagtgtattattccattggatttgtcacaaacatccttccagaagcaatgttactgagctttacacaagtgtgaaaaaaagtttgctaattaaaggaattacaaattcagatcagtacatactgatatcttttacagaataaggtgctatttttctaatgccatttagttttccacatataagtatttatttgtgcctaagtaaggaactaagaatattaaccatggggaatgcagttttaatctcatgaatgacattaacataataagaaaaaatgtaataatagctgtatatgataggctgtaattgctgaatgtcaacatagaatgagaaatattctaatttgtgaagttaaatttatcatatggtattgaaaacttccatatgtttttaaaaacaattaacataaaaatatatatatactcaaatgcaaaagcaagctctgttgccacaggtatgtgatttgatcaaagtaatagatttttatatcttaaaccatttagtgtttcattttgaatgtttatgagggattttaagaaagtaaatgacgtgctatttatttatacaaatgaatgactttgggtaaatcatttaggcatattagaagccaaagtcctttgaaagatcaatcattgcttgaaagactgataaataaggatcataacaacttatttcagaaaatttattttaaatactcttcctagtctatattacatacatacagtgcaataaaatgtcaaaaaatatatacacacagcacactacaaaataatctaaactattttaaccatgagtgaaatagaaaaaaaaaattgctacttactctcaaaaataggatgtttacatgacatattcattttatatatatgaattcaaataatacttacaataattatccttatattaatataataatatttttatatgttattatttttagctatttttcagggcatattattagaataacataagtaatctaggtttatttcctcatattacctcatcataaaccatctcaaaatgaactttggtgaaagtgtgtgtgtatgatatatttaaagcttagctaaattatatcccattctcattcataagaagatgaatgaactctctgcagagacacaacttacctggattgagagtttcagataatatttaaagtctaggacaagaatttcagaatattatatgcagaggaaaatagtatggtaggagtgtcagatgaccattaagtatggaagatcctccatttcaggggcattcctgttttcaactctcctggaaaatgttctggtctcatactagaactcagctccatttccgaggcgcagaaatatcagccagactatactacaaaataagatttaacaaatctagaaaggtagaagctataaatgataggcctgttcactttaccaaggaaactgtgggataaatgactcaaaactcaatttccaaacctctagaaaataacaaactaccaggaaatgcccatatttaatttctgtaatacaaaactgttccattatgaaatatagcaaagaaattattagcaaagattttgtttctcatcaaatgacagcatccaactagtataaatattccccctgggcagaaattgatgtcattccgacagagatagtgatatgcacatcacaaaacgtcaattaagaatttcatgatgtttttggttatatttactgataaatactcactattgtcagaagccgggttttatcttttgatattaattaggaatatatttacttaagatcaagccctcctacagaaattatttgtgtgtctagtatttatctcttatcctaatatatcctggactaggtataacttttattgataatctttctaaaccttcatacacgcatgatagataatgaatatttattgaatgaattcacagttattctattttatgtgttgatggagtttttttttcctatgaagtttttctgtgctgcctctctctaaactttttatatgtcccatatctgcctttaatgtctctctgtgcctactgcaatgatatgtattcagacagcatgtgttataggttgttaaatgactcaggaaattggtttagtaaaacagatacaagttcagaagtagtttgagttctcacaactaaataaagtgatggaatcaaactgtagccctgagcctcattgctataaaagcctgcgtataagccggccgcttgataaatggcatgctaatatgtgattctgtgtctagtggctgaccacgtgtcttgtggcatgttaatatagggttctgtggcccatgactagtagcatgttaatatagggttctgtggcccatgactagtggcatgttaatatagggttctgtggcccatgactagtggcatgctaatatagagttctgtgtcccatggctggccatatgaccagttgcatgctaacatagggttctgtgtccagtggctgaccacatgacatgtgccatactaatacagagttctgtgtttcacggctggccacatgacaagtggcatgctaacagagcatgctgtgtcccatggctgaccacataacatgtggcatgctaatacagagttctgtgtttcatggctggccacatgacaattggcatgctaatttagggttctgcttccaatggctggccactgacaattggcatgctaatatatggttctgtgtcccatgcctggacacgtgacaagtggcatactaatattggattctgtgcccaatggctggccactgagaagtggcatgctaatatggtgttttatgtccaatagctgaccatgtgacaaatggcatcctaatatagggttttgtgttcagtgacaaaatagcttcacattcatatagataaagacatgaactcagtggacacttagcaagttatgtctccctctcctttaataaacactggaagtcctcatatttagcaaggtgagaaaatagataccactatttaagcatccactaccaagatatgactttgttgtcttttgtgcagctgtggaccaaaaatcacttctcttcagaaagataaaaatgtggccctaggaaataaactaaagtctgctggaattattttgcaatcctgacactacattatgacaatctgtcccaagatttccttcccacaaccatatgtgacccatttaacgcagcccaataagtgattctctgtttctgaatgagcaatgaagagaaatttgaaaaacattcatctctgcaacaacattgctgtggcattaacatccttcttctccatggcctgcctccttcctttccatcctcactgatagctccttcttttctcttttcccaatagcttagatttgtttcaactccttgatgtaatcatgccctaagacatctttttaaaaagtaatttttctgttagtgattttattgattatcatttatttaaaattagatatttgtctttcaattttgtttatggtgatttttttctgtcaactcttatatttgctttgtatgctttcaaatctgtcatcacccttcttcatggtttttgcctatggcaacatgcagtgaaaaggtttttccactttaaggttagatgaatggacaaatggcttcaattttgctgaaggggaagaaagaaaaatgagtataaagattagtttctaaataaataagttattttaaaaaactgtaaagtaatagatatcctactagtggggaaaataatgaaatagttttgtctttcatttcagcaaagattcggtactgaattggtacagaccatattcctttagaaagataacaatttagaaagtatattttctactagtgaaagtacaagcctcactttggtttttaaatcttctcccttggttttgtttactcagatatgtttgaacttatggaaagacaactcaaagagtcacttgttcttaaactttcggatccatttttcggatatgcagagtagtgagcaatttcgcctaagcaataaagagttcactgaaaaagactttaggttgaaagtatttcttttacctgaaatatcatgaagtaataatttctataataccaggtcttgaactgtttttacagtatggtttaagtttctttgtttctgtttttttcagcctaatctttgtgcatagtactctcttcattgatcgaatgtatttgaattcaaaggtctatgattataatatgccttaagttaaacatcatattaaccttcagcgcatagagtttgcttttggtgcactagcaacaggctgcctggcagccctgactgcccttgaactcagttctctgtggctggctggagttataaggatggaactttcaaacacctacaccacagctgctgagcctttcagataaggcggggatagacccattaacctcatgtcattatctttattttatggctgataaaactgtttcttttgtgtgtcttactctccaagacccctctcaccttcccccttgctttaaaaacacattaatatcataatctagttaaattagtttgttgccatattgaaaataaggctctttttgtttctagtcaggttgatacagcaagagtttattgacaagatgtggctgcagaaaagaacggctaattattttcatttgcatgaatggcttactgcttttgcctaattactgtttagtacaatactgttaatattctccattaaatatttgccaaattaactttgccgtaagttttcattagttttaacattcaactctgaatataagtatgcaggcatactgtgtagtattatgctcactgaacatggaaagctactctaaaatgttaatacatttagcagtaacgttagaatacacagattttattcccacatatacggtatatgcatagaagtatgtatgcatatagatatagatatttatcttgttacacatagatgtgtacaatagtcttgccttgctttgtcggcatgtctaagtacagtaatattagcaattgcaattagttagttttttcttaatagaatgaataagtagatgaaagatttctacttctaaaaagaaatatgataaaaataggtttttctgtcctcctaaaaataggttttcctgtcctcctaaactatctgttttgttctttaatattttgtccccacggagagagatggaaaaacctaatggcacatagtagagacaaaataaatatttataattaaaaagatgattaaggaaaggtaatgataatcacagatgggaatgaatgagtttggatagtgcaggtcaaaaaaaggagagagaaaatgaatgaaaaaatataatagagaaattggggctaaactaatgggtgccatggaaatggagggaaaattatgtggagtagtaggtggaagagaaggagaataaaatgaaggaatatatgctaatagaaagacatcgaaatagagaagaggagtgtaaaaaggcaaataagaaggttagaaaacaagagtacagtcaacaagatggagaaagatggaagaaggaccctgaaaggagtagatgaggcaaaacaaaagaggtgagcaggcaaagaagtgaaaaggatgcctctgtgcaagagtgaaggaattggggtcactgtgttagctttgcattgcccatacatattaatgacttttggttgattttaaatttcagatttggtattttccttaagcctattaaaattgcaaaaattcatgtagagttagacttccatgcacactatgaatctagtcaactacagcaatctaataacataactcacctttgtacttcaactgaaatagcatttcatctaaatggctactctacttcttataacctaactatgtctcttggcaatactacaaagtcattataatttgtcttctaatttctcaaaagttcatttttattagaagacttgatattaatttaaataaaaattaataagccattgaatcacactagtaaagtatttgcatagcaaattgaaattcacctattataaaaacacatagattcatagtctcattgacacaggaagaaaagatcttaaagatacactaatcctaacctctcatttaatttttgagaaaagtaaggctagaattattgagataactaattattggcagaatttcagactagacctcaatataagacttcctttctcaatttaaatcaagatattttgtcttgtttttttttttcatttcagtctatgttattatccaagaaatgcatcattactcacacattagcactgatgggattttttaatcctgtgccatttttttttgtactatggctagagttaaaattgaaattcattgcagtggggaaaaaatcttctaaaataagtaagactataatgctcaaaagataaacaacagaagagttcaagaatgccaactttaagtacatagttgtagaaagaaagaattttctcccattctgtaggttgcctgttcactctgatagtagtttcttttgctgtgcagaagctctttagtttaattagatcccatttgtcttttggctgcataaatgtcttctcttgagaagtgtctgtacatatccttcgtccactttttgatggggttgtttgtttttttcttgtaaatttgtttgagttcattgtagattctggatattagccctttgtcaaatgagtagtttgcaaaaattttctcccattctgtagggatggtctttacaatttggcatgtttttacagtggctggtaccagttgttcctttccatgtttagtgcttccttcaggagctcttgtagggcaggcctggtggtgacaaaatctctcagcatttgcttgtctgtaaaggattttatttctccttcacttaataagcttagtttggctggatgtgaaattctgggttgaaaattcttttctttaagaatgttgaatattggcccccactctcttctggcttgtggagtttctgccgagagatccgctgttagtctgatgggcttccctttgtggataacccgacctttctctctggctgcccttaacattttttccttcatttcaactttggtgaatctgacaattatgtgtcttggagttgctcttctcgaggagtatctttgtggcattctctgtatttcctgaatttgaatgttggcttgccttgctaggttggggaagttctcctggataatatcctgcaaagtgttttccaacttggttccattctccccgtcactttcaggtacaccaatcagctgtagatttggtcttttcgtatagtcccatatttcttggaggctttgttcatttctttttattcttttttctctaaacttctgttctcgcttcatttcattcatttgatcttcaatcattgataccctttctttcagttgatcgaatcagctactgaagctgtgcatttgtcgtgtagttctcgtgccatggttttcagctccatcaggtcatttaaggacttctctacactgattattctagttagccattcgtctaatcttttttcaaggtttttagcttctttgcgatgggttcgaacttcctcctttagctcggagaagtttgatcgtctgaagccttcttctcccgactcgtcaaagtcattctctgtccagctttgttccattgctggcgaggagctgcgttcctttggaggaggacaggcactctgatttttagaattttcagcttttctgctctttttgttccccgtttttgtggttttatctacctttggtctttcatgatggtgatgtacagatggggttttggtgtggatatcctttctgtttgttagttttccttctaacagtcaggaccctcagctgcaggtctgttggagtttgctggaggtccactccagaccctgtttgcctgggtatcagcagcagaggctgcagaacagcaaatattgctgaacagcaaacgttgccacctgatcgttcctctggaagcttcatctcagaggggtacccaaccgtgtgaggtgtcagtctgcccctacttggggggtgcctcccagttaggctacttgggtgtcagggacccagttgaggaggcagtctgaccattctcagttctaaaactccatgctgggagaaccactactctcttcaaagctgtcagacagggacatttaagcctgcagaggtttctgctgccttttgttcagctatgccctgcccccagaggtggagtctacagaggcaggcaggcctccttgagctgtggtgggctccatccagttcaagcttcccggccactttgtttacctactcaagcctcagcaatggtgggtgcccctccccaagcctggctgctgccttgcagttcgatctcagactgctgtgccagcaatgagtgaggctccatgggcgtgggactctcccagccatgcacgggatataatctcctggtgtgctgtttgctaagactgttggaaaagtgcagtattagggtgggagtgaccctattttccaggtcccacttgtcacagcttcccttggctaggaaagggaattccctgacatcttgcacttcccgtgtgaggcaatgccttgccctgcttcagctcacgctcgatgggctgcacccactgtcctgcacccagtgtccgacaagccccagtgagatgaacctggtatctcggttggaaatgcggaaatcatccatcttctgtgtcactcatgctgggggctgtagactggagctgttcctattcggccatcttcctttttctaaatttaaatttgagttaataaatcatttaaagaatattaatcaagtcacatttacctccaccttaaattaagtatctctatttatttaagttggcctgaaaggtaaacatctgatatccatggaccccctgtacttttctgactttgccagtatacacatgattttgcttatttttggttaaaaatatgcctcaatccagctaactgaagctatgggaaatctgttaattttattgtaaggcaaactacttctctgccttccaaatgaaccaaaattctcctatcccagatagtgcagtctatctctatctttttttttcctttttttttttgagatggagtcttgctctgttgtgaggctggagtgcagtggcacagtcttggcttactccaaactccgcctcccgggttcaagtgattcccctgcctcagcctcctgagtagctgggactacaggtgcgcaccaccacacccagctaattttttgtattttagtagagatggagtttcaccatgttggccaggatggtcttgatctcctgaattcgtggtccacttgccttggtctcccaaagtgctgggattacaggtgtgagcaactgcgcctggccagtgcagtctatcttaggggacatggatcagagtaggaacaagaaaaactgaagggtggagagacacagtgattctcctgtggatgtccccatgcacttttgtctcagctgtccatgttccccaacaataaaaaaggaataaacaatgaaatgacacattgttaactcataatgcagagactgtgatagcatatataactaattagaagcccacctctccttgtgtggtcccagagaagaaactttgagaactgtaaagatatttctgagagtgatcttaattggattacatatgggataaagggaggcaaactgtctttatggagaaccttgagctaccttctaaggtttgtgtttggatggctcatcacttcaaaacttgttcatcccaatgctaattttagctctttctgctggagaggggaaattaggcatggattagatctgaagagaggaagaaactgcgatatcaagatgacatttaaaaacaacttttaaatatcccagaaactttgtaatttccttatttttattatactttttaatcatgttctttcttttagtgattagcagaaaatcttttagaatgttgaggatggatttttggtgacagcaagacctgagatggatggaagagctgatccactaaacagtggtgtgtgtgtgtgtgtaagatcaggtctcactctgtcaaccaggcctagactggagggcagaggcatgatcttggctcactgcaacctctgcctcccaagctcaagaaatcctctcacctcagcctcccaagtaactgggacccacaggcacacaccaccatgcctggctacattttttttttttttttgtatttttggtagagatggggtctctctatgttacccagcctggtctcaaacttctgagctcaagtgatccacccttctcggcctcccaaagtgctggaattatagatgcaggccaccacatcgggcccctctttacaattctgcctcattgaaaagaacccccagagatagtggaataaagaaaagatttgaaaccaaatcttagcaactctgggactttgataaacggccactcgttgacctggattggacctgagagatggcttcattagttcatctgttccctaagaggcaatgtctttcctttgttccaaaccatgtgtttggtacctgaaagttttaggaccctgcccctgcaactaactagctatgtgacctggaatatgccaattggctcatctttaaaggaggaacaataatattatttacatcatagttttattgtagggataaaaaggagatgttgttcagcatccatttattcataaaacaaacaacagtaacacacctactatgtggcaattgttatgctaaatactgaggatatacaaaatttgagttcctgatctcgaggtctcagtccagagggattgctgagaggccactggatatacacaaaacacagtgagaagaaatacaatgtagacagagcattatgagaatatggaagaggaagccattaactttgcctggagaaagttaacaagcagcaggcttgtttccccacagggaaagttgaaggcatgtttttgagcgttttctctctacccagctttaaattgtgacttaaatgccttcagaacatgttcaattctgtgttctctgtataatgtttcttgtgtaaatgtttattatttgcaatgatgataatgtccttttctattgtttgattactgggaaagcaggggtggctgaaatctcacgtggttcttcagccagttttaatagcaagttgttcctggttgtttcttcctagaatgactccgagaatgcaggatatttgatactgtcaatgagaaaatatgttttctacatatcaaataacatattcatagtcatatttaactaaacaggtattcaactggagagacataaaattttcaacataaaacagtttgtgaatatgaggagtaatagatacttgtatcttgctggctagcatgttaattgttgcaatttatatggaaagtcattcagaaacatcaatcacaattaattatttacagaatctttgactcagcattactaattctaggaatgcattctgcagacatattggccatttgtgaagtaacatgtatgagaatatttactgaagtgattataatagtaaaaggttaaaaaccacataaatattcaacaagatggggggactgggttatcaaactattagataaattttatgcattgtatatgtaatgcatgttcaaataattacaatggagcaatatgcaatggttaaaaagaataagacagcaaaatatgtactgatacaatgccaagcaaatcagtaaagtgctacagtaaagtgcacaactgtgtatggagtacataatcattagtggatggagatatagatatttagatataaatataaacacagctatggatatggatatacacacatacattcatatggattttttatataaataagctgtccctaaaaggatacacaagaaatgatcacaatggtgccagagaagatgaaatataatattcacttattacacacatctgtgctttttgaacatgatattatgtgtatgtattacctattcaaaaatgcattaaatgaatctagaaaataaatacctaaaacacagaatatcatccacaaccatatttataattgtcttggtggaaaggatttttgtaaattcacaagggttatacatgttaattcatttttatatttagaaaaatagtttgaattttttctaaaggaagaatatttttaaaattctttaatttactttttcccccaggaagtaaataaacttcaattactttacaccaaaagaggcagcatcagctataaaaaagggatgaatcctgtatttgatagcataaatgaggcataataatcaaagaaaaaacttttgaaaagaagaatgtttgagctacaggacccttgggatgccagcagtaatttacacaccattacttattcagggttgcattcctaattactctttggtaaaaaaataattattatactatagtgattactcctttcatcacagaagagaaacaatgctgatataggcaaatcttaaagaaatagaactctagtttgttgataaagttgtttatatgcagtagttgaaggggaatatagtaatagcaaaaacatatttcttaaagagcattgagttttccagcaaactctcatgctcaagtatttttacaaaaatgtacataaaccaagtcaaattttaaacttgattctagattgttcatgacctactcattttctcacacatttgtgaaagcacctttaaaaaacaatgaattaaaactactgcgctgtaccctcacccaaaaatgattgaaaagaggaagaaaaatttgccttctttagtatgaataatttatctacattctaattttaaagatcctaaaacaaacactatcattttcctacaataataattgtgattatgtacatctatatttctagtcaatctaatcaaataggtcaaaattaaagaagaaaagccgtgccttgattgcatacactcaatctacaagctttcctgagttttcgtttaaaattatatttagttcattcttttatacaagtatccatttgtttaaaattatatttagttcattcttttatacaagtattttaataaagtaggagaacttttagtattctatcaactctttattgacatatgcattatctatattatgtatttaatactgaaagaagttttatactagcccatatcccttttcatggctggcctggcgttcctggccatcagttgtgatatacttataaatacagttttttttaacatcctaagccaagcaaaattcagaaggtggaacataccgaaaatacttaaggatatactctaaaggcaaatgtgtgtttgtgctttttagattatgcatagcactgcttccttatattactgtggactggacttgactcataggtattttacccaatgaaacatggaagactatttccttttataattcgtcactgtaaagcaaatgtctaaattggaaatggtaaaaacggatctttccatctatttctaagtacacagagcatactgagattaagattcatatccaagtgtatctataatgtgttttaataaggtcatgaataatgaagtaattttatacaatgtggaaaacctgtgaagtgtaacactcaagtgatatttatctatgaggtgtatccattttatggttcccttttcataaatttcatttccacttgtggagttgtgtcatatgcagactaattaatatgacttatcctgtggctaagcaggaatgtttttcacttttcctttattctttcaccttgtgcaaaattattattcccctcaatacctcatttatctctcacattcaccctagggagtccctcgtgcagaatgactaggaggtgtataaaggggaacaacaatctggcagcctcatcataaaatgtgatatgttagctatttctctttccaagggacctatccagctgagactgtatgaggcctctgggccacacatgcaaatacagcaaactcacatcccaagaaaacttttttggcaaaaagacagaggaaaatagctttgtaacagaacttgccttttaaagggggtaaaaaaaaacaattctgttttgggggagttattcatgtagaagaaataaacagctatagccgtgtgtcaagaagagacattgttactaaactagatatgcatggaaatggaattaagttccttgcattcacactgcaaattctgggatgattgttcatttccaataaacaaacaccatttttaaaaatttggtcaaaaacagtaaagaataatttgaacccatgttattataaataagcagatgactttctcataacagacgtgaaaacaggcattgatatctatatatctatatctatatagatatatatcagattttatctgccattattatactggccctcatttgggtctatagctggctcttgctaggtagaagagtttacccttaggcctctgttataacagggtctagttcacacaaaagattgaactatttgcgtacatgctagtgtgaaatagccttatccgtagggccttcaaaaacagcaagttgaggccaggtaaggtggctaatgcttgtaatcccagcaaagctgtaatttcagccaaggcaagaggatgacttgactccaggagttcaagaccagcctgagaaacatagcaagaccccatctctaccaaaaaaaagttaaaaattcacggggcagtgcccctgtaatcctagatactccgcaggctgaggagtgagattcgcttgagcccaggaggtcgaggctgcagtgagttatcatcacatcactgcactccagcctggacaacagagtgagactgaatctcaaaaaaaaaagagagagagaagattttactcttaatttatgtcatttatccatgtgctttgccttgtggctagtttcaatagtgaatagatttatgaaaattcatattacctagatttattcttgaccaataaaactcattctaaaggatttttctagcatatataagtaaatttattaagagaagctaataaatttagcttctggtctgtatgctagttaacctagtaattaatccaaatttccaccagaatttgattaatacatctaatcagcttcacaggaagaaaattgcacgtgggttcctgatatttcacacaagaggtaatttttttttccagaaaggaaggcttatcaatagtgatagttttaagctccaagcgagtgagaaattgagtctcccctgttcctgctgtattttcaacatctagaaaaatctctgcatttgtactctttcatggattagatgaagaccaccatgcagaataagccccaaaacatgaaaacagattcgttatttcattgttttaatcaaataaatttaattttgcagttgtttatgatatacgcaatgtctactaagtgacatgggatttaagcataagtggcaagcagttcacataagtgattaaaattagcatgattttaaagaaccaaacttgtttgttttcaatattattctcccttcattagaccagttttctgagctttattttccaccattactgttttccatgacactacatgaaaatgaaatcattatccacatcagcagcaccatcatagacaccaacattcaaaccttgaaagaaaaaggtcccagttatttacttccaaacagctagttaccacttgaccagcaactagccccaacatgccaaggactggtattcattctcttaatcattattataatcatcttactgccttacatcaaaatactatgttacatgtcagtacaatgcattaattgaaaatgtacttcttccacacacccacattaattcaacaattatgaagcgtgttaggcactgtgggattggtctataccggcagaactgtgttgagtactgagaaaataaaaagatgaactaaacttccttcaaacttaaacacctaggagagataaagtatataaacaaatttgaatcttcctaactttatacataacagtcctcggtatgtaactaactgaataataaatttttgttaggattagagagttagaaaacaagaaagtcctgggtgcctaaaattcaggggtcaagagtgcaaaaggagaagcagcaaatatactaccaatggagggaaaaggagaaacagagaagatcattcaaactcaagagacttcacagtttccctctggtcctgccatgtcttcacttgtgcaaagttatatagatggcacgtctttggattctacttctaagatgaatggatcccagctatcatcccacaataggactaaagaggggagagctccctcttccaaactctttattaacctttactgtgagtcaaaattctgctacagacaacacaaccatgcagtctccttgactagagtccttaatctaacaaacacggcaatatcaaagccaccatctggaaggaaatatttgtgtgtggaattatgtgtcatatttaaattccgtatatacaatagtggaaaattactggcaaatgcatggttacctcatacatttacattgcaattgtgtaagttttctttgattaagatgtagtgttcattgcataccaggagtagagaatactaagtaaatttgcaactgtcctcttatgacaatccaatgagacatttatatttaaacataaaactgtagccatccctcagtatacatgggacattggttccaggaaccccacgtataacaaaatcttcacatactgaagtcctgtagtcggccctgcagaatcccgcagaacctgcctgtaggaaaactagggttttgcatcccacaaatacatttttgtaattagtgtgtttagttgaaaaagaaatagacatagaagcagacccacgtagttcaaacctgtgttgttcaagagtcaaatttaattaaggaaaatatagcaggaaagattacttttagattttctagttgctgcagagaccggtaagaatactcatcacctctgacgacatgcaggttctgtaggtttggtgtgggtgggatgttatgggtgggcatggttaatatatttgttacaagaaatgtaataagttgtcataatttcccccttctgcaacacatgggcatgacttactgctactttcaaatatattatccagattctactattattttaaacttggtaactgatgtccaagaagaaagcaacttttgactcctatcgtcagttctgaagtctttcttccaattaaaagcagttaccagtgaacatccagtcttatgactaaaatgcatacattctttctttttaattttcaaaagagaaacaatgattatataaagaaagcttcctaatcaagaaaaatgtcttttctctaactaaaacaaaagtgaatgtggaaaggaatcttcaattaagaacggatcatttattttccctatatattattacctcctatttctttccatttggttggatttcaatagaaataacttttatgttaagtttgtttagccttagtttgctataaaaacataaaccatgccattattattgatgaggatagggcagccaggatggtcttgaaaaaccattatattcaaatgtgcaaatgcacatcattatatgaattaaggcttgcttatgtacaaaagtatcaatgggattagtataaagtcattaaagatttttaggaagaataggttgtattatagcatgctgtatagtttcaatcaaggaatacagtgctcttggcctcagttaatggtttatttgtaagaaatatattcctattgcatagcttccctctagctccagcatttaaaaagaaaccatccaataggtctttttctagaaattgagatgggtaagagaaagagtgttaaatattactttctttaagtcctatcttaaatgaggtaatttttcaaatgatgtgtagataaggctttcatttatttttatttttgatttttaatttttatatagttaaggggaacaagtgcagatttcatacatgcataaactgtgtcatggtgaagtctgagcttttagagtacccatcaccagaatagtgaacatcatacccaatagggttgatatctcaagctaaataatgatgtggaatcaggaaatggaatagagagttgactctcctaatcacccaaatggatcatctgtattgctcctggaagctgagaccaaaacctctatttctctaacactttacagtcaagaagcagttgaactgttatttttttaaaataataaaatattctaacgcatcattagtcatgattattagtcatggccataggttcctgaagcttagaggatgaactcacctcagtaaaagaaaaaaggaggccaggcactgtggctcacacctgtaatcccagcactttgggaggccaaagcagatggatcacctgaagtcaggagttcaagaccagcctggtcaacatggtgaaacctcatctctactaaaaatacaaaaaattagccaggcatggtgatagtcacctgtagtcccagctactctggaggctgaggcacaagaatcacttgaacctgagaggcggaggctgcagtgagccaagatcacgccaccgcactccagcctgggtgacagagctagacttcttctcaaaaaaaaaaaagaaagaaaggagagcaggaggtctgtgagaaatactcaggttttcagtgaatggcactgttacatgtttctgagaaaattaaataatatgaagactctcttaagggtaacctactctgtgagtggcctttcagtttttcccattgttgaaatagtgcctggaatgttaaagggtggcaaaatatgctacagccaaaatatgccattttgacattaggataacactgagctacaggtatttttaaacaaaacagcaagtacacaaagggttccatgagcctcccctttttcttcctgaaagcaggacattaaactgaagggtatcctccctgtacaattgcctttcctttttcaacctattataaaagtatttaggttttgccaattctttggctcttcatttccttatgagggcacccatgtcaggcaaaacttatattaagtaaatctgtgtgcttttcacctgttaatcttagatctgtttaatttttaggcccagctgaaaaatcccaagatagtagaggtaaaatttttcctcccctatagtttttatccttgtctacacaatgtttgccaaagagagggctggtaaaatgtggccatacatttttactaaaatttaattgaataagcactataatcttctcctaaatgcctccaagcatttagaatagtattgtttttaatcaggtaaaaaaaatctcattataacaattgtcatttttattatcagaaagttctacataactaagtcatatcttatcccagcatatctctcaaatgaacaatacttcaatgataagattacattccattctttgtgatgcaattctacacaatggatctctctattgcatgtctctgcaatagccatgctttacaaagaacataaaatgtgtgtgctatttgtgatgtgtgaggggaagcacactgaagtaacatatcaaatagaatatttattctttgtttttttggttcctaaataaagatgaaattattcttcaaattctctttgcctttcttacttcagataactcagccacctgcataaaatgtggcttaggcaccaaatcaactaccaaaacaaaagctccgaagaaaaagatttaaagctggaaagtgaggatggagtaaagatctgtgcctggtcctgatttctgttacctgctcatttttttcaatagatcccaatgcttttgaactcactaaatgactgccagcacattggttgattcatctgaatgctttcaggctaggaaaacgtttcaacagaagcctcacccttgtatataagagtcctaagcaggaatatgactagaactatttattgatcctcagctgtcctatgcagctctccaaatcctctgggcctgacctccgttgcaacacaacaagtgcctctagacaaatatctgatgtatagtatcatttggaagggtacatttgtaccatgtagcggtacatggtaggttgaacgtaatttaatttcttcctcttatgcgttcttgaagcattttcttagtacaaatattattacatatcttactaccagaattcacttaactggttagattaacaacaacaacaacaacaaaagaggttatagatgagattagtttatgatcagttgagcaatcagcaataaaaagaccaaaataacaaaaatgcagagattttttcacaatgatttttatgcctcccacctgctttagttttttgaaataatgggataattaaaaggatgacacctcatgatagtcttccaattttatgatggttttgctaaacatgataaatgaaaccttaaaaacttcaattttttaactttcactttttaaaattactaaattatttaattataggatagatataacaatagaaatacaagatataaggaagaaataataatttacctccaccattctactctggcttcatctccctgagataaccagtactaaccaatctatatttatagttcttatttttctctatgctcacaaaaatgtgcttacatacagatgattacatgattacttttctgtaatacgacatatgtttctacttgatactatgtcatggatacaattccaaaataatgtctctacaggagagattgtagtgaaaacatgcaccacgatatttcccaacattcagctgcagtttctttcctatctttgaagaaactccaattagtttcctcaccattattatatgccacagttaatattctaggcacattagagtacttgtgctcagtgattcaattatagttccaggatatttgcataggagaaaagaggtctaagcatgtcagataatttcttcatgacctttaatgacctagagtggtggccttcctttcaataccaaatctcttttcccaaactgacacttttgtgaaggcatatacctgcatgtttatgcgtgcgcgtgtgcacagacacacacacactttgaatcctgggtggttaatcttaggcagtttccactgtttctgtgttttagttttgttggttggttggtttttcggccttcttttcatcatatatgtctttggctttagaaacaactgcttttgcttatttggcacactgcttatgtatttttctgccttggccaaattactttataaaccaaccatcagcagctttgaatatagtcattagtacatgtaaaattatacatatgccttaaatcttcaccagactaatccaaatttgtatcttggtattttgaatgtaatacactgctatacttatggtataattcatataataacttatttaataggagagaagaaatgaagggaggaagggaggaaaagaagaaaggaaggaaaagagaatgggagaaaggaagatataaacaacaaaaaatacatatttaccatcaacatttaaaagataatgattatctaactagcagaggccacagatagagctcccaatattttgagatagttttatgttataggttttcaagcacaagtaaaattataaggacatgtgtcaaggacaattatgttggcgagaaaacagaatttatgaacccttgattttcttccagtccctaaagctttgattccatgttgcatctacagctttccagatgctttggctgtcacattagtgattcagtaattattctaagcagagaaatctgtaggcgagatgtgtggcgttaggtaaactttactataatgctcaaaccacatagtagaaaaatatttaccaagttaacatcttagagtcccagatctaatccagagaaaaataaaacgtacaactatcttcagagatatagcatattgtatttaattacaatttgttctggcttattgcttttcattttacaaaatccacgatgatgtggtttacttaaccagattttaaaacccagggacccaaaatgctgattatttttccagaaaagtgcagtgacactctagtttataaacctagtgacttcttgctgctcatgttatagtgcaaacaagtagatatttaagggacattgaagtggaagtaaataactgttgtgtatcatcgtaataaaaccattgaataattgctgaaataatctgattttgtttaagagttgggtgattgatgagttggcagttatttttgtctttctataggtctaaattttaaaatacaccagatatttaagttgaatgtgacatatttacctctctcttaggcaacctctaagcttaatttattgcacaagtacaaatttacttgatatatcaatgcacttttcagtatcttaaattaattcctcattaactagttttattttaccgagttgaatacctgtatagcacaaaaacagattcaagttctttattttcttccaagtaatgtcaacagctttcattccttcagggtatgaaggcagggtgttgtgtatgcctgtggactggtagcaataaaaacaacataaaattagttaaagaggaagaaggagaattgggagattttctgtgctgcttttaccaatctaaaagaaattgttaaagtcatttaatttacattctctttacgataattgactcacacaacccatctttttttcctcaaataattttgcaatgatcaaagtagattggatctttctgtggctgtatctgtttattacaagcacaattattcaagtaacaaatagggaagtaattcataaacatgcacacccaatcaggtataaatctgcagatgctccattagtaattagagataatatttcaaatacggtccatattttttacaaataacaatgtattaaatattaagtttttgattagacaaaatttcaaatcaatcaaaaaatagtactggaggggagggcataattattaagaaaactattattgtaggtaagtctttcaaaaaatttaaaggactttattttgaaagatcaagtaggtttgacaagtatttacatgtgagtgcatcatgcctgtccagcattatatcatgaaatattttacatcatggatcaatctggtaaactgttagccatgattctaagtatgcccttttgggtagggagaggaagaggggacatttgagatctaaagaacattgtgatctatggtattgaaaagcaggaataaagagaaagagcacaatcagcaaggagaaataccaaatcccttccacaaaggaaagataaatgtgattggccagttttgaatacctatgtgtcaggacccagtttctttctaaagataataaggtaaaagatgccattgttttacttaaagaatcaataatctagtatgaacataatacaattttgataaaaatagagccacggaatgtaaatgatactttaggccacccttgagaacttcagattaggattttttttaccctgtatttactcagtgagaactcagcatagatacaagtaagaatgttgctatttcttttttccttgtccacattgtgagacacgcgtaagctcttgcaagagcatccctcaggcctgccctctggacccaaccctaagtttgctgggctaaattagcacagttagcctaacttctaaccactaggctcctccactgaacaacaaactccatcaaaggataatgctttgatttgcctctttttacttgccactcatatatcttctctaagtaatgcaagggaaaacaaacaaaaatggaaaataaaaaataaaatacaaacctctatagttaggaaattaagcgtaaagaaattttaggtaaaaatttattcaatatatctcagttctcaaatgtattctttttatctacactgaatcaaagaacaattgcagaaagggtaagaggagagggagagagagacagaaggaaataaacagaaaaaagagactctaagtcttgcaaaagacttcataagaaggaagtacatcacaagctgaacttcaatcaacaatcacttcttgggtgtagagtagcagatttatttgaagtctagcctctttttcccgtggtggaataagactcctactatagcaaagggtttgatttcttattttaaatgtataatgaaaacatagtatggctgccggttagagtgatgtggtcgatttacaaagattcttaactttgggagacatttaagattctaataaagaccgtgtacctccccagaaaattgtagatacatgtacttacaaagtcttctgtacacagcttcaaagtggtctcaaaatccttgcagccatccagggatcaaggtttggggtatcctgttgtctttatctcatcttcatctccaataactacagtaataaaagaaagaagaaaaatatgaaccccatactgtgtgtatataaaaatctaaggagtggcatctgactggatcaggtcgatgcatgtatgtcataagaatctaggaagcaccaggttgagtgagattaatgagcccccagccccatattccattcctaagagtggtattaagaaatactgtcaagcaagagacataccctcatggttttctttttagcttagaggcattagagttcttcaaccaaatgtatctttctcatagtaatctaatttctgtccctactcagtagacaaaaatatgcccaaacttgtctctttattgagctgcagaaggagagtaaaaataaaacgagaacaaagagatggttgtgacagacatgtcactctaccctgatctcaggtttttttccctcacaagaaacaaatattcttctcaggtgtgagaaggtaaagacaacatgtaataccaaagtaaactcattgtattctgacagccctaaccagaagccagaaaaaaaagagtacatttaaatatctcattaaaaagtttattattatacctgagtaactcagaggaatcatgcacacattaaaatatgtgcatctcgtaactccaaaataaaatcaaaattcactgaagcactctcaaataatggcttactagagaaaaaaaattaaaaactgggacaaggttgcgcatttcaccagtgtgcttatattatcaaaatgaatggattttcttcctcaaaaaatttcacacgtcgatggtaacataaagttccgtaattatattctatctcctatctttccaacactgtgtgatgcagtaattcttctgtgtcaagatgtaaagcagtagggaattgaacaaaattaaaacacatttcactaagtcgtgagctgagaatacctcttttgcccaagtgaaggcatggaggaaaaaaagagtgaaagggttttctgagaaagactttataacaacaggcctttaaaataattatccctgcattaaaaatgccagaaaacaaaattctaatacatccgaattgtcctttattttttttgatttttcaaaatgtttcttaacataaaacatcaaggtggttggttgaatagtaaaattacattgcatcagtttcaggatattagttcaggtctaataaaattttaatagaaatatgtttaatgactttaacttactgctgaatgaatagtactctgcaggatttgatagtatatgactcgagaaaagattattaagaagaaatataaggcacttttataaaagatatttgcaggaaaccattagatgatacagaaaatcaataatgtcctagtgccaatttcagcaacattaaaattacagtgctcgttgatatttatgatgatagagctaccaaatcatttcatttttgtctttcactacattagcatttttctttgttatctaggaccagttacaaaatttgatctgttcctttaaaaaatgttttacagatgatcctgtttctaaacagctcttctaaggaagaattttaacagtctattcttcatactttcagtgtataaatggattgataaagttatttccttttagggaagtcataataattgtaaaatattaagacattcaaaatggaccttagtagaaacaaataaataggacttaataaacagagttgctcagcttgcttttttccaagaggaaaaaaaatggtgatagtctagcgtcattatctcacatgtttaaaagtgaagtccaagaagtaatgaattgttcaagagtgaaattgtgtatagagtacaaataaatatcttgattttttcccatgtccttctccaagttcacccaaattatcatgcaaacaggaatatagagcttacacttatttggcttttgaagtaaccctgtgatttttttaactggccagactactataaacaatggaatttagataaattgatagaatcagaagaaaaaataatgaatggtgaaatattattgccaacattttttgacttggtgccctggatatatataaatatagctatttaactacatatcccagctaataggcttctccacaggtaaggagacacaaaaagataacccactggaaggctgtctacaattgctgtctccaactttaaaaggacaaaaaaagtttaatgatttccgaaaccctgagctcctcgagttatagaatataaaaatagtaactgcctgaggcaatgtcatctcactggtggcttccatgaattgtgaagtctgcgccagtgataagaggctgggagaaaactttcagatcttaacccgtgctaaactcttatgagtcaaccttttgccatagtagccaatgggatacatttttaagcattaaattcacatacactaacacatgtaatagcaaaaacagtaataataaaggctagagggagggtacacattcactcttaatggaatctgtttcaaaagatgagtctactgcctataaagataaagataaagatatgttaattacatataaagctttctgcaggaccatagtcttcttgaacttagagggggtgagggataaaaggctacatattgggaacagtgtacactgctcaggataaggggtgaactaaaatctcagaaatcaccagtaaagaacttttccatgtaaccaaaaaccacctgtataccaaaaatcctgaaaattaataaaataaaataaaaagtcattggtaagactgcattttggcttaaacatttctccaacttattctaccatccagaccagcgtatcattttttcaggatcatatagaatttcccagactttgttttataggtcaatctgagagccaaatataaacatgtgaaatatgtgctaatgcttaccatttatattttctgctagttgatagttattttttactttcaatgatcattcattggatagtgttaaatcagacattggcaacctcccaaagatggagaaggggtgggctttcagcctgtcataggtccatggatttgttgctaactggatccccattcctgctgctgtccagagccaccacccgcttccccaagagtctgatttatcaccctgagtgaaatcagaaattcactgtaaaaccatgccccacctccctccagcttcctagggtctgacttttgaaaagggatgaatagggctgggcgcggtggctcatgtctgtaatcccagcactttaggaggccgaggtgggtggatcacgaggtcaggagatccagaccatcctggctaacacggtgaaaccccgtctctactaaaaatacaaaaaattcgccaggcgtggtggcgggtgcctgtagtcccagctactcgagaggctgagccaggagaatggcatgaacttgggaggcggagcttgcagtgagccgagatcgggccactgcactccagcctgggcgacagagccaggctccgtctcaaaaaaaaaaaaaaagaaagaaaagggatgaatgtacaacattggtgttattattacctctgaaaagattgctagtccttaatctacactataattatgtttgtttacatttaatagctattttccaactacataaatttccccattccaacttatgtttgtgcatgtaaatatgttcatttttaatgagataagattcgttttcttttgaatttgtttaccaagtgtgctagccataaaattctccacaaatgccatagatcggggtccccagcctttttgtcaccagggtccggtttcgtggaagacagtttttccactagttagattttcattaggagcatgcaacctagatcccttgcatgtacagttcacaattgggtttgccatactgtgagaatctaatgctgtttctgattggataatctgatttgacaggaggtggagctcaggcagtaatgctcatacgcccgctgctcctcccctgctatgtagcctggttgctaacaggccacagactgatggtggtctacggcccgggaggtggggacctctgccatagatgatctacctgagttctggatacaggagccactcagtaaatatttgtcgcattaaataagccaactcactgtacaacagcaaccaactcacttcctaggcaaccaggctgttcaatcatctccagtcctttcctcaccactgtcatacataggagactcctctctataccagatcttatcatcattccacagcattttaacatccacatctgtgacccattcaccactaaaaactagacacagcttatatccaatggtgcaccctttcaaccactgttttgccagttttttctgccccttgatctatttccccaattagaaccctcaaacctgcgtcattctacatattccttcttcactcaattccactgaaagtgggcagaagaaataatcacacagcaatgaactcatgatttagttgattatttctcattcctcaaaacatgcttgctaaaacttcctcaacttatccccaccctttttctttttgtaaatttatctgcatctaagcctctcatggtcttcctgtcttcaaagagcagtctttatctccttcaaagcctgtcctcacctgttcttttattttcatctccttctgcttcctcagggaccttcattaatggattatctcctagttctatcatatgttcaacctacttctgttcagtgattctttcacaataatgtagacatctgcttatttagaaaatatttctttgactcctgttactccttccttttcttcctgacagaaaaaaaaatcataaaggaaaagttcactccaatataaaggaaaatttttcacttcctacgattcattcactcaaactctaaaattctactccaaaaaccactctcactacaattatcaatatactctttgatgttgtgtacaatggatatatgtcagacatgttggtgacatttttagagtaatgaaagctactgacccctcctacctgttgaaatgcctttgttgtcttttataacacagttttctcctaagtaatctactgctgtggcccctctgaagtagatagctctgttaagtcctctttctgcgtccacaataacacttcactgcttccttctcagccaaaagttcccctagttttcacagtctccctgggtgtaccatccattgttgttactcttttaaattaacaactatagtcaatgagccagatctatcagcagatcagatctgtgataggctgacttgtgtctccctagaaattcatatgttgaaaccctagcccccagtattttaaaatatgactgtatttggagatagggattttaaagaggtgattaataagttaaaacgagaccataaaggaggagcctcatctcatttgactggtgtccttatacaaagaggaaatttctgctctctttggcagcacgtgtactaataatataggaaggatacataaaagattagcacagcccttgtgcaaggttgacatgcatatctgtgaagtgtctcatattaaaagacagagaaagaaagagagagagagagagagagaagtttgaaacttcttgaaatctgaacacacagagagacaacaaggatgtgtgtgtgtgtgcacagaggaaagaccacgtgagaacacagcgagaaggcagccatctgcaagccaaggaaagagcctctgaagaaaccaaacttgccaacaccttgatcttggacttctcgtctccagagttgtaagaaatcaattactattgtttaaaccatccagtccgtggtattttgttatggcagcactagtaaactaacatgagatccttctcttgagctccagatccctcaatacaaaagcattctagttaacacaaactgaatgttttgtaacttcccaaatccttgtttgcaattatattcattttacttccctcaaaatctgattctcttcttttattcttatgctgatagttggaatacagcttcccaaccagtttcccaaaccagaaacctgggagttatcattggtacattcagttttttcatccaccaatgttacttgtttaccaagtcatgttcgtgctgcaaatctaaaatccatcctccttctccatatcattatttcccacttaaatgttgtatcaacctccttgctggtttcccatcttactacagccagaataaacttactacagccagaataaatttaaaatgcaaatctcattatgtccttcctttgctataattttttcagtggtttttcatagcctacaaaataaatcctaagtcttcagtatggcataaaatgccctccatggcctagtgatggcatccactatcatctgcctttccaaatctatagtccaggcatcctgaatcacgtggagtttttgaaggttgaataatctttccttcatgcctttttccagccttcccctcattacctgcctcttttatttatttttttttttttctacaggagcctcactctgtcacccaggctggagtgcagtgatgtgatctcagctcgctgcaacctctgcctcccaggttcaagcgattctcctacctcagcctcccaagtagctgggacgcagacatgcgtcaccacgctgggctaatttttgtatttttagtagagatggggtttcaccatgttgtccaggctggtcttgaactcctcacctcaggttatccacccacctcagcctccccaagtgcagggattacaggcatgagccactacgcccagccacctgcctaactgtcattcttctcctacaaaagtaaacacagatgacatttgtggatagtcttacttaaatgacctgccacaggctagcctgatctaggcgctgctccaataacagccatgagacctttgtgtatattagttccctatcacactagcattgcaacagactctttacctgtgagtctaaggcactggatttaaagtctttgaaaaaccgtgtctttgtatcctgagggtccggtatgaattaaataaatgtaaattggcagaagaataaatgaatgaatgaatgaatgaatatatgagtgcaggtttaggcatgtcaaattctatatagaatttcctgagggataagccattagtagacacagctatattctgagtctgagaattttcttagataaatattttcagataaacaccctaatccctccagatactaaattttcccaactcttatttttaaaatacagctgcatccttcaggcaatttattggcatgtctagttagttctgcagtttcacaaacatctaatgtcatggtcaaacacatgtgcccataaggccaaggtcctcaaactttgtattgctttatattacttatattctaccaggtgagtgtgtgttggaggggaagagttcttcttttctcaaaaaagtaaaatagtaaagtatacctttgtaatacaattgattcaaaataaataggccctaagcgtgcatcactttagaaagcaattattttgattttcagtagttttataattactattcactaaaatttcatcttattccagcctccaacagaagttaaaaaaaaaaaaaactttttctacctacctgcagcttttgttgaaaatatgagtttcttttcctgtttttcttacaagtctctcaaattactcaactttcttatctagtaatttagagtcactgcaaattgttcaactctgttcatactactgcggcttgctaacttcctgggtttttaactttatcattctttattgagtttctactgctttttgtttgtttgtttgtttttagagacagggtattgctctgtcccccgagctggagtgcagtggcgtgatctcagctcactgtaatctctgccccctgggttcaagtgattcttgtgactcgagtagctgggattacaggtatgcaccaccatgcccagctaattttttctcttttttttttttatttttagtagagatgggttttcgccatgttggccaggctggtctcaaactcctggcctcaaatctgcctgcctgggcctcccgaagtgctgggattaccagcgtgagccactgcaccctgccaagtttctactgtttcttaatggtgaatgcatgtttatatgaagcatatgcccaattctctggaatacgtataagaatgagttatagagagacttcctgcttgctataatacatacctatttctatctcaggcctgtgtgcaggcagctagaactggagatgtcaagaataggatgacctctcaggttattatgcttgcataaaactttattattcctcgattatctaatttatcatagtattataatgagtgataaagctgttgtccccttgactagtttataagtgagcatagtgtcttcctacttgtctttctattcttttttttttttttttttttgagacagagtctcgccctgtctcccaggctggagtacggtggtgtgacctcagctcactgcaacctccgcctcttgaattggagcaattcttatgcctcagcctccctcacgccactacacccagctaatttttgcatttttaatagagacgaggtttggccattttggccaagctggtcttgaactcctgacctcaagtgatctgcctgcctcagcctcccaaattgttgagattacaggtgtgagccaccgtgcccaacctctctttctattcttagcacaaggaacagcctagcatttatagatgttcaacaaatggctgttgtttaattattttagccagcttcttatctcttgtcaatgttgaaataattttatttaactttttggtagggtggaatctttttttttaaatgcttcctttttatttttgcaattaaatgaatgtttaatcattaactgtaaacccattttggatggattttaccatgtttagttgcagtttagacatcactcagtcccaccatactcttgctctgcatcactgaatttattgcaccaaattcagttcctagctgtctttaaactgtatggactgttagtatttcttggttatccatatagtttggaaacctgtctcgtattttcttcctctggctcaaaactatatttattcattttagaatgtagttattgtatattggccacaacttcatatttctattgattattataatctgattcatattaagatagatatatttcaagatatcaaagatgagttatgaagtgaacaaaagtcctgatcaatgatttacatttcttctgggaaatactgtacatctatttgccatggtaaccaggcttgttttcttacaccatttctttcccttgcatctctggcctgtttcgaaatgtaatgaccaaaatgctaactaatacaaccatttgatgatgctggataggaaaaagaaaaaaggcatctgggtagccacaatctacataagaactaagcatgcactttcttttaaaggacttatctgaagtgatctaattggctgtgttgttgaaggacagaaacctgagatcataaaatcataactagtgaatttgagttctgattaaacattcattaaatccaatgggtaatacccacgaaaaatcaagcaagtgtgtaatcacagtaacttgaaaactgctattcttaatctcaggaactctatcagtgatcagcctgtcaggacttaagagcagagggtgactagcacaaagtctttggaatggaataaaggcaagaatcacaagtaaaggacctgctagaatttagagacagtgcaatagagacagtgctaccaaaaaaaatctgtgaataaatggaaatgcaaagtatttgcatgacttacatcggggttctttcagtagccagtcaccttggaatgaatcagtaccagggaagagtaaaccagtaaaccaagaaactgatgatgagaacaagagaagagtcataaaataaggtgatgaacagaccatttgtgagtcccaaaggttccatatccagctagtctttgtgaaatagttgaggatagaggtggatctgctgttaagttgagtttctgtgaccattggtggtaagaattcaaatatatatatatagatatagatatagatatagatatatagatatatagatatatagatatatagatatataaaatactcaatgctaatttaactgttactttaaattatagaaatctgaatatccagaagatagaacataggatcccctccttctgaagacatcaagagtataaatcagatgaaatctgtcagtctttgagacttcgcctctgatgattacatgtggtgttaatactttcatttttgctttcaaaatgctgttacttcaaagactagcttctgaaggagaagattgcaatataaataagatatttaattcctaaggtgcctaatgtaggcttatgttttaaaaggagattcaagcttatttctaggtcagtaagaacatgtatagcaactgttgttttagggttcatgaaactaatcggtagtctgtatactttaatcaatgttgcatctatatcctttattgagaacataatcattaatttgtgggccaattttgtggaactgtcagtggaatagatggcttttatgaattgagaccaaggctgatccttcaagccatttactgcaaataataagccttatcagaacagaatacattcactgtgttacatttaaacatcataatgattcttgaacataaactctgagatggttagggggttctgaccttagcaagaacatcgcttacatttatactagcatctaaataagcatggtgcattcccaatttcctgtatgcattcaattatataggactcagtactgtaaaagtatgtttattaatccatggagctcttctaccgtaggtatgattatttatatatatatatatatatatatatatatacgcacacacacatatatagacacatacacacatatatatacacatacacacatatatatacacattcatatgtgtatgtatgtaagtgtaaatgtatacttacatacatacacataaatatacatataaatattacatatacatacatacacataaatatacaaaatgtaaatgtgtatgtatgtaaatgtaaatatacatttacagttcattacacacatatatatacacatacacacatatatacacattaaagttcattacacacacatatatacacatacacacacatatacatatgtgtgtacatttacagttcatgtatctatagcacttacactatatataatgtgggtgtgtgagtgtatatatatatatatatatatatatatatatatatatatacacataaacacacacattctctatcaatgagggcttattgtgaatataaagtccagtttcagcttgagttgtgtatatgtttacattcacaacataaagagttctgaagcttgacccaattgtgcttgactttactgttatacttgtaaggtaacagtactttctaaaatattgatattgctcttaaacattaaactcttcgaagatactaaatgtggtacagaatatatacagacaacatgatgaggcagttacattgcttacataaacagtgaactttccatatttggatatattttcattgtgtatatattattccatctggtagcctaccctgaggctttattttatcaccctacttgtcccataaagattcttgagatttttattgaaagaaacaatgaaaatgctaattagttatatttttcatcataatcttttttttatactaaaggatctctctccttttttgtttctgcttctatatgctatttccaatgagttttgttgccccaaagctatcatttttaggcttctaatattgttttctgttcacagggcttaataactactttttaatggattctgtttacctcagaggcaggcattttggagaattcagcttatattagggcagaattaaaaaattctatgtggctttgggggcttcttccctcagaaaattaaaatggtttaatcttttgactgaaaagggaactgacatgattccttttaaaatgagacattgggatttgaaatggatcacaaaagtagacaatcctgcatgtatttaaatgcatagacagcatattttatgcacataattattttggctcttttaattattatttcttacctgcttaaaaaaatggctgcctaaccaagcactggaagttgaggttctgttgcttcaataaaaataaccatggagtccaagttccacattctttttaaaagcttcttttttgacctaaaattttctccatttctctgttccctttagtcatgaaaagtccatttcacaactgaattaaataatgctaaatttagtacccaaaaaggggttctttaatttattcatttgctcatttaaacacgcattgctctgtgcccctaatacctgcatagattgatgggaggcacaaagggtcaccttttcatagcgtggttagtgatacaataaggtaaaggaaaaagtcagagacggtttagacttgagtagacatagataagagaattaaaagggaaagctgcatttaattttagagatgattaatttgcatgagaatagttgtcacctacaagacaatctaaaggagagcattcattaactgatataagaaacaacagtcaccatctaccagaaatttttatagcccaaacaaggtacaaacggggaggacattgtgctagaagttggaatagaaaatatatgatccctgcctctttgctctctggctgggaagacaagattaattccagaaagcattctcttcactttctctccaccttctcactccctggccctttgtcagtatttctcttcttctgcactcatcactatctgccttgttttagttattcctacatgcacatgtgatattcgtgataccagactgtgaaccccatgagggcaacaactgtttcatcgccgtataaataaaaccaggcagcattccttacaacagagaatgcataacaaatattagtgaatgaataaatcaaactgtaaagcaggataacatatgctaatgccacataaatgggatctttgatcagatgtcatgttagcgaggccttctccagccacccgatgcatattgttcctctggcctaccatctctttaaccactcactctgcttcattagcaaaattcttattgctgcctttcattacagtaaatattaacttattttcagcataatacaatagtatataagctctttgggagaagggaatttgttttatccactgccataaaaatcccttcattttagagcactgcctgacacaaagttgcagtccaatatttgttgatcaaagaaattaagaaataaaagtatagggaatagtgataatttttgttttaaataagttgatttaagccatccaatacccaaatactaaatgagaaggagcagttcccttatgttcttaaaaatcctgagtgacatgctaacataatacttacatgtttgtttaggtattgaactatcaataatatcattctttaaggagaattcctgtaattcacatccaagaactgttttcataatttgaacaatttattcacatgtagtgtatctgaagccatataaacaagcaactccccaaaggagacttatttcaaactagcatttggctgggatgcgtagtccctaaagagttgacattgcccaggaatattcatttcagagtgctggactgaggtcaggattccaggacctctgctgctactaaataacagatgtttcagtgtctcaacttccttttcactagctaggggtatgggggatatagggatggcataaatggattctaaaatcccttccagctgcaatgcttacagattctattattgatagtaaggatgattttgatggaggaatggggaaggtgacgggaagcagcaggataatcacattccaactaaacacatgtgctctgtaaccacaattttttacctttgccaacatctggtgacatttctgatagaaatacttaaaatgtgtcagtaacaaataagttctctctctctctctctctctccatatatatatatattcaccaaccacaaaatgaagaagtatgtattgcggtttcaataggaagttaataaacttccttctactaaatttttatgtatgtaagtgagttttaggctttctaatttatcttcatcttttaatcataactattcacattttctttgttgaatatcaagaatcctgcttatcagcagaatactatgaaaaaaacagttgaaatatgtgaatgctggttttatatcagaaattgaggattatttttaataccatataaagaaatgtcctttaccgaatgtccatataaaatggccttttttcatttcctaataacataattaggctaactaagcagctaatactaacttaaagataattaaatgaaactcccaaaaaggcatagttaaactctaagtagataatagttcaatgggaaagatactgtttaaaagcaaatgataaaatcctataaaatgtaattaatatgaatttgctttaattgtagttgattgtctcttttcaaaaacatgctctcgaatactgagagaacgtaagttatcataacttgaacttattcatttgatcaatgcaatagtaaacttccctcattttcttttttacaagttaaggaacataaatataatttcacaagatttttatgttttctctaagtgcagcttgttttcattacataagttatttctctcagggatgtatggaagaattaaagatattaataaacatggggtattaatacacaataaattatattatcgagatatttaaaataaaaataagtagtctttcaggtacattttcagtaatggtcacatttcctaactgatagaatacagtgtaaattaaaagccaggactagtaattcaaaaagaatgtaaaatgtgttaagattccttaactgtgctattctttctataagacaaaaatacatattcaaaaagtggaaaaactccattgaatcagccagaaattaccagtgttctccaagaatagtatataaactggtcctactaatcagccatttaatgattattgaaagacagtgcagtctttctgtactgcaacattatacagtgaaagctgaaaaaatacttcagaaatgaagcaatgacaagattatctgaatgggaaacatgttgctattacacattcgttgaaatgctttagctatatgtaacacaatagccggttaaaagtattttaagaaacagttgtttgttgtctctcttaacaagaactctgaagttaggcagtttcatggttgattcagcaacttaagaatgcttgttccacatttctgctctgccattatttggtttgttggtgatattcctactcagggtgttaaaatgactacagcagccgtaagcatcacatgttcatagaacaacttgcaaagaataaaggtcagccttcccaagtgtcagggacttctagaagactccccaactatgctgttggctaaaacatctttacttgtccattcctaaacaaatcattgccaaagacagatgggattggcatgactggcttagacaatatattgatttatctcatgaaacactggttgaatactacttttttctgagcaaagtttcgtatcaagcaccaagcatcatgcctttcatcctgtgcatttttgatgaataaatgaagaaatcctatggtttttttatttgctttttctaatggtgtcattacaaatggagatggaggaggtactccagtctactatgatcttactagttggcatttattaaacaagtcagcaggaggatgcaatagtaatgatgagtatcctagagaccctgttgtgtagtgttgaaagatgtcagtagaactcagaagagctttatcttctgcaaaaagaaaccacaatagaagcactaatttgaaagatgctggtagcatttctatagtctgtgcaagaaatagacactcaaaaccaatgtgaaaagttctgttttttaatattcttagcaaaaggaatatttaaattatttaagtaatagcataactggcatttcatgcatgtacaattctaatatctaaacatgattatgacattctgtgtctagagagaaaatgtgactaagaggcctgaaaatttaaggatagcagtatactcaatgaccagatcagaatagcatagttacaacaaaagtaagttataatccaaaaaaatagaaaaataaaggattagaatcacctataaagtctagatgatcaaaaatgcaaactctttcattttttttttctttaagagaaatgagaagtggaaatagcatttcagagatgcatggacttgaagtcttaagagcttaaattcaagggaattaatggtaggaaaggcacagtaaacagagatggttccattgctgctggcgggaaacagccttgttctttctcttttcttttctttttaatgattctctggcttcttacttgagccattgggataatagggaccatctccaaatagagcctttatttagtaaaatagttgtaataagaaaatggagtacttcatcatcacctgaaagcaaaagggatacggctgactacaaggaaagcttctgtcatcacagagcctaattctgaacatgagattaagctctgtgtacgtgctagtgtggcgttattcctggggccttcagaaacagcaagttcacgtttgctaaaatacattttatgaagttaaagttagcacattgtatttcagtgccttaggcctcatgacttaatctagtacacgtaattagaagttattttcaatgaagacaagattaatcaggagaaaaaagtacaacatgtacttctggaatattataacaagatatgtaaatttccttcttggtgataagtgtagcaaattgctttatatttttcaatgtatttccaccagttttcattttaagaagttagaggatattgtaatacaagcaacttttggcaacacatagactctgggtagaccttaagcgtctctaggtagttactttgagtagcatttggtagaccttggggtagagcttaatgcttagaaacagtttacagcagggctcctcgattaccctattacccgtgggtccagggcctgttaggaacaaagctgcacagcaggaggtgagcagagggcaagccagaaaagcttcatcagtatttacagccactccccatcactcgcaatatcacctgagtttcaccttccgtcaggtcagcagcggttttagaatctcataggagcacaaaccctattgtgaactgtgcatgtgagggatacagattgcacattccttatgagaatctaatgtctgataatctgtcactgtctcccatcactcccagataggaccatctagtttcagaaaaacaagctcagggctcccactggttctacattatgatgagttgtataattatttcattatatattacaaagtaataccaatagaaataaaacacacaataaatttaatgcatttgaatcattaccaaaccattatcacattcttggtctgtggaaaaattgtcttccacgaaattggtccttggtgccaaaaagtttcgggactgctggtttacagcaaggctcagaagtagcaacatagatgagtgctgataaagttggaaactctgtacatgcctaaaacaagactaggagagagataagaatccatctttctactacaagaactatcacccttccagatttggttgttattaaccggacagttacctaagcactaagatcatatagtctctgaagattcttcagcgtcattagaattttgagggctaacatatacaccagcgcatgagtctgtccaggttctcacaaacacttccctcttatcagattacaatggaagcagagcactgtggcactaactaggaggttgatatgttgatatcggatgctgcagtgtcagtggcaaaatttggtactctgagataaacgatttcacagctgaagacaggaaaattcaaagttaggtgtagccagcacctgctctatgagctatttgtcactgtggagtctggctttcttcagaatggcggtgtcaactacatatttgctatcacaaaagcagttaaatttctactccacagccttacttgaatcctgataaaatatattttgttttacataagggagaaagctctctaaaaatgaagaaagaaaagttatctaaaaatgaggaacattctgacaaagacaaattattttagaactttctcctaatatgaataagtaaaaagcaatgctattctgatgccaagagaagctctttcttcctgaaccctggtgggcagaagttgtcctgtgaaatctgtttctgcctttatctatgtccctttgaggaaagagaagcacaattcctagatctcacagagcacattcaagtgactgaagatcctccccactccccaaacacatgcctacactaaacagaatgcagtcataaaagtttctctctggcaaagaaaggcattaatacttaaggggtatacctaaggatatttaaatggaatatgtttgtgtttctggcaccccacataagaacccggattctaaatttagattaaatggtaaatggatatttagattttttccatatcttggctattgtgaacaatgctgaaatgaacatgggagtgcagatatctcttagagatcctgattttaatactcttagatacatatgcccagaagtaggattgctgtatcatagtggagttctagtttcaaatttttgagaaacctccataatgttttccatagttgctgcaccattttccacccccacgaacatataatggaatattatttaacctttaaaaagatggaaatcctactgttagcagcagcaaatccatacagttctgcagcgacctcagttcttgcctcctcagaagaaagaattcaatggagaggcataagacagagttggaggcaagttttagagcaggagcgaaagtttattaaaaagtattagagcaagaacaagaggaaataaagtacacgtggaagagagcaaagtgggggacttgagagattcgagtgcatggtttgacctttgacttggggtctcagatgcaagcattccacatgcatagtggcctgccagcacctgggaagggctacaagcacagggtgtttactggagttgtatccatgctcacctgaggcattcttcccttaccagttgagtgttcctagaaaaaggtcatataccagttaaactctgccattttgcctcttagtacacatgcttgagtccattacccagctcctgagatcttatcaggaaaccgctgatcactagtttcatttgtttctatctattggaagactgcctttccttggcaccggttgtgaacaattattattttagagagatagcataacaaccacctgacaatcacctgatggtcacttgacatttctagtatgtgtgtgtttgtgtgtggaggggtcctctcctaccctgctcatgtctgcttgactacctactataacactaccatatgcaacaacatggatgaaccttgaagacattatattaagtgaaataagccagacacggaaggacaaatactacatgattccacgttcttcttctccccctaactcttggcaaccactgtgctaccctctgcttctataagtttgactgcattagtgtccagtggttgctgggggttaaggggaggaagaaataggaagtcgatcttcagcagatataaactttcagttatggtagattaatgaattctagagatctgctgtataacataggcaacagtaccgtattgtacactaaaaattttgttaaaaggataaatctcatggtaaatgttattaacacaattttaaaaattaaataagtatctaatgaaatgcatgtgctgattagcttgatttaaccactctacagtgctcacatatttcaaaacatcatgttgggggcaagcattggggctcatgcctgtaatcccagcactttgggaggctgagttgagtgggttgcatgagcccaggagtctgagaccagcctggggaacatagtgggaccccatatctaaaaagaaaaacaacataaaaaaaccccatcatgttgtacataataaacaaatgcaatttttatttgtcaattcaaaatacatttttttaaaatgataaaacataatactaatcaaactaataaactaaaagtgtttagataataatgttacataaatatataattataatctttgtagttaatgaaatagggattgagatttacattgtaaaacagacccttctttcaaaagtatctcttttgttattgaagttcagcaatttaattgtactcttgattgcataataagggtagacaggtaaatatgcagtatgaaaagcattcagtgtctagtttggactgtgaggctaaatccccactgcaacctggtggacacattcttgagtctcagattcagtcacacacatgggtgaatgtggctttcttaacaggtaaagctgcaaaactaaagccaagctatgtacagatatactcattcctagtttatatttaatgtaaaaaattgcaaataactgaagtgtccactttagcaaagggttatgtaaattatactctatactaagggtctacaaactttttctgttaagtaccatatagtaaatattttcacttttgtaagccacactgtctctgtcaaaaccactcagctctgctgtggtaacaagcaaacaatcagaaaagacgcaagcaaacatggctgagtttcaataaaatttcatttatcgacactgaaatttggatttcatgccattttcccatatcagccatttaaaaatgtaagaatccttcttagttttcaagtgatacagaaacacgagaaggaccaacttcacccacggtctgacctttgccactctgctctatagagaggaccttcccaggccctggagacctgacatcgcacagataatttgttgtcctgatctccttgaagcttctgaacagcaaattaagctgccacggatttgttagtgttgatcacttgttcagcacagtcttgtctgatggagcagagggaaaacgcttaccatgtctatcatcctcagtttttgtttcaagattcttccatcttgatctcatggcataatcctctaagaaaaaaaatgttaaaagaacaagacttaagcctggttatgattacaaaaatagaagtaactgtactgctctaaagatgtacttttgtctgtatttcccagtgttaagagtatcaaaaatgatctccttttagaaaactgagcaagaggaagggaagccttacctcatggatgccagtaaccagaccctgaaaatgaaaataagatttttgcagatgagataactctgatggattcaaaagaagactccacatactcaattctctcttccaattggtgccccctctgcatcactgttcttcagttctttagagagccttatcatggctataatacacacagagtgtcactgtagtacagggtcttatcttatgagaaacaggagtgtgagcagaaaaatgcacagtagtgggccgaatttggatattcacttccaatatcacattgcatttttagtttctggacacgaaaaatgcaacataggacacaaaataaaaatattccacaagcacaatacagaataagaggaaatagtggcattgttttctttttgtgtcatcagttttgaatcacggtaaattatgctgcaatacaaattttatttttttaaatgttgatgccttaaatacatagattgaaatagatatttaattttatatttaaagtaaaatggttccatctcaataatctgatttcatagattgctttccttttgtttataaagactatgtttataaagtcaccatttacataatttaaacctaatatttacttgaaatacacataacaaaccactagtcataaaatgtaaaatgcaggttgtcctttattttatttttggatcaataatctggtttagtaattatgatttatatgataatttagacataaatcttcactatccctttctctgaaactacttagatagcatgcttgaacattgtgcttctttgtagcacggaatatgcataagcccagttccttttgcagtcccatttttttctccttctaaagagaggtcatactgcctactgaagaggcaaatgaaatgagggcaaagactaaacaacttttaatttagggaatattctccattaatgaattccccagagcatccttcagctaagccacgggcttctcattcctctctatcagtattggggagttgaaacacttacagagtatttgctagtgcctgtctctcaaacccattttgccagctggagagaagtgtgtagaagttctagtcaaatcagcaattctcctggaccctttctgatttctgattttttctcctgtaccttgtaaatcacagcacaaacctttctttgtgattctggtattagaaaatgttttcttttttcaaagatcacttttttatttaagaaatggaaatgttatttattggttaaatgacaagcattcaataaacaattatgtgccctagtacttgtctatgaagggctaatatatgacacaaatataaggcatacagaaaaaaaataccttctttagaatggcttttaaatttgctttattatttttaaaataaagacatacatacatacacaaaaatatagttctattactttttatgtaatacttcttataaagaaagaaaatccaccaataactctcaaagaggtcctgaccttaagtatttaattatttccaaatatcaccaaacgagtggcatcagggcagagaggagaaccacgtgcttgcacagacatgctgaggtcagctagcagtggcaccagagctataacaccatccagtgacataccctgtttgcatcactgacacctttttctttgccttcccattcacctggtgaagggcaggacactggaacagatgggtgtaagaagtgaagtagaaacacattgacaagagttagaatgcattttagagtcacaaataacaagctatattcctaataatcacattgatcatattgataaatatttattgaccacttccatgtgctaagcactattctaagccatgagaatacagcaatgcataaaagagacaaaacctttgcccttatggatcttacattctagtgggaggtgggagggaggacagatgtatgcaaaataaaaaagtaaaatgcatagtatgttagagggtaatgcatgctataaagaaaaagaaaacgagaatgaggataaagagtggtagggagcgctgtggatgttgaaattttaagtagtgtggtcagaaaagtctacaccaagaagatgacatttaagtaaatacttaaaagtagggaaagagaagtccacgcaagtgcaaaggtcctgaagcagtagcatgtatggggtctatgaggaacagccaaggagttgtgctaacactgagtgggccagggagttaaccagatcaggtaatgtatggccttgtggaccatcccaatgactgcttttacctacagccagattggaagccagtggaaggcttgaagcaaagaagtaacagctatacaatatttctaacatctgctgtaacaggatctctttggctactaggctaaactagacttggagagacaaggcagaagcaggcagagcactcaggaggctattacaatcaccatggggggagaagatggtggtttgaaccagggtgttgccaaaggaaatgtagggaagagattggacagtaaatatatttcagatattaagctggcatagttttctgacagattggacagtgactgtaagagacagaggtataggatgactgaggtttttggactgagcaacttacagatggtgctaccttcaagtaaactgggggagacagggaggaacagaatgaaggggaggattaggagtggagctgtggatatgttattgttgagatgcctactacacaccaagtggagacacataggcagttggctatgtgagtctagaacccgaggaagaggtctaacctggaggtacacatttaggcatcatccaggtataaatattataaagccagtgactagatgtcatcaacaagggaaggagtgtgaatatcacagagaaatggtgctgatactgggagccgaatcactccagtgcaaagaagttgaggcaacaaggagactaagaagcagagaccagttaggtaggaggaaaataaggagaatgcagagtcctaaaatcaaatgcagaaagaaaatgtttcaaggaggaccttgtggtcagctgtgtcaaattctgggtcaagggagaggagcactgtgaaccgaccttcagatttagcaatttagagaacctttaaaggagcagttttggtgaaatcatggggtagaaagtctcactggaatgcaacagagagagaatgaaaggagatgcatcagcaatgacaattctttcaaggaatgtgctgtaaagggagggagacaaatgaggaggtagctgagaaaggaagtgaagtcaaaggaagctttttcatttgtttggtgatgggcagtgagaagagatgtaacatgttcgtgccaatattacatgaagtccatctcctagtgcaacaaagatcattatggctgaataatctgtaccaagggcaacttccaaaatgatggtccttgactgtggtgcttggggaccagttaactttaaattccttaatacaaacttttttttagttatcttttatttttctcctgcaagtttgtccataatatagtcatttactataatgacagaaaatgttaaactacattatgttgatgtaagataaacacaccaacaggacccaaattcctcaaccttggcagactgggtgaataagaaaaagaggtttcccaggcacagtcctttaatacaaagttaatctcatcctagattccaaggccccctgcaaagaacccatctcttctaggattaacaagaaaagaattattattcaataagaaagtgtcctactgtttgggactgctgactcctgtcactttgcagcaagtacgctcacctcgatggggactttgagttctctattctctccaagccagagggcctgggagaggattcagcccctgtggggcatttcacactgtgaagctgcctcagctctactcattaagatgaaactcctatgaaagaaggtgctttattttctattgattggttgtaatgtgattgaacttagagtttctgaacaacccactgttttgaactccaaggtacattttccccgcaaaggaaaaaggaattattattcatttaatcaaaggaagagtaaacctaccaaatcctactaaaacaactactcacaaaaaagatgagccaatgaagcataaaatagaaacaagaagtagaattatttaggttgtgatgtcccttattcaacttcctgattctaggaatttcaaagtacaggagtaccaacattcatgtattttcaagcttaatataccaaaacataaacatttgcactttctattcattttctgagttctactctagcatagtttatttttctgttggtatatattgaaagggaaaaaggaaaagatattaataatcatactattcatcctcagagcaccacgtacttccgcttcgtacttaacaggtataattcattacttttattcatgcactgctttgattaatgtttgtctgtcttattaggtggtgagctgatgaggacagtgatcgttctccctcctcaaggcactgatttatttttagtgccaaacatagtacttagcaaatgggaagtatttttatttttaaaaataaaaatatttttaaatggataatgaaaaaaaattgagaggaaggaaccaaagaaaggaaggataaaaagaaagagagatgaagtggaggaagagggaaaaaggaaagaggcagggaagttaactggcttccaatgtgtgattattgcagatctagctctgtatttgctattttatatgcaccaccccaattaatcctcacaaaaaagtattatcaagcctattttacagaattaagaactgagacacaaaaaggttgcagtcacagcactggcatgtagcagctagaccatagtcctgtctgaatctgcagtggatctgcctctctcctttctgctatactggagcaacagaaatagcaacatggcagagaaaggccagaaaggagatgaaaaatataaccatctgtaaatagaaggatgcgtgcggtggttcatgcctgtaatgccagctctttgggatgccgagatgggtggtggatgcctgtagtcccagctactggggagactgaggcgagaggatgcttgagcccaagaagttgaggctgcagtcagctgtgattgcaccactaaaagaaaatagacaaaaaggatctttcctgtctgctttgaaggaattagactcagaactgaagcttgacaagccatgttgatgcctcctttcctaagcctatttgtgtgtagggtctctggcttcctgcaataattgtcttcatttcccagaattctgaaaaagtttggctctgtttcttatcaacacactttggtggggcggagccacctcagcttgatattttaggatacaacccttttaatgttggacacctatatctagatataggtgatctttacaaagtattgtcatgtgcatgtagactgtatagcgtggcacctgggtttaattaagacaggcacaatccataaataaataatgatgacttataaatcctttcttctattgaaaagggctaaatacagaaccaagttggaggaccggcatctcttcctatgcgagcctggccatgtataatgacaagtccaaatgaagatgcctctgttccagtggaactatagatatttttttcataataatgttgtactgcctccaattatgaaatgactacatctaaaaggggttagaaggaccaccataattctatttcatgttgacattattacccccaatgatgcctaccacactctgaggtgtttgcccttgtgctgtactggtaaactggctaacgctgaagttgaccgtcagcattgggcatactcagaagtatgacctagactaccactactccctaaacccattacctgtctgtgcagtgacaccaatccagccatgttttattatgtttctctacctttgctccaggttggaatacagtttaatattcctgtcatttctccctaacctcaacctcaagttccagtttaaatctgacctcctttctgaattactgtagcacttttggtcttctcctccttggccaacctcctctgcctaccacacacattttagcaaatactgtaaactggattgatgactagatccttgatttcccagcaaagtttgcaaattccttaggggtatagttcttatctcattactgagtactccacgatgctaaatacatgatgtagcatgattttgttttataaaaatcgaaacagaaaaaaagctcagttcaaactgttatatatgtatattagttttatatatattatatatatattagtttgaactgagcttgatatttcaatggcttgttttatatatgtatcccataagtttactgcctgacttgcccactttaattttaagaaacaacaacaaaatgcagaaaaagtatgtttgtccttaattataagaaatatttggcaatagaaaacatgctaagtttaatattttatattttctctgccaatgagactatgaaatttcacactttatgtcagacatattttgtgaaggagtgccagtggattgtcacataagctggttgtctactataatatctgatgctttttaagaaggagagtaattgggttagatttaaattagtgtgtttttagtaatcctcaaatgtatatgccttcaagtgaaactataatgaagaaaaggaagaaatagcaaatgcatatgtgaacttaataaatacatttgttgattatgatgatggtgatgatgatgacagcggaaatggaaatttcattttcttcttctacagaaagccttccaatccgttccctctgcacttaaagctattgatttatttattttttactaaagtttgtgatgatataagattaatcagaatgcaaagtatctcaaagtagaaggacactgagtagtttatagatggaagttgattgaccactgagtagtttatagatggaagttgctatgagttgatttcaaaaagaggtgtaaaatgaaatgccaaaataaatcaaagagtcaactaatcctcatataaggggcaccactgacttgagtttcatattacatcaatccttttatttaatagcttcaatggaaaccactcctgggaacatcaaacaaggcagccagccagaaacgtcattatcccaagcaacatttctattgcataaagctacttaactcaaactacaatttattttcagaaaaagctggttttacttttcttggacaacccaatattatattattttccataaagattgcagacaaacatacttggtcggtaatgaataggtaaaaggaaatcatttcactgtattaaaatacattttttcctcaagagaaaaatacagtctgatctgaaggctaaatgagcattttgctaagactgccagggccaagattactttagtcattcccatggccaattaggagtgtccttcaaagatcctacccagcatgtattcttttgatggaagtattctgtgacttcttaggttgtactgccatactaaatttggccatgttacaaaactgtgtgaactaaacccaaaccataaattgtattgtttgatcaatgctatggtttgaacgtgttctccaaagttcatatgctggaaacttactatccaatacaacagtgttgggaggtggggcctaaaaagaagtgattaagtcatgagggttctgctatcatacatggattaatgtccttaccaccagagtgcattagttactgtcagaggttcttgttatgaaagtgagttcttcagccaccacttgctctcttgctcttgcgttttcttgcccttctgtcttctgccttagaatgacaaagcacaaaacccctcaccagatgccagcaccatgctcttggacttcccagccttcagcatcaggagccaaataaacctctatagtttataaattctcagtctcaggtattccattacagcaacacaaaatagattaaaacagtcagtaaataaaatgcttctagatcatcaagtaaatctaattaaatattttaaaacttagagttccatatatctgcaaataacgacattatcttctttttaacttgagaacattcaattttacacagcttttgaatctctgagtcagtaaaacggtcatcatttttctcccaggaagagaacatgttgaggggatcaatcttccctaagcactaataaatgagtgagttttcattctaattacagatatggtttatgtgttttctcctttcagctgtgattgctatagggtaaagaaatcagaggataactttttatactgcaaccaataatttttgcattacttaactaagtatctttccagttttgatttctcaaatgccaaccacttaaaagttaatattttaatgttttttcttcctagatgggtaaaagaattcccttttagatttatctaggtatgtgaagattttttttattataattatttgttttagaaactaaagtagagcttgaggatattttaaaagaacaccagaattcctcataacaaagagtccctagtctgatatgctaaacaggatttaacagcttttacagagtataatttttttgctgtatactttaatatgaaattcatgcatgtgatgatatacagattatccttcagagaaattacataaaaacatgaaaggatataaaatgcaaaaatgtagggaagcagtaagtttaccccagtggaccaactgcaagagaataaaaagtagaagctgtggggataatgataagataatgctaagaacaattagcaaagctatgacatagagttaaagtggaagcaccacgccactgaacaataaaatataattggaaggacctaagattgaagaaatattcttaacattatgtatcaagtggtgtcaaataaaattagtggacattttagaaaataataaagagacttcatttactggtcacccaatcgtggtcatagatttttaaacatcacatcactatatgtatttcttttaaaaatgttaaggaaaatttatttatattaactgtaaccctcatattttagggaagcatatttggatatatagatttgccctttttttttttttttttttttttggcttgttgcccaggctggagtgcagtggtgcaatctcagctcactctaacttctgcctcccaggttcaggtgattctcctgcctctgccttctgggtagctaggattataggcatgtactaccatgcccagataactgttgtatttttagtataaatggggttttgccatgttggccaggctggtctcgaactcaaccttttatccttttaatacatttggagaccctttgtctctcacagagcatctatagcaaattacttaagagcatgcatactggagccaggtggtgggcttaagtttaagctcaattgcttgctaataaggaaattctggacaatgttctaaaactctttgtggctcagtttcccaatttgttacatataagtaataataatagtgtccactttacaagcttgttatgaggattaaatgagatgatacatataaaacagtaagaaaaagtgcctggcaggcattacactgtcagtcagtttcagctatttgtgattactatgagctataagctagtctacatactatttcaggttgaaataatgaaggaaattattcatgcacaaaatcattcaacaaatatttgatgagtacctactggtactagactgtgtcattaattgagcagattagtgcaaatcctaatgtcagacccaaaaggtagaccagctttccagatcacagttaccccacaaaaggaatttggcaatagattctgctatgtatttcatccttaccaccaataaatcagctgtgttctttgggttcaaaagatgggaaaataagaacataccactgtgacttttcaaaaattcatgtaggtatttctgttatatttaaaaagtctttaaatttaataagaatttaacttattaaaacaggagacttgttgagatgggagatgattaaagtctagcacatgaaaatggtattaaatcagccgggcacggtggctcacgcctgtaatcccagcactttgggaggccgaggtgggcggatcatgaggtcaggagatcgagaccaacctggctaacacagtgaaaccctgtctccactaaaaaatacaaaaaaattagccgggtgtggtggcgggtacctgtcgtcccagctacttgggaggctgaggcaggagaatggtgtgaatctgggaggcagagcttgcagtgagccgagatcgcgccactgcactccagcctgggcaacagagtgagactccatctcaaaaaaaaaaaaagttattaaatcaatgaataatatgtccaaattatggatcaatttgcaaaggttaaggaaacattcattcctttattccaaagcatttcttgagcttcttatttgtatgagtcactgtggtaggacccaaatatacagagacaaacaaccagaagctttgctcaacagtgactaacagtggagtgggaatgttttacaaataaattagtgacaacacaaggtgaaaatattaaacacaagtattaagttgttgttatggagacaaagagtaggaggacaggagagaaaaatcccccaagaaggtcaggaatttccaagaagaggtggaatttgttattaatcttaaaggatgaatgaattttccatagcaaagagagatagagaaggaaaatggtgatgtcagagaaatgtcaaatggtgatgtcaaagaaagaatactcttgaaggaagagaaggcaacagtttgacatttgacttgggtaagttcagtcttagattggtaggtttttgttaatgagtatagaaatacaactgtcaatttcaggtaatagaatgtacaattatgagtcatcagaaaatacatgttatgtgaacccttgatatacatgtttatgtaaaagatataaagaaactcatggtagaaccccaataaaaacaatatttcgggcatggaggaagaaaagatacaagtagttaagaatagggtgtggctgctaagttggaagaatcaggacaagagctctcatggaagctgaaaattaagagagcttcaggggtgatattgaaaacagtgggaaatgccatagattggtcaagaaaaaaataaatcagaaaaaatatgagtgggtttagagtaatcttttacaaagtttatctctaaagaaaaggatataaatagaacagtagagtagatgagcattgaatggtgaaaagagggttactgtttaatggcaatgtttagagcaaacatatgtactgaaaataatgagcccgtataaagggagaaaattcatatggctaattcatataagtttaaacacttgtaaagttatctttgttcaactaactcccctgaagttgccccagaccttattgaagctggtgtgacacatcttaactgagagacagcctgctcaatttacaaagccacatttctatttgtggacgtcacataaggcttaacatcataaacaggctatctcttagtcttttctttgtttgaagccaatagcccatttagatatgctcttacaacccatgacataaataatcatcaaaacattatggcccctttcaacatcaaactttggagaatttaaaaaatagaaaaatttattaaagttaagacaattttaattgctgggcaaggtccttcatgaaataaacaaatgttgaaatcaattctttcagttctctaggtgtagtacaagctgttttttgatggttaagatttatttgttcagtaagtatttattgaacatagatttctaaagagtcatgaaagggaagacaatagctaataaatgtaatgctaaaaaatgtctgtagaatccattatgctctgtgtcaagcttagtttaggatgtgtaacattaaaaagatagaagtatatttgactcttacataaagggaagtagacagctgatgtgatgactccataaaatcttcagggccccaggctctttccatgtcattactctcctaccctcagggtgtggcactggtactcgtgggtgaagtaggatgcgggagttccagcttttacatttgtgttcaaagtagcagatgatagaaaggggaaaaataaagaagttccctgtcccttttaagggaagttcacaaaagttcttttcaacatttctgcatatatttcactggccagagcttagacccatggtcatagctagctggactaataacctagttgaatggctgtaatgcctagctaaaaaaaaaaaaaaaaaaaaaaaaaaaaaaaaaaaattagaattctagttctgttactaaggaaaataggtgttagttttattaggaggtaaatagcaatttccaccatatttaaagtcttcaaagctcttcctgcctgatagggagactggaacaagaagcaaagtaggcgctaggtgaatttagaatggaaattaggatagccaagtgctcatattcaaaaggaggctcatcttttctaaatcagttgcctgggaaatcctaagcaaaaataacaaagctggaggcatcacgctacccaaattcaaactgtactacaaggctacagtaaccaaaacagcttggtactggtataaaaacagacacacagaccaatgaaacagaatggagagcccagaaataaagccacacacctacaaccatctgatcttcgacaaagctgacaaaacaagcaggaggaaaggactccttatttaataaatggtgttgggaaaagtggctggccatgtgcagaagattgaaactggggggtgggacccctccttacaccatatataaaaattaactcaagaaagattaaagacttaaatgtaaaactcaaaactctcaaaaccctggaagacaacgtaggcaatgccattctggacatagaaaaaagcagtgatttcatgatgaagatgccgaaagcaattgcaacaaaagcaaaaattgacaaataagatttaattgaactaatcttctgtacagcaagagaaacatcaacagagtaaacaaacactccacagaatgaaagaacattttcaaaaactatgtacctgacaaatgtctaatatccagcatctgagaggaacttaaacaaatttacaagaaaaaaaaacattaaaaagtgggcaaaggacatgaacactttaaaagaagacatacatgtgaccaacaagcatataagaaaaactcaacatcagtgatcattggagaaatgcaaatcaaaaccacagttagataccatcccacaccattccgtatggctattactaaaaagtcaaaaacatagcagatgtttgtgaggttgcagaaaaaaggaatgcttatatgcagttgataggagtgtaaattcgttcaaccattgtggaatgcagtgtggtgatttctcaaagagctaaaaacggaactaccagtcaacccagcaatctcattactgggtatattcccaaagcaatataaatcattctctcataaagacacatgcacgtgaatgtttattgcagcactattcacaatagcaaagacatagaatcaacctaaatgtccatcaatagtagactggataaagaatatgtggtacatatacaccatggaatactatgcagccataaaaaagaatgagatcatgttctttgcaggaacatggatggagctggaggtcattatccttagcaaactaaggaattccaaataccacatgttctcacttataagcaggagctaaatgataagaacacatggacacatagaggggaacaacacatacaggggaccactgaaaggtggagggtgggaggagggagaagatcagaaaaagtaactaataggtactaggcataatacctgagtgacaaaataatctgtacaataacccccccgtcacaggtttacctatataacaaacctgcacatgtacccctgaatttaaaataaaagttaaaaaaatcagttgcctgggaagtagtagtaattaatcattgtgattatttatcatctttgctctgtttacagaatttcaatatgttactggaagcaatagaaaatagccttaaatgtggaaggtgtaatcttgatgtcctcagtggtcccgtgcttgaagggttaaatagcaatgtttagaaactcctgaatggcggctgtcaaagagagaaagtatctgaacaggagtcaaattttcacacacgccaattttcactggcacatcagctggataccctgcaaccaattccctgttaaattaacaacaaaatcatagctgcacctacccttcatcagcaatttcctttgggaattatccaaggtcagtgctcttccatcttgctacttcatgacaggagtcagcattttgccatcaacctccagatggtgattttcaggaccttggcaaactgcctttcaaaggttgtgaaccctattgagaataattatctagatattgaacggtatttttcactctttatggttaaagtaattgggagcgatgtggctatgttggcagagcatttggcttgccagtttcccttttttgaaaactacaagtggaaaaatgatataagcccactcatctgctgtaacattcagaagaacagttattacacagcactagaacctgaattggggccctaagttcaagaagaggagaaaccaaaatgcatccccagagtgagaaagtagctatttattagaggtatgtggcacctgcaggaggagaaatgctgatacattgcaggtgacactggccacactgtggtgtcagcgatgtcacatcagtaggtcagacaggacttccacagtaaccaacaagggctgtgacatggctggcacaaagccagatgaaaaccaaatcccatcttgtagcaacataaaaccactttatttcactatgaacctcactcacttggacatctcatgacacatttgacaaaatgctctgttcattttaggaagtcatccacatttctgatggtttccctggcatctttctatggccaataataaaaatagcaatggctaactcgtagtgagcttttactatgtgccaagcactatgctaaatttatattcattttatctcacataataatgactattggccaaacactatccagtcctgtctactctccttctaatagaatcttgagtgcaaaagtccagataaagactattacctttataacctctatctgtttatttaagaggaacaaaaatcaatatcaatgtaatcaaccataacgtagccaaggagcaattttagaaagagacatttctaaaatatcagaatttcataatattctggtttatttttggatgatacattattcaggatggtaaaattttcaggtttttttttcttacagacttaaataaatcttctacatccctggacttcagcttaaaatacagaaatgattcttaaatcttaaagctctggtcatctgagttgtttctcttttaataatcttttcttcaaaggcaattcctgctcagtgggaaaattcacagctcctaagtatttatgtaccaaggtttctgttcaaagaatatttaaaagctattgaccagatcactgatttcaatggcaagctataatcatttgcagatagtaagaaaagaaacacgtaataacaagggaataatatgaactatgtctaaatgaccacattttgtatcttatacgtgttaagcttcaacaaaattggtaaaatacttgttatttgtagtcagcctgacctgggttaaaaatcctgttttgccttttatcattggagcaaccctgtgtaaattactccatttatctaagttttattgtccctctaaatatcattactacattgtgggtggtttagaaataatgcatgtagagcatagcaggtatttgataaatgatagcaagtattactatctttctagttttaaaatgaattaaatgatataaagagtaaatcttaaatgaacgtgtagaataaaaagtaaaccctttttaaaaagaattcatattttaagtcctttaatactgcctattaatgttctcttttggaataaaaaatgagttattagatgtgagtttaccagaagcaaatagtttttaattcaagcacaatagtattaggctatgtctgatattctctcaagctatcaggagaggtaaaattgaatgaaaggaagccaggagacccaagtgcttaactctgctgtgacacttattctgaaatcttgggctacatttcctaagaccttgatgatcttaatgtaaacacgagtggttgaattagatgatctggatggctttttcttgtccttgcattcaaaaatcatgtgctcaatatgatgtataaaattccaccagcagaaagtaatttatttggctgtagacattgacaggcaacatggtaaaaggaaagaacacacacagtttgcagttagacttagctgagttccaatccagcttcactttccagttatgtgacctttagcaagttactcaccttctccaaggctgttttctcacttgcaaaatgtcgataataatggctacctgctgagaatgttatgaagattagagatggtgtaagtattcaataactgagcgggcattcaatcaatcatagttaatgttttccagagtcctccaataaaatgcaaatttatcaagaaggattattttgggggattttcctggttgccaggaatggagaaccactcaaaactcaattaaataaatgagaaatataaagcattagtgttaataaggttacacagcatttcatgaatctcaagactgagagtctatggaactggaaattgaaaaggatgtaaagtctctccctctcactatctctctgcccataagatgtgtccctttctatcagtgcctttgattccttctctctcttttcttttctcatttcacccctaatgtccccagctccctgaactcctttctgtctctcttctgcccacagagggtcctttattgactaacttctatttcactcccagttgtgggataccagtacatccagagcgcagggccatgcagttcaccatctatttcatagggttagactgtaggaagaccctgggatgaatacataggagaggatagtaccccgacataaaaccagtacaaaaggtcacacaaaatgcttgttacccccataatactaattttctgacaataaggtatatagacttggagtcagggttggatacagcttttgtgagtaccgaagattatataattttaagaaccctcttttagaccaaaaaataaataaataaggggattgttttaacccattttgtgctgctacaacagaatatcacagactgggtaatgagtaaagaacagaaatttatttccctcagttctggatgctgggaagcccaatatcaaggtgcctgcagatttatttgtctggtgaaggctgcatcctctgaagggcagcaattctgtgtcttcacatggcagaaggcagaagggcaagctagccaaatgctgcatgcagcctcttttataaggatcttagtcccattcacaatggaacaggtctcatggcttaatcacctcttaaaggcctcctcttttaatgctatcacattggcctgaatgttgaaggtgacacattcaaaagatagcaggtatgaatacagaattacatagaagagtgaatatttgcttgaaattagaaaagaaagtacaacaaattacacattttaagaaggttgaatgtagcacaaatgtcacaaaagccagaaaatactttctgtgaattaattaacacacatctataatacttttttcctacattttcaggctgtatacttagtgctcaccactttgtgtaacaataatattaataatgttttctatagagagaatagaaaaataactatctttagcatagttgatcaaaatttatttttgtctaattgtcaaaatgtattttgtctaattgatagttgaggtacaaaacacaagcattttcaccatgtgtagtactattacaggtttattttctaaaaagataggaactctgatcaattctattttatgatttcataaaacttgcataatgcagcaaaccctgctttatcaattctatgactatcaggagagaacttcttttttggtttaacatcaattagaactgaaccttttgtttaccagtttacaaatatgatgtttggaagaattttccacaaaccagctgttggctagtctaagaaatctagatacttccaatgccaggtgatttataatacacttatataacaatacaaattttagcatttgtacctttgtgtcaggtgcagggagggtggtaagtgtcagtctggaaaaattcatacactaggacaactataacaataataactattcatggaaatgactgcgagtcacttaaatgtcgcccacaaaactcaagctaaatgtatacccaactttcccccttagtcagatcccaaaacactcaaacactctctgtccataggggaaataaggagcaaaagttgaagtgaaaaacaatagcaatactaacctacagtagttgtaatatcttactttggagaattaaacaagtatgtatatgcacggtgagcacattgctagactcctgggggcacttaagcttacgatttatcaacttcattgtacatctgcctctggttggggtgcatgacagattatgataggtcaatcacttaagatgctgttgagggatgacaagcaaggctgaagtagagggacattgtttctgagagttcagcttgagggctctgggtggtcaaggaatgaagactacaggagaactactgataaggtaggcgaagtgacagcaatgaccaacttcacctgttaagagagtttgcccacagataattctccatttgctagcctttcctgggtacctcctctgcttcagcaagaaactagctagcctgcagtcagaactggagcttcattaagcaagatgatacaagaggttttttcaggtaaaaaaggtaaaaaagcttcattaagcaagatgatacaagaggttttttcaagtacaagagacaccaataatatgattgtcagaaagggaaaaacaaaagtgacaactcaaagagcagaaagacactttttgaattttcataatagttgttaaaatcagtgacaagtaaaagaaaatggaagacaaaaaagaaataccttcaatagctttctttgaaatgctgttgtatacaatgcaatgaaacataactcaatcaggtgacaagtatactcagaccataaattacaaaccttctaggtaagctcattagaaactgataggtgtgcatgagaagagctgaacgagtagaaaattaacagaatgtaattgtattatgtacaaataggtcagctaaataccattaaatgagtgattttgtcaataatgaactttctagaaaaatatttacacacatgtctaatatggatggatggtgaaggtaaaactaaatatcatcttacaaactaactaaaaatgttattacataagcctttgagtaattataaaatgtattatgtattcactttttactatttccaggaccacattaatgtttcttgtacacatcatataatcatataattttcatagatgtcttgtgagacaggcatttgtatttcttccccttcccaacccttttcccaattatctttcctactaatgttttatagctgaattaaaatatttcaccaccccaaataaataaatttaataccctcccaacctgcttaagacatgctggtcttttttcatagcacatatcataatgtgcaactatgcactaatttttttgtttataggtttaatttctgtcttcctctctaccatgtaaactccataagggtagagagtcctgttttgtttacccagtaggctctatatacacagattggttaaataaataaataatgagaaaactgaatcttagaaaagttaattaaggccataagtaagtggcaaaacatcatcaaatcaaattctctgtgtattcaaagcccttgaaattaaccaccatgttaccctgtccgtgctaccaaggctgcataatttccagggcccaccacacaataaaaccgtgagctcctgttcaaaaagcaaggaaaatgtgccattaaagttattaaaatataaatcttttttcctttcttccacagttttctcttgacttgtgatatttttatttgctatttactgtggttctaagtaaagaaaacaaaacttcaaattattaccatgaattttaccacttatctttatgttgtgtaataccagctttaaatgcaaatatgagtatttaatttgtatgcagaatcaccaaaattgcacaattcttatttcataacttggatatgcatatgtattttgttcttaccagaacagtagaaacactgcatagaactaactcaattgtttttatgtcacttcttaattatgcacacattagatgaacattttctaccttcagcttgctggtgaacaaggaaggattgaaagaaaaagaggctgagggttgttttatctttctcctctcctctatgtcgtcatttcagctaagtatttggttaagaaaggaaagtaacaggagtaagaaaacatgtgttaagggtaccttggttgttcatgtttctttgaatgccagaccttctttatatgtttgaagctaattctagttcaagaagaaagtgtggcttttcagggctgtcagctcccccacttactccaggcagatgtgacactcttacctagcactggcttggaatcttactgaactcttacataccatgggttctccagaattctgtgctcatttgacattgtaattgcaaatggggcaccaaggaatggtttccatgcatggtgtgcattattcctgagtttgtgcccatactccattgtcccattgcatttcacttgcaaaacacaagctcaaagataaaattaagaatttccagacagcaacagcagaccattaaaccaagcatgaggcctttatgagcttacacacccaggaagctggccctgtatacattcacagtctaatgcatcttactgctttgtgtctagtgacactatatccaaactcccacagtaatgagtcatattttaccaagataaagatacttgatttcagtacactatgaggacaatgaaggatgacaagtagttcccaagacgcttttcaaacttttattgtaactggcaaaggaggcacatacatatgtttgcacaccaggaacaaggaattatttttatttgcagacatttataattgctttgccattgattgaggtattaaatattcaaatctgtgcagggagcaggtaatttagtgcagctatattttctcccccacttcattattgaaattgaacaaaagttgaattatacaatcatatagctgcaaatattttagccaggagaagaaccttgtactcttcagcctgttttgaagaatgagacaatcaaacaaggtcaatatcttcactgtcctttgagtctgggttcattttccattttttccccagtttctcctgacataatcccagttcagaaagcatatgttctagcaattatactaaagtttatcttatttaccatcacagtttggaattgtcctggcctaaggagccaatctaaggttggtacttagattgtataaaaaaaaattaaacaagtttttaggtctgtttgacagatgagaaaacctagtcttataaacgttgaggaactcacatagctaatcaatggcagcattataatttgcacccagggctggcaaagcatgcattcatacccaattcattctcgataagctcactaaagccaaagataatgtctgtatgctttgaccaaactagaactattatatcttttttataattttcattagtcatttagctccagtatattcgtatgcccttgattatacatttttattctgtatacattgtttcttatatattttctacttttcttccacaatttatttggtgatataaaatatacaagtgtattttcttaaattacattacaattagaactatgcatatgacacaaaaatacgaaatgtagatgatatatattttatatacatttgttacataatataaacatgattaaataaaagatgacaaattagatttatgaattgtgtgagagatgtcatatctcacataaagacactgaatttagcatttgatcaaaaattcaaagatacagatttcatcagtacagtccttatacacatttaaatttctgagtgtatattttgcattctatgtaatatttattatttattcagtaaaaccaaagattagtatatgcaaagcaatgaattcaacattgtatttgcaatgacttgcattccctttacaaagatgcttaaagcagtttaacatctgatagctatgaagatgaactttttcaaacttaagaaattctagaggcccacgttgaaagataatatattcccttatgaaaacaagtagaactaaataggcgatggagaatgttaagctagaaaggggacccagagggctccctacattgaatcacatgaggatatacccgttcttgtaattgaagacttgacattaattatttgtatttctttatgaacaagtaaaaggctttaaatagtttttgtaatttatagaagttctgttcaggtttagttgataaaatattctggttctattccttgagatttcagtttctgagcaacagcagttcaaaaatgatttgtaagattgagtttattttttattttaatgtaagggttcaccaaagtccatatttatagttagaatcataatttatttaaatactgggtgataatcaggcaagtcaataaatgaacaaatcaaaatacacaggctaaagtgagtagtaaaagagcttattgtgtaacaaagactaaataatttaaagcaaaattaaggtgagtactatgcttcattcaatagttgatgtctcaggtgcttccttccaatttaaaagatgaagaggagctgacttgatcggtcctagctgatgttccttgtcctaccttctgtcaatatgaaccacaaaagcactgaaataagaaagctttttttttttttttgtcgtggtacgtctaattcttacatgtatctgaagagtctatttaattcataaaacttctattttgtgggttttctttgaattttggatatctgaattttttttttttttttttttttttttttttttttttttttgagatggggtcttgctctttcacccaggctggagtgcagtggcgtgatcttggctcactgcaacctctgcctccccagttcaagtgattctcctgcctcagcttcccaagtagctgggattataggtgcccgctaccacgcccatttttttttttctccagtagaggcagggtttcaccatgttgccttggctgatcttgaactcctgacctcaggtgatccacctgccttggcctcccaaagtgctgggattataggcatgatccactgcgcctggcctgaaatgtgctttttgatttagttttgtagtgtaagaggaatacaaatgaataaaagactaatagataaggagaacagacaaatgtccataatgaaaagtgcaaaacatgtccatctaagagaataaattttatttggttttaaaatagaaggaaacgaaaagaaatagtaatcttaaattagaagttcaaaaatcagctacaggtttctgaagtgatggctcagcctaaattttctgaacaaatgtgtaacctatcccgatttccttcttgaaagacttattttcatctgcaaggtccagaatgcctgggtacgatttaagctctgccattaataagcatgcacaacacctgtagatgtagtcttatttataaataggatcataagactgcatatcagctcttttaaaaatgtgaggtcatgcccacgtagcccttgtcacctctcctgtgattatccctgcaagaatttagccttgctaagcctcctttcccttacctgtaataaaggtgtaatattaatagccacctcattgtgaggttacgaacttattataaatgtatttttccatataaggttcttagcatagtgtccaataaatgttatttattgtttagccaaggaggactaaagctcagccctttataagagaagctcctaggaagtccatgaaccttcatgcaccaactcagcctccaagagcagagtctgcctggatctgaataggacactttggtgtaataatctccatcacgaactgggaagtaggaagtgaatattcgtatctccacattccacacataggaaaccatcttaaataagctagattattgagtacaatgtcacatggctagcaggagacagagctgaacttgaccacaggtcttctgatttcatgtcttgccaaatgagaaaaactcacagtcatgttccttcaaataaaatgtcatcaactgtgaaacagtaggaaagagctactctagtgttcagcaatcagtagcagtaggctacttttcttagcaaaattcaagcagggcataaatctgggcaaatatgacatcagaggtggacatgaatagtgacaagtgcctccacgtaaaaccgccactcaaatgatcctgttatcttttgctaatctgcaatttagttgtatcagatttttcctgaaacaaactaaagtaacaactgggacttgtagatctcactgtcattgagaggatttgctgtcatattagttatgtgagttagtcttaaatgtgagggtatggattttggaaattctggattgttttgacatactagtcttgttttggtttggcttaatttttctggaatatcagaagcaaattcagatatagcagatacaaacaagctcagtaataatattggctttgtgataaacatttttctctttgcaataatttattcaagaagggctaatgagtaaagaaatattttgctcactggaggataccatatcttttacagtgcccagttgagcacatcaattattatttaatctctaatgataatcgatatacaattaatataagaaaatcaaacatttgctatataattcagttctacagtgcctcagtctcccttaagaagctcgcttattttcttcctaaagtaaacatctttttatgtgcttccattgagaatgctactaagatgttcaatcattggaaattttaatttcccagctaaagttggtgagataaacctttctttagataagtaagttttgacaaaaaaaaataaattactgcttctatctgattgtgcaagtaaaaaataagttggttgtatagaacacaatgaaactaacatataaaaagcattcaactataatttgtagattactttgtatgaatgagcattgcagaatgagccaatattgtgtttgcaaatatctctccacagaaacaacaaatctttgcacttttttcagcagtgtatattaatttagaataataaaacatcagcactattcagatatctgctctttctatgtcatattctttgctcacatttaatatttatgtcatttaccttcccctggggtgacaatggcataatgaaatagaacataaaattagaaaatctctttacggtagcattcctatcctttgggagtcaagacatccttcttttcttgttttcattttataacatgcagccattcctaattagagaacagaacaccatatatatatgacaagtgcctccacataaaccctccattcaaatgatcctgttatcttttgctaatctgaaatttagttgtatcgggtatatatatatatataatacccacacacacttttcaagttaattaaataaaatttaaatcacagaataacttgttgaaatactaaatatactgggatatcagaaattagtgattgagaatcaagcacttacattctaaagatagtgtagaccaaataccccacgtatacctctcactcatttctctgacttcccttggcattcaccttcattagagaaagagtacagcctttgccgatcaaagttgattacagagactcttggctggtaaaggcagttactttggatgactcacatctttctgcttgcacatggcagggatttggcacagtttttacagtaagactgtttctgtcatccccaagatttttctttttctttttagaaatgttaagattaattccgaaaaaaaaatatgatagttgtgtaaccatgtaaggtaagtcattgctcaagggtagtcctgcccttctaatactacttaggctttaaatatccaatttatgaaagaataagaaatattgctacactaacctatttacttcatgttaataacaacttctgggtgttcttcttatctgcatccattactccatgataatgagatgctcctgctctcagaagatattacatctgaagggtggatgttccgtatataaaggcacaaacacagctaaaacaaaatcattacatttattttcaaagtcattatgttaggaccccagaattactgttactgcaaaattatgttggtttttgagcaagaaaattgagaaattattcaacctagccatcccactactgaacagtacatcacacatatcatgagaaagataaagatcttaaagttaacacatcaccacagttctacatcctttttaattgatggtattatgtttgagtaggtatagagtgacaacactttataggactcaaaatattttctgacttgatattaaagccaacatgcagcttcccatgtgagttctctactctttcctgaaaaccagctgtagacttgtttgacttgtttcattaattacaaatgagggagtttaacttgtatcagtacctaaacaatcaagttaaaatgacaattacttctttttttaatgtgaaatttttgttcacgctcactcagacaaataattagctaagagagtttttacttttttactcggtaaggctaagccaaattccacttaagattatcatatttctaggctagcaaaagctcataattacctagttcactcttgtgtcaaatcttccataatcttttgggatgtttcaataagaaagcctcactaaggtaaaggaaaaacttttttccacattttattccttctaaactgtaaaataattagcaatatactatgtataagcagtaaatcaaaaaaatgaataaaattagaaagttatataaaaattgctttttctgattttatttcatagagtttaatttaagaaaaaaaatggccacttatgactttcctacattaatctgtttattaggttctttgctctcttctccacacagagggaggtttataaatgcatattgacatgcccactgtaggcttgtgcggaaaggagaattaatcctccattgtgtagcagtcaactcctatttagtggtttgtctgctaagatcaatacagggtctctaaggcataatggctggctcctttcactcttgctagacaaacaaataccccttttaaaaaagtcagttcacgaagaagaaaaataaaagctttttctaggcataaccagccctggctaaaacttttcaatagcctcaagtttggatttcagtgccccagtcttcatttctaggcccttttcccttctttaaatgtgactgctcttcagtctctcccaattaaaacctgtcttcaagaaataatttgatatacatatttaatcccaaagagatgcctgtatgaattcaaagtcttaatatgctacaattctcaggaatacagcagtcccccattatctgagggagatatgctccaagatccccggtggatgcctcaaaccaaggatggtactgaactcaatattttttttctatacatatatatctatgataaagtttaatttataagttgagcacagtaaaatattaatgacagtaattaataatgaaatagaaaaattataactatatgttgtagcaaacatggtttttctccctcgtaatatctcattatactctactcttcttcctcaagcaatgatgtgagatgataaaatacctacatcatgagatgaaatgaggtgactaacgtaggcattgtgacttagcattaggctactattgaccttctagcaatcatcagaaggaggatcaaatgcttcgagtgatcctggatcatgaaaccatgacgatgtcaatggtttgatgtcaggagcagacaatgtcaatgactactgggcaggtagcatatacagtgtggatacgcaggacagaaggttaattcatgactcaggcaggacaagtggggcagggtgacatttcatcattctatttagaagtgcacgttccttaaaacttatgaattgtttacttttggaattttccattcaatgtttttgaaccacagttgacattgagtagctggaactatggaaagcaaaacagtagataagagaggatactgtaactttgacaaagaaaagacttcttaggcagaattagtctctgtggaatttatgtaatacatgtaggcatttgagacatggagttgaaagcaaaccatttcagtatcatcatagacagcaacttactccacctacttgtaagattatcctgcagctaggaggtgcctggacgcctcttaaaaaccacatctcttctatttactgcttggctaacttctttttattcctctagattcagttcaaatcttgcctccttatggaagtacttcccaagtacactcaattcccaaggaatcctaccatcatttctattattgcagttattactctcaaatgttattttctgtttgtctctctctcctagaggtcactaacagcaagaactgctgctgttaatttgtgcctttccacacttagcacagtgtttggagcataataccttctccttctcccccctgcaccaatattacataagtggtaggcagcaaccagggcagtcagctcattctccctttcatcttctgtccacctgttgaaggcaggcatccagtaatggtggagagaggcagtgataggaaggaggcagatgagctaatagtcagagatgcctcttttcacttaccccaaagatgtatttactaaaatcgagaagcatgaaatgtttgaagaaatacattttacagtaccaatgttttgttgagtggtttcaaactcttctagaaggaacagcacaacgcttaacctttccaaagtgagttgattacacaatgattgttccttcaaagtcagactttggccaactacatacggcccacaggtcaaatgtggcccatctcctgcttttctactgcttacaggcttagaagagcttttaaatatttaaatggttaggaaaaaaatcatgtttcttgacatgcaaaattagtataaaaatcaaatttcagtgtccctccataaggttttattggattacactgactcttgttcatttatggattatctaggcttgtttttgcatgacaaaagtaaagtcgagtagctgtgacagaggcagtgccgttctgcaaagcctaaaatgtttgccagtttgcttgccttttaccaaaagagtgctctaaatgggcatattaggaacagcacaggcactctaaagacattatttacagcacttaaaaaaataatttagaaacaattgagaggagaaagagattcacttaggcttgaagagagtaagccattggggcattcctctttagggtgaatagcagagacataaatgagataattaacagttgttttcaggaggagttagatcccatagagcagggaatgtaaacaataaccttggttgtctggaaagtagaacaaaatacatcaaaatatttagaaagctgagataatgagagtgcagttatttgtttattgctctaacttctttccttcactggaagatccttttggggtggttcaataaattgaaccaagtgttcaatttgtgatcagcatcaaagtttccaactccctatagaaactagatacgtttttgaggaaggaaagaagggagggagaaagaagaaagaaaaatatatttgagaggattatttgcttttagcttttaccatttactttaacttatttttcacttttatatgtggaagttcactaatttaagtgcttttatctaaccagacaattttatttgtatttataaaaccactaccaaatgtttcaaggaatgtacttctgctgtttcaagttttagctttgttttctcataatgaaattcaaccaccattgatcatgtagtgactgctcttagagattagtgaagtagtgaaaacgctaataggcttttacaactataaataaaccattatcataaccccttattagtggtagaaacatcaagttgtcaaacaaattctgtaagagtagtctagctattcacattaatgacacctataatggaatcactatgttctttcttgtttttaatttaaagcacacattgtacatttccattttattgccaaaaccttcatctgcaatcttataatctcctttaaacacaagaatatttttctttatttaaatttataactaacagccaggctccaacatgtttagctatagactttcattagcatgattaaaaaaacgccaaaataaaacaacaagcaaaacaaaagctcctgcaacaaaaaagactcataagcagttgaacccggaatagtattcatttttaaaggcaacttggttttacatttattcacctgcccttaaaatatggctttaatttattactgatggcattttcagtgatctgctgaaggatttaactctgaaatggtttattctaattaagagcctcttgccaatacttagtcaccatgaggcttggaagccccagggaccagctttcattacactttgtgcccatttcatacaagtagaacatttttcaatcatcagatctaatttacatctttataatgttccctcatctaacactttttttctcactctgtcaaaactgatactttggttctttagtttgttctcaatttacagtggattgaaatgcagttttcacagaaactaaaaagcttcgagtgtaccctagaagaaggtccatcttacccttagtttttaacataataagtctgatttgctcatgatcattcaaaacacagagtgacatgacacaggaaactgctacccagaaaggtcccatcagtctcactactgggtttccaatctggataaaatgcaattttctgcttttaaggggagggctggagacaaacagcaatacaacagctctgcatctgcttcataatgttttggaaccagggtggatctttgtagtgagctgtggtaaggtaagcagagcacggctttgggtgaaaaagccctgggttcctgtttggttatgcctcttactagtgatccagatgccagcagactgcatctcccaagctggcttgtcatctggtttcctgccagttgtgccagtggaaagcactggcaggagattggagaggggctggggaaggagccagtgtatttctgctgtttctttgcatcttgtaaggcagttgctcacactcctttatggctctagaattttctgcgttgaaagactgttgaagttccagcctccatgacactctgccctaaaactgaaaaacttcctcctccctttaccctgcagcctcgtgctggtggcagcttcctgctgttgctaattcctgggttatcttatgggatgagaactttcttcacttagtccattctgttgtaaacacttgatgtgatttttatttgcctacttagaccttgaatacgatcaatactgttttaaaagtaaggtactctgctcacaatccaacctcacttccagaaaattaagtgtagagaggagcatacgaagagaagtaagaaagtatgcatttaatgtacttagaatgtgggatatatgctgcatttaaaaaaaatagttttctagtatcaacatattttcacatgatttgtttcctctttctccttaaaatgaaacctgatggaaataatttttatggaagtttcttttcagttggtttatgtttaagcaggtgtactttttgggtcatctttgtttttgtcgtgtgttgttgatttttcttaactacatagagtaagaatacaaccacagggcatattcatacagaattctgaccaagtagaactatagaggtagagtcatgaattttttaagatcctcttcatgtatatattttttctggatataccttagtttgtatagttaataaaaagaatgaccattcaatcggtgctttaatctcctaagaagaggcaaaataatccaaacacaaatccataaagtatactcatttaattttaggagataactttgtctcactttgattggaatagaatctttcttctaaaacataactaatgtaaacataagctcccggattctcatcaaaaacaaagtttgtttaaggatatagaaactttctaggttaaattgaacactagaattttagaggaagcctctggctgtctttgggaggttaaatcacattttctctaatctcatctccttttatatttaaacagctgtgactatttacatgaagcatcatcacattaaattatttatacttaaagaactttggaatcgttagcagggaagaagtccctggttagtgactaagcagagaggtgcacacataaggagaaacaaggtgatatggtttggctgtgtccccacccaaatctcatcttgaattgtagctcccataattcccacatgttgtgggagggacccggtaggagataattgaattatggggtcagtttcctccatactgttctcatagtagtgaataagtctcaagagagctgatgattttataaggggtttcccctttcacttggccgtcactctccctttgccagctgccatgtaagatgtccctttgctcttgcttcatcttcctccatgattgtgagtcttctccagccaggtggaactgtgagtcgattaaatctccttcctttataaattgtccagtctcaggtatgtctttagtagcagcataaaaacagactaatatacaaggcaagcccatgacctggctgtatgagtggtaagaaatgaccctctcatggtaaactccaagctggccctgtgcttccaacacaggacaggaggaacccaggccctacctggagtggtcagttgagtgagaacaccaggcctttctgagtgagaacaccaggcctttcatagaactgccatcagatcatgtcaagtatttgggaacaggagtaatatgggcatggccagacccgccaggagggatacaacttgtactcacaataccatcatctcagtcagacactactgctgccaaaaaggagcctaattctctgccacaataaagagccaagtcttagctcccaggcacttagaattttgtgcattcttttctgtgacacttaaggagtagataaataggtggcaaaattatcaggccttctttggcagaattagaaataaaatatgtattaggtcattactggataatccataggtaattttaaaagtacagtcaaaaataaaataggtaaatacaacttaaaaatgccatgagacctctaatagctaatggattttaggctgtgtaaactcagatgggggaaaaaaatttcaaattaaatagctgcacttcttgttttaaggctgcctaactgacattctcccctaaggctggcactgcaggcatacacctggggaccagcttctctgtcttcccctggcaaaggcacttgggagtctttgaatagattataagcaatgaacagttccaggggtgtcagcaagtgagagtggtggctggttataagaaaacaggcttatcaacagcactgtcaaagtggcaagggatttggctccttgggtgacagcctgcagggcagcagcggtgactagaaccatgcaccgtggggagtttcatccaacagagttacctttcaaaggccaggaagagatggaagcaatggccgcaggtaactaaagaaagcccccagagtgaaagtagccctgacagtgttgaagatgaaacctcttgggacggaaaaccaaaacatgcatcttagggaagctggtgccatcagcccaaagccaaagtgatcaggcattcactgggactttgatttacttgatggactaatttttctttttctgttggaagacaaacatgtctccctcaatatactcacaaggtttaaccagagaggatcttgttaagaaaaataactaccacacgatggaattttcagataattgccagtgctcactatctaagattagtagcatccaagagaagaatagatggttattgaacaactcagctacttcacaggatgatggtgagatttagagaacagagtctatatttatttgaattgttggatatttaaaaggacaaaatctgccaagttggagttatttgtattttaaaatgatggccaagctgagcatggtggtgcatgcctattgtcccagctactctggaggctgaggctgaaggttcccttgagtccaggatttctagactgtagtacactatgactatacctgtcaacagccactgcactccagtctgggcaacatagtgagaccttgtctcttaaaaaaattaaaattaaaatcaacaaattctggccagatttatagattcatgtttgttaagtatgtgaccatggaaaacaggtagaaactggaaaagtggcaggtctcgccacttctattttcatttcaaatcatctaggttaaaaatggatttctctgagtataaaaagaggaagcataaacagtgtagaaccaggttatgctgggcattttgtctaagtattggagaggaatttagaaaaactgaggtggtgacatggttttgggcctggagaaaaataagaaatctggttcaggaaaaaaagaggaagagacctttatctcccctcactccctgccatatgtattgtttaccatcagacctttccctgaaggatttatttaagcaataaatatttattggttccaattatttgctcagcactggacaaggtctgtgctagacctgggtttataacaatgacatgatctttgacctcactgaactcatgatctggtaagagaagataggcctgtaaaaatctaattctactctctcagttgcaagtagcattgaaggcatagcaaagggagagtggatacttttattggatagagataaaattgtcaggaagtttttaaataagaattgacatttgagcttcatcaatggaaattggaaattacccaaaggatttatgcagtaggagtgccaagaggaatattctggaaagaacagtattacaagacatacagaaatggaaagacgtagtacattccagtaatagaaagttatttgttccagtgagactatggggtgtatgtgggtgaacagtggaggatgaggtggccaagtcatgaagagctgtggttatcatgctaaagagcttggctctttcctgcaggtgatggagagacactgaaggcttttatgcaggagaatgacatgaccagactcacagatatgtgagagtgaaaggatagctccaggcaacaaagactaggaactcaaagcacaggaaaatatttccggtggctccacagctgggaaagccagtccctagtgggtttttttgtttgtttttaatgtgtacctctcagtaatcagttgtacatctattttcataacttctttaaaaatcataattttataaaatgagggaataaagtgttaaaaacatggctctgaaaggcatattttgaacataaaatattctgtaaaggagactatatagtcttttactgatgacattcatttaggtaaaaaacacttcattagaatgttaggtcaaaatcatatgttccatttataacctttaaagccttgccataatcatataataggctaaaagcaagaggaaaaaaataggaaacaggaaagaatttggtttttttaaaaaagcacaagctaaagaacgcagtcagtaagccctgctgaaatcccacattgagggtttactgtataaatgttgagaatgttgagtagatgtgctaaaatcatcttagttctttccttgattttttcttttctatacacaaatcttaatcctttaatttcatgtaattttcacactaagggtcctaattaagggtttcttatttaaaattgtgccttagcgatacctagcattagagaaaattacttatctttgtaaaagaaacacaaaatgctgtcggaattatttttgcatctttttggaaacaccttgaaaatagataatttatgaaatttgtggggtaggggtcaactatttccagaggaataagatgcccaaaatacagcctaaatattacatgtgtgcaggcaaaagataaggaatcggtacaggcaatttactggaaatacttttctcgctctcagcttgtgaaaaccagcaaagacctggtttgtttccaaactttcatttaggtttttatgccccctagcgggtatttggtatttctgcaattgtaaaataatgctgatatttttcagcaattccttcgtgcattgtgagttcagactctttatgttgacaatatttaacatcgatactcccttaagtatcttaagtattcaaatgagaagttttaaacattatttgggctataacactttggataatttaataacacctgtgaaaacacttttcatgaaaatgcatatgaaaacatatagtatcatggagttccctgactcccttgaatttatccacgcactccttgaaagttcatagactccgaggtaaaaatctctaattagggtgtggaatcctctagcttccgctttcatttagtgggcgctaattaagattattaatgctgtgaatagtggaaacagtttttttaaaatacactgttaaaagttaacagtagctcataatttggctgaaacaagaaataacgcagaatactttaaacaactacatacattagctgatccaaaaaaaaatgttcttgggctttgatcgtatagtaattgatcctccaggcaagagaggtggagacaaaatcaaggcaactttttaggcaaatatcgattttaaaatgtcaaagagaaatctgcctattgtgaagtaataccagggcccctctggcaaacaagttcaataccacaagcaggtgttatgtaacaacactcaaaaaaaaggtcatttgctatttgcaaacattacagctactgtaaaaatcatccatcaaactgtgatccttctagaataccaagctgatggcagaaaatccatgaataacatagatactcagaccctaaggggtagaattactagttacaaagtgatccagcttccaggtcagaagaaattgtttcttagacctctcagactaacactctggtcaaagagaaaaattcagtggataggtcaataatttaaacgcacatagacgtacacacataatcaactaacggctttcaccggggcattatacacattacttactttcatctaactttttaaaggatacctgcttttcaaatacttacactccaaatactgattcatgtcccatgtgagtttcttttaattattgtagtagttgaaatgcagcatttttttgaaccagcaactgccctatacaatgtacagaatgctcctgaacttctgtgcacctgcacaggatctgttcattcattctattccttatacctagtaattcacaatttttccttgtaaaaaatgaaaaagataatgtgagagattgagttacagtaagcatcaaggtttattttaaaatcagaattttcttcctgttgtacaaggatctcttctatcttcatgattatttatcaattacatgacttttgttttatcttttagtgtgtgtgggacatactttcagagatggaaagtcacgcattagctagggagatttgcctcatataacatttgtactctatcaaatgaacatacatttatacccatcaaataaaaagagaaaaaatagaaactatatgaataggactaggaagctaacagtattgtttgaagatggtgtaagaaaattcaaggaaatatttctccatttgagatataaagacagccacatcatgcaacttctgaactagtcatgcaacttctgaagaaatactaaacagggaaatatttagtaaggtgtcaataacatttggtttacaatgaattatgttttaaaattatgcatattttcaacctatcaatattacttgataaataggaagatggatagatggatgaatggatgcattgtctgcctgaattaatcagatttcatgagatttagtattaagtagagtgcatgccagaattcaagaactttgcatgaaaatttttgataatatttgagacaaatctttaatagccaaaacttaaatctcttctgaggaattggtcttccacccaaaataatcttcaatatttggcaaaatataaaattttagccagtatttttgggaagtacgcaaatttagaattaacatttttatgcaaaaggcacttccatgttgtacctttttaaccgatatgaggaagaaagggagccataaacatgaggtctggcagatgtccagggtgaaaaaggagcagaaggaaactggtggctctactgacatagtaaatataggagaaagaaggaaaacttagaagcaggggagagtagaaagagtatggggggccgggcacggtggctcacgcttgtaatcccagcactttgggaggctgaggacggtggatcacaaagtcaggagatcaagaccatcctggccaacatggtgaaaccccttctctactaaaaatacaaaaattagctgggtgtggtggcatgtgcctgtaatcccagctactcagaaggctgaggcacgagaatcgcttgaacccaggaggcagaggttgcagtgagccgagatggcaccactgcactccagcctggcaacagagggagattccgtctcaaaaaaaaaaaaaaaagaaagaaagaaaaaagaaaagaaaagagtatagggaaaagtttcctttcaattaacgatgttcaagttgctgtgttatctaaaatatttgatagttattctctcatgatatattctcttgtttcgttcttcttctttttttttttttttttaaaaattttgagatggagtctcgctcttgttgcccaggctggagtgcaatggcgccatctcggctcactgcaacctctgcctcctgggttcaagagattctcctgcctcagcctcccaagtagctgagactgcaggcatgtgccaccacacccggctaacattgtatctgtagtagagatggggtttctccatgttggtcaggctggtcttgaactcctgactcagatgatccaccagcctctgcttcccaaagtgctgggattacagccgtgaaccattacacccagcctccttcttatgtttttgcgaattcattctttattttcttaggctttaggggcttcttgtagtcttttaatcaatcttattaaatacagaaaaaatatatatatgaatataaaccccacattatgtcatgttttggtgtaactttttttgggaaatgatttttcaacgactgagtacataatataaaattctaaagaaaaacagaaagaatgaaataaataatcctactgggcttagcataaatttacaaataaggagtcaggaaaaatgagatatatttttttatattgaatataaataataaagtaccaacaggaaaccaagttgcctaggatataaataatcattaaaaggtggcagtattttagaaacacttaaactttcaatgatcatttcaccacggtgtcacttctcaatataagctttctattctaagcctttcctccacggaatttcagagagatgtgattcctgaggtgtataatgctgttttgcttcttgctgtgagtttgaatactagttagaagatcttttgttaaacaaagaaaagcagctggttttgccagtgagatatatcccatccctagcagattctgtgctcaattacaagttgcagataaaaattacccatttccatttctccaggtcactactaaatgagaagagagacaaaatgagtaatgtaaaaacagacatgaatcatactatattttttgctcttctccaacatattcgaatagtgagatatgcttaaaatattacaaatatcaacagcagtcaactttaaactgataaagggagcagggagaaggatagaaagagtaatgtaaattgtaccaaggagtatgaggaagaaggcagctggtgttccatgggaaccagccaagggctcaggctgtccttacatgagaaattgcaggacagcctggactgtcttagcacccctgcctgttctacttccttgtattctcttaccatctcctctgctttctctcacaacagcagagccttggagaccatcctaactggctataacatggggaaactctgtgtctctacccaagagcataaacgtgagagaagatgttcccactgatgaacactttgtgcccccttcctcttctcaccataatcattgcagtcctgcccagtccttgcaaatactcacctgtgttttctcagttgtgaaggaatgttggattataaaacaaagagatggtagagctaaaaaataaatattttatttggtgtagattagcctagctttatgacacgaagcttatgtatctgcaacctcttttaccttatgaatccttctagactgtgaatttgctgcctttcaataaactggtgtatctccttacttttcgtaattttctctaataattgcaagtatgctgagcttgcctatcctatgacatagtgatcctagaatacaaaaagtaaacagtaaataatgatttttaaaaatctttcaagggcaagagaaactatatgatggattcacttagctagtttatatatttatattttaaaaggcttattttaattacatggactcagtccttgtattctttagccataataaataattgagtttttattaaaaatcaaatcccttttttaaaagccgtgtgtgtgtgtgcgcgcgtgcgtgtgtgtgtctgtgtatgtaccttctctggggcttactgcataatcagtgtgaaggggaaaaacattgtgtataaaatatgactggacattcaatgtgaactgtgacagatacataatttggctcatatgtacacagcattgtataaaaaggagttgaccttccaatcccactgacatacctctacagtaagaatatccccaagacttttgaaaatcatcttctaaattcctttagctttcactgtttcttcactaacataacctttagattataatttagcttcccagatagaaggagatcgtgttttatatgaacacagcattctggttcttaggttattatttttgtactataaattaatactgttattctggtgccaaagccttgtgggaacttcagctatgttaaattagctcaactactgatcacccacaaacaccaacaggaatgagtacctggatcttcaaatcaaaggaccagagctcagaatagggtcactaaatgtggcactagatagtatcaccttctgtctctctcaacagtttttcttcagccaattcctctccatctccatattgacacacatatgttttcccacaaaacaatgttagagtgactattgcctaggctacctctcaagatacaatataaccccaagtcctcctaaactcccttgagcatggattctagtatgtgagttcctttgatccctgtctctcaggactacactctctgagcattgagctctccaaagccccagagtaagcatggagtagttggagctcagacacagctgggtaacttcggcaatagtaagatggaaagaactcctccttgtcccccgccccaggagtgcactctagacaaagtctccatcagtaaagaagagaaagtgtactcattcaactaatatgtagtaggagctggccttatgctcacgaaacacaaagtagaactgctcctgctttagcaattttacattctaatgtcagtagggtggatgaggagtgaaaaaataaatcaataaataagaaaatgttacttgttaataagtactctgaagacagtcaaatgaggaaatgttacagagaatgaataggaaagagaataagactactgtgaattaggtggccagaaaatcacttggatggagacatttaaatggcaccctgaataatcaccatctgggggctgcacacaaaacagaaggccagatggccagtgtggccagaggccagtgagcttggtgaaaggtggtgtaaaatacaggcaggaactaaatgaggtaggcccttggaggcaaaactgaggagtttggatttatttcagtttcaagtccatgtcagggtttaagcaacatagcagtagtccaatctccatttttaaaaccaaagttctggctgctatgttggcatgaattgtaaagtgctaaatgtagaaaggagagtcaggtaagaagctatatctatggctctggcaagaaatgaccacggtttggtttattgtcataaagagacttgaatgggatacaatttggtttgcacagagacaacaagaccagctaagagatgaaacgttgatactggcaattaaggcgatggctcttccaattttggtatgaacaactgcatggtggtgattatgtttaattataagtggcagaattgtggggggaaaatatttgagagaggaagaggaagctagggaaatgagagttccattttggttaatttaaattttaatgggctcttaggcatccaggggtagaaataatcagaccagaccactcaagatatgaatctgattttcaggagagacatcatggctgtcaatataaatcaagagcatcagctgcatagagatagttttaagctatgagattggacaaagtcacataggaagtgggtttatatggagaagataagaggacggaagactgagacctaaagtactctaaggtttagaaatcagataaggggaaaggaggcagaaaaaaagatggagaagtggtagccaatgagataggagggaaaataagaatattttctaatactaaagccaagaataaaaggagtctttcaaggagagaatagtcaactaataagctacaaatgagagattgagttagatttttatggagaaatggccattagatttcacaagtgaaggttaatggggaccttgaaaagtttattttttaaatgatgacatctggtgaaaggaatgtgatgtgctactttttctacttaaatttcataaccaattgaatgttgaaaaaactaagtggaaaattgtgttatccagactctaaatttcagcatagaattattgagtattaaataaatgtaaagaactgtgtcatggcatataaaggaaaaattgaagagctatcattacatcatctgacttaaaatattttccaatcaaaaagattacttaatgttagaatcactttctataaggttgaaaggtaatttttatattcagatatttataatttctgacattaaagtctgaagccatatatattatagtcacaaagtagaaatagatatgtccaaaaaatcatttgacttaaaggaaaaaattcttagtttcaggtagaaatgtctttctgtgacttaaaacaatatatatatattttttctttaactcaggtatggtgacatggtgccaaaaaccatagcagggaagatttttggttctatctgttcgctgagtggggtcttggtcattgctctacctgttccggtgattgtatccaacttcagtcgcatctaccaccagaatcaacgagcagacaaacgaagggcacaaaaggtgcgtattcaactccgtgcaaccatggtttagcacttcccactttttataatgagctttaaaatttcttaatggttattcagtgctctggattggtcagtagttgcatcaatcaggaccgagtaggttattctacactaaaaagaaacgtaacatctcagtggcttaaaacaataagcaatatttctgaatcatgctacaagtccattacttgtccagagaatagagagtccatcttgacagtgtacttctgcagtcactccagcaggagtaaagggcatgatgaatcacacactgcttcctaatgtccctcctggaagtggtttgagtcactttcttgtctattgcattaaccaaagcaaatcacacagcaatgtctaatttcaaagtgggcaggaaaatacaattctactgtggggccagaagcagaaaataagaaatatttgacgaacagcactaatgacagtagcaaaatcagaaacagattcttggcaaattttattaaaatcagatttctagatctgattcattgagtctctatctatcaagggtcaaactggttccagtagacgagggttattaaaggtcaccaagatgtgtctcagatattttacatagttgacacaagaagtaatctgatcatctgtagctgaattttattctcgtcccagcagcttaccgtttgtttgaacttcatgccaggtaattaatccctctaagaataagcatagcgtacactcaactgtaaaatggggaaaataataaataataagattaagattatatacaagtatatgtaaatttatataaacacatcatattatcaatatttaatgtttactgatggtttatatgtgtcagacattagcctaatgtttttcacaaaagaattcatatgttaaaagacaaaccttagccaaattaaattgaaaagtttaattgagcaaagaacaactcatgaattgggcagcctttgaagccagagtaagctcagaaactccagcacagccgcatggtagaaaaagatttacaggcagtaaaaggaaagtgacatacagaaaacaaaagtgaggtacagaaacaattgtactgattatagctcagcgtttgccttatttgaacacagtttgaacagttggccccctttgattggccaaaactcagcggttggcacaagagtgggttacagtctgtttactcctccatgtaagttacagttcactatgcatagagaaacctttaggctaaacttaaaatatgtaaggaggcaactttaggctaaacttgagtcaacacatacaaccttcacaaaaactctggcgttagttaccattattatcctcatttttatagatggtaatcctcaagtacccccaaattaagcaattgtaaagtcacatacctgttaagttggagatccaccattccatccaagccattctggctcccaggttcatatacacaaacactatgataaagtgcctctcagaaaagctatgtaaatgttagcatacttcccttccccaatctttgtcaaaatagtcaccttgagaggcagggcccttgttgcttagaaataatcttggaaatctcttttgtagtttcctttggacttatggcactgtatttccagtgttcttcatggtcattatatctttgtcctttaaggatagtttcattttttaaaaaatatccaaaaccattcataatcatgactaaagtagatgcacaacctaggtgatgtgttataactacaaaatatcatgagagactttgatatagttattcactggctttgtaggtaattccagaacgggatcttaagcacgcatatgaacaatgtcagcctcttaagtaaagtatacaatctcataaagtaagtctttggaaagttctagttaatcactgtggccacacagcatatttgtccagagaactaatttatgcccactgtcaaagatcttcttcctttagcaaagaatcactttttcaagctctgtagttacttgctttatggaacccttcatttttggacaaatgcctagcctttaattattacagagaagagttagaaatagtccagtcaacatggatatagagaactgatcatctaacgaatagggaggagtagaaaaaggcaccctctggacagttgtagtcttatgtagggaatacatacccttggcaagcagaggtaaagggatttcagccacaactgaccccaccaccagggaccttcaaacatcacactcatgacgctgcccatacagtacagtccctctactgagtacaaacacacattgtctaaaataacaggatcctaccaaaagtttaactttcaaccacccatctatctccattctagacatttctcctttagtataagagccaactgtatgaaaactatagaaagcacaaatctaaatttccgataaaccaatttcccaaacacttgtatttcttcagagtttgtcatctgcaacaaagaaatcaataaagaaaaccttagaatattttagaagccttttggtctactaaatattaaatactaaaatacatttagaaatcaaaagtaaataatgtgacattctaaaagtacactaattgaaaagtatattttgtgaatgctttttggtatctttaaatatttgctatatttttggtttctgccataatgcaatgaattttacagagttttactactgaaaaaattggattaataaagtaaaatataataaccaagtataatatgtccagtatgtagactgtgaccaataaactgaacataatcttctaagaaagaacagtggatatgaactaaataagttaccaggggatattttctattttccttcccaagagattagggggaaaaaaaagcagaacaaacgcccattaggctaagacagtttatttatctgggactgggctatgtgccaaatattaaagttatgcaaaaatgaccagctaattcagtcaagcaagcattcaattcagtaaaaacgtcagtccaactgactaataaaagtaatattacaaaatggtttgttagaccatatttttggtgtttaattcaattgccacactaagaccaagcaaaagcatgaaatagacacaatattaattttagaaaattcctatcatcactatcagaaatactttccttcttctagtttcttccatttgcaagtactcttcctacttttgctgtccactcctgccatatacagggaatacatggtttaccccatttctatcaatcattgataaagtcttaactaaatactgacatgctggtgggtataggcctaaactgtgacacctctcctctactcccaccattggtaattatattttaatagatttattgattctcgtagttatactataagtatttactgagtagaatgtattagccaaaataaagctagattaatgcaatgacaagtggcaggttgacattttgaagcagctcttttaatatatggatcacatcacctaatcatctgcatactcacaggctaacctgtgagtaattatcatataataatcatagtagtaattatagttataatttaataatactaattgcaacaacaaaaaccctcactagtttctagaatgtcccaggtgttttatatctgttttttttgtaatattcacaatcaacttgcaaaggaagtatactatttccattttacagataacttgctcatgctcacaaacctagtgattaaagtccaaggcaaaaaaattctagtattatttgaactatgaatattttaggatattcctatagataattctaaatgcagtgagaagtttagaatcaatgagccaatgtatagtgtaatatttttaaatttcacattgacttagaaagacactacccatatgtagtctgccatttatcacaccctgctagggtggttttcaaactttagattcattagaatcatctggaaagcttacacacacacacacacacacacacacacacacacacacacaaacaaaaaaaaaaaaaacaaaacaaaaaacagattgttgagccctactcccaaatcatcagactctgtagttttgggttagaacctgaaattttgctaataaattcccaggtgatgctgatattgctgtttggaagaccacattttgagaaccactgcctagtacattcagcaatgtcaaaatcaaagatttttatttaagtagaataatgaaaaagcaagaaataactacttgctagaacctgagaatgatctcttaggttatctactgttaaaaacaaaattacccagctcctaattccacctaagaatttggtcttggatgctctcctatatcctctttcagttctcaccgcttccaccatggaatcctcttgtagacctctcattgcttagcctcttccactaacccaaatcccagccctttttctgcttagccctgccatctccaggattaaccaagttctggacctaggaatgttgcactgtctgccactgacttctttcttctctttttattgtagtttggtactaacttgtctcatttctagcacagctatttttcttagcaagtgaaaagattccaataaatgccttaaacttctaaaaggtgataaagtttactatgttacctcaaactgaggcattttactaacccttaaatgaaagaaacaactgtaagcaaaatttccagaatgcatgttacagggagtgtggaggcaggcatttgaggaataaggaattaccaaagagaaacaccttcattacctcacttttaaggctacctaggatacctttatttttcaaaagattttgtgatttggtaacaagatggcccaataacttcctttaatctacctcatacctcatctagaaatgactgaccatttaaagaaatcaatgtctcagtggtgtttggcttatagatccttctcagattgacttccaccctctgttccacaacataaactataaagtttatgtcacttggcgtaattaaaaaacaatctacttgataaaacccattgtgttccactgcattctagcctgtgagtacttcacaatacaagatttctatgtcaaattagtttgaggaaatttgcagattatatatccctgttcttctcacagtgatcatccacaatgtcatatggtgtgaggaacccgggagcaaaggaacctgtttaacacctcagcatttcccagccttttcttgaccacagaaccagtcatttgcttcatctgtttgatttagattttacttaccacacttacgaattccttggaaccaactttgagaaatcctgctaagattagatgattggacaaaagctgcagctatgaagaattgggatgcataggaagaatatgtttatgagacagacaacttttttccaaataccatcaccatttaaggcaaataaattatttgaaaataactatgaagctttttttacactgaaaatgtaaaccttgctttaattaaaatttaagaagtctcctacttttcatacagctaaaataaagtacttactgaaacttttctccaacttccatattatttgctggtactttgccatgccagaagttgtatgtcctaaaagggtcgggggtaagagactgaaaggaatacatttctttttaccagcagatggctttcttttaacctcccaattacataattggtgctgccaagattgtcatactgagtggctcagaagtaagatgatttcctaaaatatctttgtaaaataatttccctcaattacctgctgtaatcacaagtcatgaaggctagcattcaacaggcatttgttgtggtgctccgcaagaccaattaaaccaattaactcctatggaattgtagtcgggtcaaagaaaagccatgattgaaatttagatgggaagttctttttctaacacgctgcatgacttagcaaaaatggatagtctgtctctaaagcaacttctttttccctaagcttagaactacttctgcagtagtgtttgccaccatatgtaggctttccattatatgatgagaaatatatgtcattttattttgctggactgtatttttggttaatgtatatgttttcttaataaaagaaaacagttttacccaatgctgctgctgaatgcttagagaatgaagggagggagggaggagttgggagtcaggagtagaaaggcaatgaatgttccaggagactaaagagacttgaagactgaaatttcaacaataatccctttttggaaaccaatatataaattgcttatttctgaattattaagctaattctgagttgtttccaaatgtccttttcacttgctactgtttcactgagtctggtctgaaatcctgaaactgcagcccagcttttgaagttaaaatttttctaccttccaatttcattctctactattgtgtcagtattttgagtgatctaaacattatgtttccaacaaagaatgaaatttgtctaattttctcatcatttataaatatggtctttgtacaaagtatattattttaacctggaatcagcacacaggaagaataaatttaggaaggaagggaagaggggtggagttaaagacatgatatcttaatgcgattttgagagcttcacacatctcagtgctactctcaaatgatatgtgtgaaaggcatcttggtacaataactttggagggaaatttggtaagacttaacaaaagaaacacacacacacacacacacacacacacacacacgcactccctttggtccaggaataattttgctttcagaaatatgtcttgtagataagctcatcatcatattcaaagcaggcagccttgcttatagttgccaaagatgctttaaaaattaattggcagttggcctggtaaataaataattatttgtttataccgtggtatattatacattcattaaaaatgaggtggatctttatatgcatatacggaaagagttctgagatgtaattaaaaaacacaactaaatgcagaagagtgtgcagagtattctctggagtaaaaatgtatgtgtatatacatgtgaatatatctacttgctcttttatgctcagaaaatttctcacaggattctctagaaatattaccagtgattgtttctgaagcctaggagtgggatggctccagggtcagagacaattgtttgcatgcacttctgtagtattaaaaattgtgtcatatgtttatatttatttttcatttaaaaaatctagataattttaaaatttttattaaaaagagcattccaggacttgagactaaagatagtatttttctaggttgtttagaagggaaaaagaagaagttttgtgagataagcctacaggaaacttatctaagccatcccagtctctgttttacatacacttgctagctacatgtaatacaaatagaatggtcaccaaaatagtgctgtccaggaagggaaaacgagactgtttccatgacggtctaaatgcacgtcaacaacagcagttagaaagtagaatggaatatcagaaatctggctacacagccagatccttagtactttcactttagggatctaactgtaacttaaaggaacaattgaactggccacctaaaccctctacattgaaggatattctctacagacacacacacacaaaatgctttaaaaatgaaaaacaatgtttaaatctctctggataggcttactatgttcttcatttcagccagttcaagagtgaaatacaaatcagatgcacatacagtcgtgcggacccgtgccggtagacaaagtagataaattcacagttgtttttgtttatttgtttgtttgtttgtttgtttgtttagagagagagtccatgttgtttggcatgggatctacctaggctaatttaaaggataattgcaaaaatataattttatattggaggatgcagatatagatgaataatgattcttaaaaaaaaaaaaaaagaaaggaaggaaggaaggcaatcagttcttggtacttagttactaatttttttaaggacattagtttaaacgaaaaggagttggcagctggtttcctgagctaccggtcttcatttcattaagttactcagatcgggataaatgaaaatataagtaaagtaatactgctatttttattttgacagaattgaaagaaacaataatgaaataacttgatcttattgtaaagacttaattataattcttaaaggcataagccagctccaaggtagttcattgattttactgataaatattaactgaaataaagcacttaaaaaggtagagaggtaattttcaatagttgcatttgaaaagctggcttacttttaaaaatatgtaggctgacaataggattatacaagggttcattcactgttttaaggaaacgatttataaatgttaatgggatgtttattttttctcctatagaaagctagactggccaggatccgggcagccaaaagcggaagcgcaaatgcttacatgcagagcaaacggaatggtttactcagtaatcagctgcaggtacaatcaattacatctctttttttaatgttcaatttcttggtttaatattgatttagttctactttcctataattttattatggctaattatgacaatggctatccaaacaacaaaagtgtgtttgtttgtgtttttttaataacttcaccctgtacatccttgttggctgtagaaggttagaaacttcactatgaaatactgccagtgaatcatgatgcctattcatcattgggcaatatttctacactgtctcttattaacatggtaaaggtaaaaaaaaatgcttaataattcaaatgcctaattctttttcatttcaaatttatcttccttaacgttcatttgggtcaggggttggggtgggtggctaacatgatgtcttgttttacttcataacgaagagggaatactattcagtgttaggaagatcatatggcataaactacaatttgagaaaatttatttttactccagaattttcctttaatatttaggactccaatctttacttacaaaatagcttttatttacgtgcacatgatcgtggtttcaaaattttctaagcactatgctaaatttgatcatcaaaacataacagattcccatcttacaaacatagttgctagttgaatgagtaaaagagatttcaaatttcaattcaaggaggcatgtctaaaagaccagaccattcatttgatgaaattgtaaatgccgatcatccaacttaacaggaactgcacatttgttcctttctagttagaaaaaaataaaatgttgccagttaatagagcagatctctctgtggaaatatgtagccgaggttcgagttgtttgcaaataaaatagaaagctcttctgtcttctctttgttaacagtcctcagaggatgagcaggcttttgttagcaaatccggctccagctttgaaacccagcaccaccacctgcttcactgcctggaaaaaaccacggtaaggagacagcatgactgccttcccttgctctctgacagtaattccatttgcttttgtgcatacttaatgcttccgagtgtgatttcactgtctgcattactggaaaacatgctaaaaaacaaacaaaccaaaaccccacaatatttgaaattactttgaaagatgtaatgacatttcaatttggaaagtattttagaaacttatttaaaatgttttattcttagctgctgtcttaactctagtctaagaagtcagttaatgcagatgaagagtggtcttccaatagtaaatcctacacaatatcattttctgtgattcttaaaatgcgaattagacagaaaaaaattaatggtgctcgagggtccctagcatctagatcaagagaatagcaatagcaataacaaaaaacagagaacaatggaatataagcatttgtttcattcacaaccataatgaatagagatagataatagaaactattctcattagaaaaatgactcatgtaatcactggtatgcccttgggtgctaaggagtgagtctgtatttctccacttacaagctcttgtttggacctcctcattggcaaatctaccaatttcttaaccagtttgtaaataggagtcataatctatgataatcacagagcagaacaaaatcttcaccatatttggatcatgtcagctcactcactctcgggtgacacatgatttgtattctcagttccaaagtattgcctgttcatgtacttatttaccaatagagtcattcagcaaatatttactacttgcctattatgtgcccaagagtgagccagacccaagaaacgccatgaaatgaggtgtggcctctgctaccatttagcctctgtttataaaacaaaatcccagacagggctgttactggaaaagagcagcgaacatggaaagcaacaacggtgccacagtcaagagagtaaagagggcagagccatgaggggacaggtcaggcaaggcttcctggaggaacttgagtggagacctgcagggtgactaggagttagctaggcagagcaatgaaggggctaacaggtgatacaagtacctgaagaaggaaagaactcagcctaggaggaagtgaaataatttaagagtggtcagaagaagagagtgtagcatggcaaaagaggagctgaagggaaaggcagtgtccagataatgttaggctttgcagccatgtggacaattttgatctttagttcatggaaatcatttaaatgttttaaacaaggtagtaacatgattatacttgcatttttaaataaagatatggacaggtctgtaacctagtaggataaatttgaaagttaaatgatacattaataataaaatgttggccaggcgcagtggctcacgtctgtaatcccagcactttggaaggccaaggtgggcgggtcaactgaggtcaggagttcaagtccagcctgaccaacatggtgaaacctcgtctctactaaaaatacaaaaaaattagccagacatggtggcgggagcctgtattcccagctactcgggaggctgaggcaggagaattgcttgaacccaggaggcagaggttgcagtgagctaagatagtgtcactgcactccagcctgggcaaaaagagctagactctgtctcaataaataaataaataaataaaatatttttattcctatcttttctgttccctgtattttccttttttgagggctttttttaaaatcaaaaatcactaacaccaactaatataaattatgctacctacaaaagtatgtagtaactaataacagaatgactcctgcactttcaatcactgatgagacaaattagaatctcatgcattataacttaggtatgtgaaaccatgcattgtaagagaaggaaacagattgtgaatcttttgtgcaccattttttctttgaaatttaatatttgaaatattaatttcaaatatttctttgaaattctgtcttgtctgattatattattctctagactttaaagagtagaatgttaaatttcatttatttcaaaatgcttgtctcagcaaagaaatgacaaaacgagtagctaaaacataatctatttcttattagccagtgtcttgcttcaattgttttactcatattttaggatgagagatggttaagtggaatttggtatgtgcaaagccttccattataagactatccccacccatgcaaagaaaaacaaaatagtaattgaggtcattctctagtagttcagaccaaaaatgttttcctttatatttctgaggtgaaattcttccataggcatttcaggaggttttttgtcaaacattttaaaagcaaaattgataccatgtttctataaaatacgatatgcgaaatgatgcctattgctatttgctactgggctggaagttaggaaatagtgacggaaaaaccccaaatgcatacagagatcatgagtacagccagtgatgccagtgatgtattacgaagattacaaaaaaggccacaaaagttcaatgctaatcccttctgggtcgaacacagagtgacacattcggcagacaattatattttacttatgtaacgaataagtcatatttttctgtactgggcatttttagaggaacatataaagaaatggatagtgtcttaggggtctcattttctaatttagaaatgttttcactcccatgtgaaaagatttgctaatatataacagacaatctaacttggggcatcctattaaaataatctattttccataacttcaacctttttaaaaaataaagtcagtgggaatttctaatttccctgtgggttttatctatatgcattttttaggttttttttttccttatcatataccttccagattttatgtttaaataaataaatgatatttcaagataaagttagtctataaagggacactaaatcagcctacagatgtcaatctctaggtttaactacagagatagttccacataaatgccaaaaagaagtggttttgatgtcaatctttatgaaaatggttttatttaaccattgtatcaagtctaactatacttgggcagatttgagctttaaaaataaagctatgtatttcgtttttaaaaatgtgcttctctgtttcttcatttacttacaactgtggaacagaatcacgagtttgtggacgaacaagtctttgaagaaagctgcatggaagttgcaactgttaatcgtccttcaagtcacagtccttcactgtcttcacaacaaggagtcaccagcacctgctgttcacgacgacacaaaaaaacttttcgcatcccaaatgccaatgtatcaggaagccatcaaggtagtatacaagaactcagcacgattcagatcagatgtgtggagagaacacctctgtctaacaggtacctgagattaatctgtgttgtctacacacctgtgctggttcccagggtgtgtcttctgcactcatgttgtcacttacatggcatctaaatccctagctcctatggttcaggaagagacaaaaatggtagcgtaacaagtaggaaaatggttctgcttgcatatccattaagggttaaaaatagtggttatatcagtattaaaagagtcgaaagaagaagagatgattgagtgcacacaaatgtgtttttctctcttctgttccacaaccttttcttatttgggcaaggacttttatactcaggagtctcttatatattcaatagtctgaaatgatggtggacactactaaaagagtcaaatgaaattgagatcaacatggctaaaaattattgaacagcatgtaaaaatatacaaacacactgtctgtaacagtaaaaatgaaaactttgcctacataagtcatttctatcaatatataattttgatcagaaaggtatttttggccatatcaaacacaaaatcaacataatacaaaaaataagtgaagtactaaaattgtttgcctctggttagtttatgaacaaattaagtaaaacttccatattgatatatttcctttgcttttccttattcactgtttttaccacaaatgtgtaaaaataaaaagttgtacatttaaacaatatatgtcattaaaaatcagtttctgccaaaataattttattctgttttcaaattgaacagcatatattgttagagtgagagtctgtaaattcagtcctcttctttgttggcattcagaagtctttgttgaaatctggatgagattctgaattcaggtgatgttgatttacataaattggatgtctctgggactagaaaattaaaattaggagccataagacttctatcttcaagatattttagctttgcagttttatatcctttataaagtgaagtcgacaatggaaaattatctagcaagaaaatcttaggacataaacatcttaattatgttttccatgaaaataaaataatcagtttcaagcttctgtgtatatccttctctctcatttcccttttatccccttccccacatagagtatacaattcatccaataataccatttgggagcttgaagtgttagatagtaatagataatttttttatttctgtaatatgtgatcatcattaagttcagaggtttgagggcattatatatcccaaaaagacatgaaaataaaaatattctgtggtcaaaggaattaagaaatcaatgtgatatggctctttcatagtggtttctcaaacctctcagaggtctgtcttaaataaaacttctttgctcagcccaggctgtccaaatcttacttgaagctctttctttcttacatttttttataatacatttagtttgataaatacttgatggaaccaagtcaaactgtcttttagaaatttatttaatgttaattactatgttcatctttaacatagattaagatttggtgtttcatatttttaattataataactttccttagacaattaaaatatttttataagcattacaacacatattcttcagttgtatgaaaaacattttaagtaaacaacttactttcctaaatatttttttttctatcagccgatccagtttaaatgccaaaatggaagagtgtgttaaactaaactgtgaacaaccttatgtgactacagcaataataagcatcccaacacctccagtaaccacaccagaaggagacgataggccagaatcccctgagtactcaggaggaaatattgtcagagtttctgctttgtaagacaattggaataaggtctaagagaattcgagccctggctgtgaaaagaatctcaacatagaagaaagaagaaacaataaatattctgcagattaatgcagcaaagaaagaaggttggtagtgaaacacaaagcttccaatcttaaggatgtgaataaaaccaccaaatggcatttctagacagtttgacctgttatacagagtaatattctgtggccctttgactttgtgaatgagcacaatgaaatgccgcctactgatgcttcttatgatcagaactcttttttaataaaataaataacataaatcgttgaacataatgttccagttgaatgcaaaacaaaaaaaatatggaaaacattttgataaaattttttcctgttaaaaccatgaacattggctatgatgaagattattacatatgaaaaaaaaactcacacaacatatttgtattgactgaaggaaaccatcataatgcatgctagaattctttgaagcagtgatctcagtttccttatgttgtcttcagaataggcatgataaactataattgtagaaaggggtaatttctgtgcacttacaacaagctgagtgttcatgttccatggtgggctgtgcaaataaactccttttagacctgcagtatttctcatggggatgctcattagtaaatctaaagtgttcagatagttcagtattcattatcgtttaactttgcacctagatactgttacaactgcaataatttgttgtacaactgttgtatcaggaatcaggatttttttgttgttgtactttccagatccttatagatacggtaagagccacattcgtagaaaaacttctggtgtggccaggttttaggtaactttttaatccaaaactattgtgccataaatgtttttcagtaatattttttggtccactgtattcctgtgacacagtgcattatctgttcttgtatttctatagcacctctctattgggtttatcatcatcaacaagactactgtttactgtagttcaagtgactttcctacttttgtatttccaaaaaaaattatcttgtaagtagcttgtcatcaatccccttgtcgaaaactagaaaaaaaggagttgacccatataaattatctctaacgtctttgttgtttatggaaaagcccagatactggatatatcactatgtattttatgaacagaattgactgggactaatatcacaggatcaatcatctcagaatcttacttgatgcattatttattttgctttagatcttgaatacattttgagaataactaatgtggattgaaatgtagagatacactggagtgctttatttagcaatatttgatgaaagcatgctttctacgccattcaggaaggcagcacaaatttatctcagaaaggttcctgtgtattgcaaggtacaattttctccaataaatcaggagaacaggagtttgatgatgcaaagttgatctctgtacatttaagtgaaaagtctttataacttttcacccttaaaatatttcagcagacatgtctgcacatgacagtgtaaaaaagtttaatgtcaaatgcaaagtttttattcattccaagccaccactgtaaggaataaagcttagcttctgtacatggaaagagctaataattatccctctgtcagagatgagatttttaaatgcttatgatatttaatcataaaaagggattaatccaaccattttctagtaaagccagaaattcttgcttcccatttctagaatagtttctagaacagtgctatgcacatattagatcttaataaacatttgctgagtgaaagtaagataaactcaactatctcttgggaagaactggcttcattcctagtacatcttttaaaaagttactaattttccagcagtacaaatattaacaattatattaacacctgcctcatgtcagtttatgcttctagagcaatgtctagtgaaacttatctgatggcatttattgaaaaccttctaaaaagtagactaaggaaaccataatcagaattactatgtcttttgattcccaatgagaagttctattttcatgttcttaatattacatacaagaaaatgcagttaggttatttcaattgacaattctgcctcctcttttgatttatcacttacccaaaattattaattttattaggcttttggaaaagaaaaaaaactttttgatgttttaggtgatttaaaaatataccgtgttggtggtgaatgactattgatgactgtgttaagtgcatctgtattgtaagtgaaatgtaattatttctgtgtaccatatggagtaactaaggtcattgtttttgacaattttgtttgaaattcatatatcttatttcaaaggatagcataatatctgcattatgctggaaaaaaatagacctttggagaatacttaaataaaacatgtgcatgcttgaacaggac

SEQ ID NO: 682 - DNA, 130755 bp, Homo sapiens
actcactgcccgggccgcccggacagggagcttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagaggtgagtgcgcccggctgggggccaggcgagggggtgggggctcccaggaggaagcaggggcctctggggagggagcgcgtccacaggggcgcgcctggctgctggacaagtttgcaaacaccctccacccactgcggtgccagaggagggggcgtaggcgaacctaccgtccactgaccgcggcgcctcaagcgtcccgagggcacccagcctggcttgcgggtgcgcatcgtggtgaagccgggtcggggtcggcgttgcaggctcccctcttcaccgcagaggaggaaatcgagctcggccgggcgcgctgcaagtcctgaagttccgacgagtggaacgtaggtagcaggtctggtctgggatgcgacgagaactttccactagagttgcatggtggggccccgctctggccggagtcccgggggccacagatccggtctcccgagggaccggcgcggggcgaacgaacgggctgcgggagtcggagccgcagtccgggagccgcgatagactgaggccgagcgacgggccagggggggacggcagtcctggctgctcccaatgggcccttacgggcattattagtatccctttttaggggcacccagagagtgtgggaaaaggggagcgttcttttcactcctgttatggcagaacagaacttacagtgctcggcagcgtttacgtttatctggattcagcgaagtgttgttacaggcttttttttttttaatttgagaccgagtctcgccctgtcgcccaggctggagtgccgcggcgcgatctcggctcactgcaggctccgcctcccgggttcaagcgattctcctgcctcagcctcccgagtagctgagactatagacgcgcgctaccacgtccggctaatttttgtatttttagtagagacggggtttcaccatgttggccaggatggtctcgatctcttgacctcgtgatctgctctccttggcctcccaaagttctgggattacagtcgtgagccaccgcgcccggcttgttccaggcattttaatacaagatgctggactgatacgtggaggcaaggaaggccggtttcattctgcttgaacagcttatttggggagtgagtgatgaacagatttcaagtttgatcgctgatgcacttcttgaggaggctggaataaacttaccaggctttacccaaaagaaaaagaaaggggaaaaatgctaaataaacacattccaagtattttctctcagctaaaaggtttctatttccattcagcatgtagattttctctcttttgatcgagaatgcacttgactagccttcacctattacagtcaaagatgttttttaggaatacctggaaagctcagtttatagtcaagtaagttacttaaaagtttttcctttgagattttcctttgaaagctcatttactcaaatgaaaaattcttaaacagtgcacccactttttgcacgttaaattacataagcaatttataatttggggcaacatagcaatttgaaacaaactttaagagccaggcaaagaactaaagcagttctgttctccactgcccctccctccaccaaaccttcaaaaattcctcagcatttctgccagccccatttttcataatctgctgcaaatctgttatttgttgctactagtgaggactggccgtgaatagtcttggaggtagtgaatgtggtgagaactatggagaaagtaatgggaacaatagttttgtgttaaatacttaaaaattggagtgcttttgtttttctaaaattttaaaaggctgtaataacaaatttttgtagctgacaatcaactttaatcagacaatcataaaaaggccttttaaaatccacccagctggaagaatgaaaagtttcaccaatcgttcttgcactttttgcttttggttttgaactttacctatgagatgtgtgacagttttacatctcaccttgtgaaaagcttaaagaatgggattctcactggcagaattacagcacaaaggagtgctgtatgaagaaattaaacatggaaattagactcttcatctaattttaagattttcctattacacattgtgggtctgagtgctttgctgaccacacaggggagacagagagagagacaatgagaatatgtgtgtagattctacactgttagcagtatagaagaatgggtaaataaaatttaagcatcactttaacccaggaaatcccctctgccccccaacacacatacacactacacgtctcacaaagacatgcacacacagaactggaactgccaaaccaggagcatttcgaggctttccagtctttcctttctgctcagtctctgatgggggtgccattgagcagcaaaatgaggcaagcggtggctctctgaagggccagggagaggatggagcaagataaatataaatgtggataaaaatgaatgcattatgaggacttagctcatgacgaggctgtgtgtgcagctaaactcaacccttagagtaaattaggcttttaagattctttaatgttaatatttcttttccaaactgatattgtaacatgtattccagtatattgtaaacatcttcccagagggaacttttaagttgttctgttgcttgtgggctttattccaaaggcttcaaatgctttttgaaagtacatcgtgcatattttaaaaatgaatacttttagaaaattattctgacccattaaagtgctgagtggaattcttttcttttctttctttcttttttttttttttttggcaggttctcattctgccacccaggctagagtgcagtggcaccatcacggctcactgcaacctcaaccttccgggctcaagtgatcctcccacctcagcctcccaagtagctatgaccacaggcacataccaccatgcctggctaattttttattttttgtagagacaggatctcactatgttgcccaggctggtcttgaactcctgggctcaagcgatcttcccaccttagcctctcagagtgtggggattataggcatgagccaccatgcacagctgaatacaatttttaaaaaattaacaataattatgtttttttgtttttgagatagagtttcactcttgctgtccaggctagagtgcaatggcacaatctcggctcaccgcaacttcccgcctcccgggttcaagcagttctcctgcctcagcctcctgagtagctgggattacaggcatgcaccaccacgcctggctaattttgtatttttggtagagacagggtttctccgtgttggttaggttggtctcgaactcccaacctcaggtgatctgcctgccttggcctcccaaagtgctgggattacaggcatgagccaccacacccagccaataattatatttttaaatcttaatttttgaaataatttccagataattgtagaagggccagtgagttactagtcagcattggtcaagaagaggttcaatctttttatgcctgtgaattgggaacatgctgctgggtagaaaaactgagctgggaccttgaacacacatgtgaaacagtcgctttccatataatagccagaatgagattttggaaacgaatctgattgtattttccatttgaaaatcttccagtggcttcctgttccctactagaatttgcagagactcacagcgaacctctttgacccatttccattcacttccctcttgttcctaccactccagccacctgtgtcttctttctagggcctgagcagcctttgcagtgactcttccctctggctggaacctttttcccaagatctcggcatgctggcttcttctcatcctttgggtttcagttcagaggttctccttgagaagccttccccaataaccaccccctgccaaagtatcatatgcatacaccccactatcccttaaatttaatttcctgataatgcttctcacaacctgatcagttccttccttccttccttccttcctccctccctccctccctctatttctttattgacagagtcttgcaatggcaaattctctgctcactgcaacctccgcctcccaggttcaagcaattctcctgcctcagccttcccagtagctgggattacaggcacctgccaccacagctggctaatttttgtatttttagtagagacagggtttcaccatgttggccaggctggtctcgaactcctgacctcaggtgatccgcctacctcagcctcccaaagtgcagagattacaggcgtgagctatggcacccagccttacctctttgtttactccttttcctccactgtccccccaccacaaggtaagctcctggtggcagggctgctgtctttttcactgctaacacagcatggagctcatacgggtgctcagtgagtatcagagcacagcatgaaggaaccaagcccctgcatgtcttaccaggtgctcttcacccttatcttttcctactggcttttccagaaacagaattgctggagctcccatgccctcacattcggggcttggttaatagaaaacaatcttttattttgctgtgatgccaatgtgatttcattgctggaggagctagtcaattaaaaccagacagatttttgggctgtattaaccccaaacatattttacattgtcctaactattccaactagaaaaaaaaatgtcagaaggtaatttttcatgttaaacacagttctaacaactccttgctcaggggcaggtagccctgggtgccttgactttggcccttgccgttagtttaatcttaacccaaagcacatggctctgaattggtatgtttctcagcaggagattaattattataaaaactgaaaggggtctcacactgtgtgaggcacactatgcctctggggactggaatgaaagtgttaaccgggactggcttctggggctttgggggtggtgattaactttcaggacctctgttcctttttgggtacagtgggaggctcttttcatagaattgttaggaggacgtaatgagctaatggcaggtgatatgtgcttaaaatatatttgccattattaccaatggttctcctccattcttctgaactcaagtatgggggaaatgtttttcctagacaaaaggtgttgggaggagggttcttttcttattgaagtgtatcctgaatggtccaccctccattgttcagaatgctttggtgaaggggccctccggtgtcgccctagagtgcccaagtcctttgctgcagctctttaggtttttgtttcctagtagtttgagcaaaacccacccaggaccaagcagttctccagagaagcagggcccgccctgactgccattcccctcctactcctgcccccataccttcccttatggagttcaaacttgacatagtacaggaatagcttcttgtcatgtgcctctcaggaaggtataaaaatgaagtccagttcctgttcaacttttcccacataactcttttccaaactgggtgtggtttaaatttttttatttttattttttgtgtttgttttgttttagggtttttgagtgtgaacatccagaaaattcttttttttttttttgagatggaatcttgctctgtcgcccaggctggagtgcatgtggcgcgatctcggctcactgcaacctccgcctcctggcttcaagcaattctctgcctcagcctcccaagtagctgggattacaggtgccctccaccagacctggctaatttttgtattttaagtagagacggggtttcaccgtgttgggcaggctggtcttgaactcctgacctcgcgatccacccacctcggcctctcaaagtgctgggattacaggagtgaaccacctcacccagctcagaaaattcttttcctttttaccacatcgagctaggttttcccaatgaggtcagttggctgcaacatagagaaaatgaggctttggttcttagagtagattccgtgtacaggcgtgagtatgtgtccgcaggtggtcttgtaggaaatgcaaagggcgccaggtgcactcctggcttctggtacttcctgcttaatggcatgggtgagccaaccctcaggtgcccgggagggagccctgattactctccctctggcactctgggcattggctaacccgtgaccggagttaaaccagttccctctcttttcattctatgtctcccactcctgcctccagccgaagtgctaaaaatgcagcctggcaggggcagagaattccattaggatcagcaggccccttttggagaacaaggatactaagaatacctgccatcctggcacttcctccctcctaggccttacttttctctgtctgaaccatggctgttgaactgggtgattcttagccacaggaagggagggcctagatcttccctagttttgtgagactctgcagctggacagccatcccttcatgggagctgccacattttcactctcggggcctctgacaggcactaggatctagggacatggccggcatgtgaaaccctgggctgctatggccaggtcacctcctcaggtcctggtgtttcagagtgataaagaagaaagggtgattatgtctcaaacatttcattgagaaacctacactgttctttttttttttttttttttttttgacatggaggctcactctgtcacccaggctggagtgcagtggcgcgatctcagcttactgcagcctcctgggttcaagcgattgaacccagggttcaacctcctgggttcaagcggttctcctgtctcagcctcccgagtagctgggattacaggcacccattaccacacccagctaatttttgtattttttagtagagacaacgtttcacaatgttggcctggctggtctcgaactcctggcctcaggtgattggcccacctcagcctcccaaagtgctgggattataggcgtgagccaccgtgcccagccagaaacctacactcaattctaaagcattttatttcatccttcttggctagttcttcaattatcagtgcttctttcactcaatggtaaatggattttccatgagtcttggaggtggcaggcagggagaaggggcagaaggaaagagaaagagagaacagatgttggctttatgtttggaataaaattacaccaaaagctaagaacatttatatttgtgcttagagaaaccccatttcatttcagaagctcaatgcctggatttttttgccagcacattttacacttgtatgtttctccttgtactctgtgcctccatgtatttctgttggtcccttgaaaacaagatccaatcatcacagggttagtgctctgccctaggtcactccagtaggggtccatcctccggatttagatctcaggttggcacttatgcaaatgctttctgacaggtccccttttttgtgtaatctgctttttctttgaggatctagatacctcagcattcagggacagtaaacatcttagaacttgccttagctgtggtcttgcctctcattagatacacaaagaaaagccttgtttattttggagaaggaattgttttgttattttaagccttagggccttgtggttagagctaccaatagtagattggcttcattatggttttgaaaatgatcactttcacaagtaagaacaggctgtcttagtggagaatattagaacagagactcaaacttaactgaaagttgttttctgtcactgtgccgcttagggaattctcagtgcggtgataaatattcatggacttcccaagtgttgtgtgtgcctggaggccagtttttcacttgttccaattaacggcaggctgcctccacacaggaagtgaaaccagcctttaagcctttttacaattctggcacatgatttgaagatttggtgatgaaagcaatgttctttgaaagttttggagcaaataaaaaaaagaagctttttagattcactcttagtttaaaaaataaccacttggggagttgaaagatgtaagttctcatcctagctttgagaggaacctgcagggacagctggggtatagtgtgtcctccttctaaaactccacatcctcacttgtcaaatgggaaagcagatggatgattctaggcccctttggggcagaacactgattccatctaaaggggagaggtgggaagggatactttctcccatgccgtttgggacacagagcctcagcctgagtttgaccctcagccctgtgcgtgactctcggtgtgaactttcttagacatcagcccagaaacggagatggaggctgtgtgaagagtttcattaaaaatgagtgatgcagccaggtgcggtggctcacgcctgtaatcccagcactttgggaggtcagggtgggtggatcacctgaggtcaggagtttgagaccagcctgaccaacatggtaaaaccctgtctctactaaatacaaaaaattagccaggcgtggtggcgcatgcctgtaatcccagcaacttgggaggctgaggcagaagaatcacttgaacccaggaggcggaggttgcagtgagccgagattgtgccactgcactccagcctgggcaataacagtaaaactccgtatcaaaaaaaagagtgatgctagtgggttctttgctgttgacagttgccattccctgccacctgggctgtctgttcctccagtaagtaccccctccaactctggggcaatagaatagtctggaaacatggaggtatatttctgagaatattggatctccccaaacacatatgacctcttcctgctaaatcttctgagagacagagggatggactaagctttttccggggtggatggagtggggcatatcccccctgagggggaacagcagaatcttcaggatcagggagaatgatgtcattttcaaaagtttattcattcaatattattatgtcattttataattggaaatttaaaaaatattttgtgatataaactgtagaatgcaacgctcttaaatattctggctgggaagataaggataaagacaatgattcatgacaggggttctcaagaagaggtatgcttcagaactacctaggaagcattttcgcaaggtagaagctcaggttcccaggacccgtggactcaatctttggggctgtggccctgccttgtgtatgtccaagctattctgtgccacctctttcgttacactccactgatgcagtatatctgatgtctgattcttgggcagtggtggggagcctctctctattaccccatcccaggaggggtatgtatcagaacctggccattgagggtaggagtaagctaattatgcttatccaagggaggtggcaattcctagacaaagtgagaatgttgagctggatgattcattaagccaagtgcccttaggattttaggacctgttggtggaaagagatacagctaatcaggtgggccaaccagtaaatagtaaggcctttccctttttaccattatattttttcctctcagctactctttatactcacatcttattataaaatatttaggatacacaaaaggatttaacaggtaataaaactcgcctgtgtactcactacttgacgtaagaagtcagacattaacactacagtggaagtccccggtcgttcctctctccagtgtcatcccctcactcccacccagagaaaaccattatcccacattgggtgtttcaattcccatgcatgtctttatcctttgatcatgattgacatgattatgttggtaacactctatagtgttgttttgcaccatgtcagttacatttgattgcatataacagaaaaccttacttcagtggtgtaaccaaaatgggagtatttttctcatacaacaagcagtctgacagcaaccaggttgggattagacagtggctccatgataaagtcaatgacctggctcttggctctgacatctatagtgtatgcttttagaacacattgttccttaaatggctgctgtgcttctgggcatttcatttgcattccaggcagaaaaaagcagaagggaaaaggacaaaaagtctcataccagctgagtctgtcctttttatcaagaaggtgactggaacatctcaacagcaaaaaacaagcaatccgattaaaaaatgaacaagtgatctaaacatatttctcaaaagaagaaatacaaatggctaacagataaatatatgaaaaaatgcttaacatcactaatcatcagggagatgtaaaccaaaattacaacctggtttcatttcattgcatttaggatggctatgtcaaaaaggcaaaaaataacaaatgctggcaaaggtgcagagaaaagggaactcatacactgctggtggggatttaaactatcacagccactattgtggcaggccaggtctcggtaacgcaggcctctgtaacaactgtttcagcactgagtggttaagttaaatattaaaagctaatagagccggtgccctcatacaaaggctggaatgtaatgaaagcccaccagaagttttgcccaggcctttcctgggccttgactcatgacaagataacaaaggaattcttaacaggcctcatttaggattaaacaagttttactggggatcttaagaaattccccagacctccacaaacaagtttattgggggtctgaaggaactcctcaaacctccatgatttagcgggagacaagataataaggataatcaccccagcacctggattcacttagattaagtacatttactgaggctccagaagaaggtcctcaggactcagaccttagttatagattagaagaagttaatcacttatgtctttaaatgaatgcacacttccatgtagacatatagcttagaaggtatataatccctggaaaacgtaattttgagttgatgtggtgatgttttccaggccttctccctgtacccagggagaaataaactcccttctttcccagttcatctgcatctcattattgggcatgagaataagcagcccaaccctcagttcggtccgggaacactatgaagaatggtatggaggttcctcaaaaaactacagatggaactaccatatgatcctgtaattgcactactggtcatttatccaaaagaaaggatatcagtatatcaaaaagacatctgcaccctcatgtttaatatagcactattcacaatagccaagctaaggaatcagtctaggtgtccatcaacggatgaatggataaagaaaatgtggtataagctttggcaacatggcaagacctggtctctactagaaataaaaaaattagctagacattgtggtgcatgcctatggtcatagctgctcagcaggctgaggtgggaggactccttgagcccaggagtttgagactgtactgagctatgattgccttactgcactccagcctgggcaacagagtgagaccctgtctctgttttttgtttttttttttttgagacaaagtctcgctcttgtcccccaggctggaatgcagtggcatgatctcagctcactgcaacttctgcctcctgggttcaagtgattcttctccctcggcaccccgagtagctgggattacaggcgcctgccaccacgcctggctaatttttgtatttttatttgagatggggtttcaccatgttggccaggctgatctcgaactcctgacctcaggtgatccacccgcctcagtctcccaaagttctgggattacaggcatgagccacctcacccggctgaccctgtaacttaaaaaaaaagtgtgtgtgtgtgtgtgtgtatatatatatatatatacaaatggaatactattaaatatttagccataaagtaatgaaatcctgtcattggtagcaacatggatggaactggaagacatttggttaattaaaacaagccagaaacaaagttaaacaccacatgtcctcactcataggtggaagctaaacaaaaaagttgattttgtagaagtaaaaagtaggacaaaggttactagggcctggaaaggataggaggaaggggaggataggaagagatttgttaaagaattcaaaattacagcaagataggagggataagtttagtgttccatagcactgtaggattactatagttaacagtaatgtgtaatgtgctccatagatatgtacaattatgttaattaaagcagcttttaaaaaagaaggtgataactcaatacgaagccctatgctatggacttcagctaacctttccctgattattccaagctgccaggaagagtggcaagtcaagtgtgctagctgggcaagttgccaccctgaatgagattgggtcccctttgtggaaacaaggggaaatgggtgctgagcaggacgctagcagcagcttaccacatacatgttataaaatttcatataaatagtatgctttcttcttcagcttgctttttcactgtttgtgaagtttgctaaattcatctgagttgaaaagtgtaacctttgttcatttatcttcatagacaaatatgtaaatataccatagttttatttatccaatctcctccttttgtttttttgttttctttcttttttttgagacagagtctcactctgttgcccaggctggagtgcaatggcgctatctcagctcactgcaacctccgcctcctgggttcaagtgattctcctgcctcagtctcccgagtagttgggattacaggtgcacaccaccatgcccagctaatttttgtatttttagtaaagatggggtttcaccatgttggccaggctggtcttgaactcctgacctccagtgtgatctgcccgtctcagcctcccaagtgctgggattacaggcatgagccatagcgcccagcctttttttttttttttttttttttttttgagttggctgttgcccaggctgaaatgcagtggtgccatcatagctcactggagcctaaactcctgggctcaagtgatcctcccacctcagcctgttgagtagctaggactacaggtgcatgccaacacagccagctgtttcttaacttttttgtagagatgaggttttgccacattgtcgaggctggtctctaactcctggggtcaagtgatcctcctgcctcggcctgccaaagtgtggggattacagacatgagccactgtgcctggcttccaatcgctttatttatttatttatttatttatgacggagtctcacgctgtcaccccggctggagtgcagtggtgcgatctcggctcactgcaacctccaccttccaggttcaagtgattctcctgcctcagcctaccaagtagctaggattacaggtgcccaccaccatgcccagctaatttttttttttgtatttttagtagagatggggtttcaccatgctggccaggccggtcttgaattcctgacctcatgatttgcccacctcggtctcccaaagtgctggaattacgggcatgagccaccacacccggccccagttgcctcttaatgggcatttaggttttcctgaatttttctattacaaacaacgttgccatgaacattattcttttctattgtgaggtttcctttgccataattaaatgtgcagattttaagtgtggagtctgatgagttttaataaatataggtatcaaaacccctatccaagttaagagcccttaaccttcttacatgtctccctatggacatgtgtgagtctaggagtggaaacactgagttgtaggttatatgcaatttcagccccattatatgttgccagtcctgcacatcttataggcaggttattgccatgggagatctggactaagatatttcttcccaagagtactctaaacagatctgagaatactcctcagggcaggttgcaactagattgtgaagtgagtgatgcaactggctctttcgccactcatgcttatcattcagtgccccatcctcacccttggctgtcacacactggagccttccctcagttcaaccctcagaaccacctgcaacccagggctcagtagctggggcttgtatgtggactgcaaggttagggtagttggtggctgtgagaagccctcttcattccttcctagccatggagagctgggcaagtcgtttagcatctgggaacctcaggatcctcatctatgaactggggacaattccagtgatacacccttcacaggattagagaagactgtctaggtaaaaggcctggcgaaaggtgaaaaagtttctgtgtgggttgatacaggtactgggtcctttgctttttacccagtagaagatattgaacatagatttgtaacattgcttaaaggacctctatgccaggaatcaaggacaaaggccaaatatatactttgaaattatactacaatctgtatatcaatttggggagaattgatattttttctaggttgagatttccaatttatgaacacagtatatctctccatttagttatatcttcttgtatttctttcatcagtgttttgttgtttttagcagaagagttctgtatgtgctttgttagatttatacctaagtatttcaccatttggagtgattgtaaatggtattgtatttttaatttcaatgtctatgtgtttattgcttcatatgtagaaatacaataatttgtatcttgcaaccttgataaaataacttatttgttccaaggagacttttttatagattccttggaattttcttttttttctttttctttttttgagatggagtctcactctgtcacccaggttggagtacagtggtgcaatctcagctcactgcaacctccgcctccagggctcaagcgattcttgtgcctcagcctctggagtagctgggattacaggcgcatgccaccaccatgcctggctaatttttttgtatttttgatagaggtggggtttcaccattttggccaggctggtgttgaactcctgacttcaggtgatccacccacctcagcctgccaaagtgctaggattacaggcatgagccactgtgcctagccttccttggaattttctatgaagataatcatatctgcaagtagcaatccttttattttcttcttttctgatcttttctttctgatgtgttttacttcttttacttgctttattgcattggttacaactttcagcacggtgttgaataagaatggggaaagcagatatccttgccttgttcccatccattttttttttcagatctttattaagttgaggatgtgcccctcttttctttctttctttctttctttcttttttttttttttttttttttgagatggagtctcctctgtcacccaggctggagtgcagtggcacgatcttggctcactgcaacctctgcctcccaggttcaagtgattctcctgtctcagcccccaagtagccaggactacaggtgtgcaccaccacgcccggctaatttttgtatttttgtttgtttgtttgagacagagtcttgctctgtggcccaggctggagtgcaatggtgcaatcacggctcactgcaagctctgcctcccgggttcatgccattctcctgcctcagcctcccaagtagctgggactgcaggtgtgagccactgcgcccggcctaatttttgtatttttagtagagacagggtttcaccatgttggccatgctggtcttgaactcctgacttcaggtgatctacctgccttggcctcccaaagtgctgggattacaggcatgagccaccatgtctggcttcttcctaattttcttagagggttttttttcccccatgagcgaatattgaattttgttaaatgaacaatatgatcatgtgatttttatttttttagtctgttagtatgctggatgacattgtctgattttcaaatactgaactagctttctatccatggcataaattccacttgattgtggtatataattatttttatatattggtgagttctatttgttgatattttgttaataatttttttgtgtttatattcatgaagaatgttgatctgttttttctgtatttttgtctggttttggtatcagagcaatactagcttcataaaatatattaggaagttccaccctctcttctaatttctgaaggagattatgtggaattggtgttaattcttctttaagcatttggcataattctccaatgaaaccatctgggcctggagatttgtttttcggtagtttaaaaaattatgaattcaatttccttaatagttatagcctgattcaaattatctatttcatgtggggtacattgtgatagtttatgttttttgaagatttaattcacttcctctatgctaccaaattcatgtgtggttatttgtactattcacttatccttttgatgtctgcagagtctatggtgatttcccctgttttattcctgatattaacaatttgtcttctcatttttttctttgttggtcttgttagaggtttgttaattttattggtcttttcaaagaatttgttgtttgtttcattgattctgtattgctttttttttcattttctttttttatctattattttcttctttctgcttgttttgggtttattttgctctttccctgtgttctaaacttaaatgatggatttgagacttttcctctattttaatactataaattttccccagcactgctttagctgtatcccacaaattttgacatgttgcgtttttattttcatttagttcaacgtattttttaaaatttttttcttgacacttctttgacccatggactatttagaagtttagtttgcggctgggcgtggtaatcccagcactttgggaggctgaagcgggtggatcacctgaggtcaggagttcgagaccagtctgaccaacatggtgaaacctcatctctactaaatacaaaaaattagccaggcttggtggcacgtgcctgtaatcccagctatttggggagctgaggcaggagaatcacttgaacccgggagacagaggttgtagtaagctgagattgcactattgcactctagcctgggcaacaagagcaaaaactccatctccaaaataaataaataaataagtttagtttgcaagtgttgagaatttctattgtgtttctgttattaatatctggttatttccattgtaattagagaacatagactatatgatttcagttatttttaatttgttgaggtttgctttatatcattgatcttcgaaagaatgtgtattctattgttgggaagagtgttctataaatatagattatatttttttcttttctttatttttttgaaacagggtctcattctgtcacccaggctgaagtgcagtggcactctgatggcaccatcttggctcactgcaagctccgcctcccgggttcaagcaattccgcccaccttggcttcccaaagtgctgggattacaggcgagagccaccgcgcctggcccttcaagttcccttttagccttgctttctttctcctctcctttcaggacttcagtgatacggattttagatctttaatagtagtcccagagactctattcatttttttcagtctcttctcatggtcaaattgaattctattgttttgtttttagtataccgattctttcttttgttcccctttcattttactgttgaacttatccattgagtttttaaatttttggttattgtatttttttagttctaaaatttccttttgatttttaaaaagatcttctatttctttactgagactttgtatttctttgctgtggctttctgttttttcatgtttcaagcatgttcataattgttcatttaaatatttttatgattgcttctttaaaagatttttcagaagatttgtcattttgatgttggcatttcattctgcttgagatcagttttatttatttatttatttttttggcacacagacattttgagaccctggatcttagtttagtcttctgttttacctgttttcctctgacttgctctggctggggaagagggcatgctgcctcgttgctgccaggtaggggtagaattctaggttcctcactcagcctccattgacatctgagtgtggggatatcttcattactgctggtcagaggtcaggtggcagttccggctccccaccaggcttccactgatacctctctggctcagaggggtagaagtgcctcatttctgttccaattcttccccacctggcctccccaaacactagagtagggggaaggatggcctcctttctggttggcagtgaaagccctgactttctgcaggccccagatactgccccagtagggaggaggagagatgcttcattgcttcattaatgctgggtggggatggaaggcctggctcccacatggtcctcacaccagtcagtggggctagacatcttagttctctacttcctctaggccctttctgacgccaccctggagggccacttgtagtacttctctatagcttggtgagggtggaagtctagatttctcacttgacttttgctggtgtggatggggacggggccgtgatgtgttttgggttgcttgcctggagtagagcagtttattgtctaaaagttttctgtctggctgggctgcccctttccttgtctttagctcctagtctaggacatatggggcaaaaggaaaccgatttgttcttgagtcctgaggttcctagccagtctgcctgcttctctctacctttcagagttttgtcttgttttttaaaattatgctaaaagacgaggccaggcgcagtggccgacgcctgtaatcccagcactttgggaggccgaggtgggcggatcacaaggtcaagagatggagaccatcctggccaacatggtgaaaccccgtctctactaaaaatacaaaaattagctgggcgtggtagcgtgcgcctgtagtcccagctactccggaggctgaggcaggagaatcgcttaaacctgggaggtggaggttgcagtgagtcgagatcgtgcgactacactccagcctggtgacagagtgagactctgtcttaaaaaaaaaaaaaaatgccaaaagacacataacatataatttaccatcttaaccatttgtaagtgtagagctcagtggaattaaatatattcataatgttgtgcagtcgtggccaccattcattttcatcctgtaaaactgaaactctgtaaccattaaacactaattccccattccctctccccttagccactggcaaccaccatcctatctatattctgttctatgtgatttttgactactctaagtcagagttttgaaaatgcttatttaatatctagtgttctggggtgtacttagtgggaagaatagggaaaagtacatctagtctgtttttggaggggattctttgttctctgttacttagggaggactttaacaaacttcttgctaacaggtctggtcttccggagatagtcacattttaaaagaaaattgttttttccttaaggatcggctttttagtaatagtaatttacgtactggtaggctggagtatatgttttgggagtggcatgatggaaaagttaacatgaactgagcatctcatctgggtcttatgaaagccacagttgggcctccggcagtatcaaccccagacccccagaggggaaagcccctttgagaccctggccagacagtattgcctcagagcctttctgtgacaattggcatgctgccagtggagaaagcagagggaaacctttggttaagtaaacatgatattgtatacagtattcatatttcattgcaagagttgaatggtctgagtcagcataatcagttccatatgtttggcattgatagtccaggcatgactagttgcacctttgaaacaagacagatcagatgtttcatgttaggaaaataatagctgccatttattgcatgtctgtggatgccagacactgtgcattgtttcacgtgcaatattccactcttatcttggagagaaaacaggtactgaagtagagaattcaggtactggtgagctggagggtatgttttgggagtggcatgatggagaaattaaacttggggactcagcatctcttctgggtcttgtgaaagccacagctgagtcttggggagaatcaaccccagagccccaaaggctggagggaaactgtctcattttacagaaagaggagagtgagttttgaatggacaggtgacttacacaaggtcacctggcctctacgtggctgagctggggctatgccttgtccctctgactttagggttcttgttctcaccccacctctcctgcagcctcctcatctcctaaagcacgtgcagtcaaacctgggccctctgcatgaggatttgcgagctccatccaggccattcagtgccccccatccctggccttccgcagccccctggcccaccttagagtgatctgtgccactgaatctattccctaaagtaggggtctgaccctggctgcacattagaatcataagaggagatttttttttaaatcccagtgcccaagctgcaccctgagccaataaattcaagccctgggtgggacatgggcatcagaagcttaaaaacatttcctggaagattctgatgttccgctgggtttgacagcatagtgggagagttggaagaagatagtgaaaagtcgaggtcagattctggaaggctcttttctggttgcattggtgccccccatggtagggacatggacattgcagtctgtttgggaagcttcttttgcaaagcaccaccaagaaaaaggcaaatgccccagtgaaaaagtgggggacaggctgaaagggatgatgagagggtacctaaagccctttggggcccttggggcttgccctgctaacatgtgtgttcaaggccaagcagagaggtacctctgctcattttgttttttgatgttttttctttttcttttctttttttttttttttttgagccaaaaggaatgtattgggccaggggcagtaggaaggtcaccccactgataagcaagccccttgtgcttttgctcagatgtctcagccccttcatgctgcaagccttggttcagagaggttggatagctttcctggtgtgccaggtccctgtttgcccctccagacccactctccatgctgctctaagccccaagaagcagcctgtgggaagggcaacaatgaaatccctagtgctgtggctccagctggttttgactaaatgatactaagttatatttgttcctctaagtaaatccggggtgttcccatattggttgcttatctgaaattcaggtgtaaagggctgtactgttttttatctggcaacccaatgccaacaccgtgttttacaggcaacttcacgttccttccaccgtgcaggcatttctgggctttcactggcacttgggcttttctcctcctgtggctgggctgtgacctcttggggcacacactgcccagccatttacttcctttccttcctgcaagcgccaggcctgttctctccagcactgactcagagccagccacccgctttctcttgcagggctttgctacacttagggcaaatgggtggcgtgatcgcctcttcctcctttaacattctccaagtggcccaagggtcactccagtgaagttaataattaccatttgcaatttaggactgatccatcaggtcaagtgagttctgattgaaggttgttttttttttttctttttcttctaatgaagtgttgctactctgtttgtttgtttttcttctaatgaagtgttgctactctttattttatttatttatttatttattttccgaaacagagtctcactgtgttgcctacgctggagtgcagtggcgtgatctcagctcactgcaacttctgcctcccgggttcaagcaattctccctgcctcaccctcccgagtagctgggattacaggcgcctgccaccaggcctggctactttttgtattttttagtagagacagggttttgccatgttggccaggctggtcttgaactcctgacctcaggtgatctgcccgcctcggcctcccaaagtgctgggattacaggcgtgagccactgcgactggccactacactttatcaatcaggaatcctttgggtattgcataaatagtactaagtagaaaatttccttttgtgctatgtttggcctcagctagctgtgggggtaaagggagtggggtgggagtccttaacctgggtgacagggcagctgctcaggacatgattcaaatatcagcctggtgtgtgcacacagaatgtggggtgggggcactggtctaggttctgcgttttctcctagagagggtagggaaacagggataccagcatttacaggattccagatgcaaaagcctttctctgaactttgggaggtgaaggcgggcagatcacctgaggttaggagttcgacaccagcctgaccaacatggtgaaactcggtctttactaaaaatacaaaaattagctgggcatggtggtacctgcctgtagtccctgctactcaggaggctgaggcaggagaattgcttgaaccctggaggcgaggtttgcagtgagctgagatcacaccactgcactccagcctgggctgtgacagactaagacgcgatctcaaaaaaaaaaaaaaagcctttctctaaatcacaaacccacctgcagaagggctgtagggctgtttgatagcaaataccttcagcagacagcaagactggtgaggaaacagcatacctctggaataaggtgcatcctcttggccatgcatttatgtgccatatgttcatgtgtgcttgagttgggaagcaaagaacctctaggaactgaaagataagccctcactcttttgcagcctcctctgggcctcgtttttcttttatttctatttttggtagagacttgtctcactctgttgcccaggctgatcttgaactcctgggctcaagcaatcctcccgcttcggcctcccaaagtgctgggagccaccacgcctagcctgggcctcttgagtttgaggctgaactttagagagctcagctgatgcttctgcccattttattgttggggaaggaatagaaagagcaggagtaatgggtcccacaggctggcactcactcctgccattactgtaactctggtagaggagctattcctctctcttcccaggtgcctgggatcataaagcaggctgatggcacacagcatcctggggtagctggggtggggtggaactgaacagggttcaccagccagcaccctcagtcccacagggctgccacctgccctgctcaaccctcttcccacagcatggagggactccagggccagggaggctgcttgctgccacatccccacccactatcatgggacctgcaatttcagttgctgctgctttctttagtcacctcggtgatcaccttgggctgtgatcaccaagcttcaagaaaatcaaaggagctcatgttaggaaaggctggtggagaccatccctggagagattgagagatgccttagagctaagagcccttcgcatcccaagcccgatgtatattttttcctctcactcatggctggcaattatattactctagtattgcccttccccatgcattgtccaaggcagacatcactaattaaactcagcccttatccccgcagggcccagacctggctttagaaattcctactttaggtggccagcaggccagggttcagatgcaagccagtaacagccatgtcagccaatatttttggagtgtgctggtggactcgatgcctatcagctcctactgctgagatcctcttgtcctcacaagagttcaaagaagttatagagctttcctgaggccataccttgaggtggtgagggactgggtgggcctcagccctctgactgcaaagctgctagctaacctctgagcagcactgcccaccagcccttctgcctttgcacactgcatttgacaagtgctcagcaaggattcatggatttgagggtaggatgcactagttgatcacatggaaaataacattctttactggcttgccctaatgaacgaattttgagtctaagagactattcacaaagtccctaaatgtctgagccactgtaattgtgtgtcataggcatgctgacagcctctccaagttctgtctccagccacagcagtgtccttgcctggaccacctctcttccctgctcacccttcaggacctctgcacgtcacacccgtttattctgtaaatgtttgctgcatgtgactccatgccaatcatcatgatgggttcagatgatgccacctccagccttcaaggaagttacagacaagtatgttcagaaaaacagggcaaactcacacagaaaaatgggcagtatgtgaataaacattcactaatcaggtcccttgggcctgtcctgtactgggtgctgaagaaagatgatggagacaaaagccctgactttaagaagcggacgctagggctctggtcaagggctgcatggtgattggaaacacatgggcacagtgcaggggtgctgcaccacacaagtccaggactggatggagtggcccctggagttggtaaatgcagctgctggagcagctgggcggctactctgggacctgagtgggaggctagtgatccaaggcagcttagcagcactcgtttatgtgaagttaaaattccactccagctgtttatccagtccacatgaggaagcaatcctggaagaaggtgggagggataaggtggagatttcttgtgaattccacccaaattacaaccagaggcaccccacttttccatgtgctgtgtagaaaggaccacatttgcattaagtctttgatgtgggtaagcctttcagtctgaattcatctgcaatcactacccaaaaataattttgagagtattccacttctgtgggggaaaaacagggggaaaagatacgttatacaaccaaagtaatagaaacaatgaaaaatttagcaacttaaaatataatttctaattcatcattgcccaaacccttgggtccaaaaccttggaatggtttttgttttggcttttttttcttcacattttgtataatcacccagtgcccccacacagggctggtgaggttatgcattgcacagctctagagaacaatttatacagccaacaacgatgtgaatggcaataccaccccactaaaattgtgcagtacgagcctcaccaatctcaccagccacgtgggggtccagcctcagtcccaacagttctcaagggttagaccatggaagatttttactaactcataataaaatgagaaaataattaaaataatagctaacattgagtgcttactgtgatccagacagtaataactcctttattcccgttggcaaccctatgaggcaccatggttgccatccccactttccctgtgagcaaactgagcctgagcagcctcgagccaccagctgtccactcctgagaactctcctttatgccaggatcgcatctttcctcaatatctggtgtcagactgactttcctttgtggaacactggtggtagtgaggatgctgttgctgtcagccccctcttcttggtctcctgtatccttcctactcttcactgactgcccctgtagtcaggtcttcactgccttcctggaaggttcccacttcctgctcttcttcctcctactcagccagttgctggtgccagaatccccctcatcaagcctagctctgagccttgctctcccttgctcagaagccttccaggaacttctcctgcctcgactgggattcagggctctccacattcaccttaattttggtttatctcccatttttgttctagcagagtagctctactcttcagctaaattgctgttcccaaactggttgggctacttcctgtctcttcagtttcccaccacctttgaccctggcagccccaggcaccttctccatccctcagatccatcctttactcactcattcaacaaacctattttgagcacctcctacatactggctgtagtgtaggtggtaggtatcatggagctttcagtccggcagtggagaaagaactggatgagtaatcgtaagatgtattacaaaagggtcctagcacctaacctgggggtgctaactataggaggttagtcagagaaggcctccctgatgctatgggcagcctcccctccccacccccagttagccatgtccatctcccctttagctcctgggacccactgtggctctgttcctgaaataagtctctttctttatcccatttgactgtcgtagcaaatcttgaacccaggaggtgctatataaatatctgttggcaatcaaatcattctatcaacttctggtaaatcaaattgtacagatcagatatatatatatatatattttttttttttttttttttttttttgagatggattttcgctcttgttgcccaggctggagtgcaatggtgagatcttggcttactgcaacctctgcctcccgggttcaagcgattctcctgtctcagcctcctgagtagctgggattacaggcacccaccactacgcttggctaaattttcgtatttttagtagagacggggtttcaccatgttggccaggcttgtctcgaactcctgacctcaggtgatccacccacctcagcctcccaaagtgctgggattacaggcgtgagccaccgcgcctggcccagatatcttttaaaccatctagagtgttgagtgatttcagggtaggtttcgtggctcccggacttcagtgatgtcactttagtgggtggccttgcccctaaccaagttaacactttgtttggtgaacagcttggctcatggaaaactgaagattataccccaaattgtaatcagaggttattatcttgcagggttgggcttacaaaacagactttattattattttttttaatttttttttttttctgagacagagtctcgctctgtcccccaggctagagtacagtggcgcgatctcggctcactgcaagctccgcctcccgggttctgccattctcctgcctcagcctcctgagtagctgggactacccgtgtctgccaccatgcccggctaattttttgtatttttagtagagatggggtttcaccgtgttagccaggatggtctcgatctcctgacctcgtgatccgcctgccttggcctcccaaagtgctgggattacaggcgtgagccactgcgcccagccccagactttcattttatattgtatatgcttcaataaatatttgaattttttcacaacaaatttgttaagttcctaattaaaaatttaaaatattcttaaataaattaaaccaatgaaggtataatttgcttctcccacttcccatttttgccttctaagaaagggacctatatttaaatgggggaaaaaagtgatttggattaaacccctaactcctgagtcctctgtagctcagtgaataggaagaaccacagatgagtgtgcccacccaagtggcaaaggtgaattgtcaaggcttcaaagtacatgaataaagggccaagtgtggtggctcacgcctgtaatcccagcactttgggaggccgaggcaggtggatcacaaggtcaagagatgaagaccatcctggctaacatggtgaaaccccgtctctactaaaaatacacagattagccgggcatggtggcgcgcacctgtagtcccagctactcaggaggctgaggcaggaaaatcacttgaacctgggaggcagaggttgcagagaactgagattgcgccactgcactccactccagcctggtgacagagcgagactccatctcagaaagcaaacaaaaacaaagcctacatgagtaagtagagcacccttgagggagctctgcaggtatgagacaaacagccagaacatgcattgctgcagaaagcatccacacatcagaggaaggggagccccctcctcctaccaagagcataggtccacccttgtgaaggtttgcctggcatgtgggctgtgagtgactggagaggcaatggtccctgtctgttgtcatcctgatcttcactccctagcataagtgaacactcccatgatggcacattcatctgtctggacagctgggctccaggccagcccacagctgacccacatagccctcccctaaagcacacagaaggccctacactcccacactcaccaagacctcaggataaggaaaagtcttcctgtatccttgtaggaaaatctcttctcttctatctggcattgatcctgactcactaaggaggcagttcccaaaggcaacagccatgagagttggcccccaacatcaaaggggcctgggagggagcagttgctggaatgggagagggagctgcatggcaagggctcccagacaggggtatgcccttcagttgaggcatatgtgctgtccagagtggcttggcagagaggaacctagaggaaaaattcccagatcccctcccttctgccccacgatttcctacttatatctcccattagccaattaaatacttaactgaatacttaaatttaaaaaattccagcctgggcacatacatagccagactccctccctacaagaaaaaattttaaactagctggacatggtagcacgagcctatagtacaacctactcgggaggctgaggtaggaggatcgcttgagcctaggagattgaagttgcagtgagttactgtaccactgctctccagcctgggtgacagagcaagaaggccctgtttgtttaaaaaacaattatttgttgttcatctgaaattcaagcttaactgggcatcctgtgttatttgctaaatcgggcacaactctgagcaaagaacaccctactccctgcacacacacactcaggagcccaggagggcatgatgtcctgagcatggcaggaggccagcccttgagcaaggatggagcccccactgtgtacccccagtcaccaacccataatgtagactgctaggcctatatctctctcacccacctgtctcactcactccctcccaacgtatttgaatagataacaaccagtgtagaatctgtgtccaaaaatgccactcagaaagctaaaagtacagctattatgagccttcccttgctcagaaaccatctaaaatacttgtggaccagatgaaataaaaacatttccaggtttattccagcaagcaagcattttcctggaagcttcagtattctatagctggtaacttaagaacactttttttgttgttaaggcacaaaaattgtaaactcatctctttgtggccatgagcagctttttttttttttttttttttttttttgagacagggtctcactctgtcacccaggctggagtgcagtggcacaatcttggctcaccacagccttgatctcctgggctcaagcgatcctccttcctcagccccccaaatagctgggactacagatgcatgccaacacatctggctaatttttggggtggtttttttttttcgaacctcaatcagctttttaaagactatcagccaaatttgcagcatagtctctgacagagcagacagtaagaaaagttatttattttgagacagggtctctctctgtcacccaggctggagtgctgtggtgctaccttggctcactgtaacctccgcctcccaggttcaagctgttctcctgcttcaacctcctgagtagctgggattacgggaatgtgccaccatgcccagctaatttttgtatttttagtagagacaggtttttgccatgttggccaggcttgtctcaaactcctgacctcaggtgatcctcctgtctcgacctcccaaagtgccaagattacaggtgtgagccaccgcgcctggccaagaaaagtgaccttgagccctgctgtgtcatcaccttcttcttatactgctgagttgggcatgaaggacttggaatgagtcagtaataagaaaatttttatttttggtgggggtggttacatttcttcaggactcttccagaggcgagtttacaaacgaatgaactggtgaataagaatatgtccagatgtgtgtgttaatgaattctgcttatcttttcctggggcacagaggacaccccagtgctctctcttcttggcctaagaagttgggaacctacttgggaaactcttcttatttaaaaggctaaaatttggatgttctgttttacagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcagtgtacctaatatataccaggacaccacaatttcttggtggaaagatgggaaggaattgcttggggcacatcatgcaattacacagttttatccagatgatgaagttacagcaataatcgcttccttcaggtatgtgttctttcttccttttttatttttttagttttaatatttatttatttatttacttattgagacagagtatcattctgtagcccaggctggagtgcagtggcacgatctcagctcattgcaacctccacctcctgagttcaaacgattctcctgcctcagcctccggcgtagctgggattacaggcgcccaccaccacacccagctaatttttttttttttttttttgtattttttgtagagatgaggtttcaccatgatgcccaggctggtctcaaactcctgaccttgggtgatccggccacctaggcctcccaaagtgctgggattacaggcatgagccaccttgccaggcctcttcctttctttttaaatgtcattatgctaatgctgcctcaaaagcaaaagccttttgttttctatttaagcaaaccactggtccctttagagagttgaaggataactgacagtgtgtgttcaatctgagcttggcagtgttggaactgttggttaacagatactcaggggctgggcctgggaggctacttcccacctgacctacatatcatatcaagtacagctggacccaagagctctaccagtgagtgggaacagtgtttcttaccgggtaggaggagacgttaaaatcaccctggccatgtggggctttttaaacagtgcaattgcttgagctagagagttctgggctatagtgtgctatgccaattgggtatctgcatcaatatggggattccccccactaccaccaaaagcaggggaccaccaggttgcctaaggaggagtgaactggcccaggtcagaaacggagcaggtcaaaactcctgcactgttcagtagtgggatttcacctgtgactagccactgcattccagcctgggcaacatagtgagaccctgtctcaaaaaaaaaaaacccccaaaaaaaagccagtgcagctctctcgtcccttcagttaccctgccgcccctgccttccacctctccccaccgcctcccagtgctgatgtagcccccgtgcaccgtggggcaggaagagatggaaagtctgtctctggaaatgagacaggccctaagcctcagaccatcatctcagtactccactttgttttttaagagcaagctagatgaggtggagggttgtgtgtgacagggataagctaagccaggacttatatctggaatactctgttttcccagggacccagctgtcatgtctcagaatgctgcagacgggcaggtagatgcttctcttcttgccaccccttttgtattctccactctttcctcttagccaggaggtgttttgcttttctgtttttgtttttttgcatcaggacttcgttgcgtgcacagttttagaattgggttggcctgtggttgttaaaagcacaaaatgaggtcagagccacacagggtggaagcaagagcctttttcctgcaatttctccactttggagtggagccttctttgatctgttacattttcactttctgtgacatgatacttggcaccatcccatactgtgtcatgccttttagtgaatcattttgtttccttttcagaaaaccacctcacaattaccacagacctaactactcaggttagtgtgccaacacttccacaagatgtgcccttttttttacattttttcccccaggttgtaggcttgcttagtggataatcccttagcctccaggcagaaaatgcaacttccacattactctggctgagtctctcggcagccgttctcagccagtggctaagactgcttaggagatttgactatattttttctgcatcaactataaaaagcagatgtcttacaattacatagacatagcttctgaagagataagtaaaactatcatttaataataagtgaatgaccgaggcaggcggatcacgaggtcaagagatcgagaccatcctggccaacgtagtgaaaccccatctctactaaaaatacgaaaattagctgggcgtggtggcgcacgcctatagtcccagatactcgggagactgaggcaggagaattgcttgaacctgggagatggaggttgcagtaagccaagattgcaccactgcactccagcctggcaacagagcgagactccatctcaaaagaaaaaaaaaaaaaaagaagtgaatgaggagtagtttaaagatttcaagaacagcaagctggcacattggtctcattgggtgtcacctaggaggggagcatagccctaccttgctgtctctctggacttggccagtgtatgactgtgggtgagctgcctcatcttccctggtctattttccaaaggaagagatggacttggaccatgtgactgccagctctacttctgctctcagatgccatgagctgttcagaggacttaaattgtagagttttaaaattttgattagtcagtttcttgttttggacccatctctttagagtacagaagatgacctgggtattattttgagaactttagaaatttggagtagaatttattctactgtgtgttttcagcttattatatataaactcattctaaaggagaaaaatcttatttgacctccaaactaagcctgaaagcaaatttagcgatcagaatttttgcaaatgatgagcatttcttttttgagacggagtcttgctctgtcgcccaggctggagtgcagtggcgcgacctcggctcactgcaaactctgcctcccaggttcatgccattctcctgcctcagcctcccgagtagctgggactacaggcacccgccaccatgcccagctaagtttttgtatttttagtagagacgggatttcaccgtgttagccaggatggtctcaatctcctgacctcgtgatccacccgcctcagcctcccaaagtgctgggattataggcgtgagccaccgtgcctggccatgatgagcatttagttgaattaggtagcatacaggatgataccaaatttgcctgtatatgattcttcaactttattaagataatgttcaggggcacagtagttgtacagtgattcagtgaaataaattatagttgtaagagttaaagaaagaggaaagaaacatgaaatgcagcttaacagttaaagatgggtttattttagagaaataagcctgagaggggctcctggccaattttggtgaggagcattatcttttatagactaagagtatatattagtttcagggtagggggcttatcacaagcttggaatgtttgtatgttggggagaagtttatagcagggttggaatgtctctggtcagatgggaggttatcttggggctgacatctctctggccgaaggggacgttatctcagggctggcatgtctcaggtcagggaggggtttggagtgtttttggttggagatgttatttgttttttatggtcatgctgaccttagccattaggctgatgccctttagatttaggcggtttttaatcaaggtgaactttagaatgacagtgcttgtccaagatggcgatactcctgctctgtcaatagttacttaatcaagatgacaaatatttatataatttcttggcaagagaggatgatgttggagttgctaaatgtgcattgttttttaggtgaggacactgagccccatgagcagggtcactaggcagtgagctagtcttacttaaacagggagcctgatttgcatacctgcagtgacctctcttctcacatctcctgggccctaaggaaatctactgtggctcccaggaacagtgaagagttaaaaaatagttttaggctttcaatataagtaattttgttagaaattcattagcctgcaattttgctggagttgccattagcgacatctatgtggactatgtttattcaagagaatgtgcaattaaaatcactaggggcagagaacatagatgtatattggcagaggtcaaaaggactctagagagaaacacctggtattttcagtttggtcatgggaccttttttttctaaaaggtattaggatcacacatagaaattcccgtaagaataggcagaatttatgtgaatttttaacatgatgaggtctctagattgaggaccccatactttgtatctgcactcattctttaaatatggcacaatcgtgagttactagagactgaccctgtgttttatctttcttttcattatactttaagttctgggatacatgtgcagaatgtgcaggtttgttacataggtatacacgtgccatggtgctttgctacacccatcaacccatcatctacattaggtatttctcctaatgctatccctcccccagcccccccaccccaacaggccccgatgtgtgaaagttcccttccctgtgtccacgtgttctcattggtcaattcccactgatgagtgagagaatatgcaatatttggttttctgttcctgtgttagtttgctgagaatgacggtttccagcgtcatccatgtccctgcaaaggacatgaactcatccttttttatggctgcatagtattccatggcatatatgtgtcacattttcttaattcagtccatcattgatggacatttggattgattccaagtctttgctattgagaatgatgctgtaataaacatacgtgtgcatatgtctttatagtagaatgatttctaatcctttgggtatatacccagtaatgggattgctgggtcaaatggtatttctggttctagatccttgaggaattgccacactatcttccacaaaggttaaactaatgtacactcccaccaacagtgtaaaagtgttcctatttctccacatcctctccagcatctgttgcttcctgactttttaatgattgccatttaaactggtgtgagatggtatctcattgtggttttgatttacatttctccaatgaccaataatgatgagctttttttcatgtttgttggccgcataaatgtcttcttttgagaagtgtctgttcatatcctttgcccactttttgatggggtcgtttgtttttttcttgtaaatttaagttctttgtagattctggatattagccctttgtcagatggatagattgcagaaattttctcgcattctgtaggttgcctgctcactctgatgatagtttcttttgctatgcagaaactctttagtttaattagatcccatttgtcaattttggcttttgttgccattgcgtttggtgttttcatcataaagtctttgcccatgcctatgtcctgaatggtactgtctaggttttcttctagagtttatatgatttcaggtcttacatttaaggggaagagaagggaaagcatctggtctttggtcctaaaacagcacctgtcctagttgaagatgtggtttagagtatctaatggcccagagctttggttactcctcacaccttccattgctcttacaccctctttcccgtagtggcccctgctgttatatagctctctcccttccaaaggaagaaaggactgtgataaagtcatttactctaaggaaagctgtaacattcactggtgatgtcattttagacaccaagaaatagagatattgtaaaaatcaatacacatatgcaagtacacactagttatcaaaatggccatccttgcacatgaaggtgttttccggcaattcattatttgttggctgcatagttaactgagggatggctgaacattgaggcaagttgggcagacctggtccctgtcctcctgctcatggttgtgaacagaatggaggggaagggccaaatcaaacgtcaggtgcggcagcgctaaggtactgttgccttcagattttagatttgtccctgacgtattaatttagaggaggaggaactggcaccaggactgggggaggtacacttctgcctctcaggagcaaccgcatcttgcaatcaaatctcagttaattgaaacttggggaagaaagatggaaataataggagctcatggacatttaagtacgaatcccatgtactctggaaagactaagggagatttggcatcatgcacaagagtgtccctgaaagatttttaaactacttggtcttggctcgtgtgtgtgtgtgtgtgtgtgtgtgtgtgtgtgtgtgtgtgtgtgtgtttaaattattttaatagtaatgtatgtattttgtcaaaaacttggaaaataccaaacatacaaagaaagaaacaatggcttataattgcaactctgagaaaaattttccaattatatataaataaattaaatgttcttgaaattaatcttttattgcatagatgattatatatcctgtttcattcagtttatattatgaatatttctgtatattattaaaagtcttcaaaaaaatttttttgttttttgagacagagtcttgctctgtcacccaggctggagtgcagtggcgtaatctcagctcattggaacctccacctcccgggtttaagcaattctcctgacttagtctcctgagtagctgggagtacaggcgcccgccaccatgcccagctaattttttgtatttttagtagagacagagtttcatggtgttagccaggatggtcttgatctcctgacctcatgatctgcccgcctcggcctcccaaagtgctggtattataggcatgagccactgcgcccggcaagtcttcaaaatattttaaggtattttattgcatagatgattacatattctgtttcattcagtttatattatgaacatttctgtatattactaaaagtcttcaaaatattttaaggctgctatatgccactgtaatctgctgttgtgaaataaaagcaaatatagaaggatgcaaatgaaattataaaattaaaaattttttaatttttgtaaatgaaaaattctttttaaaatgctgagtttggggtatatacaagggaagaaataactgatgttctgctcctagcctaggtgccctcttgagctatgcttgttttatgctaataatctccctctttttttcctgtttcacttggatgtctgttattgttgatggagccaggagtcatctttgattaataggtgtagaaaacattcagtgtctgctacaggttgaggtccctcgagagcattcacctggcctcctttatgagacttgagtcagtgggctgggcctcctccttggtgctgtagccactaacctgcctcacctgtatccaatatcagctcgaaactagcatatccgtttgtccaggttccaggacactgcttggccaagacctttcactggagtctccaaagaagggtgtaatttgggatatatattataattagctctgatgtctagtatagcaagtaaacagccctctagcttgggtggaaatgtgccctggtcaggcgcaacactccagaagggcagcagccaccagaccagacgacagggaagcccagctcccaagcaaaaccaaaaactggtgggagtcttgtggtgaggggaaagtatttgttgttttctgtttagtctagggattcacactgctttttaaattctggcatagttcccagtggctaaagctggaatgattctactgtttcattaaattttctttataaaaatgttaagttggggccaggcatggtggcttatgcctgtaatccccgcactttgggaggccaaagagggaggattgcttgagccagggagttcgagaccagcccgagcaacacaataggaccccattgctacaaaaaattaaaaaaaaaaaaattaggcagacatggtggtgcacacttgtggtcccagctactcaggaggctgaggtgggaggatcgcttgagcctcggagtttgaagctgcagtgagccatgatccactccagcctgggcaacggaacaacactgcctcgaaaacaaaacaaaacaaaacaaaagtgggtagtttgcgtctcctgacatcctgtttcctttggggcccccatctccatgcatctccatgcaggctcctggtactgtggatgctgtgttttcggggcccccatgggctctctgtgctgggcttttccctcccatcttgccttactggggctgatgcctgttgccggttctttattctgctgctcttggtggcaatgagaacagaatctagaaaataaaaatctaatttctttaaccaaactatctgctggaaaagctgttattaaccacagatgcctgatactttctgacttgcgacctgttcacaagacttcctttcagctcgaacttccttgcccttggcttaccctgtcggcaccatgtgaacggtggcaggtaaaaacagggcgcttacagtggacctatttcttaaaattatttttttcatttttaatttttttgacatggtaaaacatatatataacataaagtcccccatttcaacccattttgagtatacaattcagtggcattcacgtttttgtgcaaccatcagcacacgttgcacatccatctccagaactccagtagagtaaccactactctattttttatttttattttattttatttatttatttttcttgagacagggtttcactctgttgctcaggctggagcgcagtggtgcgatcacggcttattgcagcctcgacctcccaggctcaagcgatcctcccacctcagcctccccagtagctgggaccacaggcatgagccactgtacctagctgttttttgtttgtttgttgtttgtttttttgtatttgtagagacagggttttgccatgctgtccaggctggtcttgaactcctgggctcacgtgatccttctgcctcagcctcccacagtctactttctttctctgtgagtttgactactacaactacctcatataggtggcatcatacaatatttgtcctttttttgtatttcttttaaaaagactctagagcataactgctacttccaagtcatttctgagcaggctagactggtagtggtaaggactgagggttagagacatgctgtgtgtgtataagatgtgcctgggctaacccagcctgtgctgccctggggtgatgggtttctgcagctgctggccatgcagctgtacccaggtggttcctgtctagacaccatggctgagtatgtgccatttcttttgtcttccctcattcagatgtttgtatttggccaaaatctgatgagatttttataccattttttttaagcagtggtagaacattctgactattcaaaaagtcttttttccactccagcccccagccctctccctgtagggaatggagattacccatctcttgggtatctttccagagatattcaatccctatgtaatcctatgtatgtctgtatgtgtgtgctagtctccagcatggtgtgttaatctaatagaatgctactcatagctgtggttaaatcaatacccagggtatttttttgtagctatggaaattctgttttcagctgaatcatgtaatatgctataattatattttacttcttgtcttagtctgttttctgttgcttataaaagaatacttgaaactgagtaaattataaagaaaggaaatttatttctcacagttaaggaggctgggacattcaaggtcaaggacccccatctgataatggtcttcttgctgatgcgactctgcggggtcctaaggcaacgcagggcatcacacggcgagggggctgagcgtgctcatgtgctagcttaggtctctcttcctcttcttataaagctgccagttccactcccattaattctttatcccattgttaatccatgaatggattaatccattcatgagggcagagtcctcatgacccaatcacctcttaaaggcctcacatctccatactgccacattggggattaagttttaatacaagttttgaagggaatattcaagccatagcacttaaggacttagcacttaattaattaattaattaatttgagacagggtctcactctatcttccaggctgcagtgcagtgtgcgatcatagcccactgcagcctcaaattcttgggcttaaacaatcctcccatcttagcctcccaagtagctggggctacaggcatgtgccaccatgcccagctaatttttaattttttttttttttttttttttttttttggtaagagatgggttctcgttatgttgcccaggctgatctcaaactcctggcctcaaatgactctctcaccttagcctcccaaagtactgggagtgcaggcatgagccactgcacccagccccatagcgattcttgagtagctttttgattatcttgaatttaatagtttcctaagtatcaatcactcattcttctctaaaggaatgtatgcatctcctcacaccacaacaaaattatcagtactgatattcatttatttatttaggagatgcctgtcctggcttcttcccttctgcctctgtctaatcaggttccctctgggtctggggtccagctatctttactactattctgaggatcctctatgcctcctgtggtccagctcctgtttcctagagcccaggtcctctttcttggcttctactcttttttttttctactttcctaaactttattaaagaaaaaagtaatggtggtaaacctctagaacttactcaattttctgggattcctcccccgagaatgtgatatattgatttccaaacatgccggaagtatacatggttcccaattgtactaaatagactaaataggtgaaaagctgaagtcctaaagtgttcatcttccaacttttcccagcctgtggtctgtccttgcatcagcaataattgcctgaacagctgctatggcttcattaatttttgtctgtagctgtctgagctcttctgtatacagcagtcacagaatttgagtagcttcattaagaactgcatctcctgtgtcaaaaccaagaatatgtttgtctaaagcaacaggcaagccctcttttgtttgatttgctttagcaactgcatcctgtgtcaggtgctcctgaaccaaaatttgaattgccttaagcattaccaggcaatcatcatgacattgaacctgaagcaggttagccaaagccattacaccaggcttaaaatcaggattatttacgtccaaatttatcaatggttctgcatttttagttgcattgtcagcagtttttgcattatcaggtactaagtccttgtatttttcagcattatctccatattcaaatctaacagctaaaccaagaagccagtcaatagcttcttgtcgatcttgaatctttaaacgacagttaacatctctgagatacttttgaaagaactcgggccagtcactgctgtggatgtttcttaaattacctctgtcttcagtcttgtagtatctgattttctggtcttcaagccaaacagtgaagtttctaaattctgtttcatctttgcagttgaaaccggcggggttgtggtagtcaagagccgtcagctttcattggaacatgctccccgcttctcactctctttggcttttactcttttactttggcaaggagcttatccgtcactaacttcctgggacttgcatgcctgaaaatgccattctttttcctaccttcaccttgaggtagtttggctgggtacagagttcgaaaggaaaatattttttgttttaactttgaagtcactgatatatttcctttgagttctgggttgctctagagaagcaggatgtaattctgattcattcataagtgatctgcttctgttctctctggaagcttttgggatcttcacctcatcttagagttgtaacgttccctgatgaagcccccatgtggtgggtcttttttctcctactgtgctgcccagccgggggcccggttaggaaacacccatatcttcagtgctggggcactttcttgaacttccccccttccgcatccactctccgcgtttcctctggagctcctcttacatggtggttgggatgcctagattgctgttctgagcccggagcctttctggttgagcctccacagagactgagcctcctgtttttctgggcagagggaggagagccagggacagcccctccagtctccagccccaccccacaccccaccctcccagtgggagcctttcccttggatgtctagaaagcgacaagtataatgatttatggaaaatctttgctgtaatataggtggcatgggtcaggccttgctaattaatgcaggtgcctatttttaccagacaactgctaagcccttcctgccttgaatgactaaagacaaacttccgattgagttctctttgcattctgcatgctccttttctatttctggtgtgtatcctccttgctggttggcttaaggttctcctgggcatcttacgcagtctgatttctacagtccagggtgagctgccagacggtcctttgtgcctcatagtttctcggcttctgggggctctgcacctccgctttgtacctctggtctgggtgcagtcccctcaggctgccttcctggggctgtgccccacctccctcccggccttcactttctctctggtccctgtctccctgagtccagctgcaagcctgctgccactcccgggtcccagaccttgaggcagagccggtcttcaaaggcacaagtgtcctcagtctgtccgatctcatggttcactctgttgagcccctgggtcttgcctcaagaaaatgatgcctcttctaaagtggatttgtgaaatatgtagaagcaccccctcttcagtagccttggtttccctttgaactccaaagattagatccatctgttgtgcaggatcttcaggaactgctgaaagccagggtcaccgctcaaccactagtcattgcccacgatgggcaggacatcattctaggcacagaattctcccatctttcttcagcccttcctgtcaccatgatatccagggggctaccaggagagggtcagccagctccttatttggagatatttgtcctgtgtattctcttttcatcttctcctggtaacctctaagcattgtgacatccagccactgccccaaagcatgaaaggatctggcctttccttgatccctgggacctcccccatgcccaccattcattcatcaggtgcattccaaaattatattgctcctacaaaagaacgaggggaaaggggaagacagagcatttcaagtcaaagggaagccactcagatttacacatcaggaaatgcaatgacaggggactgttaactcctggatcctgggaacagtaaggaagtaatgttaacctgagtagctctgaccccccgagttctgactgatgccattgttgagctgtgtcttagctgctctatttatcacaggccaatgaggatctgcaaaatggtattgttgggaagaagtaaatttaaaatgtttagtgttcagaaaactgaattcaacctaaggaaactctgtctcattcagacctggggacctcactcactaccacatgtctgctccagatgctaaccaggctgtgctatcctctggcagctgccacccctgcctatcaggccatggttcaggatggagccccctctacccttgacagcttcctggtttcttttaagccttaagcctcagcccttcacaggttgagggatgagatttattttgtttagaaataaataggttatacagggaagcaagcttctaggaaggaaggtggaacttccatgtttttcttctttttcttcgttcccctggtcatggtcttctttgctgtgtttaaagaggagtgtctttgagccaataaagaaatcctctggagagcatctgaaagtatttaaaaatgttccccggctgagaacggtggctcatggctgtaatcctagcactttgggaggctgaggtgggaagatggcttgagcccaggagttcaaggctgcagtgagccatgatggtgcaactgcactccagcttgggtgacagagcgagaccccatctaaaataaaataaaataaaatgtgcatttcaacatgtaaacaccgggcatgtccaccccaggagagatcattaagtacccagggacttgcaccttaggtgcaccttcaagcacttgacctgtgactgctgcaaatacagtcatgctgtcagtgagagaccttacaaaatgatggctagggccccagaaagttctaaacaggacaaaggctaccagctctccatttttatagtcattgcagtcctggtaaattaggtgaatattgaaaccatacaagtatgttaaatggaattagggtctagtctcaggaggtcatttgggatatggaacagttgcccttggcccctaaaaacccatggagcccccctagtcattgtgaccaccaaaaacaactccacaaatttccaaaatgccttgagggggcagtaccccaatgcagagaaccactggtgcagagtctaccatagaaatcaagacaggtggccgggcatggtggctcatgcccataatcctagcactttgggaggccaaggtgggtggatcccctaaggtcagaagttcgagaccagcctggccaacatggcaaatccctgtctctactaaaaaatgcaaaaattaatcgggcatggtggcgcatgcctgtaatcccagctactcaggaggctgaggcaggacaatcacttgaacccaggaggcagatgttgcagtgagctgagatcatgccattgtactccagcctgggctacagagtgagacagaatctgtctcaaaaaaaaaaaaaaaaaaaaaaatcaagacaagtgatagcacatatattagtcagggtttttccaagaaaccgaacctataggatctgtgtctacagctttatctagaaagagagagaaagaggaattattttaaggaattttccttagttccttaaattaactcctaaattatttattaattcctaaattatgaattccttaaaataattcctctgttttaaggaattagctcacacacagtgggggctgacaaatatggaatcaacagggtgttgggtggagacccatgaaagacttgatgttgcagtcttgagtcctcaggcagtttggaaacagaagcccctctttccctggggacctctgtctttttcttataaggccttcaactgtttggatggggcctgcccccatcatgaagagtaatgtgctttactcaaaggctgctgctttaaatgctagtgacatgtgaaaagtaccttcacagcaacatctaggctagggtttgaccaaacaactgcgtacaatggcctagccaagctgacatataaaattaactatcacagcatatgacaaagaagttgaagaagtttccatcctataataggaactcaaagggtagtcactgtaaatatcttcatgtgtttttctttgcagcataaccagtgtgcagcgttcagacaatgggtcgtatatctgtaagatgaaaataaacaatgaagagatcgtgtctgatcccatctacatcgaagtacaaggtaagtccacagaccagagtcccattgccagagaactgtttgttttagggcctgtgttaaatgttttgtgtataatactctagagttttgcctgcctatttataactctgtatgcaaaccttgcaaatctatcagcactgaaattttacaaggtactccactttgtagtctataagtaataatgaaatgaattcaattcctgaagtttgagctctattataggcattacaggtgagataaaaagagattttggacttccttgtccacagattattgacaataaaaataagctgaagacttctttttaagaagcaaaatgctttctactatccagtttccagtactggtaccagataccactcacctggtcaagtggctgttggcttattattcagcatcttttcctgtcttgcctatgcagacagtgaaaccctggagggtgagtggttttcctcgactggctcaacagctcagcctgagacttcttttgggcactggtatctgtcaggtgcatggttcagagaaattccatgacatcatatgaaggtccatggggatgaagagtgagacatcaggctaggaaaaggcaatctctgccctcagggaacttgaactctaatgggcaatgtgagctgatgcacaggtgaaccaggccaggtgagcccaggtcctggtttggtgccctgatttgggggtttgcatgcctggttctgcaatggcagtgctgcaaggaggaagcatctttattatcaccctcagaggtcactcctcactacccctgggggcttccctctgggggccttgtgcccctcctctctgaggtgcccctcttagcagagccattaggtcacctcccttttctactttatcctgaccttccttgtcacaggctttagagcaggtgattagcttttcagtcagaaacatctcccactgaaagtctgctatgctacccattcttttgtgaacctgaaattgatgcccaccaatgtggagggaagcctcagggagcacagatggaaggaggaggagtgagtggggaagacagaggggagggggaagagactccctcagaggagtctcttcatgacctttgctctaggcccatcccaggctggacagctctttctcagggttacgtcaacatcagccaaagagggggtttcctacatttgcagctaatttgggaaaaaaatatttacaggagattttatttgtcagaatcccagaaaaatgcccagagcaggaacatattaagtccaaacagagtttcaaaaaaaccttgaaacaggataaaagaattccatttcacataactgccacgtcattcctgctggaaccagatctgtgagttcccaatccccaaaagaacacaattagctggactcgttatatttttgaacacctgccccaaatgagtactgactggctttctctgagcttccttgggaccttgattttggaaagtacggtagatttaaggattgtaactgcaactgtgtttatacagttttcatgagaatttgctttgaaaagcactcagccttatacaaggctgtggattttaaaattccttatgacccatctgaaagtcacacacataatagaatgtcttcgtaccatggacagatctattacatagctttgttttactctgcgtttattttggtaagaaatactgaaaacctgccaactagtcagtcccaggagtttgagcaacacctgatgtaagaactgcctgtggcctgccttctggtaaaaccagttctgagtcactatttatagcccctttggcaaagcatcctagaaagctggcttaaagtagactggcaggaattagcctctgtgctccttcttatccaacttaaggaggtgaaaactgattaatacagacctgcctgaggctgtagataaagaactcttgtttgccaaggctgggcgcggtggcacgcctgtaatcccagcactttgggaggccaaggggcaaggatcacttgaggtcaggagttcgaggccagcctggccaacatggtgaaaccccatttctactaaaaatacaaaaattagccagacctggtggtgtgcgcctgtaatcccagctacttaggaggctgaggcaggagaatcacttgaacccaggaggtagagattgcagtgagccgacatcaggccactgcactccagcctgggtgacagagcaagactccatccccacccgccccccacaaaaaaagaaatctattgccaagttctagtccagtttccattcccctttgggctctgtctctgttttcagatctgaaacattcttttgtgtaacgttttctccgcaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggtaagtccgagctgtgggcttattgatttattctctaatagcggacaggatcaaaagtttggcgacccttgctgtgcaccactagcaggcagtggagacagatgaaaatacaggtgtggcagcaaagttatgggaccaggtagacgggaaggcaggtgggaatcacaggtgtgagaattcacaggccaaggtggggaaacaggtgagggcctctgggggtacatagggttaagttgttgaagtggccagaatccctgagcccaggcagcaggagccctgctcgcatctcccattgtagctgtggccttgctggtctgtcaggtcttgcgtttatggaaccactgacgtgaagacctcagtggatttgacaccgagagagtggattcatcatggggagctattgcaggaagtgtgagcccttgggggattgtggctgaatggacattccatggtcgtcttgatttccatccaaatgaaagtggcccagttttagtcccgcacatcactgatgatgctcttgtcaataccactgacgtttcccatgcactgaagtcagtgggctcttctgtggctcctctcattgcatctttcagcaacatcaggcaaggttaccacactccctccctccttcctttctccagggactgctgtatgcctgaggctgttctaggccttcaggacacagcgtggacttttggaaacactgtcctggcttccatttcattgagtgacaccaattcattgctcctcctttgtcattgactggagttttgaatggcagggctcaatcctgggtccccttcttttactctgagatgcttccccttgggagagtttctttgggcccatggtttaacaccatctataagaaatgaccttgaactccagcccagacccctctcctgagttgcaggctcatgtatccaaccgcctccttggcattgccacttgctgggtacataggcatctcagaatgaaactcttaaccccagacttgttccactccagaattctccatcttagtgaatgatatcaccattttcccatccttcctttttctcatttttcatgttggcatcagcagttctgtcagttctgctcctacaatacatctgaaatctgtcttttctccaccctgctgccagcaccctggtccgtgtcactgccagctcttgctgtcgcctctgcagtagcttcctaactgggcctttttgctcccagccttgtccccactcccaactaccctcctgggtggcagatgacatcacctgcctgctgaaaaccctgcagtatctcccttctgtcttagactgtcacccagtccttcctgccctttccctaggggctgcgtgtcctagctccttcctatctatccaacccagccccatcccatgctctccatcctgcttgttaggcacgagtcacattgattgtctttcacttctctaggcacatcctgttccttcctgcctcaggacctttgcactgtctcttctatctgcttgcagtgttcttccatcggccctttgtcccatgacccaactcatcacttcttcagagaggccatccctgatcactcttaactgttttaggtcccctcaatcccatattcctgtgtactcctccattgcacttgtcaccgtctataattacccagtttattcattgggtctccttgtctagcttcttagagaacatatgctcagtaaggacaagagctttgtctctcccattcacctctgcactgccagtggctgaaaaggtacctgcctcctagtagtactcagtaaatatttatggctaggatggatcagtaagtgaatgccagcccctacctattaactctgaatcacttttctaacccgtgacttcaggaggaatgttatggttttctctccttcatctgagttttctttgagtttttttagggaattaagtaactttttattcaaaatcaattttaaaaaatagactctaccctttataggatgatcactctgaaatcccataaagacttattttcattgaggtaaaattgacatacaattaagtgcatagaattcagttgtacaactcagtgagttttcctaagtgtagacacccatgtagctaccacctcggtcaagatatagaatattgccatcacttcagaaagtccttcatgatcccttccagtgggtcaccatctcccataggcaattctgttcttatatctgtcatcatagaataattttgcctgttcttgaacttcaaaaaatggaatataaagtatgtacttttttgtgtcatacatactttccgtggcttcttccactcaacatgatatctttgagattcatccatgatgttttatcactagtacatcatctttatttttatttttattttcagaaggagtcttgctctgttgcccaggctggagtgcagtggctcaatcttggcttactgcaagctccacctcctgggttcaagcgattctcctgcctcagcctcctgagtagccgaattacaggcacctgccactacgcctggctactttttgtatttaagtagagacagggtttcagcatgttggtcaggctggtctcgaattcctgaccttaaatgatccgaccgcctccacctcctaaattgctgggattacaggcataagccaccgtgcctggccagtacatcattttttattgctgatatagtactctgttgtattaatgtgttaatttggtttatccatttgtttggtaaacattttggatatttgtggcagttggctattatgaataaagcagctatgaatatttgagtgcaagtcttttggaggacatatgtttttattttgtcttggataaatgcctaggagaggaattgctgcttcatatgtttaacttttaaagaaactaccaaatggttttccaaagtgattgtgccatctttcattccagcaacagtggatgagagagttccagttgctcatcgatatgtttaccaacatttgatttggtcagtcttcttaagtgtagacatttagtggatttgaaatctagtagattattgtggttttagtttgcatttcatttccctgatgtctaattttagacaagacttagagaagattttagtgtctcttcttgtgcttattaatcagtcatgtctcttttttggtgaagcgtcacttcaggtcttttgcccaattctataaaaatcctagaatccacttgacaatgtttacacaaaaatacctgctgtgattttgtctgcaatcgtattgtttttatagataagtttagaagaaaaagacatcttgacaatattgagccttccaatcaatgaatacattatatctcttcatttatttaggtcttctttaatttctctcagcaatttttgtagtttttgttgtagaggtcttacaagtcatttgttaaatttttttttattttaaaattggaattgtatgtacttaaggtatacaatgtaatgttttgaaatacatagtgaactgattattccagccaagctcattaatatagctatcttttcacatagttaccatttgtggcggagttcggggggcggggagggagggaggcgacaggggagggcatgtaggaggatgagaacacttaagatctaccctcttagcaaatttccagtatactgtgcaattttgttaactgtgctgtacattagatctctagaacttattcatcctgtggactaaaactttctaccttttgaccaagtcctcacccacctccacccacccttttaaaccacggttctattctttgtttctgtgagtttaacttttttagattgcacatgtaagtgagaccatgcagtagtttttcttttctttgtctggtttattcacttagcataatgtcttccagtttcatccatgttgtcataaatgccaggattttcttttttgtacacgctgaataatattcccatatatatatatatatatatatatataccataattttttaatccatttatctgtttatggacacttacattgtttccgtgtctaagctattatgaataatgctgcaatgaatatgggaccacagatacctctttgagatcctcataccatttcctttggatatatatacccagtatgggaattgatgaatcatatggtagttctatttttaattttctgaggaacctccaaactattttccttaatggctatgccaatttacattttcatcaacagtgtacagccaatcagaatgcattaatttagtacttatgtactaataaatagcatatttgattttatttcccaattatttactattagtaaatagaaaatagatttttgtatgttttataaaaatagggacaaaatctgtccatctctgtttgtctagaacttttctgtatgttttctcaaaattagaagtgtgtttttgtgacaagatgtgcaaactattttaatacccaaggctgtagtttgtcttagcttggagatctgatttatttctaaaaggtcagttacacccttacaacgaccacctattttgcatttcaagttctttacaatttaattttactttttaaaatttgaagcttttttttttctttggtagagaagacttgggctcacgtttttttccagggtgttacgtgaaaattctcaaggtggactactaggtttagctggaatcaatctgacagtgttcatatcatcagtaccctttaaaagagtcattggaattacatgatgatctgaaaagtttaggagacagacccagacagcagggcagcctaatccaatcatccttaaaaatctgaacagtcagaatagaactgtagcatacagcctgttggtcacaggaacaagaactatttgttcatttgcatctcaccaaattcttacatgcactgatccaacaaatgagccaaaacttaggctccaaaaatgttcattttcgtcttctaaaactctgtaaagtctatccagggtagatacctgtctgagtttgtccagctgaccagtgcacggggtggtggaaccgagtgttgttgctttcccactgtacacactcatggaatccacagtaccacatgctgtcagggcaatggctccacactaatcttccctgttattgttccagttttagtgtatgtgctaccaaagcgagcaccaccagtatttctttaggagggatatctaaatgggagttgaagggaaaagtgaacatattttaaattttaatacattctaatctccctccaaaaaggccttgcaagttggcaatctttttagtggaatatggtaatatgtgccctatatcacatacacacagtattcagtcttgactttttgccagtctgatggcaaatactctcatctgtcagaatatctgatttacgcctctgcctgtttccatgagaccaggggggctcttgaaggcaggaactgaaggattttttggccacatattcaggggtctggttcagtgcctggaacatggtagttgtagaaatgaccagtaggagagcacttgcggcagcattcaccagaaggtgcttctgaatgtgggtgtgcatgatgaattcactctccatcaggggccatcgggtaccaaaaaccaaaaactgaaccatgatgatggaaatcctcactaacatttcaccagctgttctagagtttttagagtagtgacaaatgtgtctgtaaatgaagaactcttacttaaactgctgagtcgaaattctagtttctaaatcaatacgcagtataccgcactgctcaggcagttttcctatttgtgaagggtttggaaagtggggctgctgactttatttttcttagtgacagtatttattaaatgcctgtttcatagtgaagatggtctagctcatgctatacagtgaagtgaaggcctggaggagtaatcatatattcaagccagaaacctgaaacttacccagattcttctctctcgcccatccaacagtcatcaccaagatctgtacattgttctctcttttttttttgttttgagatgcagttttgctctgtcgcccaggctggagtgcaatggcgtgatctctgcttatcgcaacctctgcctccagggttcaagtgattctcccgcctcagcctcccaagcagctgggattacaggcacccactatcatgcccggctcatttttgtatttttgtagagatggggtttcaccatgttggccaggctagtcttgaactcctgatctcaggtgatccacccaccttggcctcccaaagtgctgggactacaggcgtgagccactgtgcccaggccctgtacattgttctcaaatgtcaattgtgctcatttcttcctctgcccttccaccaccatggccttaattcaggctttcctggttcatcgccaggactgttgctgtcacctcttacctgtggtccaatctttctcgttctcatccccctaccccaccaccatagtgagtgatgctccaccttgtgattaaagaggttctcctaaaatacagagcttctcattcctggcatgactccccactacatgcaggttaaaatctaccattttaccctgaagtctgagacccattggggcttcagcctaactttcccacggtctccgcctgcctcacctgcaaaggcacctgcttgtgagacctgatgaacttttcgcaggcccatgagcgactgtgccttcttgccaagctgccttctcattgtctggcaaacccctgttcacttgacacacagatcacggctctcctctgaaaaccttcctggtcacccccttgtctgtatattcacaaggcctcttccccattgcattgaagaacaaaccctctatctatttgtcaggcctccaagaagacttactaatcaagtgattattatgtatgatttattagttaggttagccccatcacccagcacagtgcctggcacataagaactatgtgaatgaatgaatgaactaatgagcaaacaaatgaattacaaatagtccccgagttttaggtcctttcactgggacaaagggacatcatgataatgaagtaacttgtatttataaaattatttttacatttaaactcttatctcttttctcatttatatctccagctggtcctgtaaaattaatagaacaggatctttaatgtccattctgtagacccaaagggctaaaacaagtccagggaggaagggcgtggggcccaggctgctgactgtggggattgtgctgggctcacaggggttactctcaaaagtcagctagttgctgactgttcccttgtgtctgcgttttgtaacattataaaagaactacgtaaaaacttatttttaattaatttttttttaattttgaggaagctttagtttgatacctgagtcccttccagtaattcatgtatgaggaactaggtgctgaggtcagctttggggggccttgtgcagagtagctgcccctgacatgctgatgtaaataaagcagtgagtgttcccaggggacgccattctatctgaaattgacccctaagtaaactttgccgaccccttctactgagggaatgctaagtggtttaaatagccgattgtttggactgctttgagcaagcattgtttatggaacaggaaggtcatatgccttttccctcttgatacaagtttttatttttcctctgtgttgtatgagctttctttaagggacatgaaaagaagtactttgtctaaaggacattattctgagtgaacaaagccaatctcaaaggttacgtgctgtacaattccatttagataacattctcaaaaggacaaaattttgctaatggagaacatatcagaacaatttcaggggttaggtttgggggtaggatgttctataagggggtagaagagggagcttctttttggcaatggaacagttctgtagccacaaatctgtacctgtcataaaattgcataaacctatacactcattcttccccccaaaataaaacaaagcagaaactggtaaaatcttaataaggcctgtgttttagttaataatattgtaccaaagtcactttcctggttttgatcattataccatggttatgtaagatcttatcattgggtaaagctgggtgaaggatgtacagtaactctgctatttttgcaacttcttgtaagtctaaagttatttcaaaataaaaagtttcttttttaaagaattttatcatgggcaaaaccaaatcccaaaataaagagcagaactgcaaagagctttagcttcatggtgttcaatggtggagtgctttataagttagtgggtaagcatgttctcactcataggtgggaattgaacaatgagaacacttggacacagaaaggggaacatcacacaccggggcctgtcatagggtgaggggaggggggagggatagcattaggagatatacctaatgtaaatgacgagttgatggatgcagcaaaccaacatggcacatgtatacatatgtaacaaacctgcacattgtgcacatgtaccctagaacttaaagtattaaaaaaaaaaagttagtgggtaagagctctagctttggcatgtagactgatgccactttgctgtcatgtatccctgggcaagttactcaacttctgtatataaaatagggataatagcagtgtctactacataaaacatttatgaggtttcagtgaaataatgaatgtaaagcccttggtaccaggattgcctataggaatgattgaaatgctacctattatattttttgtgttgttatttttatatgcaatagttactaactcattgtcaattttgacctgcctttctgttaacagtggtgggcttgcgttgatctttcaggcttttcttttttaaaaaatacacattttatatttaaatccacatctaggaaacagctaagctagcttttgttttagttagctggatataattattaatatccttgtaataacagaaacaacagtaataactagaatttatacaaattagttcataatgcccacagtactttctgtaaagaattactttgaatcacatagcaagctgtgataattaggcagttttgttgttgttgtgtttagagacaaggtcttctctgtcacccaggctgatgtgcagtggcgtgatctctactcaatgtaacctcaaaactcctgcactcaagcaaatccccctacctcagcgccccaagtagctaggactacagggataagaagcttttttcaaattttttgtaggacgggatctcactatgttgtccaggctagttaggcatttttaatacccattttacatattagaaaaacatttggagctattaagagacctgccttctttttttcttttttcttttttttttttttatgtcacccaggctggagtgcagtggcgtgatctcagctcactgcaagctccacctcccgggttcacgccattgtcctgcctcagcctcccaaatagctgggactacaggggccagccacctagcccggctaattttttgtatttttaatagaggtggggtttcaccgtgttagccaggatggtctcgatctcctgacctcgtgatccgcccgccttggccagtgctgggattacaggtgtgagccactgcgcccggcgagacctgccttcttaaggtctattctccatgtggccgctggagcaatcctgatacaagtcagatcatatcagccctctgctcagagctctgggttttctacccaactcagagaaaaaggcaaaaggcctctcccacatgttgcctctgcctagaacctccccaggcccccgagtatcaacttggcccatttcctcactcctactctttcctcagaggccatttctcaaggaaccacctctgatacccccccgcccatcatttaaaattacagcttgcttccccacccatcctgaccctctgatcgtcttctgtttttccatagtacttatcaccttctaatatatcatacatcttacttatcaaggttattatttattgcccatttctccccctgaaaatgtgagctctataagggtggggatcttggttttattcatggatatatcccaagtttctggaaaaaatgtctggcttgtagtacatactcagtaaatatttgtcaagtcgatgaaagcagagcagatagagaggtccaagttaagaagctacctcacttatgcagcatgatcttccatttgttgcttcctttggtagaaagatggacactagggaaaaaagaaaaagaagggacagaattgtttatctagttaatttgcgggattgcttaatccagaactcaaagaactggctcaactgtgctcttaggagttgctccctcagcaattcggattgtccttctctcaagggaacatcctgttactgaatgttccttaaaaatatctgtcagagctgtgtcataaatatcttttctcaaaccagcagaggaccaagcaagaggggcgtgaaccatcataatggagttgggtgaaaaggagaaattgctctaagagggacgacctacccactagaagaggagttggctcaggagattgtgggggttccagtgcccggggccattcaggatagagtgggtgggagggtggagacttagggagttggatgctttttctccctggaaagtcacaagggtttggggctgtaaatgtcaaggtctattccagtctggtagttactgttcatccacacagagagaactggcgagtgagagggagctgtcttctcctagtgtacactcattgctatggtcaatccaggcttataaacgagtgtctagttgggaagccagtgccattaagccattaaagtttagctgaaaaattaagcaaagaagactatatttggccctaagtgctgtctggttttggagaaatttacctttggtttgaactagtttcctcttctctctactggtatctctttggcctatgggcaccaaccacctgaccttgtacactgttttaatacattgtgtggttactgccaggcaattcagacttggtgtaggtgtcttgtgctaggacatttgctatagattgtttttttgaccttgggtgcactatgaaaagaaacacacaggagaaatgactgtccatttgacctgaagtcatgttctgtgataatgtttccctttcagcattaataaacctgttaggactaaagatcactgggcctgaaatctgctactataggatcctactataggttctataactggataatggatctcagtgaaataaacctccggttttaccacagggctggctcttccccttatgacaagtttggaatgtaattttgtagtttgtattcaagggtttcctaagagttttgataataattgaagtcaaatgactaattttaaactgccaatgtctcctccaatatataaaaaaggtaagttagtaactccctgtatcttctgattgagccaaggccaatttttctaaatataagccaggttttgcaagttcatgcagcctggtggttgaaatgggcatatcacttgggagcttaggatctggaaggttaaaagtgatgccaaggcatgaaaatcaaagtgttaaaggcctcactgtgaaacagtgatcagcagagcatggaccccttagtgggatcagtgtctccatcctcatcctatatgtatcttctttcttaaaatcaatgcttgacaacgtgcccaaagtccagttacttcgccagttctccctttccacctccctattttcctttcatctcttccttgcattacaaaagaaaaaagacctctcttgcttgtctggaatcaccactatgaagcatcagttctcaatgctttggtctcaagatccttcgtttgtttgtttgtttgtttctttttggttttttgtttgtttgtttttgtgtgtgtgtgacagagcctgactctgtcgcccagcctggagtgctcactgtagcctcaacctcctaggctcaggtgattcagccatctcaacctgccaagtagctgggaatacaggtgcatgtcaccatgctcagctaatttttgtgttttttgtagagatggggtttcaccatgttgccccagggtggggcaacttctggacttgaactctcgaacttctggactcaagcaatcctcctgcctcagcctcctgtagtgctgggattacaggagtgagcccactgtgcttggcctcaagatccttttacagtcataagttatcaagaaccagagttcttgtttatgtgggtcatatctatctatatttactgaattagaaattaaaactgaaaacttttaaaacacaaaaatacacaagcatacacttcattggctaatacatctatgctatggcatcatcatatatcatatagcctctgggaaattcttttggaaaattccatcatatattcctgagataatgagaattaaaagagcaaacaatatattattattatgaaaatagttttgactctgaggactacagaaggggtctctggaatccccagaagtctcttgaccatattttgagaatggttgctgtggtgcattgtcttggggttaagaaatttccagagacagaaaattccaaattttggctggacgtggtggctcacgcctgtaatcccagcactttgggaggctgaggcaggtggatcacctgaggtcaggagttcaagaccagcctggccaacatggtaaaaccctgtctccattaaaaatacaaaaattaaccgggcgtggtggtgcatgcctgtaatcccagctacttgggagactgaggcaggagaatcgcttgaacctgggaggcggaggttgcagtgagccaagatcatgccattgccctccagcctgagtgacagagcgagtctcagtctcaaaaaaaaaaaaaaaaaaaaagaaaagaaaattccaaattttgtccagcaaagaaattgctcttccaataaagttgtacttatgtttaagaatcacttacattgttttgattaattgcatcctaataatgagtataatcaattcagaagaaaatatttttgcaatttcaaggtatatatatgtttttgttgccaataagttcccatggtttaagcaaaaactttcaaatgtgtaccattaagatgaaattcttggggctggtagaagagtcatggtggaaaacttgctgctggggaagagtcgttacagtgggtgttggtgtcaagatattcaaggtacctcaaattacattttttgaagatgtttaaattacgaaaaatttaaggatgcaaacttcaaaatgtgtcagagtccacgtatatttttcaaaattctctaggagtaatacaagcagaagatataaagaccccgaggcagagtatcacagggatccttttatagatgtgtgtgtaatgggtgtgagagaaatattcctcctcagtgcaataaatattttctaattcactacacaaactagtagcagtttcatgcctcacttgagaagaagtgaccaaaatatgaaagtagatggcttctaccaggagtttttgtttcttagcactttaaattttctttctttttttttttttttttttttttgagatggagtcttgctctgtcgcccaggctggagtgcagtggtgtgatctcggctcactgcaagctccgcctcccaggttcagccattctcctgcctcagcttcccgagtagctgggactacaggcgcccgccacaacgcccggctaatttttttgtatttttagtagagacagcgtttcacagtgttatccaggatggcctcaatctcctgacctccgcccgcctcagcctcccaaagtgctgggattacaggcatgagccaccgcacccggccggcgttttaaattttcaagagaatttaattaagcaatccagcttagggtttcctcccatctgagggaagtattcctcgtctttgaaaattaagatactgtgaagtagcagtcaaatcctctccataataccatgttatttttgaagaaatgaaaggttaccaccgaatcataggacagagatgtatgggtttgcttttccctgagggacccgtgtgtagtcagggaaacgcagacactggtgacaaccttccatctagatggaaaataacaaaaacccaccagcactgattttcttttttatgcacatttaacccctcaggagaagcactaatataaaaaggatcagacatgcattttttctacagcgtctctcagtcacagctctctgccatgtagtgaccacttggctgcagccggggcgcagtcgtggccatgcagacatccgaccaggaacagcttttctaggctgatgcctgctgtgcttccctcagcaagtttttttccctttcattcttcaaatattttattactgttattagtgataagctttgagtttaaaaatatctgatggaaaatttcctacacatgtagacagaagacacaaaataagcttttctgccaagaagcaaatggtggcatattttcaacaattttatgaagatactactgtatgtcagatgatgtttctgtgtgccacagatatagaagtttccagattcaactacatagtaaatacttgtatagttgtaattctaaaaaataaccattcaggtcgggtgtggtggctcacacctgtaatcctagcgttttaggaggccaaggcaggtggatcacctgaggtcgggagttcaggaccagcctggacaacatggtgataccccgtctctactaaaaatacagaattagccgggcatggtggcaggtgcctgtaatcccaactacttggaaggccgaggcaggagaatcacttgaacctgggaggtggaggttgtagtgagccgggattgcaccattgcctgggtgatgacagagtgagtctcgacctcaagaaaaaaaaatttcaaattttaggattgttttagacttatagaaaaacactggggataatacagtgatttcccataaaccccacccccactttcccctatcgttagcattttacattggtgtggtgcatttgctacaattgatgaaccaatacggatacatcatcattaactaaggtccatactttagtgatatttccttagctttttacctcctgtcctttttctgtcccaggatctcatccaggacaccacattgcatttagtcatctatgtcttattaggctcctcttggctgtgacaatttctcaaactttccttgttttgaatgaccttgacagtgaaggggtgggttgctcctccacacctgtgggtgtttctttttaggtggaacgagagacttggaaaagaaaaagacacagagataaagtatagagaaagaaataaggtggcccaggggaccagtgttcagcatatggaggatcctgccggcctctgagttcccttagtatttattgatcattcttgggtgtttctcggagagggggatgtggcagggtcataggataatagtggagagaaggtcagcagataaacacgtgaacaaaggtctctgcaacatagacaaggtaaagaattaagtgctgtgctttagatatgcatacacataaacatctcaatgtcttaaagagcagtattgctgccgcatgtcctacctccagccctaaggcggttttcccctatctcagtagatggaacatacaatggggttttatacggagacattccattgcccagggatgggcaggagagcaatgccttcctcttgtctcaactgccaagaggcgttccttcctcttatactaatcctcctcagcacagatcctttacgggtgtcgggctgggggacggtcaggtctttcccttcccacgaggccatatttcagactatcacatggggagaaaccttggacaatacctggctttcctaggcagaggtccctgcggccttccgcagtgtttgtgtccctgggtacttgagattagggagtggtgatgactcttaacgagcatgctgccttcaagcatctgtgtaacaaagcacatcttgcacagcccttaatccatttaaccctgagttgacacagcacatgtttcagggagcacggggttgggggtaaggttacagattaacagcatctcaaggccgaagaatttctcttagtacagaacaaaatggagtctcctatgtctacttctttctacacagacacagtaacaatctgatctctctttcttttccccacagacaggttttaggtatcactggtcaggtgttttgtagaatgtcccacaatttagaactgactggtatttttttcatcattagcctggggtttttttgttctcgggaggaaggccatagaggtgaagtgacattttcatcacctgtttccaagggtacattctgtcaacatgatatagcacttgatcatctggctcaggtagtttgtcagtttctccactcaaaaattttctttcttttttttttttgctctttccataatgtacttgttggaaggagtcactgtatgcagcccattaaggagtggggagttatgctccacctctttgagggcagaatatccaataaactatttggaattattctgcaagaaggtttgtctattctctccaatttatctaattatttgttgatatcagtagagactcctggatatttttttcttctttgggttataatccaaagctactttattttcctgctcaaattgttccagctttggccattgggaactctttgagttagctgctgtgtctctttgacatgccccatcattgtctcgtgtgtgtgtgtgtgtgtgtgtgtgtgtgtgcgcgcgcgcacgcgcatgtgtgtgtgtgtacgttgtgtgttgtgtttgttttatattttactccagacttatatatttcctgctccaatctgagaatcagccatttctccaaggagccctggttccatttattggagaatggcattagaaaacaagatctggctaacttgtcttcctatttaaaattaataaatcaattttttaaagatgtcttcaaacctctgaaatgatagaatttttcatttagcactagtgtcttctcttcgattagttataacgccttgcatttatatgatgcatccttgtgaattgaccagtttttactattaaaaaaggattcattacaacacatcatctgagatttttaaactgtggcttttattttgctatttctggtattctgaaatatgcatagcatagtggccctgtatgtactggggggttaggcagcaggatcaggtgagcctcagaacccactttccttgatattggggctagcgatttgcagtaaaaatctaaatgatcctgctttattacctaatgtctcaccattcaggatctgaataaatgaaagcagctgccttttgggcccatggctaccttgctcttggtgccttgggtttaatcccaggtttgtttctccatagctagcacaccttttaaattaactttgcactaatgcccaaaagccatgaaccaagaaataaaataatacaaagacaaccatagaattgtagtgaacagcagcctgtttctctgctgctggtctcatgagtctccttccattccaggcctgacggagatggcggtcttcagttgtgaggcccacaatgacaaagggctgaccgtgtccaagggagtgcagatcaacatcaaaggtaagcagcaaggctaggctccccatgcatgttctgggagctggtgagggtacagcatgagcttgcagctggctgcctgggtgtggatcctggctttctcactgtctcaaggttctttgtgaccttggacaactcacttctcctctttggtgtcagggttcccctctgaaaagtggagataattacagaacctacctattgttgaggcttattgatttaatacaagtaaattactcagaagtgcctggcatataggtctttgataaacattcactcgtttagctctgcttactccaagaagaaaacaagctaaaatgttttctctttcttagttcctattttcacttttccctcttccaccgtgaactactcattaacccttgaagagccctggggatggggctttcttggggcatgatctaggaaatggaccctgtccttcccaggtcagcggggcctgctgactgactccctgccacctactgactcagggagacagaggaaaagcaagaagcagatcactctttggagcccaatgctcctatccctcttcctcctaaactccctcttcctcttgtttcctctgagctaggatttcactaggctgagcttgcttggccgtgagttatgataatagaattaaaggcacacatttgaaggcctccaagctagtggagacatttcaatccaatctaccttattctccttctgtgtgatcaaaggtgttaaacttgaaatttgaaagaaaagaaaaacctacaattaggtagtatctttttatttcattttaaatcatcctccttagtgtgtcatagaaattcaagcaaattttatgttttactatttaatcatagtttaaatattgagaagtaattatttggctcatgttcttttcctcttgtccttagggaaacagtgcaaggaaaaaggagaacttgtttaataatgaattaaaggttgggtacatacagaaggagactcaaaattacaaaagaagttatactcaaaaaagatgctaattttagtttcagcaaatcaactggacaaacgctatgaaagggaatattctaaaagttcactgggataaaaaaataaccaaactaaaagttattactggaggaagtgtataacttccttccttcatcacaattcccattattacaatttccaaaagacatgttgggaatgtcaaaaattcatgagtgtgtgtgagtttgtaaagacattttcatgaagtataaacctcttaaaatttaaaaatgtataaaatgaaaagcacttctccaattttatgcttcagaatctcagctaaggttttattctattagatcattccccaaacttctgtttttggctttcatttattataaaatttatgtcaaagctaccaagcctcccttcttctaatgtgtaattactatggtatatgtggtcaaattttggtctggaaaggcagatgctttagggcagttccacaaataatctgtggaggaaagtgagtcaaaccttattcttccccattcccaaggctttgtgtgtactaatcaaacccaaactcctaaatgtggcccccagggcacgcttgatatggtcttgacacaccttcctccttctctcctgctcattccatcatcaccttcatcctcaccacaccctccctgggcctcatccacagttccccacatttattcctcaccacagctccatggagcagtgctggtactatccccatttatagaggagacaactgtgtgtagttgtagatagggcgtgtgtagctgtgcctggggccatacagcaggtcaggtggtaaaccagactcacagtccctgctggtgttcccactgtctgcttgctgcccttggcaataggcctccagtgtcctgttgagggacacaagctccagggtcaggcagaccagagttcaagtccctgttgtactgcttacaacctctctgtgacttttgccaagcttttaacttctctgatcctgtttccttatctatgaatgtggattgtaagactacttctctaattggattctaggaatgattaaagaaagccctcaaagtgtctggcacatagcaagcacaggaagtgttagccttcatttttaattatgagtgtaattattattatgaattaaattcagcacaaagaaataagattccccaaatttaagatccttcttggattctaattgaaatagctacccttcacccatctgtttccaaggtcatagcccacccattcgaggacacacaccccttcccctcccccagcagatgcagctggctcttttgcttgaactgactcttagtgtttcctcggcctggaaagctccccctacacatgcacacatacacatgcacactcatgcgtgcacacactctcctgtggcacccctctcttctggtgacagggcgctcttattcttggttaacgtgggtctcctataccaggccatgtgctccacgagggcagggctatgactctgtctctgtttagtaagctagtgcccagccaggtgcacacagtagggtccatgaacatgtactcagtaaaggacatgagtatttccacatcttttccagttcaaaggtctcctcatttcattagtgaataggaaagtgggtctgcgttcacttctttggcccttcactggaagacttctttggcccatccataggctaacacaattaccctcaggcatagggaggctcctcttgaaaacatgtttccctttactaatctcaaggaacgaaaacaggtattaatgcatttgtttggtagctgtagcctgtcatctataattgtgtttgtgtgtgtatgtgtgtgtgtgtgttttgttttatgcagcaattccctccccaccaactgaagtcagcatccgtaacagcactgcacacagcattctgatctcctgggttcctggttttgatggatactccccgttcaggaattgcagcattcaggtaaagttccagggtgaagagggaagtagctgtttggtgctctctgtgggtttaaggatttttcttccttccaaggatgggcatggagggcatttctccatctctgtacagagtcccctgacctccctgcttcagtgtccagcatgcatgcactattccatgtccatgctctgcccatgatactgtgtccttcctgtgcaggattcagggctcagtcagaagcaaaacgtgtttccaagggagaacatcatgagaccagggagagttcttcttctttttttttttgagacaaagttttactcttgttgcccaggctggatgcccaggctggagtacaatggtgtgatcccggctcaccgcaaactccacctggttcaagcaattctcctgcctcagccccctgagtagctgagattacaggcgtgcatcaccatgcccggctaagtttgcatttttagtagagatggggtttctccatgttggtcaggctggtctcaaactcccaacctcaagtgatccgcccgcctcggcctcccaaagtactgggattacaggcgtgagccaccacgcccagccaagaccagggagagttcatttttaaggtcccgaaacacatgcttgtgaccaagagttgaggaacccaggcactccccagtgtggctccttctgggctggtggccatgaaggacagaagggccaggacaagataggtcgtctgtgctactgagcgtagcaccttacccagtgtcaccgggggatcctggtcattgcaggccttgtggaatcttcagccatttttcactgctgccttgaatgggtatgaaacggtgctattagccatcctaaaatgataacttgcccatgatgtaagctgtgctcttgagttttcacttcataaaaatgaaaatggtggcagtaacaactgtttactaagggaccacaggggctttgcaaacattatcttacttaacacacgctgcactgcaggctcagagtactcacacagcctgtgagtggtagaaccagaactcaagtccaggaagctccagtgcctaaagcagcggtcagaaccatcagctcttccgtctcaggagggacatcgcatctgggagcaggttaccgaacatgcaggaattatccactaaaagtattaatgcatcctgcctggtacttaatcatacagtagggtcaggaattagtttactaaatatctggtctcattagttaaaaatatgttaacctgacacaggccagtcatgccaacacagctcaaagaattttgtgttgacaactagatgtttttactcgctagtcaaattaatttctctgttcttaacgcctcccacttttatctaacaggtgttccttccctgaagagtaaaagcctgtattatccgtaaaatagcctccgccctcacccaccacctccagcctttcttttttttttttttttttttgagacagagtctcgctctgttgcccaggctggagtgcagtggcgcgatctcagctcactgcaagctccacctcccgggttcacgccattctcctgcctcagcctcctgagtagctgggactacaggcccccgccaccgcgcccagctaattttttgtatttttagtagagacggggtttcaccgtgttagccaggatggtctccatctcctgacctcatgatccgcctgtcccggcctcccaaagtgctgggattacaggcgtgagccaccgcgccctgcccagcctttcttaattcttgctcagttttgttttttgttttttttcctgtaagcctcccaagcactggtaagtgttaggaattcttactgcatctacaattcctcaccaggaatggtcttttttgtgattgattttttttaacacctttttttgagatatagtttactttttttttttttaatttgagacgtagtctcgctctgttacctaggctggagtgcagtggtgtgatctcggctcactgcaacctctgcctcctgggtgcaagcaattctcctgcctcacccacccgagtagctgggactacaggcgggtgccaccacgcccacctaatttttgtatatttactagacatggggtttcaccatgttgaccaggctgttctcaaactcctgacctcaagtgatccaccagcctcagcctcccaaagtgctgggattactggtgtgagccaccacgcccagctgagatatattttatataccattatattcacccattatttaaaatgtacagttcaacggtgtttagtatattcaagaattgtgcagccattaccactatctaattgtgtctatattcataagagatatttgtctgtagttttcttgtggtagctttttctggttttggcatcagtgtaatattgaccttctagaataagtatgaaagtcctcctcctccttctcctcctcctccctcctcctccttccacctccctcctcctcccttgtccttcctccccctactcctccctcctcccttctcctcctcctcctccctcctcctcctcctccctcctcctcctcccccctcctcctcctcctccctcctcctccctcctccttctcctccttctcctcctccttctcctccttcttctccttcttcttgttcttttcttggaagaatttgtgaaagattgatgttaaatcttctttaaatatttaataaaatttgttctctttgtggaaagttttttcaatattagctcaatctttttacttggtatgagtctattcagattttctattacttcttgagtcagctttggtagtttctatgttataggaacttgaacatttcgtctcagttatctaatttattggtatacaacatagtacatagtattccattataaccttttttattctttgaggttagtaataagatcccctgtttcattccaggttttagtaatttgtcttctctcttatttttcttagtcagtccagctaaaaatctgtcaatcttatttatctttttgaataaccaacctttgattttgtgaatttttttctattgtttttgtattctatattttctttatttctgccttaatttttgtttcttttttttctgtttgctttggtttagtttgctctttttctagttttgtaaggtagaggttaggttattgattgtgttcttttatatataaaaaaaaataggcatttacactctacatttccctgtaagcactgctttagctgcatcccataaggttttcgttgttgttgttgttgttcatctcaagttttctgtcattttccttgtgaattttttttgtcctcttgattatttagaagtgtgtatttaaattgtcacataattatgaatttcccaaattttcttcctttactgatttctaatgttattttactgtgtttggagaatatacttcacatgactgtgatccttttaaatttattaaggcttgttttatgacctaagtcctatcctggagaaagttttgtgtgcacctgagaagaatgtacattcagctgttgttggatgaagtgttttgtgcatgtggtttaggtcttgttggtttagagtcttcagtcttctgttgccttgctgatactctgtctcatggttccatctgttattgaaaatggggaattgagatctcagctcttatttttgaattgtctgtttctcccttccgttctatcagtttttgcttcatgttcttttggggctctgttgttagaaatatccagggcctctttccctagaggtagacatttatttatttgtttgtttgtttgtttgagacagagtttcgcgcttattgcccaggctggaatgcaatggcacagtctcaactcactgccacctctgcctcccgggttcaggcaattctcctgcctcagcctcctgagtagctgggactacaggcacctgccactgcgcctggctcatttttgtgtttttagtagagatgtagtttcaccatgtcacccaggctgaggtagacatttatatacatggacataactgaagcatgggccagccctttttaaaactgttaccaaagtgctgagttgtttgaagagcctgagaggacatgaaacatgaggatggtgagcttcagggagactctcaggaagagtaccaccccaccttgagacggcaggtctcagtgacgtgaggtgggtaggatggttgaaaagtctgaaaacaccaggtcacccctgatgatggaagatgatcacacacaagatttacctgctctctttctgccatggttttgggtgttcatggtacacatgaagaagcatcctgagacagccaaagtccagtgttttcttgcccaccttggattctgtggtgctggatatgatgattctgttcttgtcccccttggctagctcagcctccattcatcctttctcctttccatctctggtaggctttccagatttggcaaataagaatacaggacacccagttaaactgcatgaataatgtcgtgacatacctatactgaaaagttacttgttgtttctttgaaattcaagtttaactaggtgtcctttatattctcttgcagtcccactggggttaatcagcacaagctctaaaagttatcttttctattctgtcattaacagtgtattcccagtttttgaagggaccaagtatggctttgtaaaattataattttaaactctgactcgggaccaaatgaatgttttggatgagattcagatccatgcactagcaggacacaccctctcacttcctttggtcctgatcttagctcttttcttcacccatttttgggccacacactccatttctaattttagctctcccatgtacttcttgccacttcatgcctgttttccctgaggacccactgactgagaaggactgttatagaaactctgttttcctctaggaacgtgctctcagacagtgtccctgagcctggaagtgctccccacatgtctctggaagtggggcggggaggagagccaaaggtttcctccaccttcgctttggtggttggtcaccaggaagtaggtgcacactctaaagtgaaacaaacaaaaagtgatgtctgccaacagccaccaccaagacaagcgtctgggttctcgtttctcctctggtggctcctcaggccaaatgataccttcttgtcacccacggggtctgagtcagaggtgaaactcaacccccacaccgtactcctggtatctgccaggggatttggaattccagaatgtttatttctggttcattgacctaagattcaagcacacatagcctgaaattacagtactgtatatccagagcccagaactgcaagcccattattaacagtaatacattttgtggcctgaggatttttcccaaattgctctcagttgcatgttttacccgatatcattttgtctgttctgattttataagtgccacatattacagaaattttgaaaaagcatgtaatggagaacaaaatcccatactctcccttatccccatacccagacaggaggtatgcgaggaaagagatggaagtttcgcccaggactagacttgtgctgggaatcgccctctcttgcctatgtatacagagatttggagggggatgtggagagactggtggagttatggagggaaagataaggcagtatgtttaaaggagatttggagaaaagttttctgaaggaggggcaaatgaccctttgctatatctcctcatcaaaaaaaaaaaaaaaaaaaagccaagaatctacatttcctgtgtgtgcctctggaattcaatttctgttggggtcgaaggggttaagaataaaggacacactaaaattagcctcaggatgagtgcattggctcacgcctgtaatcctagcactttgggaggccaaggcaggcagaacccttaagatcaggagttcaagaccagcctggccaacatggtgaaaccccacctctactaaaaaaaaaaaaaaaaaaaaaaaaaagttagccaggcgtggtggcaggcacctgtgatcccagctactctgaaggctgaggtgggagaatcacttgaacctgggagacggaggtcaaaccattgcactccagcctgggcaacagagtcagactccatctcaaaaaaagtagtaataataataacaataaaataaaataaagttagcctcaaggcaagagcagtgttccttaggttacataataaaaagaaagattaagaaacgctgggtgtggtggctcacgcctgtaatcccagcgctttggaagtccaaggcaggtggatcacctgaggtcaggagttcgaggccagcatggccgacatagtgaaaccccatctctactaaaaatacaaaattagctgtgcgtggtggcacatgcctgtaatcccagctactcaggagactgaggcaggagaattgcttgaatccgggaggcggaggttgcagtgagttgagataacaccactgcactccagcctgggcaaagagagcgaaggtccatctcaaaaaaaaaaaaaaaaaaaaaaagaaagaaaagaaaagaaaagaaaaagaaagcaagaaacccatcctctaaaagcagaatttgggaaatatttcctttaaaaggcaaaatagtaaatatttcagggtttgccagcacatattatatctgtttcctctgttgcatactccatgaagcagctgaaagaggtcaagaatcgaagaggttctaagagaggagaggctttattttatagtataatatgaattctaatcatcataattatttgctccgttacctgccacagtgagaattgttaattgttattttaggcgttttcctcaggtgttcagttattgtccgagggcatgagtaacacacagtgatgctagcggtaaaatgtgtgtgtgcccagaaaggaagcaggtccttccccttagcgtagaggaagggccacgtgcaccgaatgcacacaggccccgtgcctgacattcccaccaccttactaatgcccggtcctcatgtttactcttcgtttaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggaggtaattcctggggttcagaatgtatattgcccccaatgacatgtgattcaacaaacccttcccagtggcctgactgagagttgaaactttgctttgtttggactttgtctctggaggagaaaattattgaggcgactgatgaaaatgggaaagatatttcctccatactgtaaaagcattcagtgacaaaacttagccgtgttatgtataggtaatcttttcttttacataggagataatagcagcacactttaaaacatgctctctcacaacacaacaatcaatacatgttaccaacacagtggtcaatacagaagccttcggccactccaatatatgtggggatttctctccaccagcaagcagtcggctctgcagcggagaccagctgagtgtcctccattcaagtctgacactacatggagatagcttcagatcccataggttgaggactcaatccccaggcctcccctccctcccaaccccgtccccagcctttagatgccaatcacaagtctgggcctctggaacttctgactaagtgtttcccatgacctcagctttgtgtccaattaatttgctagaacggttcacagacctcagggaaatacttatatttaccagtttatcataaaggatattacaaaggatacaaatgaagagatgcggaggatgagatatagaaggaaagggtgtggagcttccatgccctccctgggcgcaccaccctccaggaacctgcacatgttcagctatctggaagctctctgaaccctgttctcttgtttttttgtggaagcttcatgatgtcagcattccttcctccaggttatgggtcaggaccccctttgtaataagggtcttatgacccacagtcagaaagatggggaagattagagtcctgcattgaggcaggtgaaaggagggcgggaagaggtcagagagattgttttctgaggcctgcccctgaggcgtaaagcacccaacatcatagcaaaagattgtaaccagggctatgggagttgtaagccagaaatcatgacaaaaacctgtgtgtgtgtgtgtgtgtgtgtgtgtgtgtgtgtgtgtgtgtgtgtgtaggttattatatatatgtacatatacacacatatatacacataaaataacccacaagtccattaaaatgtaatcgaatcattcaaatggataggtttaattgcatcgtattttctatttgttctatctgtaatttgttctccttttcttctttttcttcatttaaaaatattatttttatatttttaatattaatatttttatgattctatgtttaatatttttatgattcttattttttattctttgtttggcttattagccatagctctttttctgttcttttagtggttgctttaggattcacagtgtacatatttaacttatcacagtgtaccttcaagtgatttataccatttcacatatattccattttctccttcagatatttttggctactgttgtcaaatattttactttaatgtatcttaaaataccattgctacactgttgttatttttgttcagtcagtaatcttttacaaagagatttatataaccaggaaaaacacatgtttatgcattatagttaccatttctagtggtcttcattttttggtctttatattttatctgacatcattctccttcttcctgaagaacttttttaaaaatcatttcttctagtgtggatctgctggtatggtattcagctcctgtagtctggggaaaaatatttattttacttttgaagtgttcttatttttatttttagccttcatttttgaaaggtatttttatgaggtatagaactgtaggttcacaattttagcttttgtttgtttgtttttactttcagtacattaaaagaagttgctcccctatcttctcgcttgcattgtttcccacatgaaatctgtgatcatcctaactttgttcctctgtatgtaatgtgtcttttgttcctatttttacccttatcactgattttgagcaattgaattgtgacaggctttggtgtaattttatttatatgccttgtgtttggagtttattgaacttctggggtctctgtatttgttgtttacatcaaatttggaaaaagtttggccattatttcttcacattttttttctgtttccacctatcctcttttttaaggactccagttacatatatattagaccatttgaagttgtcccataactcactgatgatctgttattattttccccttcttttatctctacattttattttggatagtttctgttgctatgtcttcaatttcactcatcttttttggtgtagtatctcatctgacattagtcctatccagtttatatttcatctcatacaccgtaatttttatctcttttttgcatttttatgtctctaagttttggaccatccagaatgcagttataattactttccttttttctttctttcttattttcctttttctgtcacacaggctggagtgcagcgccaatcatagctcactgcagtcttgaactcctggcttaagcaattctcccaccttcaccttcgccttctgtgtagctggtactacaggtgcatgccaccacacccagctaatttttggtttttttttttatgttttgttttttggttgttttttgtttttttttttgagatggagtttcactctcgttgcccaggctggagtgcaatggtgtaatctcagctcaccgcaacatctgcctcctgagttcaagcaattctcctgcctcagcctcctgagtagctgggattacaggcatgcaccatcacgcccagctaattttgtatttttagtagagatggggtttctccatgttaggctggtcttgaactcctgacttaaggtgatctgcctgccttggcctcccaaagtgctgggataacaggcatgagccaccacacccagcatgttttttgtttgtttgtttgtttgtttgtttatagaaacagggtctcactattttgcccaggctgctctcaaactcctgacctcaaatgatcttcccacctcagcctcccaaaatgtttataggcatgagcctataataggggattataggcatgagccaccgtgcccagccttttcataactgtttcaatgtctttgtttgctatcctaacatctatgttatctgtgggtggtttcaactgattcatttatgtttccactctaggtagtatttttcaggttctttgcacgcctgataatgtttgattggattacagacattgagaattttacagtgttggatgctagatattcttctatttctgtaaatagtgagctttgttttgagacacagttaagctagtgggaaaccgtttaatcctgtagggtcttgcttttaagatttattaggcagaacctgataagggctcagtctcaggtcggttattacccactgctgacacaagaccattctgtgtgccctactcagtgcttcttgaatcattagattttccagtctgattgatgggaacaggcactattcttcccccgtgtgaagcctggataccattacctttaactgtttcgtgtggttctttttctattttcctttagaggcatcctaaggattctggtgccttctcctgggtatttgcctttcttagtttatgccctcgtttttatggagcccattctcaattagcttccacaaaatgtatacataaaaagtaaagattgtgggaacttgcatatccttatgtaatactggcttagtaatttttccaaatatagaaatttaggttgaaattattttccctcagaagtttaaaggcgtttttgtatcattttttagcttcatgggttgctgtggaaaattctgatacttaagttttctatgtgaactgtttttcagttttagtttttaaaatatcttttctctttaatcctggttctgtgataagctgtgatgtgcaatttgttttggtcatcaagggcattcagtggcccctttgatctggaaatgcaagtcttttggtccttaaacttttttttttcctttggaaatgttccactctctgttttttccaggaattgtgttagacgattgttaattagacctcttcgattgcttcctcaattttcttttttcaaattggcctattttctttgcctttttattctaccttcttggagatttacttgatttatcttccaattcttctattaaatgttttattttacttatcatgttgctaatttcaagtttttttcattgaaaatttttttctggttctcaatcataagagtcttttctggatatctcaattattttttgtttgtttgtctttagtctccctagttccctacactagctttgtctcctctaagccctctgttctgtgtggttttttttggtccctgatattcagtggggaggcttcgccagacctctgctaatttctgctgtctgctcctatggaagagtgaagaatcattgatttgattggaactctgtgggtatgggcagagcttgtaggcttcactataggtgattggacagtgacctaagtgttttgatctagatacgataccccccaactgtcaaaattggtttctttcctctgtagccgctcacttcctctagaaaagaagtgtcctgctccaggaattaaacgtggctgctgatattctagtagccaagtgggggaggaggggaaggtagagtccttgttatttagtatataaactttcacttattttcccagttttcagcctggctccttatcatgcctccattctacaggtgccctaagtttagtggctttctgcttcagagaataaatcaccctgtgtcctatggatatttgagggcatacttgccaggtgtgtaggcatggagaagacagactttgagacgcaactatttcttttttttttttttttttttttttgagacggagtctcgctctttcgcccaggccggactgcagtggcacaatctcggctcactgcaagctctgcctcccgggttcatgccattctcctgcctcagcctcctgagtagctgggactacaggcgcccgccaccacgcccggctaattttttgtatttttagtagagacggggtttcaccgtgttggccaggatggtctcgatctcctgacctcgtgacccacccgcctcggcctcccaaaatgctgggattacaggcgtgacccactgcgcccggcagagacacaactatttgttaatcagacttccaatcattctttccagttttagtccccattttactacctgggcccacagcttctgagctgctctgtgattctttgggagaatattggcttgctgagttaattataccttcttcatctctttttcagctttcaaatatgtgttgaaatctctcttctactgttgactcctctttgccttgtgagtttatatctttttaaattctttattgccatcatagaggggttttgggaggaggcagacatacagacatgttgtgttggccatatttatccacaaattctacaacaggtttgaaagtgtgcgactgatttcataggcagctttagttgtgtgatgttttctaagctgaaattcattttaacttcatgattactgtttctggaatcagcagagaaaaagagggttatagtatcctttcacacatatctgaaatatagaatttaacctcccctcattcaactacaggcaacagtttggtgtatattattctaattgttattattctttctagatatagaaggtttattgttttaatttctaaaatggatctatatactttttacaatctgatttttcccccattggatttttttatatcaatacacatgacctaattctttccagtgacgaggtagtaagtattccattggaaaatgtatcaaaatttgtattattattattatttgagacagagtctcactctgttgcccaggctgaagtgcagtggcatgatcttgactcactgcaacctccatctcccagattatatcataattattgaccaagcattgcatttatttctatttgtcactattatgctgcaatgaatataacatcacctacagattaaattcctggaaataaaatatttggtcagagagcatattattttcaattttaatagatatagttaagttattctctcccaaaaaagactgtagtaatgatcttgacttgtttcccaaattattttatacacgtacactcgtgtacacacacacacacacacacacacacactttttaaatgtgttgacagattagctctgttcagactgtcagtaacttgcctctggactttaaaatggtggctgcattctgagctcagcagtgtttcctaccttgtgcatctcaaatgccaccaagctgatctctagctggccatgttaactttctgccccacaggtttatgctggagaacattgttcaagttgtgtctgcttcacttccccaggagtccagagcaccacccaccctaccttccctgccttcttcttctttgctattttactttaggtgctcatgaaatttcctttttttttttttcttttgagatagggtcttgccctgtcacccaggctagagtgcagtggtgcaattacggctcactgtggccttgactttccagggtcaagtgatctttcctcagccactcaagtagctgggactacacacctgtgccatcacacccagctaattttttatttttagtggtgattggagtctcactatgttgtccaggctggtctcaaactcctgacctcaagcaatcctctccctctggcctcccaaagtgctgggattataggcatgagccaccatacctggccaacattttcttcttttctttctctttctctttctttccttcttttcttccttgcttgctttttctgcccaggctgaagtgcagtggtatgatcatgtctcactgtagcctcaatctcctgggctcaaggaatcctcctgcctgtctcctgagggactggaactacagatgtgcaccaagtagtcagctaattttttagttttttgttttgttttgtagaaagggtctcactatgttctggctgatattttcaacttaagaaatgaatttctaggcttcagtaacctaaaagggctcacttatttaaaactcactgatatctcagtgaaaatcttagttgaaaaggtgaaaatgtgctataagtcttggtctcatttgagtgcttttcatagagcatttgaaaaccaaacacttgaaaacccagatgagaatacatctgtgtgtgctttgtggttcttcattcttctctccttttttcttttgtagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccgtaagtctaaaccctagaagagcacgattagtcatctcctttcaacttgctggtttacttcagttttagaagctttcatttggttttgaaaagacctggtgtgattgagttaggcaaggcacctttcaggggaacataaagaatatagtaaatattagaggtgactgaacagttacaaaattctaaggtatcttttgggactttcctcacttactcattcattcattcattcttttacttattcatgagatagacatagaattcatcctctgttatcacctgacttttgccctcatggaatttaggctcttataggatgacagtgtggaatacccaagttgtagcattaggtcagggagctacagggcttagcagtccagcaattcatggccttttggaaatttcatgggactttgcaaaagaagaagataagggaataacctcatcctcatagagaatggcaagaagtaagcagacaccaaaggaggagaccgagcaagctctctggccagcctggcacagctgcgggcaagccgaaattagacatcagaattactggatcaggacatgcagtctgacactacataacacaaccaggtgcatcagccaggtggcacaggttccctgctccaccaagtcccattgggcaatgtgatgtacccacttggtggattgtgcacctgagggtactagggtcaagggctcagcaccctgtgtagtgaacagcaaacaagctgatcctctgtgcagttgcacggtcgtcatgctgtggccaccttgacctacttcactgcccacgtgactagccccagcatggctcggggttggggatggttaggccttgcagtttgtcacactcagcaaggatgaacaaagatgcttggagcctgtggcagactgcctctcccagaaaaggtggtacttgaattgggcttgtgtgttagtcaagattctttagagaaacagctaattgaacatgtatgtatagaaggagatttatgataagaaattgactcatgcaattacagaggctgagaagtctcacgatctgccatctggaagctggagacccaggagccagtggtgtaatttagtcagagtctgaaggcctgagaaacaggggcagtggtgtagatctcagtccaaggataggagagtactgatgtctcagctcaagcattcaggcagaagaaaaggggagaattcctcctttctttaccttttgttcttgtcaggccctccatggattgaatgaggcccagccacactgaagagggcagtctgcattatgagtcccctgtttcaaataataatctcactggaaacaccttcacagacacacccagaaatcatgttgagccacatagctgggcacctctgtcacccagtcaagttgacacataatattaaccatcgcagcttagagtaattttgacagatgaaatttgaggagtctcagatgggaaaagataacatgagagaaggcacaacgtggcagctttaaattctgactcacttgaaggtctggaacataacgcttttgtgagagcgaggtgtgagatgaagctggattgaggagttctgaccctaaaatgcagggccctgaaagtgaagccaaggcaggtagaaatttgttgatagcaggggagccaatgataagcatgagctcaggagcacaacttgagacttacagatcatgatgatgacctagatgattcttctttcatgaataattacattgagtttgctgatataagtaaccttctaacctgccttctttccaccagagcatatttgctgagcacattccactctggtcttccaagactgagcaggcaactcagcagcaggctcctgccagctacagaggttttcttgcttcctgaaaatgtatatcagaatcatccacaatgtttatttggaataccactgtgtgcttggaactgggtaggggtatcgtaggggagcatcaatatgtcaggtaattcctgccttataatcaatctaaagctggcaagatcctttagatttttgctaaagctggcaagttcagtgaagactctctagtgtaagtactggtttcatttcacagtggcaaacaaaaggcaaagggaatctatgtgtgaaatagtggcttcctccccaagtaccagccagtgcccttccaatgactttgctaggcatgactccagtcaaacccagagggacatttgattttgatttctatgaagtctaaagaccactgctatgatgtgaaccctggacccaatacagcagcaggaaaggcagctgggtgatgatgcctgggtgtgattaggtgggcagcttctagacaggttcccttcccacctgggaaaggaagagagtggggtattgctgcctccttttgtgacacagaacatccgtggaagggcagatgcactggtttcattatcaagtctgtctcttctttactgtgatcatggaaagcatgcttcttctgtgttgccatattcctgatcaatctaaccctagtgacagattgtattagtctgttttcacactgctaataaagacatacctgagactaggtaattataaagaaaaataggtttaatggactcacagttccacatggctggggagccctcacaatcatggcaggaggcagagaaggagcaaaggcacgtcttacatggtgacaggcaagagagtgtgcaggggaactcccctttataaaaccataggatctcacgagactcactgtcaagagaacagcacgggaaaaccccgcccccatgactcaattacctcccaccaggaccctcccatggcactacaagtcaaaatgaggtttgggtggggacacagccaaaccatataatagatccaaattttagcttcttcatggtatctatatggagcatcagatatagatgctgcatatagagatgaacagggtgaatgggtgagcagatgcatccactgatgatgctcaagctttgttgtaatcatttttagccacatatcatccagcatttatcaaaactgccattttctgaaaggacacttaaaatttattttaatttccctgcctcagtttacctatcaggaagcagactgttggaagcagtaggtgatggaagtagagaaaaagaaggcttagaagtccgtgttgttctgcctcatagtaaatgatcatggtattaattcattttaagtagcaatcctgcttaaaagtcacagctgcgagagaagcagcctttccttttgtcttttgccccaaggcatttgtgcgaggtgcctctggattaactgcatttctccattggctgagttgcaggaatcaaatgcctctttgagagaagggcttttgttcacaatgctgaatgcttggtatagctatactaagcataaaggttcagtaggaattttatctttctctatttggcagaaaatagtgattaccagcagacacttaggctgtctaaaaacaagccagtttgtttaaagagctgcaggtcatcctttctccttctacttctggcttgggtgaaagctgcttttctgaagggggcctcttgagccgaggcgttctgaagggcagcaatgatgaaaaccttatgaatgactgtggctggagagccttgtgcactaaatgccattagcactcagctaggctgtgcattctcattgccctttgttcagaacggtcccctctgcagggagaacagaactgccacagttaaggctgtgacctttccagtcacttacctccttagggatgccagatcatcccagtgagatcatttattatgctttacactatattttatgcatcatgacagtcttgtgaccacaaagacacagtggctcactttactttggaaaacattctctgatgcagctaagtttcaagcttatgatccaaaactagggacaaataagaacatggaagaaaggtggaccctgggagtcccctgaaacccacacccaaaaggaagtttaagatgatcttggcatctgtcactttgatttccttcaatttccttcatctcagaagggcaaagcttagacaaaaccttgtctcaaaattatccgttcattttcatttttagataactgatactaaagctacttccttatgcaggacagagcagttggatatttttgaaagatatttctcattataactgtaattaagggtggggtttttcatgtgcatgcagtttcagaactttcttggcagtcgtttttccttggcttatcgcagctacacagaagacaggtttgtagctttgcattcccgcaacagtcatgtcactttcagactaagaatcctttgatctttactgaatggatatttattatatctcaaacgatgatacctaccttttttgttctatttttcttgcgattccttgccttccaaatcagagtttaaaatccaaagataaggaacaaatacaatgtgttctctttgaagttggaggcaggtcttgctcgtctttgtactgtctgaacacagggccttgaccttgctttgtaggcatttgtggcactatggatttgatgtgtgggcccagctacaccatctaaaccagctggagaatttctctccatgaatgggacagtcttttattaagtgtggactagtatttcccaacccaccctcattcccgtaaagtgtcagtggatcttctgtgaaaaaagagttcagtgagcaaatagaattacaaaatattgcatattataccaccttgaaggcccaccatgtatactggcaagttcaagcctctttgaagttcaacagaaaataactctgtttaactttgacccagaatcgtctaaatgttaggcagagacacatttttatacgtgcggtttttatggagttcgttgctttgggtttattgctctaatgctagtttactcttcgttttcaaaggtatagatcttggaagtctcatagcagagattattatagccttgagacagcatgatatatagaactaacttttttttttttttttttgagacagagtctcactctgtcattcaggctggaatgcagtggcacgatctcggctcactgcaacatctgcctcccagagaaccaagttctttggagactcagggaagctgcagtgtacttggcccaagacctcggcctcctaacaagctcccctaatgagcagagctatgtgcctggatgttggcatgtgcccaccgcctcttcctgtctccttttctccctctttctcactgtcaaaggagagcagagcatttgaactggtgttgtcttaaagtatgaggaataggcaaggttctcatggccagccagggatctgaacctcttctgaaacccagggattgatcaaatagggtacattttgcctggaggagaaacttaacatggaggtaaactccatgagtaggtcaaataagcttcttggtttggggaactagacagccttgatgattttctctaatgcactaagacttgaaagataccacaagctcaattctgtaagaaggttttgtatttatttacagggaaagaagacccaactgtagcaccaccttgaacatgatataagaataatcatagccaccactgattacttgcagcatgccagatcgtgtactatgtgttttacataaaggaactcatttaacccttaactgtgaggccaggcgtggtggctcacgcctataatctcagcactttgggaggccaaggcaggtggatcacctgaggttaggagttcgacgagaccagcctagccaacatggtgaaaccctgtctttactaaaaatacaaaaattagcccagcctggtggcgggcacctgtagtcccagctacttgggcagctgaggcaggagaatcgcttgaatctaggaggcggaggttgcagtaagccaagatggcgccactgcactccagcctaggggacagagcgagactccatttcaaaaaccactgtgagaaagataatatgctcaattttcagttgaggaaactaaagctcagagatgctgggtaactgccgcagagtcataaaggttgggctaaaaacctcactccgactgactccaaaaccagggcttttcagaacccccctactcgttcccaggcgcccctggctttcttcataatacagtctcattcaaattccacagtgtggcctctccgtagaaagaaggaagaacaggacgtgttttgcagagttagatgtgagagttttgtgttgatgcctgtgaatttgaaacccctttgaacgagtcacctttgttgttgtcatgagacagaaacttttatctcattgaggttatagaacaggccagagtcttaaatacagttacgagttatagggttgtgaattcttttttttttttttcagacagagtctcgctctgtcacccaggctggagtgcagtggtgcggtctccactcactgcaagttccgccttccaggttcacgccattctcctgcctcagcctcccgagtactgggactacaggcgcccgccaccacgcccggctaattttctgtatttttagtagagacagggtttcaccgtgttagccaggatggtcttgatctcctgacctcgtgatccacccgcctcggcctcccaaagtgctgggattacaggcgtaagccaccactcctggacgggttgtgaattcttataaagtagttggggatatttaagtcctttgatcattgaaaacaagtaccaccgcagttgccctgcctaactctaatgccacacataggataaaaaacaaattgactttccaaagatgtgttattacttttctgactgtcaagatacactgtgtcttatcttacatgtaagtaaagttgcaatcaagtgccatattataaatctgattttattaccaggaaatgctttcagatgtttaagtccttgaggctatgaacctggtgttggtgaaaaatgaaaactcactcaatgaaaaatatgcagttggcccgtggcatacaccccatgaccagaccacctcatgtcagagaaatgtccccaacttatgtgatctgtaccctgacagcaccagagataatacacatggggtagcgcctgtgtgcatctgattttagtggatttctctgacaacttgaaaaatcagacttaaatacttggggatatgaattggggcacaccgttctttacatacttggcaccaaaacagtatggataaattacatccattttaaaaaaacatgaatcattttaaaactatatttaagtttaccatttaaggatatccttagagaaaattgttaaacctcttttaaaatatatgtcatatatctttctaatcactatggcaacatttattataattccacccctaaaatgtgataacccttgaccatctccaaaatgtgtgactgataaacactggccagcatctttgtcatattttgatattcagaatgatggcaacggctatgatgctggccatcatcgaacggtgggtgcatttgctctgggccaggcactgttacacatttgttaactcacttaggagaataagaagtggaaattcaaaaagtaacctttctggggtttcctactgagtcataggccctaagtgagtagacacaggttaagtatcccttatccaaagtgtctggggaccagaagtgtttcagattgtggattctttctgattttggaatatttgcattatatttaccagttgggcatcctaaatctcaacttatttacttagcatttcctttgtgtcatgtcagtgctcaaaaagttttggattttggaacatttcagatttcagattttgggatatgggatgctcaaactgtattatagcctacttgaatgtttatttccaaaagaataatttgtttttgttagggtttctattcttctattcatttaattctttcccaatcgtgtaattcctcttattttgagatgattctctcataagtgaggtatcatatttgagcctgcagccagaagcaggccagtgttccgcatcaggccgtgaggcttgtcctttggaggagctgtctaccgtgaagcagatgtgttagttatgtctcagcaatggcctgagtcaccaaacggctccatgaccgtgggggtttggtccatggagttactctacctgatgattttctgcctcgctcccaaattaaacacagaatgaccaactaactcataatcaaaactagtttgcagtaaatacaatgctctatttatgtttttttgttgcttgttttgaaacggagtctcaggctggagtgtggtggcgtgatcttggctcactgcatcctccgtgtcctgggttaacgcttttctcctgtctcagccacccgagtagctgggattacaggtgcatgccactacaccctgctaatttttgtacttttagtagagatggagttttgccatgttggcctggctggcctcgaactcctgacctcaggttatctgcccacctcagcctcccaaagtgctgggattacaggtgtgagccacctcgcccagcccaatgctgtatttctgaaaaaggtatcaccagaatattaaaaaaaaaggttaattattaatttgttcacttaattaacaaaaaaaagtctatggcaaatctcatagactcggagtccagtggggtagaaaaaccaacattcttaacggtcatattttccctttcatcccttgtctgggggtgtgatattacgatatactgtgtgtctggttgtgtgtgtacacacacaatatatatataatgtgtgtggaggggagctttccatcccggggtcctggcttattactcccatagcccttgttgtttcctaagggactaaaacaacaagcatatcttttgttgaagtattggccttttgtccttggtttctgaagtagcttcagagctttaacggtgaaagacggtctttcgctataatgtttgggcactttaggcctcagaaaacagaatctctcttgctgatcttctcctgccctcctttcatgtactcctctgtctccccaaggcagggctctaattttcccctgccctcatccataaagaaattctttgacctacctgatctgattagaagtcataagactcacatttcggaaggagtcctgtttccattccctggaggaaggagccacgcacagagaggccaagaagaatctgaacagataggtcttgttgggtttcctcgctcagtctaatagtactagatcatgccttttttgtccaatcacagttctacatggttgtcaatcacgcctatccaatggagcctccatgaaaggcccatgaggatggggttcagagagcttccaggtagtggaatacgtggaggtttccagagggtggtgcacccagggcgggcatgaaagctctgcaccccttcccatgtgccttgccctgtatagctcttcatctgtatcttctgcaatatccttaataataaaccagtgaccaggcatggtgggtcacgcctgtaatcccagcactttgggaggctgaggcaggtggatcgccaggtcaagagatcgagaccatcatggccaacatggtgaaaccccgtctctactgaaaatacaaaaattagcttggtgtggtggtgtgcacctgtagtcccagctactcaggaggctgaggaaggagaattgcttgaacctgggaggtggaggttgcagtgagctgagatagcgctactgcactccagcctgggtgacagagcaagactccgtctcaaaaaaaaaaaaaaaagaaagaaaaaagaaaaaaataataaaccagtgaatgtcttttcctaagttctgtgagccactctagcaaattaaacaaactcaaggagggggtcatggggtccctgatttatatagccagccagtcagaagtacaggtcaaacaacctggggcttgtgatttgtgcctgaaacttgggggactcttgggggctgagcccacaccctgtgggatctgacactatctccagatgatagtgttggaattgaactgggttggagaatgcccagctggtgtctgctgtggaattgactgattggtttttggtagggaaaaattctcatacacttcttggtgaccagaggtcacagaagccttctgtgttgactattgtggtgtgggagcagagaaaactgcttgtttttttctgcagggggcatttctgggccatgatgtccactgcctgtttaaatttagaaacagtctctggatggccaacccaggtgcccccttggtcatgaatgatggactgctctctccttaagggttgagatggttctatccttcaccattgctaggaaagtgactggcttgagagtgagtgaccaggaaataaagttaccaatagcactgcctttgctgttcattgatgacctgtgacatctgtgacctgtgacatctgtgacctgcatgacctgagatctctttctgtctctgcaatcaaatttccaaaattcagagataaagacatgttcctagaacttcatttcagctttcacaacccctataatttccatttgaaaagccagcccaaacacaaaattagtttcctacgccagagaacattatgattacagaggtttggaaaaggggaggaaggtgttgtataaacccttagttctggttattttttcccctttatttgaatgacagtgactttaaaataacatacaaataaaagtaaaaccagagttttgaaaattgagcaagttgtacatttgtcacactgaaagaaaaaaaaaagtgtcagtgccctcttccaggtagattttagtcaaaattctaataatttcaaggaacaggagcccactcgtgctggttcaagggcaggtggcaggtggacaatgtcaagggatagtgtgactggcgtattgtgctgtgggtggttctgaggatcgagggcttgaggagtcaggcttgctctgccgtccgggtgcatctgctacgtgctccctctcttccagaagcttctttaggaccactctaagtgccatgccctcatggccctagcttgccaatgccccccaaaacttgatgttacatcctgtccctacctgacttttggttccattggccatggcctgagtgacaaaggaatgctgtggaagtgtggcttctggcctcggacgtgggcgggatggcttccctcagaaggaactgtagatgcacctgcagtttgcccagacctcagtgttttcatttcctctcttcctctctgtctccagaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggtgagagctatacccagtaagggctgataggatgtgatggtccaggcagtgcacagattgccagaaagtaacctgggggatggatggctgattaaagaatgaaaaataaggctgggcttatctcaacacttcaggaggcaaaagcaggaggagtttgagaacaacctgggcaatgggcaacatagtgagaccctgtctctacaaaaaatatatgtatttttaaaatttgctgggcatggtggatcatgcctgttgtcccagctacttgggaggctgaggtgggagaagtgcttgaacccaggaggcagagattgcagtgagttatgatcacaccactgtactctagctaggtaacagagtgagaccctgtctcaaaaaaagaaaaaaaaaaaaaagaagggaaaaataagaatcaaaaataatttttccaatgataaagatatgatatgataacatgctttacagaactgctgatacccataggtccctcctatagttactattaatggtaataacttacttggaagattagtcttttcagatgccaactttggctttacttattgaacttagttgcaatgatgtatactgtacatgactgaattttagacaggcaatatagctaacccttagctgtctacaattgggacagtttatttgctgttgcttgttttgctgtgtttgaaatagtactgctttgccatgtttttacccattcaagccttgggtaacatgctttgtgctttggtctgcacggaacatgaaatatttcctatggaagccatcctcagactgccctgggcccacggagctaaatgcccagccatgcgtgttggcttttgcatgttgctggaatgtcctttggcacggtgccactgtggtaccccaagtgaaccaagtgctgtgctcactccataacccaatggagccacctttgtttgactctcacctgccctaggttgtttaatgttaaacggctgtcataaagtccatgcataggcatctagatcagtgtgcttatacattaagtttttgccaaacatgacctttgtacccaatagcagacagaacttgtgagcaaatgattgagttcccacctgtctgttcccagtgacactgaaacttgctctcccttttggtgctgaaatggaaccatattacgttcttgcagcacataggcacagtttctgggaaacattagtaactggtgatggggaggcaagatgtgtctacctggtagaaattcaatgaccctgagattctggctggacgcagtgactcacgcctgtaattccaacactttgggaggccaaggcaggcagatcacttgaactcaggagttcaagaccagcctagccaacatggtgaaaccccatctctatctaaaataacgacaacaacaaaaattagcagggtgtggtggcatgcgcctgtggtcccagctacttgggaggatagcttgagcccaggaggtggaggttgcagtgagccaagatcacaccattgtactcctggctgggtgacagagtgagacccccatctccaaaacaaaacaaaacaaaacaagaacaaagacaatgagattctgattctaaagggacagcttaaaaaaattggagtttaggctgggcgcagtggctcatgcctataatcccggcactttcggaggccgaggcagttggatcacttgaggtcaggagtcccagaccaacctggccaacgtggggaagccatgtttgctatgcaggcagtccttaccttgcagggctccagtatgcacaaatttcaattaccacagttaaataacacccattccccaaaaatatagttccaattttagttaccattctatattaaccataatggcataaagcataaactcgggctgctggctcttcaggccaccaaccatcgtagaaataacagatgcacatcctatcatgaccaacggcatcatttctttcaaaggctgttgtgatcggtcactgcgcccttgtcattctttttgtgcccaccttgcggagacatgtggctgtgttgcctccttgtctcccagggacaaacccacatgacattttacaaaaatgggtaattgaaagagggagttggtgaacaaaggtaaaagtgcagtaaagaaatgcaaagtgatagtgttcaacgtaaaatttgaattgaatgcaagactgtgggaagttgataactgcccctgctgatgtgaaccagcggtccttagtgaaggtgaacttatgcacatacatcaagaggttgtgacaaaaaggttgaaaatgtcccagagaaagcgacactgtcaaaaaacagcattgaaggaatactgggagatattttacaacattgaaagaacaaaagctaaaacattagcagtcgatccaaacttagaaaggaatgtgacaattcttcaaaacagagaaactatattttctctgtatcataagttacatgactagaaggcaaactatttaacctactctcgatcgtttttttacaaagaaatgacactttaatttttcatgtttctaacattttaaactacagtagaagtaaatattagttgtaattttgttattttcttgtacgtgtataatgacatgagttttctcattgattttaaaattactatttttaattaataattgaaaaattgtatatacctgtggagtacagtgtgacattttgatctatgtatatgttatggaatgagtaaatcaagctagtttcccatcagttattaagatctcttcgcatggtctcagcttacacaaagtgagacctgcctatatttgtagattataaaagatttaactgagttctgaaagctttgactatttgttcttccctgttacaagccagtgtttctcatatatttcaaacccatgactggtctattggtatctcaccaggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggtaagtctcccagctaaaaatgtttgcccactggtattgacaaggttgttataccaagtgattatgcctttcctgttgggccagctgcttacattgctcccagatggctgccctgccttatgcataccctgggctcaggcagcttcctgacttacgccatggtctacagaagcagctgccagcaaaagccaggcctgaaaagggttcctttacagagaagagtatcagtaggcctttgctactcaaactggattgctgttaagtgaggacttttattagaagccttaaaaataggccgagtgcggtggctcacacctgtaatcccagcactttgggaggccaaggcaggcggatcacttgaggtcaggagtttgagaccagcctggccaccatggcaaaatgtcatctctacagaaaatacaaaaattagctgggcatgatggcacacgcctgtaatcccagctactttagaggctgaggcacaggaattgcttgaacccaggagggttgttggcaggttggagtgggacagaatgagtgaggggtgtatggctatactttggagggggctgagcctccctctttcattgctccaccttcagaatgctactagaacatcccactcgctccaagacttgccataggcgtgggaagggcttaagattggcagccaggctacgctttatttgtgttcatcccagtcttaggggtcagttactttagtctttataagcctattcttacaattgttataccttagtatgtgaattctaagaatgactattttaaagaagtggacaaaatctgatctaaatcttgaacatataattgactaaaatacatcccaggatcttggtgtgacatgtgggttcatcataaaacaagtacagagaacctctgcagaagctgcaagagtagctcattaatatgtattaaaggcctgctaggcactgggcactgcggtagcctggaatacagtggtgaacaaaatcctgccctcatggggttcacagttcatggggagtcaggcagtagtcaagcagtcacaaaatagattaaaaatggcaactgtaatacattctatataaaggggtaagaatgtgtcagaaaaatttggctgcattaagaaagtcagggaaggcctttgtgcagaagtggctgacaccagagctaagatctgaagaaagagcaggtattcattagatgagagagaagaagagcattacagccagaaggagcagcacatgccacattaccaaaaagtggggctgctgagtacagcaaatatattaacaagattacaatactatttcaaatatttagaaataaaactatttccaggaaccattaaactcagcagaagcttaaaacaaatgaaagacttgtaacaggttattgttatctatgtcgaagtcagttcccatggatccttactacaagatctattcatttgttccttttgtaaaaccactttccagctcatttttaaatgaaaatacttttatttttacttataaaagtaacattatatttttttaaaaatcagattatatcgaatagtcaaaaggagaaagtgaggcccatttcaggcccatagatggtgttggttgctattttggcatacgtctttccaagtgctttgctttgtgtacatcagtatttttttcaaaattgtgttatctctttaaaataatctatgtacctaaggtaacttgagattaaatctgtaatctagactttcaaattcataatactttcccaccaattagtctaaaacagtgactaaatggattattaaaatagacttcattttttatttttaaaattaatttatttttttgagacaggatcttgctctgtcgtccaggctggagtgcagtggtgcattcatggctcactgcagccttgtcctccagaacccaagtgatcctcccatctcagcctcccgattagctgggaccacagtcacataccaccatgtctggctaattttcttactttttatagagatgaggcatctcactttgtttccctcgctggtcttgaactcctgggctcaagtgatcctcctgcctcagcttcccaaagtgctgggattacaggcatgaatcccagccttattttttagaacagttttaattttacagaaacattgagaagatagtacagagatttctcatatgctccatacctagtttcccctattattaacagcttacattattagtgtcacacgtgtccatgtgaagagaccaccaacaggttttgtgtgagcagtaaagctttttaatcacccgggtgcaggtgggctgagtccgaaaaaggagtcagcaaaggatggtggaattatcattagttcttacaggtttggtataggcagtggagttatccaatatccaatatccactggaggaccaattttttgtaagcagggggtggatcttgcaaagtacattctcaagggcccgggagaatattacaaagtaccttctcaagggtagggagggtgtatcatacaaagtacattcgcaagggtgggggaataccacaaagtacattatcccaagggcagggagggtgtattgtcacaaagtcaattgatcagttagggtggggcaggaacaaatcacaatggtggaatgtcatcaggtaaggcaggaactggctattttcacttcttttgtggatcttcggttgcttcaggccatctgggtgtatacgtgcaggtcacaggggatatgatggcttagcttgggctcagggtcctgacaattagtacaatacatttgttacagttaatgagccaatattgatccattgtcattaactaacatctctactttcttgagatttccttaattttcacctaatgtccctttagtgttctgggatcccttccaggatgccacattttacagtcagtcatcacatctccttaggctcctcttggctgtggccatttcttagaccttccttgtctttgatgatcttgccagttttcagaagtgttagtcgggtgttttgtaggatgcccctctattgcaatgtgttcgatgttttgctgataatgagcaggggttatgggtgattgagaggaggagcacagaattaaaatgccattgtcatcacttcttatcaagggtgcatattaacatgatgtatcactgttgatgttgacattgatcacctggctgaagtagtatttgctgggtttctctaccatgaagttattttttctccctttccctactgttctttggaagcaagtcactatgcatagcccatattgacagcatgagggtttaactccctccaccccttactagctacataaaatatttggaattcttcaccacaggagattggtgtcttttcttccattcattcattcaatcatattttcataagtatagacttatggatattcattttatactcatagtctagtattactttagtttcttgctcagactgttacagctttggccactgggagcttatctgttattctctgttcttggcggtacctggctagagtagtttcaatattgccaagtaagtctaaaataaatcaaaggaaagaaacacgtttcttctagggggaaagcttttgttgtagaagagcccattgaaaagcggaagctctgtagcatccttgtggaatcagtgcctgccccagtagccctgtttttatagtgaagtatctttgttttcattcacccaggaatgcattcacagaggaggattctgaattagtggtgaattatatagcaaagaaatccttctgtcggcgagccattgaacttacctgtaagttgactttcatttccctttttggcaaaagttaaaatagttgagaacaaagaaggatcaatagacagatttctaacaaaagccaaagatgtcgaagaagaatggatatttttaatgtacaaaatgtctttaaaagcagcaagtagatagccagacattgccatgcacagctctgtgggctaatttactgcaatcaggagcttgacctggggttaaaaggactcacaatgtcatgaaatgtggcagaaaagaggaaccttctagggtgacagaagatgggtagaggccagggatttaaagaaaacttctaactagtgaacataatctcaagcctcatttcctgttttcctggcaaccaactccgaggatgatttgccaacatgctttatagtaattatggtttgagctttgctgaatcagagagtgggggcttctggtttaaacagcggaaataaacagacactagtgttcctgaataatttcagaaaaagtatagaaaggacatgcaaatattaacaaattcatgcttctggatgtttgcccccaataaagaaaatagataagaatgacagaatacaggttgctatgaaatagaaacttgcttggtgtagaatattattaatttctttacctttctagtctgtaagttttgacttttagatatcctcaattttttttttaatttaaaattttaaaatttgtcatttagaccactttctttcctttattggagaaccactggataaagctttttctctgagaactaatgtgtcctaattatccacatttttttgatctttcaagagcttgttcatgccttaactgtggtccagactgaatcatttgccaagagttgttgaactggtccccttctggttaatttctcttgttgccaacatgactcatctattatataccttactatattatatattttattatagaaaaatctttttctccaattcctcaaagtgctcaatttagcccttgctatgctgttataataggtttcatatacagtatgtaaaataagagcttattctctagatgtttcctgtggtttgtgagactccgtccatggcatgggagggtaggggacgtgtggttcttttgtatactgtagtcaagggtataatattaatagtaaagaattcaccagaaattacctattgacttatcttccttacccctttaagtcaaaggcaaaccacccctacatgaatctgattaccggctgctgctaccacacaacagaatgagaaatgtggttctgatttttgtaattcttcagaattaaccttgccctgaaggattcattatacttagtttaatcattctaaagtatgaaattttattactggcatttttgggagagaaataatagatacaaaatgaaaaaaggggccggctatggtggttcacacctgtaatcccagcactttgggaggccgaggtgggtagatcacttgaggtcaggagttcgagaccagcctggcccagatgataaaacccgtctctactgaaaatacataaattagctgggtgtggtggtgcatgcctgcagtcccagctacttgggaggctgaggcacaagaatcgcttgaacccaggaggcagaggttgcagtgagccaaggttgcaccattgcactccagcctgggcaacagagctagactctggctcaataaataaataaataaataaggaatgttttattatacaggactttatttcattttaattatcaagtgaaagaaaacacgctgacaatttttgtacatactatgttactcctttttcagtacatagcttgggagtcagtgaggaactacaaaataaactagaagatgttgtgattgacaggaatcttctaattcttggaaaaattctgggtgaaggtaagcaatttaaagtaattcttttaaaatgtgggataagaaggtagcagtttagaataattctttaacatatatttattaaataaaatagcatctcaggactctgagttatactatggatagttatattttattatttaaaatgatagactattgatttttgaaactcagatctggcacatgaaaagattctcttcaatgcctagcacatacaggtccttgaaaaatattaattttctttcttcattgaaaagcatgtaattcattgagtagtttcctatgtactttaagtttattcctctagttcttaagttcattgttcttggcacctttctaattaggaacaaaaatgaaaatacgtatttaacttgttaagttgttcttaggatgaatgataatggtattaaaagtttgtgctttaaaaacttcaataatatttttcatgttctcttctaagtgtcttggattggttataatgcttaataaagtgatgagcaaaggtaggcccaagccacccaagctcgtgacaagcaggagactagagcgtggcgcatcaccctggtttgcgatgtgggtggcctgggcaggctctgcctggctgcccgtgggtgagttgctctcataccacatgaaaccagcagctctggcactgtagcatttctgtggtcagggaagagtttgcacagtgtccatacaggtgttctttcacttcacaggagagtttgggtctgtaatggaaggaaatcttaagcaggaagatgggacctctctgaaagtggcagtgaagaccatgaagtgtgagttatcagtgatgaatcccattcttctagggtgggcagttgcttcagtattgggtgctccatgaggccatatgtcacaatctcagttcccagtgggccagaaggcaatgtggaacactggtcaccaagggggacttactttaatgagctcttcatgcatgcattacatattctttatactcaaggcaataacattttttatttttactaactcctgcatgcctatgcatacatactgtctgtcttgctctctctccttctctcactgtctctctttctctcactctcatctagtagagctaacaactccaaagtagagcatcaattgctgaggcaggggtgatctaatagcaacatctgaccccaggggttgttctggccggcctgtctagtgtggtggggccacttcctcatttgaggatgattgcatggccctgaggaagctgcgggctgcctggcaagtaagttccccagaaagaggagaaatatttggtcaaggcatatgaagagttgctatcataagctagaacttccaagcaagctgggaagagagccagcagtgagacagggagagtcttgtaagtcacagccaagaacctgctttatcctgcaaggagtagagcgctattaagaggcttaaccagccgggcacggtggctcacgcctggaatcccagcactttgggaggctgaggcgggcagatcacaaggtcaggagtttgagaccagcctgaccaacttggtgaaaccccgtctccactaaaaatacaaaaattagccgggcgtggtgacacacacctgtaatcccaggtgactgaggcaggagaatcacttgaactcgggaggcggaagttgcattgagccgagatcacaccactgcattccagcctgggtgacagagtgagactccgtctcaaaaaaaaaaagagtcttagccaaatgaagaatagagcaggttaaattccagaaagttcactttgatgtcagtgtggaggagaacaaattacagtgttgacaaaaatagtggtagatgccagttaggacactgtaaaatctatgcagtctaggccctctcaaatactttcttttttttttaattgagatggagtctcactgtgtcacacaggctggcgtgcagtggcgccatcttggctcactgcagcctgcacctcctgggttcaggtgattctcccgcctcagtctcctgagtagctgggattacaggcacccaccaacacgcctggctaaatttttgaatttttagtagagaagatggggtttctccatgttggccaggctggtttcgaactcctaacctcaagtgatccacctgccttggcctcccaaagttctgggattacaggcatgagccacttcacccagcttaaaatctatatagttaaggaaactatagtgacttgctgacttgtctaattgaaatagctagaaagggggcaggttgtgctgggcttcttcattaccataagatgaccagatttcactggcagagcaaggcagcatttcctctccatgtccttcttccaggaagtgcatttctggagctggggccacacagctgtataagtttgattctataggtgtctggctgggcatggcctatcactggggaacttagaaaataggtcgtggtcacgtggcatttcacccagtcttcatcatgaatcatggatggagattatttggtgctcagtttgtcaatattcttgatgttgcttccttattaaccccttgtacctattcaatactatttttgatcagggaataaagtaaaattggattcttcctaaaatttaaatccactatttactggacattaaagcataagttagattgtaagcatgtactgagactcttaaatgaaaaggctgaagtttatttatttttttctttttgagacagagtattgctctgtcgcccaggctggagtgcagtggcatgaactcggctcactgcaacctctgcctctgggttcgagcaattcttctgcctcagcctcctgagtagctgggattacaggcatgcaccaccatgcctggctaatttttgtatttttttctagagatggggtttcaccatgttggccaggctggtcttgaactcttggcctcaagtaatccgcccaccttggcctcccaaagtgctgggattacagccgtgagctaccacgcctggcctggaggctgaagcttaattcagctataaaaaggaaccacaataaccaacaagtcacatgaaccggtactttttaagtagaccataatgactaatatttatgtaatactcactgttagccaaaggacattgcagttattcctgtatttcatcaggacaacaggaagagaaaatgaacataactaaaaaggaggttcaggaactagcccccagaaactaaaacaccctgaagttagaatactcactggagctgaaccaagcactgagccatattctgcactgttcctgcctcttgtatgattttatctgagcctcacagtgcatctgtggggagtccttccataattcctattagggatataaggcaggtatattaggaggcctggtgggaggagctgggcctggaacccactttttctctggcttgactctgcagttatttaatttcattagggtaaattgcatagggattacacccctgctaattgtcaaagattgagagtataatctctagcttcaaaatccccaggctcagctacatttacctgcaggttggacccctggggaatagtctgcaggcagagccctacccctgtattcccccacctggttgtttgcagcaaaaggaataggtgagggcaaatttttgcagatgtatagattttcttttaattagaaaaatttttaaatttttctaaatttccttcagtagaaagaagattaatatatattaagccaataggatggtatagacactgcattagatgccctcatgcatgattttaatcagtagttttaccctgttaacgcaaattccctaaggcaagccagactttttatttgtttttaattgtggcaacatatacataatataaaatttaccattttaaccattttaagtgtacaattcagtggtattaagaaccatattcataatgttatacaaccatcactaccatccatctccaaaacttttcttttctttttttctttgagacggagtctcgctctgttgcccaggctggagtgcggtagcacgatctcagctcactgcaaactccgcctcccggattcaggccattctcttgcctcagcctcacaagtagctggaactacaggcgcccgccaccacgcccgcctaattttttgtatttttagtagagacaggatttcaccttgttagccaggatggtctcgatctcctgacctcgtgatccacccacctcagcctcccaaagtgctgggattacaggcgtgagccactgcgcccagccccaagacttttcatcttgcaaaactgaacctctacacctaccgaacaatgactccccactaccctttctccccagccctggcaagcactattctattttctgtctctgattttgactctctaggtacttcatgtaagtggaatcatagagtattcatccttttgtgacaggcttgtttcacttagcataatacagaattttaaatgtctctctcttaagccagtttaattcaaaaaatttggtatgaaaatgcatccaactcacaaggcgtggttgagcaaccagacttgcaggacatacaacaatagaaacagagaggtgtggggttctttctttttttaaaaaaagcaaatataattgcaacagatcagttagaattgttctttgttttggtgttggggttttttttttggaattttttttctttaccattagactttaactttgtagagcagtttcaggtttgcagaaaaattgggcagaaagtacagagaatgcccataggtcccctcctgacacacataatttctcctattattaatgtcttttattagtgagctgcattttttgcaattgatgaacccatactgatacattattattaaccagagtccatattttacattagggttcactcttggtgttatacagctctgtgggttttgacaaatgtgtagtgtcatgcatccatcattatagtatcatacagaattatttcttggccccaaaagtcccctgtgctttgcctgtttgcccctctcttatctcccctagccctactagcccctgacaaccactcatctgtttcctgtctctatactttcatctcttcctgacctgggttttagagaacagaactgctgttgcccacccactccccttaattgagtaaattatccatacttaaccttttctattttctcctctagtggacaactcttcacagcgggagatcgaggagtttctcagtgaggcagcgtgcatgaaagacttcagccacccaaatgtcattcgacttctaggtacttccgagaaatgcaggagtgggtggccaagagggctctgctgatctgctctgtgccaaaggaaaaaatctctggtgtagataagtttacacttcgtataaccccaacataacttataacattgaggttttcacccagacttttcttcataatgatgttttctgaggctaatagtaataatgagtttgcattttctggacgctgataggctcaggaatgatttgagttttccacagaattctaggagagtgtgaattaaattgtcctcagttactcaaaggcaagacacagaggtggttgtgttataatttttattaatttaaggttatgcatgagttagatagcagtgggataaaggtgaaaaagtaggcaaattccgtaggtttatctttgagaaataatttattaacctgtttgaaagtactgatttcttaagatcatgatacattgatgatttcatggaatatgatttaacagttccatagaacatgatttaacgtaatttggctttgcagctccattagccaaaaattacaaaagaggagattaagtatggagtggatgctgtgtaagtggctctgtcccaagagagaagagtaacctggaaataattgaattttctgctgaccttggtgttttgtttttgctttgccatcctgtgactgcatacatgctaagttcttttgggatctttcaaagtttcatatgattggcactgcagagagatgtgaaaatcaatgtttgtatacagtattatgtcaaataagctactgttattcattcactgctattggcttcagccgactatgagaacaattgcactttgtgatcacaccacagagtgcaggagctttgcaagcatgggatcaggtgatagcctctggctctcagattccatgataaatgatattatagcttctcttttgcaaaactgttaaaatttagggatgtgaattttacctatagcccttcaaagttattgtaatagtttaagcatttgcagtggacttcttcacgtgattaaatatctatcacatgaaactagttcgccctagttcaatactagttcagtattgactttgagggttgtagcgttaaggaatcatagccactggggacattgtgtctttcatttcctaggcctccttatctgaaacaaaaatcttatggggtcactacccctcagactcagtggaacagaaattcctaggtttctagatggctatacttgttacagtttaatttgtgacagccctcatgccctcattaatctgaaagggggaaaaataccagtagtggaccctgtgtgtgttccattttctagaacagagtgtgagttaggcgctcttgattttttcaaactgttaacttggtaacacacggcttcagtttttccagtggtccacgagggcttttctggtcacagtaacaaggactctttgtaattgatgctgtgtttgtaatttcaggtgtgtgtatagaaatgagctctcaaggcatcccaaagcccatggtaattttacccttcatgaaatacggggacctgcatacttacttactttattcccgattggagacaggaccaaaggtaatgatctccttgtgttacccctgaacacttctcagggcttatgtgacttagccaggacaaccaaatcatctaatcttgaaagtgaagccaggaaggagaggacgttgacttttgttcagtgctccctgtgtgtccagggttgaaatgtggggtctatcctcacagcaggcctgctccaggtattattatcctgctttatggtgggtaagtggctgcgtgcacagtcttatggacaaagccttaccaacttgagttgggtggcccaggctcctggttctgcacttcacaaccctcatggccgcatactccccagagcttgcagactatgggaaggccattgaaggtggctctcctaaaagaaattttacagagctcattctggatttcaacctttgaagaagtgttggtgaccaagaagactgcacaactgacattctgaaaactgtttgtaacattttactccctatgttgacttacccaccatgagcactgtgaagccctgggaatgttggatgtagctgtagaggcagttacggatcatctaggaaatttaggaccatggagacgcttgcctttcttcagggtcaattttcagtattgactttgagggctgtagcgttaaggaatcatagccactggggacattgtatctttcatttcctaggcctccttatctgaaacaaaaacagtatcctcctgttatgttttgtggacaaacggtagactgcgagcaggcggtgtgtgtcctgactacatgcccagctaagcaggacgccccttcctgccttgcacgcatcttctctgttgcaaaaggcagcgatcctgcggggttctggttgggacacatgtgggaacagggtgtggctggcctctgtcaacagtcattctctgactgggcaaaaggcaaaagtcactccagatcatcactgcccttaatcacagctgtaagaaaccacaggtcctgggaaggaaccgaaccacccagtctacaccttggcattctcggacacaccccacctttgtccctttagctgccatcagtatgaggaccgctgagtgcagtggtgcaattaggaacaactgcttccttcactgcatcagcgatggctccaggaaagaattcttgctgctcttgcttgatggtctgatgagtccacaggatgaaagtgcaaggaaattagttcttagggaccatgaaaactcactcccactggctctgcagacaaaacacaggggaaaatgtcccatgcagcaccagtgtggtggagttctgcacactcccctgtatctacaaacctggggtgacagtggcctagggtcagccaggtcgcttttccaagtgaagcagtgccatgggactcactcacaaactattaaccaaaggaagtttattaagttctgcccaggtgcggtggctcatgcctgtaatcccagcacattgggaggctgaggcgggggaatcacttgaggtcagttcgagaccagcctgaccaacatggtgaaaccccatctctcatgaaaaaatacaaaaattagccaggtgtggtggcaggcaccagtaatcccagctacttgggaggctgaagcaggagaatcatttgaactaggaaggctgaggttgcagtgagccaagatcacgccactgcaatccagcctgggcgacagagtgagactccatctgaaaaaaataaaaaaaacaaggtttattaagttcattagttcactctgtgaacaagtgctgactctaaggtgggcactgagctctggggacactggagggaacatgacagatgtggttcctgccccatggagctgagctgctggtggtgagtgagaggagaacaggagacagacaattggttattcacagtgagggagctatgggcaccaggagcacaggggctcaaatgcccagtgggccaggcagagcccagtgggggcataggggcaggaagtgtgcaaggtaactagactggggggtgtggtgtctgcgcacagatgcagaacctcatggtggcagggccaggacttcttcgtttcagtaacctggagaatgttggcagatagatcagaggtggtgattggaatatgaagccccatatgctgtggggtctgctgtttagaaggagggattgtgcagagaaatgtgcattcccttccccccgccccccacatcagtcactgagcatcctcatgtcagggaagccacacacagaaatgtgcattcacttcccccccacccccacacccagtcattgagcatcttcatgtcagggaagccacattccttctaaaagatgtttgggccccatgtgctgtcagagaagcttcttgtttttggagtcccctcttcttggcttgttcattataacatctctggatgcagggtgcctttcagttccccggtggaggctgcatggagttgctttctagttgttcactgagggtgaacatgctccctccattcatcttctctttgtcatgagcgtatccatcctcaggatcagaagatgtgttgggaattggtaggccagcttgcttgcctcagcagtgcccctaagaggggcagcaacccctgccctgaatccttccagcatggagaaactagagagaagcggaacctcagactgaagtgccccgacctccggtaacttatgaacttaataaccacaagtcacaggtgactgatagagttacagtgaaccatgatgacaagaatgacaactgagggccttcatgggggaagtcggcttagaaaaacactagtcctcatcccaagagacaggtccatctgtagaaacagccctttatttaaaatttgggaaagctgaaacaaataggcaaaaatgtgagacccaatttagggtcagcacatgctggagcctccttttccacttccagctgacgttgttggtatcttacgcctgtgtgtgatggaggggagggtacttttgctttgctttttttcccccttttactctttctcttcttcctagggacagcttaagtgatcaggacaggagagtggccccctttcttttttccagttcccccctggccccatgcccacatgtactcctgttctcttccatgagaatgcacttgtctttcaccaacatgagtactaaccgtagagacaggaggctgcagctgcatcacacagctgttataaaatcaccgagactcttccaaagaggtgaggggcctagtcctacacagaaaatataatagacagggctgagtattttccttctctttttcccccaaaaagaaagatgattgcattataggaagtctgtaaaaggataaaaaattacccacaattcccaacaccttagtacaattgttggcgatttcagacattcatctctcattgttcactcaatgcctacatttctcatggccttcacgtcactacatacacacttgcccctgggatgacagtggctaacctttctcaagcatgtagcataggccagcctgtattttgtatgtattaatgcaccagtggcacaacagccctaaaaagtagttactagtggaatctaagctgaggaaactgaggcacagggggccatggtgaaagcaggattggcccccaggctgcagactgtgagccttcaatgctcttctgactgccccattctgtgtgcacccctctccagcagggcagcccccacacagatccctgtgagtggcggcaccacatcatttcagtgggttttgtttcatgttgatgggtgattttactcacatttaatttatggtacgttgtataatttgggaggggggtggtggcggggggatggaatttcactcttgttgtccaggctggagtgccatggctcaatctcggctcaccacagcctccgcctcccgggttcaagtgattctcctgcctcagcttcctgagtagctgggattacaggcatgcgctatcatgcctggcttattttttttttttttttttgagacagagtctcgctctgtcgcccaggctggagtgcagtggcgtgatctcagctcactgcaagctccacctcctgggttcacgccattctcctgcctcagcctcccgagtacctgggattaaaggtgcccgccaccacacccagctaattttttgtatttttagtagagacggggtttcactgttttagccaggatggtctcgatctcctgaccttgtgatctgcccacttcggcctcccaaagtgctgggattacaggcatgagccaccgtgcccggccatgcctggctaattttgtatttttagtagagacagggtttctccatgttggtcaggctggtctcaaactcccgacctcaagtgatcagccgcctcggcctcccgaagtgctgggatgacaggcgtgagccaccgtgcctagctgttacgttgtataatttttctaataatttcttgggggtgtggaaatttcatgttattgtacaagagtgcattttgtagcaaaaaagattaaaaatacacagggctatttggtggcccaaatagttttgtctattcaagaatgttacataaatggagtcatacatttataaccttttttttttttctttttgagacagagtctcactctgtcacccaggctggagtgcaggggcacaatcttggctcactgccacctatgcctcccgggttctagcaattctcctgccttagcctcctgagtagctgggactacaggcgcctgccaccacgcctggctaattttttttgtatttgtactagagacggggtttcaccatgttggtcaggctggtctcaaacttctgaccttaaatgatccacccgctttggcctcccaaaatgctgggattacaggtgtgagccactgcacccggccattttataaccttttgagactggcttccttcactcagcattatgtctttgagatccaaccaagctgtgtatatcaatagttcattccttctttattgctgtgtagtattccattgtatgcttctaccacagtttatcttttcacctgtttagggacatatgggttgtttctaggttttagcaatcatgaatgagactgctataaaattcatgtacagatttgtggatgaagtcttcatttttctaaagtaaatgcccaagagtaggatgctgggtcatatggtaagtgcatatttaaccttataagaactgttttccagagaggccattccattttacattctcaccagcagtgtgtgagaaatgcagtgctccccattcttattaggacttaatattgttgctggcttttctggtttttccttatagctgtcctgattgatgtagagtgatatctcatcatggtttttatttgcatttcccgaatgactaatgatgttgagcatcttgccatgtgcttatttgccatccttacatccgctttgatgagtgtctgttgttcaagtattttgtttattttttaattgagttgttgattttctcgtcatattttgagagttctttatatgttctaaatatagttcttttgttggatatgtggtttccagagactgttttccaagtttgtagcttgtcattgcattctcttaacacgggcaaaaatattttaattttgataaagcccaatttatcagtttttttttaatgagtcatgcttttgctctcatgtctaagaactctttgcctaacccctagtaaaaagattttctcctatttcttttctaaagattatgttcttttacattttacatttaagtatatgaccaattctgagttattttttgtatagggtttgagatttagtttaaggtttgctttttttgcgtatagatgaccaatagcaaaagactatcttaatccatgaaaagactgtccttaatccattgagttgctcttgtacctttgtctaaaagcagttggttgtacatttctgagtcctctgttctgtttcattaaactctgtgcccatcctttgcccctatcacattgtcttgattactgaagcttgttataaatcttaaaatcacccagtgtgattcttcctactttgttctactttttcagaattgttttaactattctggtttcattgcccttccactgaaactttagaatcagcttatctgtgtctggcaaaagttctgctgtaatcttatatccttttgaacaaaataacaagtaagggaaacaagtacacaacattttactgactgatgaatagtttccatttgcaaaaaaatacaagtgtattttcaatgatggaaaataactttcaagtattaaaaagataaaaaggaatgtagtttcctattttgttgcttagtagccacagataaggtggaagacacaaagtgcatagacaaacagaaaaatcaagcttttattcagatcttttctttgctgcctggaataaatagctcctgctcctgctagagcagcccaagactattatcagtgcatttgatactgcgatggcccaatatcaatgtatttaaacatgcttctccaggagggctagggtgctggacccatagtgccactctgcccagggcagacattgtctctggagctgtgcagggcagacaggtagatgatgagacatgacccccagttctcatggagatcgatagtacaaagggagataggctgtaataacatatgcatcacacagtgatgtgagcagcctgctagagcttcagggaagaaatgagttctgactggagaaatgtttaaaatattctacactgctgactgggtgtggtggctcacgcctgtaatcccagcagtttgggaggccaaggcgggtggatcacctgaggtcaggatgtgtccggagttggttccttctggtgggttcttggtctcgctgacttcaagaatgaagccgcggacctttgcagtgagtgttacagctcttaaagatggcatggacccaaagagtgagcagcagcaagatttattgtgaagagtgaaagaacaaagcttctacagtgtggaaggggactcaagcgggttgccactgctggctgggggtggccagcttttattcccttatttgtccccacccacatcctgctgattagtccattttacagagtgctgattggtccattttacagagtgctgattggtgcatttacaaccctctagctagacacagagtgctgattggtgcatttacagtcctttggctagacacagagcaccaattgatgcgtttttacagagtgctgaatggtgcatttacaatcctttagctagacacggagcactgattggtgcatttacaatcctctagctagacagaaaagttctctaagtccccactcaacccagaaagtccagctggcttcacctttcaaggagtttgagactggcctggccaacatggagaaaccccatctctactaaaaacataaaaattacccgggcgtggtggtgcatgcctgtaataccagctacttgggaggctgaggcaggagaatcgcttgaacctgggagggagagtttgcagtgagctcagatcgcgccactgcaccactccagtctgggtgacagagcacgacttcgtctcaaaaaaaaaaaaattccacactgccatcatggatatcctcaaaagagtggtaggaggagtacagtggaaaattaagagcagcacacaagatcagaatgagcaaagaccaaatgatctgggagcatacctatgttttaagaaaagcagattgtctcacatggcaacagcaaagcaatggaaggataggaggaggggtgataaaacaggaaagagaagttggggtcaatgtttaggttctacaacaagtagaatgacttcaccagcatgtaatacaaaacccaactcaaaatgactttcaacggagatacaggatctcatgcaataaagcccagaagtagcacagttccagagttggctaggtgggtgcttgaggaattaattgagaaattaaagggctacaattgcatttgtagcccaagctattaaaacagctcctacacaagaagaaggaggaggagaagaaagaattttcttaatttcattttcagattattcatcactagtatataaaaatacagttgatttttgtatgtccatcttgtatcctacaaccttgctgaactcatttattaattctgctatacaattattttttaagtgacttttggtcacagtctccaggaataacagaagtgttctaggaaaaaacagcacaaatgaatagtacctgatactcattacatcttcatgaatgacagcaagatgcaatatttcttatgacccaaatcctttcctggaaatcagtatctagaaaaccaaatacccaaataatacagaatagaggcataaaacttccatacttaaagattaagacatttcatttatttatacagtatgtaattgacatgtgtcttggagtataaaatcattgaaaatgcaatgtctttccaaaatgagtaccattttggaaaactcatgtttggaaaggaagccatggcaaattcagtgccttggggagggtacataatggatggacccattcatgactgccagggacttgtgcaaatccttttctgcagggccatgattgcactaaaacacttaattactacatggaagttttatcagcagtcatcctcataactgattccaacagtggctggttttctaacacagcaatctagtttgatttttataagctagagaaaacactagactgttgaaacttataggcagggcctacgggagcaaaatgaaaattcctgaatatgtacttgtggtgctttggtcctgtgataattggtgaagactctcctaatttctgtttagaagaaacgagtatctttcaaaacatttcgtagtaaaatggtagcagataggggtgcctaattggaaacagctcatcctaagtggacttttcccctccgaaacattagacccctgacacacacacacacacacacctcgccgctgctgaagccagaccacctgtccctttccctcctctgtgcaatgcgtgtgctctgtcccactctgaaggatacacggaaggatcacgtttgacctcataccttctaaaaagaaacaatgtcattcactgtaaatacttttaaagatggggaaaagagaatatgatgtttgccaagaagtttaaggtttttctcattcctttttaaaaaccttatttgtgatattagtgatatggaaataaaagatttgtttccttatttcatcactacactgtaataaattaaagcatcctttccccccccggcagaaactgcttgcaagttttcctttttaaaagatagtctttcttcttgtttcctctatcatctagcatattcctctgcagacactattgaagttcatggtggatattgccctgggaatggagtatctgagcaacaggaattttcttcatcgagatttagctgctcgaaactgcatgtaagagtcctcggctatcctggaagggtttggacctcatggtgtttggtctttgcagggttagtgagaggacctgttcctgtttagataggcaaggaagctgcagtcagcgggggatggtgtggcttgctccgaagatggaaatatggctgggtgtttgggagttttcactgcctctgtatctgagagtctggttggcttccaaagctttcccttatgactccagttttaccttcactctctcactcggtaggaatgcaaggtgtgacccttgtgatccttccccagccatcagctagctttggacctagagttatgtgtacgtcagctcctcttaaagacagcagtgaaaatcataaaggcttttccctaagttttcacaacacttccttaggaagaagttttgtactttgaatacatggaagctgtcctttcacagcagacaatggcttcattatacaagaaatgtggacttaggttctccctatttcttcaacctgcttcagcagagccattgtctgctgtaaatcttcaaaaacaataactatgtcttgattttaagttttttattgcaagaagagggagtggtccttcaatgtattttgtcatttgtttttcttggtcagagatgtgacaatggggcctgccccctcccgcctcccagccgaccctgcccctagggctcctacctctttcacctcatttttgaaaacactaaaggggttttggttttgttattgttattatttaaataatttttcgaccatggagggagaatcatgaaaactctttttcccttactgtttccttcatgttttcccagcaggtagggtgaccagctttgcagtttaccctggcctgaggggtttctcaggacaagggattttgagtgtaaaaaggcagtgtcaagcaaacagggacaagttagtcaccttccccagactactttatatctatttcttctccttctcttccttttattctttcttctcctcttccttcttcttgtgtaggagctgttttagtagcttgggctacaaatgcagttgtagccctttaatttctcatttaattcctcaagcacccacctggccatcttagcaagaagcccagcatcttgctcttactgcaggtaattccccatcttccccaaactctcagggggcttacttagtcctcagggccagtgctgcttccagacctctgggaggaaggctgctggggtcctggatcagtccaccagagggctctggttttgagctgctgctctttctgctcctgctatgctgcgtctccatgttctccagctgtttctatccactgtgcacaggtgcccttgctagtccacatcccacacagatcagagcgatgcaagactgcatcacttgaggctaggcgtggtagctcatacctgtaatcccagcactttggaatgccaaggcgggcagatcacttgagatcaggagtccgagaccagcctggccaacatggtgacactccatgtctactaaaaaaaaaaaaaaaaaaattagccggctgtggtagtgtgtacctgtaatcccagctactcgggagactgaggcaggaaaattgcttgaacccgggaagcagagtttgctgtgagccgagatcatgccactgcacaccagcctgggtgacagggtgagactctatctcaaaagtctcaaaaaaaaaattgcatcacttgctcttgctcttgctctgctgttggtcctcacttgctctgccattggtcccaatgcagcatgctcacaggctggtggtgtctctgtgttcttttggtcaattatcataagtgttttcacctgtgtctgatacagaccagtaatttaaggcattgcctctgacgctgctgaagacgtaacctgctctctgtaggttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtggtatgtacacagctttgattcaggggtcccacagcacaaagaggagggcatattgaaagaaatgacctcagctggtatggcaagacattttactctttgataaactgagggttggcagcttgctcagatctcttttatatcttaccatcagatactttaattcaagtggaacagtagattctgatgaagtgtcctgacattcagaagatgtgtgctttgcaaaagcccttaatttcttcccatttttccttgccgtcaaaggatgactcattgcccacaactaggatatttcatagtcacattaaattgaatgagttcatccactggctcttggaacctagatgctatatgaaaggtgctgtgtaattacgcccttgacccgagataaggaaaaaaaagcacctcacagcaacagtggaggagagcactaagcagatgtgtgacgaggctgtttctgcctttgccagatttcccagaacagcttttgtagaagtggggaactgtgacactccaaccccacgttattgccgcgttgggagagcagtgcgtctcacacataattgccagctttgtgcatgatcatcagtgtttaaggaaatgacctttcccagtgaaaaagtccattcaggctttgtggaaaggcttgcatcctaacttgttgttgctttgttcccagtgggcatttggcgtgaccatgtgggaaatagctacgcggggaatgactccctatcctggggtccagaaccatgagatgtatgactatcttctccatggccacaggttgaagcagcccgaagactgcctggatgaactgtgagtgggcttctctgtctcccttccatactctgcatggggcagccacctggctctgcactgacctcggaaacacagccatgggaggggaaagggactgctgttagccaggtgggcatgtgcagaggggtggaacccacagacaccccagcccaggagccattcctgatgtgggagatagtgtgtggtatctccagtgagcccactgaggctcactcatccaaagggcctcagtctcgaacgacaggcacggtcaagacaaggcaatggcacctgtcctaaaattccttacacacctctaggaaatatatccacagataatagcttcgccttgtagtgcatgaggtccttgaatgattcctcaccctcttttggtccagttatctttctccttctatgtagcatttcaaacactccactcacagtagtagccttcatcaggaaactcagaaatctaaaccaatgactttggggtcaggctgctcatcagaatcgcttgggagatagtgtaacaatacgattcctcggccctgttcccggaaattatgatgctttcggtacaaagtgggcccagaaatgtgtgttttagaatgctccctggggctgggcgcagtggctcatgcacgttatcccaacactttgggaggccaaagagggcagatcgtttgagcccaggagtttaagaccagcctgggcaacatagagagaccctgtctttattaaaaaataataaaataaggccgagtgcggtggctcacgcttgtaatcccagcactttgggaggccgacgcgggtggatcacgaggtcaggagttcgagaccatcctcgctaacacagtgaaaccccgtctccgctaaaaatacaaaaaattagccgggtgtggtggcgggcgcctgtagtcccagctactcgggaggctgaggcaggagaatggcgtgaacccgggaggcggagcttgcggtgagctgagatcgtgccactgcactccagcctgggcggcagagtaaaactccatctcaaaaaaaataaaaaataataaaataataaaataaagtgctccctgagagatcatgtgtttagacaggagaaagaactaccagctgtgacacacacacagcacacatcccatcctgacagggcccccgtcttcaaggccaggcagtatggggaagagacccaggcctcggagtcaataggccacgctctgcttcctaactggccctgtgagtggctatggcaattaatctcccccaagcactttgctgaccttattaaaataatttcttgtggcattgctggtagcttggtgatggtgatttgaaccttcctaatggggagtctcctccctgtataataagggccatgggcttggagaggggcattctcaccatatttagcaagaacatttcaggactgtgggcctgcgctggctctgtcatggagtgccatgcctgggctgggacaggtgagtgtggacagcaccctccctacacacacacacacagacacacacacacacgccctgctgcctcacatgggagagagagcctgggtccctttgcccacaggctttccgggtcccttctaagccaaaaagaaggacactgttttaatcagagcttcgtcccgttggtagtggttggtttttattgtggtggtagatgtataacattaagaagagaaacaagcactgtaaaacctttaaaacatcctgaaatgctaataaaattagttctagggtttcatggtagtttttaaaagtgccatgtttatgaagtgcctgcttctgaaaataaggaagcatttcagtcaaacaatgttgactatggaaagagttttgttgcagtttctttctgagctttccttgcccaccaaaataagttgatatttgcggtgattatgttgggtcttagcagggtctaagctgtgtcacgttgtggtttttagagccaaaacaagtgaatgctgagtcggttttctgtgagacattttaggggacaaagcagcagagtcagcacacgccgtgtggctggggaagtcaggcagagaggggcgaacctgccacccccgcctcctgtgggctctgtgccctgggtgtgccaagggggctatggctgtgctgtggcctcggggcccctgtgagccaggcttccttccatctcctctcgaatctagatgctgggtaacaacagcatcccccaaagaggcctctgttccatttctgagacatttcctttgtaaaatgaactcaggctgagtgcagtggctcatgcctgtaatcctagcactttgggaggccaagacaggaggattgcttgaggccaggagtttgaaatcagcctgggcaacacagtgagaccccatctctacaaaaaataaacaaaattagctgggtgttgtagggcatgcctgtagtcccagctgctcaagaggctgaggtgggaggatcacttgagtttaggaggtcgaggttgcagtgagctatgattgtgccaccagactccagcctgggaaacagagcaagatcctgtctcaaaaaaagaaacaacaacaacaaaaacccaaaaaacaaatctaaagtgtttcacatgatggctgaaatagtaaacgtgagggaaaggtcagtgactcttcttcatagtgaaggaggtcgaggtcacggatgagagcaggtgccctgtgttagatggactggcactgccgccgactgttggcgtgacttcagtcagttcctctcctctccaggcctcagctgccctgtctgtgagtgtgactgcatctcttccttcgtggggctgcagtgaggagtgatcggttagggcccatcaacccacacacagctggcacttgctggtcatgttctacctgcatcagccaccttgaagctgcagttgcgtggactcaggggctcctctccgggactcacctgatgcccatcccagcaccaccctcgcgcttcacacacctgaccagcctagcattgccctcacactattatttaccctggcacccaggacctggtgtgttggctggcacagagctggccctgcctcttgcctgcttcttgtctgccccaagaaccccagcttatatccaccttccccatctcagaaaccctcctctacccattgatgtatccctccctccactgccacctgaagcatctgagatctggagaagggacaaggtgggagtcacagtgggctgagtggcagagctgggtagatactggctagcacagtggaagcacagctgataggagatgggcatcatttccctgtgcagacttgcagcctgcactcagccatcctcagagccaggagcaaagcaggtgcttgaaaaatatgagtaaagtcatacatttacaaattttgtaaattcatatgattgcatttaattgtgataaaatatacataacataaaatgtactcttaaccagtgcgtacagctcagtggcgtgaagtacattcacactgttgtataaccatcaccaccatctatctccaaaactcttcttatcttgtaaatctgaaagtctctacccattaaactaatcccattctctcctcaatacagcccatggcaacctatatgatcacatcttttataaaatctcagcagaaaaataaaaatgaccatttacaaaagcaattaccaaacttatttttctttccatccataaaattttataaagtctaaatcactaaatatcacagccctcctattacttaccagatgggggcttcttgttaatcttcttgttctactacgatgaaattgcccatttgtgggagtaggttagacagtatacatgttcaccatgtctttaaaagtcatatttatatttttatacatttgataaggtattgaatattaaaggaaaagaagtttcaaagtgatattgatactattctacttggaaataaagataaattatttaaatactttctcctaagacatgaaataaatgaaagtaagttaaataccacagcctcttgatgaaataatgaaaaggagattatgtccctaagaacagaatgtctcaaagctcatcttagatggcaaacaatcaaggctgtttggaaaacagagtcatgcaaattgacttacgcctgaaaacctcaaaaataaaaacagaaaccgtctgtcaagtctaagtgaccatctaaagaaggtaagacagggaaacaaaacagaacccctaagcctgagatgagaacaaggattgtgagacagggaaatgcgccgtgccgttgtctaggcctacattcaggatcaagctctttacatgcatggcactttgccagcctccagcttccggatgcgtgtgcaagtgttgataaaggctggaaagtggacagatgaaaagatattattatacatctacgtgaatgagatctgcatgttgtgtgtgaagtaacatgttagtagaattagccaaaagttctataggctgtaactaaatgtcaatatggaaattgcatatttctgttcgtaagatgctagtaatttattgcatgggtcagatgatttaaatttgggtcatttttttgtccaatgacgtatgaattatcagtttctcaaaacagaaaagcatcaaaatgaaatgatgcctaggcatgctggtgtgtacctgtaattccagctactctggaggctgaggcagaagatcacttgagcccaggagttcaggggttctccaccagcctgggcaaaatagcaagacttcgtcttattaaaaaaataaatacatctatttttaaaattttatatatatatatacacacacacacacacacatttttatatatatacacattttcaggccaggcatattaattggcatgcatatatatatatgccatatatgtgtatatatatgccatatatgtgtgtgtatatgtgtgtgtgtgtgtatatatatacacacacatatggcatatatatacacacatgccaattaatatgcctggccctgaaatgtcaggtctatcaattataagaaaaaaaacatttttaatgaaatgatggtataactcactcttcatctcagcctattgattcctaattgtcatctgtcttactgtgctccattaaatgtccctccattggaattcttaactatattagacactgggatgaaaaaaccacccagaagagagttgccctctataaaacaaagtggaaggagttgtgaggagcacttggacgcaggagttgtccaatctgaatctgaatccctggctacccacatggccatggcatgttctgtaatgtccctgagcccactgtcatcttcattacaaagtgacaatgacagggctgttgagaagactagatggagtgatacgcagcacacaactaccccctgccctcacccctgctcctgatcttcttagccctagccccagggccccaactaactcagctgtcctggtaacaactcagtttgatggcataggacagaggtcagcaaacttttcctataaagtgccaaatagcaaatatttttggctttgcaggccttttagcacctgctcaactctgccattgtgacataagaagtcatagataacgtgtaaacaaataaggatagctgtgttccaataaaactttatttacaaagtagacagtgggctggatttggctcatgggccatagtttgcccgccgccatataaagaaagagacctaaatactccttatctgcaaagttagatataactgccacatatgtgctcttcctagaaacagaatcacttttttgtcaaataccatggaacatttacaaaagttgtataaatattaggccaccaaaaaagtctcaataatttttataaaaagtagaatgaatgctgattaaaatgtgataaagattctgtaaaaacaaaggcatggattgcacaaagagatgggtgccatgctgggagacaatccacttctttttaactttcaggtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggcttctggtcttgatgtatttgataagaatgattcattcaatgtttaaagttgtataactgattaattttctgatatggcttcctaataaaatatgaataaggaag

SEQ ID NO: 683 - DNA, 64096 bp, Homo sapiens
gcgctcgggctgccagccctcccttgcacgttccggctcctcttctatcttcacgcccacgctaggccctgagcccagcctccacgtctcgccgccaactccacatcctggctcctatctctgccttccaggcatctcccagctgcacgctcgggcccggctcagagccctaagccctgcctcccggtcctggccgggtttcccagaactgcacggcgcctctccgcccaggcccaagcgcgagcccctcctccacacccgagtccgagccccgcgtcccggattcggacccgcctgcctggggcggtgctgcaccaggtgcgggtgtggcaggcgtctcggagcgccaggtgcagcttcctggtcaagatggtcgccgcctgccgctcggtagccgggctcctgccacgccgccgccgctgctttcccgcccgggccccgctgctgcgcgtcgccctctgcctcctgtgctggaccccggcggctgtgcgcgcggtccctgagctcgggctctggttagagacagtcaacgacgtaagtggagtgtcgggacccaggcgtggcacgtctcgggccgtcagggccgtcgtgcggcttcgcttgaccccgggcttgttcaccctgcctctgccgggtcagcaccgggtcccctgataccctccctgagccttttgtctgttacagccggggagcggggagcggcccctcctccggcccgacctgggctgcaggcaagagccgtcaggattgcgcatgggacggccctcgggtccgagcgctcggactgttactgagggtcaccatgcccgacgccgtggccctcattctgctctgacatgttttggctggatcaggaatctctcggcacatctagcagcatctttgggattcgactcttcctgtccggatgcagccacagtgggccacacccctgaggccgcagggaggacttgccagcgcttcagtttctgcataaacttagaaagcgggtctgccgcttccttaaaaaaaaaaaagaaagaaaaaatttaaatgagggggaaacgtgcagtagtcaccctacctctatttctctcttcttgagttcctgaatttctctacagttcctgtcacagttccgggagagagagtgtgtgtgtaggtggggcgggacttgtgattagggagtgcttgaaaggcgaatctggaggcatgagtgggtggaaactcttctttccaaggcaggctattagaaaacttggcgtctggtaattagaggagatgatgtgggagagatgcaggggcagaattatggaaagtcttgcaaaagagagacaggaagtctggaagaggcattatctccggcttctctggggtcagatgactcatccagcactgtttgggatgggtattttccacatgcatgaaataatgtccaggttctaaagatgagacttatattttgatttccttaaccagaaaaagaaagtagttccaaagactacaaatacttcccacaacacaaaagctactcagaggaacacgctgggtatctttctggatcttttaagacctagtgcagccatttcctccaggattggattcttctgggttggtgacctaatttgtgtgccagttatagtctgcacatctccattatttaatttcctgaacgggaaaaagtagaactcagtgaactactctcatggcttcctgctgctacgatagtgaatagtcaatataactatattggaagtgaatcagttgcatgcatattgttggattacttgaacatatctgtatagatctttgctaagtgtactgtgaacatacctgcaaagatctttgccaagtgtacttcttcctgcatgaggaagagaagtttgctccttgagtgctgcatgacctttaggctaattttactcctgtgtgaccctgggccgccagaagtctaaaagcccttctctcccaagagtggacttatattttccacatttcaggttgtcagaaacaggaaaggagagtggggctttctttcatttgtactgcaaatctatcaggaaattttgtttctttgtttttgtttgtttgagacagagtcttgttctgttacctaggctggagtgcagtggcacagtcatatggctcactgcagcctcaaactcctgggctcaagcaatcctctagtctcagtctcctgcgtagcgaagactataggtacatgccacacaccagttaatttttaaatttttttgtagagataggggtctcactatattgtcaaggctggtctttaactgctggcctcaagccatcctcctgcctcagcctcccaaagtattgggattacaggcatgagccactacacctggccaagaaatggttcttttgagtgtacaagggagcaaatggttgaagcaccactgtgtgtcatatgttagactggtcattgctgttgcaaagatgaattttagccacagccccttctcccaagacgttcacacaataatacggataacagatttatgagtagatagtcatatacactgtgatatacttgggatattactggagcaccaagggggtcacctaaccctgcttcctggaggagagacctgcctcagtctttttttttttttttttgagacgaagtttcgcttttgctgcccaggctggagtgcagtggcacaatcttggctcactgcaacttccacctcccgggttcaggggattctcctgcctcagcctcctgagtagctgggattacaggtgtgtgccaccacgcctggctaattttttatttttagtacaggcagggtttttccatgttgatcaggctggtctcgaactcctgacctcaggtgatcctcccgcctcagcctcccaaagttctgggattacgggcgtgagccaccgcactcggcctcagtcttaaaagatggataagtactaccttgatgaagaagaggaggggaacagagcagcagcagtgcaggaaattattggtgttcctgctacatcaagttctggcagggttgttagaggggactcaggtcaccacaagctttccatgcctgagcttggccttgagcctgaggccagaggcctcaaactcaaggacctgtgttggccaaggcaagtcatatcattaagcacagtgagctaagttcaggactggagggggtagtgaggaatgttgtggactacagattgcatgcccattctgaagagggcagctgccatttggcttcagcttactctgcatacattctagcagagtgggcacagaattgccacagctcgtttttttaagtgagactggaatccatctttttattatgtcaactaaagttttaaaaaggcctcttgtgggcccagtatatcccatttttaggttggattagacctccagactcccagtagctactttaggatgtgaatgagggagccattgaaagatcttagacataatgctaatcactatggctgctgtctaaagatgaattataggatcagatctggaggtagaagtaccagttaagctattgcagaaattaggcaggaaatgcagagggcctaaattagggcagtggtgacagagatggagaggaagaactaaatttgataaatgtttgtgagataaagtaggcatgccttggggattgggtgatggaagtggggaactggaaggagccatggcttgggtgactgtagatggtaccacctccagccaaggtggacaatgtaggaaaagttggtgagcagagaggagtgtgtctggtttaaaacaggtttgtctgttggacatctgtcagtggacatgtcctttaggcagttgggtatttggatctggagctcaaaggaaggatccaagttgggaattttattgttgttgttgaaactctgttggggaagggaagaggttaccacttgtcctatcagtgttttttgttttgttttgttttgtttttaatgcctaatcatttgtacatttaacacagtctctaactgcaggatttttattcctgagaagacattaaacaactaatcaattatttgatttaaattgtggaaaggttgtgaagaagaaagggtgctagggattatataagggagggcctggccggatatgggccacagtggaagaattcctgcagaacgggcttttgagctgggctttgaagggtgagaaggagccaactagatgaacaaagggtgaaaggaaggattttaaagtaaatttttcaggttgaccactaatcctgagggcaggaaagaatatcatgcttttctggaactggaaagttgagaggtgggcaggacttgattattcacgtcctataggctacagtaagaatttcggtctgttgtaattgcattggtaaaccataacgacttggagctgggagagggggacagttccttatcaaaagtacattcaaattgacgccaggagagcaacatgcaaatgcagtcagttcatgtcacgtctgagcagcactaatcctgcaatggcagcatcttttacctcttatgtgtcactggccctaactgagtctgctagaggccagagccctcctgatcctcagggtaactgcaggaagtagaaccatgacaaggttttaagcaagttagtgatgtgatcagatttacgttaaaaaaatactcttgtcagagagaggagtgcaaggcttagaactctatatgttgtggggtaaaacagttgcaaaaaaaactttctaacaagatcttcctgtgtttgtttttcattttagaaatcaggacctttgatatttaggaaaactatgtttaactctacagatatcaagttatctggtaagtataataaaacaataaaatactagactgggcgcaatggctcacgcctgtaatcccggcactttgggaggccgaggcaggtggatcacaaggtcgggagttcaggacgagcctggccaacatagtgaaaccccgtctctactaaaaatacaaaaaaagttagctgggcatggtggtgggcacctgtagtcccagctacttgggaggctgaggcaggagaatcacttgaacccgggaggcagagcttgcagtgagccgagatcgcgccactgcactccagcctgggcgacacagtgagactctgtctcaaaaacaaacaaacaagaataatgaaatactaatatatatataaacaacataatataaacaaatacattcatgtaaatgaatataacatatataataaactaagcaaatgttttgtttttaagtagttctaacattttaaggttttgttttgtttcagtcagcacttggttatttacaagaatggatttttctttttttttttcttgagacagagtctttctctgtcacccaggctggagtgcagtggcaagatctcggatgactgcaacctccgcctctcaggttcaagtgattctcctgcctcagcctccctagtagctgagattacaggcgaacgccaccacgcccagctaatttttgtatttttagtaaagatggggtttcaccatgttggccaggctggcctccaactcttgaccccaggtgatccacccacctcagcctcccaaagtgctgggattacaggcatgagccactgtgcatggcccacaagaatggatttttctgatcttctttcagaaaatgtaatgtgaatcattttatgaaaattataattaaagtctaatagacgaacaaaaaaaatttgttttttgtgaaatttaactttgagtctcagatttttaaaactagataaattgcttttacgaatatatgaaatgtcatgattgtgataaaccctttatggccttgaaaattttcaaaacgtacatatcctcgtaagaagtaaaaattgctggacaacattttaattagagttttaaggttgataaaagttaaaatattcattaggtagggcctgtcttttctgtgtcaatactgagataccagaactaccaaggttttttaagaatttcactggattttcattggatcgtattcattgtggcccaattcctcttattgtttccagtaacctaactaggaaaattggttgccagagttaaagtctcaggataaggagcagttttttgctgggtagagcaaactggcttctacaggatccaaagtcatgcctctttcctttcacacaacagatcatgctctgctcatttgttgggggcaattcttccttttatgggtctttcctgagggaagtcaggctagccagcagctagaaagcagaggtggtttcaagcagctctgtaatatcaatcatcagttgtgataagagcttggtaagaggaaattgaagtccaaggtgagagagaaaaaaattttggcatctgtttatttaatgaattcatgtctcaaagtctagacaaaggatttaaaagaatctcagtctggtgctgacaaaaagttatatggaaaaaaaagtaacgtcagccactgaaacagaatttgatttttaaaaatcattacaaatgcctgagatcaacatatgagtagactacaatcaagacgttgttattaacttatctaaagaaagaatgggacagcatgagggatttaagagcaaaagcataataaaactagggtttagtcaggcaaatgctggtcatgtccaacagcattgttgggggagaggttttcttgaaccatgaccacagctatgacatggggctggcagttgtggatatagcatccacctgagcctccttggtctggtgccatgctcaccaaaccaccttctcatccgtattgggcctccagggaggcatgctgaagggaaagagttgatcattactagtccagtttacggtttctgttcattgtaagtgagtaattgagtattctaatttatacatctacatggtaatcatgaaagtgagtaattgagcattctaatgtacacatctaccattgggaaagggtgagatgagaatctgtgttttcacagagccagattttagtgcttgttaagctaaggactggtcccttggatatatgtcgatgctgtttgggagatcagatatctggcttttttaaggcaacctctcttctgctgtctcattcaagtcatgtggagcctgtgctaaaaaatatctcaatgtaattcaccatattaacagaatataagaaatgaaccatatgatcatctcaaagtatacagaaagagcatttgaaaaaaattcaacacccattcatgatagaaactcaaagaaagttagaaatagaaggaaacttcctcaacctgataaaaggcatctatgaaaaatctgtagcaaacatcatactgtcagttcttcccagattgatctataagttcagtttaatcccagccaaaatccaagcaggctttttgtttgtttggtcggtgcatattgtgaatttcacatttttgagtgctggaggacgttgtagtcctttaacaactttgttctagcagacatttaagttccttgtgggtcagtttgatgctttccagttttcttgttaagttcttttaggatggttctgcagtagccttttgtctagggcaaacttaacagtgcttctgtggtgtggtctttctgcttgtcttccaaatacctggtatatttactgaggcctttccactctggctagtggaaactcaaacagttcccaactctgtgtgagctctgagaattgttgggcttgttcctatgcatgggcaggctgcccttcagccagaaactccaggggatcactatgcagatttctctttctctttatgtagcttccatctcttgggtactgtcccccagaaaatctaccagcctcagtttgttgaacttgaatctctggtctcagtttggtttcgctctttgtcattatcagcctttgagatgtctcccagtgatccttgcttcctgttattcatgatcttgtgtggtcctctaacacattttatcagagttggtctgagtgactgatagagcatggtggaaataatggcacatcccttctgaggctaagttataaaagatactgtggctgcatctttgctctctctaatcactcactctggggtaagccagctgccatgtcgtgaggacgttcccaacagagctctccttaactccagacttaatgcttttcagtctgcctatttgtgtcactctcttacctggatcattcaaaagaaaggccaaactcctcagcagggtctaagacctcatgaattttccccagcactcttctccagcttcaactctttctcctttccccagcctgtgttctaagcatagcagactattttcaggggtcatactcatgctgtgctttcactcaccctgggcatttacatgtttggtccacccttctcttcaccaggctaacttctgctcttccttcaagttacaggtctcctcctccagcaagcttacccagaacccattcttcatgctctcctgggctatgataggtgacctgctcagtgctcccttgactattctcagcctctgggactactgagagtgcctgtttagttgttaaaactcactcctccagtacctcttaagtcatagacaggcattgttcttgtttaccatcatagctcacaggatggcacacaggatggggctcactcagtatattttgaatgaatatgtgagtgagaaaaatgtttgagagtgaaataagcagtgacttagcatatcaggccactcagtttatttaattttagacttatacgtgaaatgagcagtattacagcagcttttggttaactgtaacaatttaatgaatttatctgtctcactttacagtgactttttggagaaattagctaatgttttactcattgttacattaaagtagcctatttttaattgcattctcaaaaccttaagtttatattagagtgtatgtattattcatgtaaaacaagactttctttttctaaacagttaagtcattccattgttctgggcctgtgaagtttaccatagtgtggcatttgaagtatcatacctgtcacaatgagcattctaatctggaagtaagtaaaacacaagtttttaatgtatataaagctatgaaggaaaattatgggtataaagattagctcatcaagcgaggaggctagaaatagagattacagttttagaagtgctacagattaattttgggacttatggcaataaaccaagttacatgctgagaatactacgagcttttagttgccttgtatgatatgaaaaatgttagtaaatgtttaaattcaggcacgtaggagtcattgataaagacgcatacatacaaataaatgcttaatttgcaaaagaagtttaaatatttcactttttaaaaaaattatagggaaactagaactgtattgagtacaagtagatttagtgagcacaagtagatcgcagaaagaggtgaggagaagaaaggaggtatctggggaaaggcagaggattctgagagagaaggagaaagtggctgtgctgagcaaggcttttcctgcacctggctgtgaagcctgggtttcttcctcctgggatgtgcactgggctctcagcaaggtgtttctcttgatgattctcgtgatagttgcttgggattgtttccttttcagattctctgttacctgtttggcttctaccttgaataatatatgggtttccatatctttttaaattatatatgtatatatgtatatatctatacatatacatatatgtgtacatatacctatacatgtatatgcatgtaaatacatatgagatctctctctgtcacccaggctggagtgcagtggtgcgatcatggctcactccagccctgaactcctggactcaagtgaccctcctggcaggttgtctcaggtagcctccagagtttctgggattatagatgtgagccattatagctggctttctgtattgttattagtattatatttctatttggattgaaccatgccattttccttgaactgcctttttggcttcatctctaaatattttacaccttcacactaaatacttcaatgtaaatttcctaagaacagagatattcatttatttttttcacagtataattatagaattcaaatttaacactgataaaatgctattatatataaaccttattaaaattttgcaactgggcagggtgggtcacacctgtaattcctgcgctttgggaacctgaggcgagaggatcacttaagcccaggagttaaagaccagcctgggcaacaagtgagaccctgtctctacaaaaaattaaaaaattagccagacacagtggcatgtgcctatagtcccagctgttcgggaggtttaggccggaggatcccttgagcccaggagtttaaagttgcaatgtgctgtgattgcaccactgcactccagcctgggagacagtgagaccttgtcttcaaaaaaaaaaaaaaaaaaaaaaagttcaccagtgtcccaatattgtcttttagagcaggcgcccccgctccccctgcacacacactccacaccccataccggaaccaattcaggtttgcatttcatttcctttccttgtttttgtttttagttcctgataatctggatttcccccctttttggtgtgtcatggcattgatagttttgaagtgcacagaccatttatttttgcaaaatgcccctgaatttgaatatttctgatgtttattcatgatcagattcaagttatacatttttggcaggaataccacagaatactgatttgtctcatttttggtgatgttaatttgatcagttggtcaaggacatatctgcaagattttttccattccaaagttactacttttctctttgttattaacaacaacttgtgaggaaaaacttttgaaactatgtaaatatgttgtggttttcatcaaaccttcagccacttgttttagcatcctttcatgattcttgcctgatgagtcagtcattactgtgctgattgctgaatggtgattttctagttccatactttcttcttcctttgttagcattctactataaggatgcactctctctactcccctaatcaatctgtcttatctgtcagtcatcaggtcggacttgttgatttttactttgttatataggttataatctattactgtttttatatattttgctcatattgtcccatatttggtctgtgggagccaactccactttttttgatgactgggagctgccattaaggagcctggttcattcatccattcaaggatgccaggaacctcaggtagttgtgtaaatgagcgtctcctctgcactcagctacctttgctgtatcttactgtttgctttctcttttttgtagttgaatgctactttctttctctgtaaaatctcttacacatgggataaaatacaagtagccccagaacaaagtatgttttatttctctgggaactatttcattgtagtatcttagtcagttttcttattgtaagtgtgcttgtgttatgtattactgtatctgaacacactggaatggctaaaaggttatgattatctcaattatattaaaattatattcgaaacagtttttatttggtattttattctattgcgtatttccaggtatttcaaactgaatatacttttggtattatttagacattaacttttatttatattctaggataagaagtgtgggaataaattataacatagaattttaccttatataggagctgttccaaaaacataaacttagtgttgatgaagacttttgtcattatttgaagaatgacaactgttggacaacaaaaaatgaaaacttagattgcaacagtgattcacaggtgtttccctctttgaatgtgagtatctgacttgccatgttaaagtttattttattcccagtgaatacaagtatcaactgaagtaatgttttatcggaattttgataaaggtggtatctgacttgccatgttaaaataaagtttattttattcccactgaatacaagtatcaactgaagtactgttttatcaggattttgataaaggtggttaacttgtaaatttttaggtttagtttgtttgtgtgtatagtagtacataataagtaagatacgtggctgggcgcggtggctcacacctgtaatcccagcaccttgggagactgaggtgggtggatcacctgtggtcaggagtttgagaccagcctggtgaaaccccatctctactaaaaataaaaaaattagccgggtgtggtggcatgtgcccgtagtcccagctactcgggtggctgaggcatgagaattgcttgaactcgtgaggcagagcttgcagtgagccatgattgcgccactgcactccagcctgggcgacagagcgagactccgtctcaaaaaaaaagataagatactgataccattgttccatttccttgcaacttattttggcaatatccttgcaaggttcttttatatctgctacctccaatttatctctcactcttccttctgtcaactgcagtcagacctttgcatccatcatcccatcaaaacagctctagtcaaagtcaccagtaacttccatgttgttaaatccaatggtctgttcctcttaccaaaagtcttgacttaccagcatttgacacatgtcaacactaactcctcctttatgccttttctccctaccagtgtgggagcttagattctaaaatgattaacagcagttggctgggcgtggtggctcagcctgtaatcccagcactttgggaggatgaggcaggtggatcacctgaggtcagtagttcgagaccagcctagccaacatggtgaaaccccatctctacttaaaatacaaaaaattagctgggtgtggtggtacgcacctgtaatcccagccactcaggaggttgaggcaggagaatcacttgaacccgggaggcagaggttgcagtgagccgagatcacgccattgcactccagactgggggacaagagcgagactccgtctcaaaaaacaaaaacaaaaacaaaaataaacctagcagtcagccttggttagtgagattatgaggcatttaaatttattttttgttcttttgtaaattctgaagtgaaagtctttagtaaaagttttaaaggagttctctttaaaatgtgttgaaatataataaacacagaaaagtacacatcagtgtactcctcaatgaatttttaaaaggccaggcacaatggctcgcacccataatctcagcactttgggaggccaaggcgggtggatcatgaggtcaggagatcgagaccatcctggctaacacagtgaaacctcgtctctactaaaaatacaaaaaattagccgagcgtggtggcgggcacctgtagtcccagctacttgggaggctgaggcaggagaatggcgtgaactcgggaggtggagcttgcagtgagccgagatcatgccgctgcactccagcctgggcaacagagtgagactccgtctcaaaaaaaacagacaacaaaactgagcacaaccatgtagaccctgatgaattatagaacattttagcacctagaacccccttttacttcctaacactttccctgccaatggcaacactatcctcattaaggagaaggttttatttttattttttaacttttattttcaggggtacatgtgcaggtttgttatatcgtaaactcatgtaggccgggcgcggtggctcatgcctgtaatcccagcactttgggaggccgaggcgggtggatcttgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtctggcctgggcgacagagcgagactccgtctcaaaaaaaaaaaaaaaaaaaaaaactcatgtcacaggaatttgttgtacgaattatttccatgacacaggtactaagtttagtacccaatagtcattttttctgctcctctacctcctcccagccttcacccttaagtaggcccctctttgtgtctgctgttcccctctttgtgtccattttctcatcatttagctcccacttataagtgagaacatgcggtatttggttttctgttcctgtgttagtttgctaaggaaaatggcttccagctccatccatgtccctgcaaaggacacgatctccttttttatgtctgcatattattccatgatgtatatgtaccacattttctttatccagtctaccattgatgggaatttaggttgattccatatctttggcaacgtgaatggtgctgcagtgaacatatgtgtgcatgtgtctttatgacagaacgatttatatccctttgggtatataatatacccagtaatggaagtactgtgtcaaacggtagttctcttttcagctctttgaggaattgccacaccgctttccacaatgggtgaaccaatttgtactcccaccagcagtgtataagcattcccttttctccacaaccttgccagcatctgttattttttgactttttaataatagccattctgactggtgtgagatggtatctcattgtggttttgatttgcatctctctgatgatcagtgatattgagctttttaaaatatgcttgttggccatatgcatgtcttcctttgaaaaatgtctagtcatgtcctttgccctctttttaatttttttttgttttttttcttgtaaatttgtttaagttccttatagacactggacattagacctttgtcagatgcatagcttgcaaatattttctctcattctgtaggttatctttttattctgttgatagtttcttttgctgtgcagaaactctttagtttaattagatcctatttgtcaatttttgcttttgttgcaattgcttttttggcaactttgtcatgaaatcgtcacctgtcctatgtccagaatggtatggtctaggttgtcttcatagggttttcatagttttaagttttacatttaactctttaatccatcttgagttgatttttgtatataatgtaagcaaagggtccagtttcagtcttctgcatatggctagccagttatcccagcaccatttattgaatagggagtcttttccccattgtttgtttttgtcaactttattaaagaccaaattattatacgtgtgctccgatatttctgggctctctattctgttccactggtctatgtgtctgtttttgtaccagtaccatgctgttttggttactatagccctgtggtatagtttgaagtcaggtagcatgatgcctccagctttgttccttttggttaggattgccttggctattcgggctctcttctggttccatatgaattttaaaatagttttttctagttttgtgaagaatgtcattggtagtttgataggaatagcattgaatctgtaagttgctttgggcagcagggccattttaacagtattaattcttcatatccatgagcatggaacatcttttttttttttcttttttttgagatggagtcttgctctgtcacccaggctggagtgtagtggcgcagtctccactcactgcaacctccacctcccgggttcatgccattctcctgcctcagcctcccaagtagctgggactacagacgcccgccaccatgcccggctaattttttgtatttttttttagtagagatggggtttcactgtgttagccaggatggtcttgatctcctgacttcatgatccacccgcctcggcctccaaagtgctgggattacaggcatgagccactgcgcccggctgagcatggaacatctttccatttgtttgtgtcatctctgatttctttgagcagtgttttgtaattctcattgtagagttcattcacccccttggttagctgtattcctatgggattgcattcatgatttggctcttggcttggctgttgttggtgtacaggtatgctagtgattccccccccgcccccccgccgccgccaccactgcccactctgtcatccaggctggagtgcaatggcgcagtctctgctcactgcaacctccgcctcctaggttcaagcaattctcctgcctcagcctcctgagtagctgggattacaggcacctgtgaccatgcccggctaatttttgaattttttttttagtagagacggggtttcaccatgttggccaggctgctctcaaactcctgaccttaagtgatcctgctgccttggcctcccaaagtgctgggattacaggagtgagccaccacgcccagccgctagtgatctttatatattgattttgtatcccaaaactttgctgaagttgcttatcagctcaaggagcttttgggcagagagtatggggttttctagatatataatcatgtcgtctgcacacagggatagtttgacttcttctcttcctatttgggtgccctttatttctttctcttacttgattgctctggccaggacttccaataccatgttaaataggagtgatgagagagggcatttttgtcttgtgccggatgtcaagggtaatgcttccagcttttgcccattaagtatgatgttggctatgagtttgtcataggtggctcttattattttgagatctgttccctcaatacctagtttattagagtttttaacatgaaaggatgttgtattttatccaaagccttttctgtatctattgagatgatcatgtggtttctgtctttaattctctttatgtaataaatcatgtttattgatttgcatgtgttgagcctaccttgcatcccaggggaaagcctgcttgatcatggtagattaactttttgatgtgctgctggatttggtttgctagtattttgttgaggttttttgcatcagtgttcatcaaagatattggcctgaagccttcttttgtcatgtctcttctatgttttggtatcagaataatgctggccttatagaatgagttggggaggagtccctcctcctcaattttttggaatagtttcagtaggaatggtaccagctcttctttgtacttctagtagaatttagctgtgaatccatctggtcttcggcctttttttggttggtaggctatttccatttcagagtttcttattggtctgttcagggaatcagtttcttcctggtttagtcttgggagggtgtatgtgtccagtaatttatccatttattctaaattttctagtttgtgtgcatagaggcattgatagtattttctgatggttacctgtatttctgtgggctcagtggtaacattccgtttgtcatttctaattaagtttattggatcctctgtcttttcttctttattaacctacctagcagtctatctgattaattttctcaaaaaaacagcttctggattcattggtcttttgaatggtttttcatgtctcggtcccctttagttcagctctgattttggttatttcttgtcttctgccagctttgaggttggtttgctcttgcttcactagttctttgagttgtgatgttaggttgttaattaatttgagatctttttaactcttcttcttttttttttttttttttttttgagacagagtctcattctgttgcccaggctggagggcagtggtgcaatctcggctcactgcaacctccacctcccaggttcaagtgattctcccacctcagcctcccgagtagctgggattgcaggcacccaccaccacacccagctaacttttgtatttttagtagagatgaggtttcgccatgttggccaggctggtctcgaactcgtgacctcagatgatccacccgcctcagcctcccaaagtactgggattacaggattacaggtgtgagctaccgcacccagccaagatctttttaacttttcactgtgggcgtttagtgctgtaaatttccctcttaatattgccttagctatgtcgcagagattctggtatgttgtatctttgttctcattagtttcagagaacttcttgatttctgccttaatttcattattcacccaaaagtcattcaggagcaggttgtttaatatccatgcaattgtacggtttcgaaagattttcttaatcttgatttccaattttattgttgtggtctgagagagtggttggtatgattttggttcttttgcgttttctgagcattgttttatttctcattggctgattttagagtatgtgccatgcagagatgagaagagtgtatattctattatttttgggtgaagagttctgtagatgtctatcagctccatttgatccagtgttgagttcaggtcctgaatatctttgttaattttatgcctcagtgatctaatactttcagtcgggtgttgaagtctctcactattattgtgtgggagtctaagtctctttaaacgtctctaagaacttgctttatgaatctgggtactcctgtgttgggtgcatatatatttaagagagttaagtcttcagttgaattgaaccctttaccattacataatgcccttctgtgtcttttttgatttttgttggtttaaagtcagttttgtctgaaattaggcctgcaacctctgctttttttctgttttccatttgcttggtagatttttctccaaccctttattttgagcctgtgggtgtcgttatatgtgagatgagtctcttgaagacagcaaaccaatgagtcttgcttatttatccagcttgacattctgtgccttttaattggggcttttagtgttgacattgtgggtttgatcgtgtcatcatgttgttagctggttattacgcagactcatctgtgtggctacttcctagtgtcactggtttgtatacttaagtgtgtttttttagtggctggtaatggtctttccatatttagtgcttctttcaggagctcttgtaaggcaggtctgaatgaattccctcagcatttgcttgtctaaaaagggtcttatttccccttcacttatgaggcttagtttggccagacataaaattcttggttggaatttcttttgtttaagaatgttgaacataggcctccaattctcttctccttgtagggtttctgtggagaggcttaatgttaatctgatgggctttcctttgtgggtgacctgacctttctttctaggtgcctttaacatttttcttcattttgaccttggagaatctgatgatttatgtgtcttggggatgatcttcttataaagtatcttgtgggggttctttgcatttcctgaatttgaatgttggcccctctagctaggttggggaagttctcatggatgatatactgaaataggtttttcaagttgcttccattctcccatctctttcaggagtgtcagtgagtcatagattccatctctttatataataggggcaatttttcaaaagcagaactttgttacttgtgtttgggatacagtgagatttgttctttgatgtttagctttttaatttttcatttttcttctaactttttttcttaattattaaaacaatttttctccgtagaaatgcagcagtataaaatggcattatttactcttttttccagaataaagaactaataaatatcagaaatgtttcaaaccaggaaagatcaatggtaagcagtttgatttgtctttaaatcaaatatacacaagttaacgtaagactgaaaaaagtcgctgatggatagatacttagagagtgatataaagtagggttattagaactgtggaaggaaaaggaaacattatttaaaaccgtatgttttcaggccaggtgcagtggctcctgcttgcaatcccagcactttgggaggctgaagcaggttaattgcttgaggccagcagtttgataccagcctggccaacatggcaaagcctcatctctactaaaaatacaaaaattagccaggcatggtggtacatgcctgtaatcctagctacttgggaggctgaggcatgagaatcacttgaacctgggaggtggaggttgcagtgagctgaaattgcaccactaaacttcagcctgggtgacagagcaagactctgcctcaaaaaaaagttttcttatatatgtctatatgaattttgtatatactgttactatctttgtctaaaaatatccttaaagcaatttaagatgcatttctatgcagcctttcttttctttaaaaaataaaattccccctctaaatgtgcaagacagcatagcaatgggctgtgcgtgtcattaaggatttaaagaaatagaaaccatgaatgtagcatgtgggagggaaattttggcattctggggaattactaaaagttagaagactgagtaagaggtcgaaagggatgggagttatgtgtagggactgaaaacaggtttgggagagcttaatgtttgcttttatactatgactcttcatgttttctcttcaaccatcctaaagaagtctgataatggaaaggcactcgctctgcagtggccaggacaaactttgtacaaaatctgtcatatgatgaggagtaggaaatgaaagaaacggataggaaatattcaggaaaatggagtataagaagtgtgatccagttatgggagggcactggagaatttacaagcattacagtgggaagttttattccttagtggaattgcaagtaacatagtgccttaagaaatttgaatcatttagcttatgtacttaatctgagtcatttctgacaatgttatctaacttcctcttcccccaattcaatttaaaaaccacacattaggccgggtgtggtggcaggtgcctggaattccagctactcggaggctgaggcacaagaattgcttgaacccaggaggctgaggttgcagtgagacaagatcgcaccattgcacttcagcctgggtgacagagcgagactccatctcaaaaaataaatgaataatgaaaaccacacatttaaataaaacaaaatgtttgataaaattaggataaaatatgagaagagtattgttagaaaaaagaggtttttttgagacacaggcttgttctgtcacctaggctggtgtgcagtggtgtgatctcagctcactgcaacctccgcctcccaagttcaagcgattcttctgtctcagcctcctaagtagctgggactacaggtgcctaccaccacacccggctaatttttgtatttttagtagagacagggttttgccacgttggccaggctggtttcaaactcctgagctcaagtgatccacccacctcggcctcccaaagtgctaggattacaggtgtgagccaccctgctcagccctagaaaaagttttttattgataatattaaacaatttatagattggtaatattagagggaacctgtaaaaatataaaagatagaaaacattgaagaatgagaaacgcttctttcctcctttacctttttaggtctggaaggatggtgtttaaaaaataagagaaatagctatctttccactacctgccattccttttctgttttgtgtgtgtgtgtgtgtgtgtgtgtgtgtgtgtgtgtgtgtgtgtgtctgtgtgtgtgtttaaaagaaacccaatatgactggacatagtggctcacatctgtaatcccagcactttgggaggccaaagcaggaggatcacatgaggggtcaggagtttgagaccagcctgggcaacatggtgagacccccatctcaaaaaaaaaaaaaaaaaaggaaaaaattaaaaaatagaaaaatttaaaaagtaacccgattcaattactttaaaatatggcaaacagttgttcagctatattacatagcaatttgttaaaaataatgaagaatttttttcacctctatttcaggatgttgtagccagaacacaaaaagatgggtttcatatctttattgtttctattaaaacggagaatacagatgcaagctggaatttgaatggtatagttaaactgcatgcatgtttactgtctgcattttctgtattctgtatttttgtcactgacctgagtcaacattctctgtttcaaatacatcattcaaaaatgaatttctgttaatcatacatttattttagatacttaaaatgtaacattaagttatcttattgctactatttattttttaattgatttaaaattttactgtgttaagataaatttttaaaatttcaaacttcatagtgggatataaaattctccattctttcagattaaaaaaatttttttaacatgtagaaatgtgtaggcaactttttagttgtgtatttcaagtaggttatgttctctgtttcttgaaaatggccatcatcagggatttaagatttttattatttgacaaattttattttaaaggatctgtctgtagcctaggagtagaagcagcatatctgccagcatgtgcttctgtggtctgtgaggcacccccaccactgtaagttagaccctctgtgccttgttaagctgtggttccttagtgccacaaaagtagacttgcaataagcagttttcaagagaatgaatgctttcccatattctagaatcactttggctgatgttttccatagtgggtgtgtctgctggggccagcagtagccaatcagcatgtgagggccctggggatttgatactgctctgattcagccagtcagctggcagaaaccaatgaggtgaggtaggcattgctgcagaggaggctcggtctgttgtactgcatggcccttggagggaagctggcaaggtggctgctctggaagagtgtgaggtaaggcttccttctggagatggcatcatgagccagactgtgccaagtagagggagcagggaccctgatgccattctgtcacctatcttagtctgtttgtgctgctataatagaatacttgacactgggtaatttataaagaacagaaatttatttccccacagttcttgaggctgcgatgtctaagatcaaggtgccaccaagtttggtgtctggttaggtccctggtgtctgcttccaagatggcaccttaaacgatgtgttctcacatggcagaaaggatagaagggcaggaagcacaaaaggggacaaccactctgctctcacggggtggaggcagaagagcaaagaagggcctaagctagttccctccaggccttttgtaaggcattaatctattcatgaggacagagccctcatgacttaatcacttcccaaaaggcctcacctcttaataccaccacagtgggtatgaagctttaatgaatttttgaggacattcagaccatagaactaggcttgtgcccacttctttcccaggcattgtgtcttttcccctgacaccagcgggcagttttgagcccctgctaattagtagctggagctgtcactgagccctgcatgttttgcactgtactcggcacatggtttattattgctatctcagacaaaacccaacctagatgtgtgagtttggtaatttattccaagttacgtcaaggaagataaggtcccggtgagatgagtaaattagcaagggggccagtctgaggtcttgtttggtagctgggactactgtgctcttgtatatgatcagatttggcacaggtttttagaatagcgtgtatacaagtagagggatctctttttttctttttattgtaaattgacaattacatatgacataaatgtatggggtacaaagtaatgttataatctataaatacagtgtggaataattaagtcaaactagttaacatactcatcaccccaaatgcttaacattttttgtggtgagaacatttgaaatgtactctctcagcaattttgaaacatacagtactctgttaactattcaccatgctgtgcaatagaactcaaaaaaagaaaaaacttactcctcctgtgtgagatttttttttacccttggaccatcatctgcccatgcctcctacctcccagcctctgtacccaccattctgctctcgtattaggagttcaattgttttagattccacatataagtgaaaatgtgcagtatttgtctttctgtgcttgactcatttcactcagcacagtgttttccagttccatccatgttgttgcaaatgacagaattttcttctttttaaaggctgaatagtatttcattgtgtatatatacacattttcttcatccattcatctgttgatggacacttaccttgattccataacttagctattgttcatactgctgcagtgaacatgggggtgcagacagctctttgacaaactgattttagatcttttgggtaaatagtaaagtgggattactggattatatggtaattctgtttttagttttttgaggaccttccatactgttttttataatggctgtactaattgacattttcacaaagcatcccttttctccacatcttcatcagcacttactctctttcatctttttgataaaagccattctgacaggtgtgaaatgatattggggttttaatttgcatttctctaatgactagtgatgttgagcatttttcatgtattaatatcttttgctcatttatatgttttcttttgagaaacatctaggtcccttgcctttttttttttttttttttttgagacaggagttcgctctgtcacccaggctggagtgcggtggcacgatctcggctcactgcaacctccacctcctgggttcaagtgattctcctgcctctgcttcccaagtagctgggattataggtgcacgccaccccacctggctaatttttctgtttttattagagacgggtttcaccatgttggtcaggctggtctcgatcccctgaccttaagtgatctgcccaccttggcctcccaaagtgctgggattacaggtgtgagctgtaacgcccagccccttgcccattcttttttttttaattttttttatctttttttattttttgagacggagtcttgctctgtcgcccaggctggagtgcagtggcgtgatctcggctcactgcaagctccacctcctgggttcacgccattctcctgcctcggcctcccgagtagctgggactacaggtgctcgccaccacgcccggctaattttttgtatttttagtagagacggtgtttcaccgtgttagccaggatggtctcgatctcctgacctcgtaatccgcccgccttggcctcccaaagtgctgggattacaggggtgagccaccacgcccggcctgcccattcttttaattgggttttttgttttcttgctattgagttgtttgagcttatgtattttggatattaactccttcttggatatatggcttgctaattttatctcccagtacctaagttgtctatgtctactgttaattgtttcctttgtgcaaagaagctttttatattgatgtaatcccatttgtctatttttgcttttgttgcccgtgcttttgggatcaaatccaaaaaatcattgctcagaccagtgttatgtagtgttctccctatgttttcttctagcagttttacagtttctggtcttacagtaaaggtatcttggtaaggttacataatcaaacaaatactaattgtccaataccatgtatgtgctacatacaaattcagcatttgttagtgtggtttgtattcttggagccttctgggaaatgaacttacatttaaagatttaagactgactgttaattaactctctcttcttctctatcctagtttctctttctatgattgggcctcatggatatatctctgcatcagattggcccctaatgattgtgagtatttctcatcattttttcctttttaaaaaatgaattttataccctaagagctttgtggtagtaattcctcagtagttaatgctttgacatatcctgtatttctggttccagagtgactggaaaatgaagggttggatacttgaatgtagaagtgccaactttcaaatgaccaaaaggcttaactgactaaaattgcttctcttcctacagttttacatggtgatgtgtattgtttatatattatatggcatactctggctgacgtggtctgcctgttattggaaagatatattaagaatccagttctggattgcagctgttatttttttgggaatgcttgaaaaagcagttttttatagtgaataccaaaacatcagcaacactggactgtcaagtaagttttgactgtctctgtaaatatagtatgatctaagagttccccagtatttatgagcagagcagtgggaggcccccttctgaacagtggtttggaaacagatatattatagatgaagagaaggaaagccaaggaaagaatgtcagagtaggcctctgatctggccaagcatgtgtcttctcttcattatctgttttccttcttgctaaatttcccctcactttcctcctgggaaaaataaaagtcccgtttcctaaggttcagcttggattaaaacagcacaaagttcgggacagggagacttcaggtgctgtcaatccttttaacatacttctccttccccccacatcttcttttctttctccttctccttcaaaaaacgaaaggaaattggccgcagggagtaaaatcaggggtgctggaagggatggtgcctgcagcctccttgtgctctccccacctctttactcccacaaagatcttcatataaccagtggaggcaccatcacagtttacgcagtggaatatgtgaagcaggcaggccatacagctgggcatcctcagatgtgtgccccagacttctagaaagtggatttcaggccagagaagtaaaggtacaactctcccaccaaagctttggaaagagagagctcagagaggttgaaggtgctcaagagtgtacttctgagtgaccagttacaaatgatcttggtgcagatcttcaaagggcatgattttgtctgttattgattgattgacaaggtcttgatctgttgcccggtctagagtgcagtggtgcgatttttgctcactgcagcctcgacctccaggcccaaatgatctgcccacctcagcctctggagtagctggcactatgtgtctgttacttattttgaaatactctagaaaaaaaatgaattggactatagatgaaacaaatttggcgtaacgttgctaattattgaagctgcatgatgggcacaagggaaatcattatattgctttctctctttttgggagtatttgaaatttccccaaataaaaagtttaaaaggacatgtaccaaagaataaagaaaggacaaacatccaggatgcatattagagatatcactactctgtaagaagttttttatggtgtgtgtgtgtgtgtgtgcgtgtgcgtgtgcgtgcatgtgtgctctaaaccagatgatgaaggaagggtagatctgctgcttagaattgaagcattcctgaatgtagagaaggcagttctgatgctttgctgtcagtggtggtgatctcttgtttagtgaaggtaaagggtggcatggactttagtgaggagcagcaaaaacctgagatccatgaagaggtaagaggccatctgccatcctcagggaatctaagctgtctgagatggcactagagggcttggaagagatacccagaccgctgtcagggtctttcaggagtcccgtccaataggagaggtgggcaggagctgatgtcctttctgattttcccaagtgggaattctgtgacaggggctgtcttgcccagcattgatcttgaagcatcaaatttagaaaaatcattagaaggatgagaagcattgactgttaggacccgacgtgggtatgttaagaatatcatgtcagactaatttttttgttttgggatgctagattgacaggaagatgtagtaaacttagtatagctgacttcttcaaggcatttgacaaggtctcttgtgacttcttgtggacaagatgagctgaaaactggtggtgctgccatatctaaagagttcatggagataatcactggtcagtctagaccgctgctgttttctgtggtagccacaagccacatctgggtacttaagtaaaattaaattaaattaaaaattaagttcctcagttgttctagcttcatctcaagtgctcagtagccacaggtgaccagtgactgctgtattggacagcacagaggtagaccacttccatcattgcaaaagggtctgtgggacagcactggtctggagcaatggttctcatccctggttttgcatcagcatcacttgaagaactttaaaatggtaccagtgccagagagtctgattagggcagacctaggaagtggggctgtgtagaggcttccaggtgattccaatatgcatctagggttgagaaccattgagctaggaggctttgaatggtgtctctctcagattttaggccttgttgctgttttattcttcttgtgaatctgttggtttgttcaactaacatttattgtgtgactatgtagacagcattctcttaaattttgtggatgatgtgaggctggccagggtcgtaaatacttaggggcatagagaatcattttagatagacccttttcacttgaagatatgtgatgagaggcaagagagttgacatgctgaatagaaaggtgaaatctgatgatcttgaacttaggtttggagtacaaattgcaaaaataccaatggaaaagttttaaaaagaatttaaaaattgaagctgatgaaaagcaaactcaacataggcaataatagggtagttgcctcccacaagctcccacaacctcagattgcagcaggagcctggaaggaaagttgagaatcttgctgtacaggccacactgtaccagaaacgttgtagtcacattacctcaagaggagtatagacagcccatggagggattgacagcacactcatccctcaacatttgtgatgataaaccccttctttacattctgcactctttcggagagctcatccattgttttcctcctaaagctttctctcctgtggaactctctatcctgagctacagacatatatatccagtcacctacaaaacagcttctcaatgccttgcaatcttctcaacctctgaatggcaaaaagggagctcatcctttctgcctttgtgtggcggtctcgccccagcccacacttgctgcccttccaggtgttcctctcgctgcatgatactgccaggagacctcaggaccatctttcacatctttcttggcttcttgctctgcctgtagttctagatctatcttcgaggcatttgacaaggtctcttgtgagttcttgcaggcaagatggagctgaaaacagtgtgaactgaaaacatcagatggattcacaactggttttgccaccatattttctgaatatctttctgaatctttctgcttctctctgtgatcactgccggtactctcatcatctcttagttttctggaatagtctcctgagcattttccttgcctgcagttttgttcctctccaaaccattgtaggtagagcaatcttgataaaataaagccatccattttattccagcagtcagcacattttttctgtcaaggccatagaggaaatattttggctttgcaggccatatggtctctgttgtaactattcacccttgccatcaaagcataaaagcagccatagacaacatgcaaacaaatgagcattgctgtgttcccataaaactttatgttcaaaaacagatcagatgtagggccagatttggcccatgggccatagtttaccaatccctcctttgttcttttgtttattgttattgacttcccactgcccttaacatcgagtccagactccatgacaggggctccaaactgcatgattggtccctgcctttatgaccagcctcttttcttgacatctaccattacactctctgctgcaggcataatgaactttgacttcttgcagcatagtttgcttttcctcttttcttctctgtgcctttgcacgtgccgtgttctttgctttgtcatcccccacccccaaatacttaactcctacttagccttcaagtcctgatttagatgtcactttttctgagtttttcaggacccaattctagttcccccaggtgtagattagactggccttcttccaagtctggagggatgatgtgttacctcttgctcttaccacactgagttctatttacttagcctaaccagagtacaagctccatgaaggcagggatcaagatgtctttttcactattatagccacacagtaggagcatatcagatacattttaaatgaatacatgatgaggagatcctggagaaaagagaactctagaggatgttgtggtttttaaatatttacaggacaagaagagagagttctgtaaagagcaagaacagagggaagctcagggagacagtgttcgggctgatagaagaaagctgtgcccagtggagcagattagatagatagggagtgaattcttgaggcgagtatgaatccttcactgaagttttcaagcatcagttggattcagtgacttttaaatcaaatgtggctgattggtctgaagttcgaatgtagttatacacaggacatgttgttgagaatcttggttggcaggcttccaggtgtagacaaagtgaattattttatttttttcttcctcagcccaaggcttattgatatttgcggagttgatttctgcgattaagaggacgttggctcgccttctcgtgatcattgtgagcctgggctatggcattgtgaagtaagtactggcgtgtgggaaaaatgctgggtcccagcccagtgattcagtccgtctacattatgacctttgtgaaaatggaacttctaagtattgtagtacaaatccctttgggaaaaatctacaagaacacatttttaaaagatttccacatacttgctattttatgttatcttccaataaagaccctgaatttttatttcaataactttatatagttagatgaataaataatcaactttaaggataatggaaaatctaaaataattcaaaccattttcaaacccttttctgttatttagacagtatcattaagcttttatggtcctatctgagtgttggaagagagagtggattaaacaccaagtcagcaaaacttctgactgaaacctgtctgtccctcaaggactctgcttctggaccttctccggcgggtcttttcctcctctcacctgtgaatcactgggcataactatgggagaacttgatttctatccttgttgtgttttttcagacctttcttcctgcttctttcctaaaaccctgattcccagaagctcactcttcaggctgggtcacctgctgcatcttgttgtggtcactgtgagcttccagaccctccctcattcctcagctctgtgggcactggcttcacaggtgtcgtcctcagcatttcatctgtcagaaggccatggggtctcaggagccatgtgcatgaccctttaagtaacctgacctcacctccccacctctcctgctcttgcccatcaccatgtttcagctactgattcccagtatcattttctagactttattatatatataactgcaccctcttcaaaatctcaattttaagcaatccacttttcaactgtcaacctcctctgtttcctgttactttctttaacatgtcggtgtcagtctttttcgactatactttggcctccagccttttgaccctggcaccttccgttgtccctccccatcttatatccttaccttcttccttttgcttggattccctggtccagcaggacattgacacccaaagacccctgcctttctctttgtcaaccttcttgacaaaaccccagccttgctaagtccagctttccttctgcctcaggctcccacccgagcaggggaatttgcccaaaaagagccctggaccacactgagggggcctacttgccattcatgaccctaaacttcacgtgcaccctcagtgctgctggcagttgtactcaatccccttgccactattttctcactctcctgtctgcagaagaccattttacccctttctctcagactctaccctgaccttcggtttttttttcactgaggaagtagaagccatcagaggggaattccactgcatctgtgcccccagaccctgtcatttcccccacatctggaccgcatgaaccactttcctcttcttgatagtcacgggccacccctgcctttgtgcccactcaactgtgagggaaactgtcctagtgctcggttttgttttttcttgcatcgtcagctttcctctctggtgggtcacccccatcagcatctcgttatttctaccattttttaaagtgaagccctccctccaccccacatggccctctcctccacttctgcctcattcacctttcccctgtgcagcataacttctcacatgagtagtctgtacctcagcctccccagtattgctctattgagactgctcttgtcaaggccaccatgacctcacctgccatatcacatggccctgctcagccctcgtccagttgtcccgtgagcagctttaaggagtgccagctttgcctggtttctgggagctcgtcttccatcctctcacatcactggctactcctccccagcctcctctgctgcaccctcctgtgttcctgagctccggcccccgggggcccaggctcaggcctctgctctgtgactcgcacccctaggctctcctcctgtgtgcgtgcccgtttgcttgtgagctggggattggggagttagcaggattttatcctggaagcctttatccccctggacttttattggagattctttctcaaatgccttttgtgttcttagtacagtgtaggaaatgaaggcctcttgttgaggaatcttgcagtacctttcacagctctggttatgaacatcagataccaacaggtgcagtgttgttactgtgaaaggaatagaagattaaatgaatgggtacagatacaaaccctttttaaatgaatcccttcactgttagcttgctcggctcaactcataaagtgagagcagtaacagttctggttatttggaggttctggttagttgattataatgaatcagaatttagattccttagattaggtaaatagtcttaattaaatatgagctatgaccactaacttaattttttacttatattttgttttgaattgactatcttaaatatttttttaaaccagtttttttcttctaattactctgagaggagggtttttgagcagccttaaatgtatgtgcaataaattctgatttgcaaatatcatgaaattattctattttaaattattaattgcaaaaaccaccatctttgtattttcccaactcaattatattttgaaagagccaaaaaaaattttttttgttgtttttgtttttttggagacaaaagtctcactctcgctcaggctagagtgcagtggtgcgatcttggctcactgcaacctctgcctcctaagttcaagcgattctcgtgcctcaacctcccaagtagctggcactacaggcacgagccaccacccccggctaattgtttgctttttttggtagagaccgggtttcaccacgttggccagtttggtctcgaactcctgagctcaagtaatgtgcgtaccttggcctcccaagatgctaggattacaggcatgagccactgcgcctcgcccaaaaatgttattttaactctttcagtttaaagaatgaaaatgaaattctgttagcactcctgttctggttaagagctggtgatcagaaaggaggtcatggacttccatctcctcatgtcctgctcttcctctgcccaagtcatgagacaagtgaattatctctgaaaagacagacctcaggaagaattaagttagacttctcagtggcacttagaagttggcatttaccttcctagatttcatcaacctactcttccattctatagaaacagtacctgaattatattcattctgttgcttgaatttcagcagcaaaatcctctggcacctttgtggcctccaaatattgcttcaaaggcatcagtatagcttcaggtcctagagaaagagaccctttgttcctgggcctgtttcctaaaacaaagtacctcagagccgggaacagactgatgtgattagatagtgacttcctggtattggaaatggtgccagttactgtattcaggtgcattttactcacccatgctttttcttctttctctgtttcctcttcctgattccaggcctcgtttaggaacagtcatgcaccgggtgatcggactggggcttctatacttaatctttgcagctgttgaaggcgtgatgagagtcattggggtaaaaactacattattctaccacccctttttgttattgctgtgaaatgtggttttactttgtatctcctgagatgaatttttagatagaaacttgtgaaaaaggcccaatttgaacttttcttctatgggatgtttcccttttaaaatacttcctgaaaggcaaaggctagacagagtgcttcttaaaatgatatgactgattgcgaaggcaccgcttgatatcatcccaggtatcagtcccatcccagaaaggttcatggttgttcttcatagagaacatttgtctttatcattatgcagctggtataccttaatatcattcttaaccctggattttaaaatgtatcaagtgaacagaaagttaattacacccttcaggtatacatacagtacattccatcactcttttaagtctcatttgtttattcattttctctgactcttggggactagctattttgaggattcagtagaccccaccattggaaaagcctagaggaagtgatgttcaaggggaagatgactctggatgtgggcagcagcactttattctctagagaagtatcagtatttatgtctgcaaagacccctagatttctagcttcagtttttttacttttattttgtgcggttttttgtttggttgtctcattggttgattggttggttggttggttggttggttggttggttggttggttggttttggagacagggtcttgctctgttgcctaggctggggtgcagtggtgcagtggcgcagtggcatgatcatggctcactgcagcctccatctcctagacttaagcagtcctcccacctcagcctcccgagtagctgggactacaggtgcaggccaccacaccagactaatttttgtattttttgtagagacagggtctcactatgttgcccaagctggtcttgagttcctggctggcctcaagtgatcctcttacctcagcctccctaagtattgggattacagatatgagctaccactcatggttgcttcagttttttgaataaatggttgaggattgagtgattaagaagcttattatatcttacctaatccaaagacctttgtcattttacctaaaatgtctttggattagctgtataaatcagatcataaatatttatccaatagtgctaaaaagcctcattcttctccctgttgtctttgatacacctgcattctgtgttagatgctcttttagtctttgagtatatttatttccacgtttgtatgatcatgaagaactctgcattcatataataataataataaatacttgccagaaggaaatagaaaagataaatatcccacatgtaaatacaccatatatattgtattcctttaaaattgtacatagctttgtggcacacgcctgtaatcctagctacttgggaggctgaggcaggagaatggcttgaacctgggaggcagaggttgcagtgagctgagattgcgccattgcactccagcctgggcaacaagagcaaaactccatctcaaaaaaaaaaaaaaaattttacatagccaacatcttagatagtgacttttaaaggtgactagtcagagtaaatgtctaacatggatcccccccttcactttttctgtgtcccttcacaacacagtcaggaaagatcgggagttcgtttcattaatagccctggctgtcggtttggtatggaggagagagattgaaatggctggtgttagtgaggttggggacacgatgctttttatttgccattacataatacagttttatgttgctatcatcacataaattagcacttgttgctatcaaaaacaggtcatttccatgtgcttaaacacaatcctcttaggaaattaaatcttttatgtggctttgtaaagtaatgagataagctaaattatttttcttcatcaaatgataattgctatagtgcaatgaaagtgttacattcaggtttcttcccttatttttatctttcagggttctaaccatttagctgttgttcttgatgacattattttagcagttattgactccatttttgtgtggttcatatcctttactgtgtccttcaaaatagtttgttgtatcatgaaaatcagattacatgtaatttgtaataacaatagaaagaaatacagttatgcatttttgttaccttaatacgagggttcacttgaaggtgaaaaagtagcaactacccaaacaaggaatatctttattttttctatgtagtttagcaaacagttagtgctcattctcagtatgtgccccatactgacgaggcatgggtgaaaaagatgtccctaaatttaagggattcacagtcttgtaggggagacagatacataactggcatcagtatagcagtagtagttgccatcttagagaggtgctgtgccaacaggggaagagagaagttaatgctggcataaaaatcaggaaagacttcacagagatggcaacatttaaattgagactgggaagacaagtaggggtttactattaataaggaggtaattagggaagaggtattctaggaagaacggaggggagcaaatggttgaagcaggaaaacagagggggacagtggcagaatgtccagggaagcctgcctctgggtggacatgcatgggagagccttggcaggcggttcagggaagggtggcagggcatgctcaagagctgagtgccttccagaggcaggggctggagaggaattgaagctgcacaggtgagtaatgtgatgaaacctgtgtcagtgagaactctggtgacagaagaagatgacgtgggaaaggagagtctagaggcaggaaggtgagtcagtattcctttgcctttgcagtggtcgaaagaagagatggtgagggtcagaagtagggtaggggatatggaaagaagaacccacgtgatagacttgctagaaatgggtggaagagagcaggttcagagaaggtttaggggctgcagccatattgcaggagaagttttagaggcagtaagtactggatcctcgagggtcttctctgattcgatgactcaagttgagtctggggaatcccattgctttttcttcatgggggcacttgtggaaatgggaggaattctagagaaaatgtgactgaccagagtggaatgcagggttatgcatatcccagaacattctttggatctgtttctattatatttatgtcctctttgaagtgctttcctgttagataggtttcattttttgccaagttctttgtttcctctgtttttgatacttatgtcttttagctttttgacattaatttttttaaaaaattgtttttcttgtatctttttccattttctcatctatgtgtctcataggaagggccagagggcttggatctcatcactatgccctagaaggaaggtctcccatttttcaggtgtgctggcaaatgtagcactcctcataggcttttctgagccacttgtgggttgttttctaagctgggtctacctattctttaaattccctgtttgtgaattctcaatatgcttccaacttaaaaagcctatgaagagtgctacaaacctaaaatttgtaattcattgtcctcactcgtcaaagcagtgattcttaaccttgtttgggtactaggatcagacatgccttggaaaatctgctaacagctgtggagcctctcttcacagaacacagacacaaggagctttgcatgacagggcagttaaagacttaccaaattatatctgtggacatcttaggagtctgaggagcctacttagggaataataactgatctaaagagttgtttctgactgaacttgtttaaaaaagcatattctactttgttcagagctgctagttcagaatccaagtttgttgaataaaattatagttaaataaatctgattttctcagagagtaatataaatatcttcctctggtgtcattttcatattttctatgttaaaaaaaattaaagacattcatttgctaaaaatgtgaagtctgttcctcagttctacatgtgagcagtgttccagtgataagagagagtactcaccacaaagtctgtaggtcccacaggactgcttgttaaggggactctcctgccttgagaatgggcaggaggtataaacataccttgcactgggataggcagaatgacagtggagatgaacctgcctgttgacctcagattatctttagatcttactgtcttattttctgtcattgtgtgtttagaaaatgagctgattatatctattcaatttagaattgtcttgtttctaaaaccgtgtatgcttggaactttaacaagttagggagtatggtccttcattcaattaattaagctgcagactgcgttttttaaaaaataaactatcttttctggtaatttatagatatttatttcaaagatttcttgttctttttttttttttttttttaagacggagtctcgctctgtcaccaggttggagtgcagtggcgtgatctcaactcactgcaacctccacctcccaggttcaagcgattctcctgcctcagcctcccgagtagctgggactacaggcgtgcgccaccacgcccagctaattttttgtatttttagtagatacggggtttcaccatgttggccaggacggtcttgatctctttatcttgtgatcttcctgcctcagcctcccaaagtgctgggattacaggcgtgagccaccgtgccctgccgatttcttgttcttaaccatccacaaggtagttcattgggaaaaacacttagtaatgcagcttggcagaaaattccaaagaaaagcagctctgatggctctaatccatctggatttgagtgggggtaatttattacctttatgaacagcattgactttcacacattccagtatctgattagtcagattggggtaggaaaataaggaaaacagatgaaagacttagtttgcttaattatgaatatttataatgaaaatgtttcagggaatagtcaaagaaatctaaaatgtgaaagatctttagtgtttcatggtgagacaaaggaagtctagtgtctatttctgcatgagcctgaatttgtgaagtttgctgtcagattgctctttggtaatttttatcactaaaatgaaatgtctgctttttctatacagaaagatagcagatttcctaaatgatataaatgacaagaaaaaaaaaagcagaactaaatacgtatacaattgagtgctttggaaaatgaccctgcttcctttgattttgatgaacttaatataaccaatcctctaagaatctaattctaaagtcataggaaaaaaaataggctgaaaaattcaaaagccatagccttagcctttctcctgtggcccttcctcccctttttttcttcttgtttctctttcgtttctcttttcttttctttctttctttttttttttttttttttttttttttttttttttttttttttttttgctgttttgctgcaggtgagtgattctgatcttgttcttctggccagcctccccctctctctccttgactctggcttgtgctggtggatatccttttcctaccacagcagcgcgctctcacttcaggatcagaagggctatttgttttcatgactactttccttccatggcaggaatgatttacactttacctaaatttaacagtgtcttggtaagtggaggcttaggcaatttcaaatttactttttattccttagcttaaaaacatttttttaaaattattaaaccagaccagatttttttttaatcctagaaatttggttttagtcaagaattgttaaaagtatatgttttgatgtatttaaggaataaagtatatttgcatttttaaagttctcatagtaacctgaattggttgtattgtattgctttagaaattgatcttttgtaatttgttggtcatttagaagattaaaaagcagttttgtactaaagtactaaagtagctttagtactaaaatgaagttttttattaatgacatatttaaaatttttaaaacttgccacatccattctgttgctcagctctgttatttttagtgtttggttcataaacaaagcttgttggtctgctccagaggaaggaattctcatttaagagcagagagagctggcttgaattctgcttcactgctgaggagtcagtggaaaagtcttctttttgcttcttcatccttggcaatgttgaacttcacctgagccctgtgctcctggaaaacagccaagattaagacacccccctccaaacccccttccctatttgtgttccgagaaaagacttacctcagagaacccccttccccactggacttaggtaagactcctggaggcccgcttgtctacctatgacaaggccgggcacagaccctctgagttcccattccttgcatcacgaataattagatgaactctttatatccactgatcgatctgaacaaaacactgaaccaaactgtaagtattcttcttcctccaggccataaacgttgactcaccgtcagcctgagccaatacacagccctcccgagaatctgcagacctcaggaaaagacattccctcatcggtgtgtctagtcccaccactcactccccacacctactgctttttatccttgtttgctgtgctctataaaagaaaaacccttttctgcctgacctctgagactcttgcagatcttatagtcgtagtattcttcctattgcagtaatcctcccccgttgcagtcatctttcaaataaagcccttaactaagtccagatttgtttcatctgatgaattttagttttaaaatttataaaatggaattggtagatgacctaacctcttaattatggttattcaaataataaaatgagaatagactggaaagatcaaaataagatagaaatagggccagaaaagcacaagccaaatggcatgtcacaatgtgatctgtaaagagtgtctcacttagaggggttttagtgcgtgcactgctctatcccgtgttgcgggtgcatggcattggtggaacgcatcatgggtcttccgtgttttttccttggagtttgttttcttagttcagacaatggtaaattgtaaaagaaaatctgtgataaagtataatgattgtacaatattggccaagataacattttctgtgttttcattagcttcaaattttaggaactgtatttagcagtactgactttgggaacatagtagaagattctgttttttttttttaacctcttattattacttggaatgtttttccttaacttttttcacatttttattagtttggcacaaactatgaagaccctaaggctaagaaagaacactgtgaaattttcattatatagacattttaaaaatactctgatctttgctgtgctgggtaagctatttaatttttcttacagtaaattatcttagtattgttatattccttcaaaggtgactttttgtgtgtttcagcttctatagtgtttatggggtggacaactaagacatttagaattgcaaaatgccaatcagtaagtataaccttcctatttaaacagttatttttatttatactattttgtagaattttgaacaatttagtttatgcttgcaaatagaggtgattttaatggagatttatgtttttactttgaactattttttacagagttataaaaacttttggctgggcgcggtggctcacgcctgtaatctcagcactctgggaggccgaggcaggcggatcacgaggtcaggagatcgagaccatcctggctaacacagtgaaaccccgtctctactaaaaatacaaaaaattagcgggtgcctgtagtcccagctactggggaggctgaggcaggagactggtgtgaacccaggaggtggagcttgcagtgagctgagattgcaccactgcaccccagcctgggcaacacagcgagactccatctcaaaaaaaaaaaaaaaaaaaaaaaaacttttaactcctccaagtgagtctgaaaaagttcctccgaaatctccttttcctattatgcccttttgtcaagttttttttatatattttgaaaataaattctcttcctgtataccctaacaggaaatccttttcttcctgcacaccatgaaattgagtggtttgtatctagatggactagaaatcttaagactggcatgtttctaggatcgtgtgttcagtatgggcattcgagcgatgttttcttttttttttttgagatgagtctcactccgtcagccagtctggagcgcagtggtgcgatctcagctcactgcaacctccgcctcccgggttgaagcaattatctgcctcagcctcccgagtcgagtgatgttttctatgggttctcatgttggaagaagatatattcttagacttagaatatgaaaggtcctcttttggggatttgttgagatttggagctagtctctagtgccatataaataatcacaaaaagccctctgaaaatccagagcttttgctgccttagagacaatttaataaaagaagaggctgggccttctgaccttagtatttgccatttgaaatcctaagtatatgttttgcatcttttgattttgaaatctttctgttaacccaaaaattttatggcagggaatatttgtaacattaaacaaccctttagaaacattttgaacaatataggtttcttgaaaaaatatgtgcttgtttatttggaagacttactggttggaaagatttcattagtacttgtcattgtacattatttgaatgggaaacctatatgcttatcagaaaattaacgtttcatgcttgaattgtccttcttttaggattggatggaacgctgggttgacgatgcattttggagcttccttttttcgcttatccttattgtaatcatgtttttgtggagaccatcagcaaacaatcagaggtacctaacataggaaatttcaagtcgtcaaggatttgttgatcaccttctatagtgtcaagaacacgtttatagaaaccaggagaatagtcgttgcttttaaggagtatacagtcaagtagggagataagcaaaacaaatgcaagacagtgaaaaaagagatgtatagactagtccaggggaagatggaagagggttgaggaagacttcttgaagcgacagcgcttacattacaccttgaggaaaggaataggatagcgaatgactgaactgggaaagagtgtccattttctggggtggtgggaaaggcatgagatactttggaggccagtgagacatgcagtttggttaataccacatactcatattggagggagatcaagctggaagggagaagtacggccaaaatgacaaaagacttgagtgtcaagttcagaaagttgtacttgagactgcatgtgataggaagcctcagcttccttgctttatccctttgccccaaggagagaacttaagttcttgtccatcctttaggaaaaaatgaaaaagtatgtacagattcaacatcccaaatcccaatccagaatgctacaaaatccaaaactttttgagcacggacaggatactcaaaggaagtgctcattggaacattttgaatttcagattttcagatttgggatgctcaactggtagggataatgcaaatgttccaaaatctgaaaacatccaaaactcaaaacacttctggtctcaggcattttgcataaaggctactcaacctgtatcagtgtgtttctcctgtcctttttaaaattatacaataatacatatatatatatatatatatatatatatatacacacacacacgcatatacatacacatactgttctgtaccttcctgtttaaggtcacgcctataatcctagcactttgggaggccaaggtgggtgtatgacttgagcccaggaattcgagaccagcctgggcaacaaggcaaaaccctctttctacaaaaaaatacaaaaattagccaggtgcggtggtatgtgcctgtactcccagctacttgggaggctgaggtgggaggatggcctgagcccaggaggtggaggttgcagtgaactgagatcatgccgctgctactgcactccagcttgggcaacagagccagaccctgtctcaaaaaaaaaaaaaaaaaaccacaaaaaaaacaactatctttccatatcagcatgtatagatctaccacattacttttaatggttttatggcattttataacatgaatgtaatataatttatataagcagtccctggttattagacattttgtttaaaaaatagatttttgctattatcaataatgttttcagaatgctgttggacatcatcttggcaaacttttgttagtgtaatgtaaggtaaatgaatttttactttaatggctattgccaaatgaccctccagaaaggttgtcttgattcacactccatcagcagtattttgagcttatcaccctaggaaatgtggcccattcagtgggctttattttcaccaatcagattagcaacttttctttttttaggaaataaactgacaagtggtgggcagagaggtaaacctgacatggagaaagaaacagcagaaagttcccttccctcaacattaaatattgcaaaattgctttgcagaaagattttacccacttatgcttttacaaacagggtttgagagctccagtttcacaatttcttaatgataattttagctaatttgaaagtaaaataattacgttttcattattttaaagtataagaaattttttaaatgtagattttttatacaatggcttttagatataaactgaaaattgaacaagtttaaacatactagtaaaactactccttgtttttgctatagatatgccttcatgcccttaatagatgattctgatgatgaaattgaggaattcatggtaacttctgaaaatttaagtgagtaatatgttttctttttaaatgaccattgtacatattgcaacagaaatattgtacctttacccgtgatgcaaggtcacatatattgtttttttctataaaatattttaaaaacttttatcttcagaaaccttattttggtagacagtaacagaaaggtcagtgatgaaattttcaagactattgtagtttgagcttgttactcatttcgtaaaatgttgaaatagttacactgtttttcataagaatggtttgatgtatattgtgcttagctgctaaataatgttcatcttgatgattgctaagtttctttgagttgcatcttcttgctctttttaaagtatgcacacctgtaatttctgatcatgctgaaagcatttctacttaaagttttaatgatattttcattctttctgttattttctacatagcattttatcattttattaattttattgtaatctaattaagcatctgttaaggcaacatcaataagtaactcagatgttgagggtaattttatctttgtttcatttttttgtcctcttacttttgcttctcttagtaacattctttttcaccttctgttttggttctctaatacatcgatgaaatagaaaacaggaaaacaaatagaaaaaaatcatcaaatctaaaagtaattactttgaaaagcttagtgaaaagtggcttaacctctagctactctaaaccagaaataaagaaaaaactacagtggacccttgaacaatgtagggttaggggcaccaaactcctgagcagttgaaaatctacttataacttttgactctcccagaacttaactactgatagtcaactgttgaccagaagccttactgttaacatagttatcacatattttgtgtattatatgtattttatactgtattcttacaataaagtaggtggagcaaagaaaatgttattaggtagaaggaaaggggaggcagcaaaggcagacatatgtggtgtaacttttattgaaaaaaacttgcatgtaggtggacctgagcagttcaaacccatattattcaaaagtcaactgtagtacagtaagacaaacttctaatgttggaaatgatagagaggacattactatggtaaaaaaggtaaataaggaaatattatgaacaattttatggtaacaaattgggcaatctggatgaggcagacaagttcattgaaaaatacaagttcattgaaaaatacatataacaacccaattttaattctaaccctgtgccactaagtctgaatagctctgatctattagaaatttaaaaaaaatttttttaatttaaaatcttcctatgaagtaccaggcccaaatgattcactagtgagtcctttcaaatacttaaggaagaaatggaagaaatattctaattttacacaaaatctttagaaggtaaaggaggtgggagtacttaaaaggccagtacaattgaaatgccaaagtctaacagacgttacaagaaaaaattatagaccaaaaattatagaccacttatagaccaatatatcattaatgagtgggcatacaaaaattctttaaaaatattagcaaataaaatctagcaaaatatagaaagacaatcatgatcaagtggactttatcccagggttgcaaggctgttttaacattccgaaaatcactcagtataattcatcatattaaaatagtacaaataaggctgggtgcggtggctcatgcctgtaatcccagcagtttgggagactgaggcaggcagatcacctgaggtcaggagttcgagaccagcctggccaacatggcaaaaccccctcttgactaaaaatacaaaaattagccgggcgtggtggtgtgtgcctgtaatcccagctacttaggaggcagagacgggagaattgcatgaacccaggaggcagagtttgcagtgagccaagccactgcacgccagcctggacaacagaacaagactctgtctcaaaaacataaataaataaataaaaataaaaataaaatagtacaaataaaagaagaaagaagaaaaaaatgacaaaagtatctcagtgggtacaaataacaaaagcctcagcaaactaattctaaaatggtatgaaaacactccacagttaaaattctatttaatggtgaaatagtgaacactttcttctcaagattagggataaagtgcaagggtatgtacataccactttgattctgcattgtatgggaggtcctacctagtgcagagaagcaaaacaaaactccaaagaatgtgaaagaaagaacatgtggaaaggaggaagtaaaactgtgtttattcgcaggcaacatggttatgtatggaaaaatcccaaggagtctaaagaaaagaaaaagtacggtagaactaagtgactgtgacagtcatagggtatatgtccaatgtacagaagtcagttgtttttctacatattaactgaaaacaattgaaggtgaagtttaaaatgttatttaccataccttcaaaaataaaatacttggaataagtttaatgaaaaatacgtaaaacctctgcaatgaagactataaaacaatgcagagataaattttagaataagtaaatgtagagatagaacctgtgtctgaattggaactctcagtattaagctctcagtttcccagtctgataaatagattcagtgcaatcccaattataattctagctgacttaaaaaaaaatacagtggttaagttgattctaaaatgtatatggaaaagcaaaagacgtagaagatccttaacattcttgtagttacaacatggatgaaccttgaaaacattatgttaagtgaaagaagccaatcacaaaagaccacatactgtataattttgtttatatgaaaggtccagaacagacaagtccgtagaggcggaaagtagatcagtgcttgtcacaggttagaggagggggaaagtaaggactgactgctaatgggtttggggtttctttgtggggtgatgaaaattttccaaaattggagagtggtgaatatctcaaatctctgtgaatatctcaaaatctaactgtacttcaatatggtatgcgaattatctctcaataaaataaaattagtggatttatactgatttcaagacataattatttcagattacagcaatccagacagtgtggtattggcataaggatagagaaatccatcaaggtagtaaaatagagtccaggaataaacccatgcatgtgtggtcagttgatttttgacaaaggcaccaaggcttacatgaagagaggatagtctttttaataaatggtactggaacaactggataaatgtgtaggaaaaaaaatcattagacttttgttgcacatctcacaatcaattcaagatggatcacagacctaatggaaaagcttcaactgttattcttctagaagaaaaaaggaaaatattttaatgacgttggatggggtaatttcttaggacatgaaaaacagtaaccattaaattaaaaaatgagactttatcaaaatttaaaatctatgctcatcaggaagaatttaagaaaataagaaggctagctacagtgggagataaaatattctcagtacatatatatctgacaaagggcttatatccagaatataagtagaattcctgtaaatcaataaatgataacctatgttgcaaaaaatgagcagaagactagtgtagacacttcaaagaagacataggaatggccaataaacccgttaaaaggtgctcaatataatcagtcatcagggaaatgcaaattaagaccataatgagctgccaccacacatctgctagaatggttaaaattaaaaagtctgatagatagcatgaactattggagaggatgtggaacagctggctctctcatacagtacttgaaggaatgtagaatagcatgaccgctttagaaagcaatgtgacagcttcttacaaagttaagcatatacctaccatacagttcaactgttccactctaaggtttacccagaaaaatgaagcagatgtctacagaaacacaagaatgtttacagcagctttattcttaatagtccaaaactggaagtaacacaattatctacaaacaggtgaaaagataaataaattgccatatatccatacaatggaatacttttcagtaataaaaagtaaccaacactctataacataacttaatctcaaaaatgtttatcttgcatgaaagtgttgcatgatttagatgattatctaaatcagagcagtggttgcttttggtgaggtggggattgaccagaaaggaacttaaagaaccttctgtgataatggaaatgttaactgtattgattggcatggcagttactcaagtgtatatatttgtcaggtttcttcagactgtacacttaaaatttgtaatatatatatatatacacacacacacgcttcagtgttcaaaaatcactgtattccccttctaagagaaatgttggggttttgaatgtcccaggaaaacatttttggattgaggaacctcatttttatttattacatcagcttatgttataattgttctagtttatggagaagcaatatttgcaaattagtgtaataacaaaagtgactacttactgggcatagattgtgtgtcaggcattttatatgtgctaacttgttcaatggtcactagaactctatgaggtagaaattattattatccccagtttatagtcagaaacactaagtcacaggaagttaattgccttgcccaagattccagtgaggcagacacttagcctttgctccactgaaactgcaaacatgcagaagagccttggtcaaatatgaaagaaatcttgatctttcctatcttctttatgccatacgcacatttcaaaatttgtacatcagggatgtaaagcatacccaaagatgtgttttgttcttgaatgtaccatgaatcctgaagatttttaaatccataaactttaaaataattgcaattaaggaaatatgtatgcatgtatacttgtttaaactctaaaactaggattcaaacaagaaacttgaaaacctggtggttctgacaaatagtttccaaaaatctgtgaacttttttcatatatttttcctacattcccaaatggtaaatccagcatcctgcctaaagtttccattattaaccctccatttctaaaaagatatagtattttttcttatcagattattaaatttctaaaggaaaatattattttgtgattttatatatatgtttataatgtctctcgtagccgaaggaataaaattaagagcctcaaaatcagtttccaatggaacagctaagcctgccacttctgagaactttgtgagtatggtatatatttagtacaatcttagtcttccttagtcttcactactttagagagctatacgagtgtcatattcattgactctcagaagaacagtttttactaagattttgttgttgttgttataaaaattagtgttgccaagtgccaagtagcaatcctggttgtccataactgaaataccttcattgtagatctcacttctcacctgctgttcctaggccagcagcatgagcatcatctgggaacttgttagagatgcagagtctcaggcctaccccggacgctcctgaattggaatctgctttttgaaaagattccatagcctgttcatctgcacattcgagatgggaaagctttgttccaataaaagcttgtgttaacttttcagcctatgaaagtgatttttgaagccattttaaaataacatttgttatctgttggtaaagaactttatgtgttacctacacggttaccaaaattaacagattttttttttttttgaggtgggaagcttgaataaaattgtaaaacattgggcagagatgagctaaaaaatattttctgcatgttatttatgcataaaaatgtttttgaagacaacaatgtaaaatggaaatgtctatcatatagttttatactttccttataactatatgtgctgtgattaatactatgtaaaaatttatgtatgcatatataagttctgacacgatagataatatgtgaagacattttttatctgttagatttggcagattctctaatagattagacagatggataaataaacaagatggataacatagactggagggatggatagaaaggatagatggatggataaaatagatagataggtagttagataagatagacagacatagacagatagctatctcagctgacctgctttccttttcttgcctcctgtagggagatgagcataaatgagtgatacaaataaataggcttttctaaagttagaatatttgagatcaggcccggtggctaatgcctgtaatcccagcactttgggaggctgaggcaggcagatcgcttgagctcaggagttcgagaccagcctgggcaacatggtgaaaccccatctctactaaaattacaaaaagtaggcggatgtggtggcatgtgcctgtcatcccagctactcgggaggctgaaacaggagaattgcttgaacctgggaggcagaggttgcagtgagccaagatcacaccgctgcactccagcctgggcgacagagtcagactctgtctcaaaaaaaaaaaaaaaaaaagaatgtttgtattatcatcattttttttaaagttataaactcattatataagaactagaacaaattaggaggcataatgagtgtggcaaagcaaaaattcaatatccttgctattttctatcttacaaatgaactttgtgtttttactgtgatttctcaggacaaaaaaaataatatttcatacatccaactaaaaccaagaagtgtagaaatctgaaatctaatttttgcgtgtgtaagaaaacagtggcataatttctgtatggcatgagtgccaacttaggacatatgtagaaactaaaagaatgtcaaatatttacatttaaacacttaagttatatatatattctgttttaaaaattctgctgtcaggtgatattaagcaaatgctaagtataaatatttctacaggatgaagatttgaagtgggtagaagaaaatattccctcttcattcacagatgtgtaagttatcttctgttacagtttgattgtaaattttaggctgtagtttaaaagggatcgttctcatcctttgtcatgtgcttttcaaacctcgtacttgcatgtacttgggtaagcccctatcaccagtacatggcccttacagaactgcaaagaaaacaaaaccctggcttgttttgtttttcacgatacagcaaccattttaaaactagtggcctctaaccaactctagctttttctgatctgccattatcaggatcatttcattttttatctattatggaaaacgtcaaatgtatgtaaactttttttttttaaaggtaaccacagcaccatgtattgtgaggaggcttttggaggaaaaacatgagtataggaatcccctctggaaactttgagctattcaggatcctctttatctatgttctgtttgacacaagaattccagatagctgtttccatagtgaaaaatagaatagccaagtatgataaaatttttttacatattggtctttccctccctagcccccatctggtttctgtttagatagcttctgtgtactatgatattccttttgcctgaagaattgcctttacatttctttcttgtagtgcaggtatgctggtagtgaatctgtcagatttttgtttgtctgaaaaagtctttgtttcacctttattgaagaaatttttgtgggaatagaattctttgttgaccttttttttctttcaacacttaaaaggttggtcacttgaatgtcttctggctttcatagtttcagaaagatgtctgctttagttcttatctgtgttcctccacatgttatatgggttttgtttgtgtgggttgaggtttttttgggtgagaagggctggggaattgtctgccttcaggattttaactttatctttagttttcgtcattatgaatatgataattctaggtttgtgtgggcatatattttcatttctcttggctgtatacctaaagtggaattgctagatcatatggtaactctatgtttaacattttgaggaagtgccaagctgtttttcaaagcagctgcattattttataatcctatcagcaatatatgagggttccaacttctccaaactttttgttaacacttattattgtccacctttttgattttagctcttagtgactatgaagtgatatgtcatcgcatttatgagttactggaatgcaaactgccttgctggggactagtgttaaatatatttaactatggaattcaaactgtcttgttgggggactagtgttatttaactaaactgtgataactgaaattaatgtataaatagtctgtgcaaagtaagaactgcctattcattatgaaactaacaatacactgttatacttttttattttagcagtcagaaaaggaaaatatgggtgtatatattcttttatatttcccatgtatttactttttcttctttctttcctctatatatgagctaagaccttcctcctataggtctttctttaatatttcttataggataggtctgctgacaacaaattctctcaattttatttatgtgaaaatgtatttacttttccttcctttttaaaggatagttttgctggatatagaaatcttgattgacttttgtttgagcacttccaacatgtctttccaatatcttctggcttttgttgtttttgaggagaaagtagtcattaattgtattgttctcatgtgtgtgatgtgacatttatcttttgctgtttttctgatttttcctttatatttggctttctgcattgtgtttatgatatgcctaagtatggtcttttttttttttttttttttttgtctatcctccttggaatttgttgagcttctcagatccatgtcccatggtcattttccagtgccttcagctacttttttttttttttttttttgagacggagtcttgctctttcacccagggtggagtgcagtgcagtggcgtaatctcagctcactgcagcctctgcctcccaagttccagtgattcttctgcctcagcctcctgggtagctgggattacaggcaggcgccaccacacccagctaattttgtatttttagtagagacggggtttcaccatgttggccaggctggcctcgaactcctgacctcaggtgatccatctgcctcggccttccaaagtgctaggattacaggcatgagccactgtacccggctagctacttatttttgacattttggtccaggttttgtcagtgttttttgtggaagggatcatctgaccttttctgtccagctttacttgctctcttgtattgcaatcacattctctgtgatccttttttccttctttgtttcattttctatgttgttttcctaccacacattaagatttctgttgaatttattctcccttgggtgccttgtacttttctgcatcactgcactggaatcatttttgtctttttctttaattttttttctgattatgattgattctttgaatttcttcatgctttgtttttatctacttctgctcttggtttttagatttcttactgtagaatgtttttaatattgccaaatgttctttttaagttattgtatttaatttggagtattgtgtgttataactatagttttcttctactgtaaaatgttttgattttcattttccttcttttttctttcctgcactgttatatggaattgattttgttttcccattctgagagcttttatgatgaaggttcctggtttgagtgcctttttccatcagtgcgcatgaattgtagtttcttttatggatgacgttgatggtatggagtaggagaggttggtgttgttttatttttcttttatttctgcagaccttctcccaccgccccccccaactttttactgtcttctttttatttactacacgatcacatctccaaggaatattcttcttttttatatatcatcctttcctgaaaacaatgatcgttcaagggtgctgctttttgtcccactcgatttgagccccttccgtgtagcaggtgctgtgaacttcttccaagtcactggttttattcagtctgttggcactaagtgttgggcttttttggaggggttgaattttgtctacggttgtctgagtcctcccacccctctactatttttcctaaagtctctcaaccctctgtttccctactctgtgtacccatgagcttgcagtcacagcagggaatctgttggaatttgacatttatttctctatttacatataatttcaagtttgtggtgtttttttggtaatgctgaaggcatgtgtcttttgtggttttgtttgtgatccttagtaattttatggttttttgagcaagactatatggagagattcaaattaggtggccaccattattttccagatttggaaactcataactaagcattttagaaggaaattatttaagcaggcttacctcctactgtgccatcacttcttgctggaaaccaataaggctcctaggtagttctctttgcatgtgaggaagtcaccattctctactatttttttctgtagatagaaatatattcttggttacaaaaaatcctttgaaatatagaagactgaacttcttatttgatgtcttcatgaaccatttatgtgaaatgagtagagctctataatctaagatgatttccaaaattttaggttcttgggaacctttgcttcttcacttacgaaaactttaacacaagaaatgtagcccaatactatccaaaattaatgtacaatttacatagcaagtttagtatttagactttaaacacagagaaaagccttccccttatacatctgtggaaatggaacaaaaattttataagtcatgggacattttaaacagatcatgaataaccacatgatatgtattatgagatattggtatgatattcactgtgaatttcctcatcttcgataacccatgaaggtgacattagcatagcttatctccctctttaatgcactgaatcgttcttaataagttttaagtagtcattaacgtcatagcagggaccgttgttgatattgctagtgtttagctctaaacaaggtgccaagcgtgtagcagactgccttctggttcacctttcctctaacgccgtcttctcccccatattttccttaatcgtattattccaaacagtctgccttgcctccttcctcacacctagtcagtctcctggccctcctggcttcaccatggaccgcactgtaggtagcatcctctggcgttgtgcgtggctctttcatggcaaaactttggaacttggacatttccttcaggctctcctccctcagacctctgtcacacattgaggctagattaaacttacttaacatttgttacattcgtcttttctttatatctatattatctttgttgagcaaaagttctgttatataacacttctctctggtaccctttgctggcagacatccaggcagtggtcataatgacacagaagttaagcaaatgctggattctgtaaataccgcctttcataatgtgtttactcataaatgggttaggtccgcaataaaatttttggatgagcacatttgtgtaatcgtcacccagatcaaaaaacagaataacactaagtgctctaaaaagcccatttcctatttccctttcacatcaggagcccactttcccaaaggtcctgctgtcctgaagtctacaactgtagattatttgtgtcaggttttaaaatgttatccctcaatagatcatccatttgctttgctgtatagtattccattgtctgaataacccgcaatttacccattggggttattttcagttgagtgctattgagaacagcactgctgcgaaaactcctgcatgtctgtctgcgagcctagatgctcccttctgtcacctgtggatacccaggagtgagaattagtgggccatggcatgtgcctgtattcggctttcgtggatacactggccttactgttaacaacattatcacctttttttcccttttatttcagagctcttccagtgttagtggattcagatgaggtaaaatatatttttgcatatttccttggagctgatattttcacaaagtagagatgtatttcagaaagaagttctgaaagctactttttaagattattataaattgaacagacagaaagatgctatgaattgatttgtgggtaaagttgaaaggatttatgaataaagtccccatttcaaacaagaacaagataaatacttactggtatgaaggaaatgaagggttattttatgaaatcttgagtttaaacgattttaagatggcagtttgtctaaattaatctctgatacttgtagacattttgctgagatattaaagtttcaatctcattttcatttactaagcaggaaatttggatagaggatgtggatttaggaaagtttttgggaaaaaaattagctgtggatcacttggacattaagttgtgtggcacaaggcgggaagaaatctgaagtgtaagaattaaagactggatgcacggaacattaactttcaaaaaggacgagtggagggaagttagtggtagctaagttgtaacttgtatggtggctgtagcacataagaggggccagagctgtatacgttgaaagagaaggaaatgattttggcatcagtctgttatttgactgtactgggatgggaaggtttgagaaggccttgctgcaaaacagttaaacttcaagattcataactctacagaaagatgtagcattacagaaagattcataactctacagaaagatgtagcattacagaaagattcataactctacagaaagatgtagcattacagaaagattcataactctacagaaagaggtagcattacagaaagattcataactctacagaaagatgtagcattacagaaagattcataactctacagaaagatgtagcattacagaaagattcataactctacagaaagaggtagcattacagaaagattcataactctacagaaagaggtagcattacagaaagattcataactctacagaaagatgtagcattacagaaagattcataactctacagaaagaggtagcattacagaaagattcataactctacagaaagatgtagcattacagaaagattcataactctacagaaagatgtagcattacagaaagattcataactctacagaaagatgtagcattacagaaagattcataactctacagaaagatgtagcattacagaaagattcataactctacagaaagatgtagcattacagaaagattcataactctacagaaagatgtagcattacagaaagattcataactctacagaaagatgtagcattacagaaagattcataactctacagaaagaggtagcattacagaaagattcataactctacagaaagaggtagcattacagaaagattcataactctacagaaagatgtagcattacagaaagattcataactctacagaaagacgtagcattacagaaagattcataactctacagaaagacgtagcattacagaaagattcataactctacagaaagatgtagcattacagaaagattcataactctacagaaagatgtagcattacagaaagattcataactctacagaaagatgtagcattacagaaagattcataactctacagaaagaggtagcattacagaaagattcataactctacagaaagaggtagcattacagaaagattcataactctacagaaagatgtagcattacagaaagattcataactctacagaaagaggtagcattacagaaagattcataactctacagaaagaggtagcattacagaaagattcataactctacagaaagaggtagcattacagaaagattcataactctacagaaagatgtagcattacagaaagattcataactctacagaaagatgtagcattacagaaagattcataactctacagaaagaggtagcattacagaaagattcataactctacagaaagaggtagcattacagaaagattcataactctacagaaagatgtagcattacaggaagattcataactctacagaaagaggtagcattacagaaagattcataactctacagaaagaggtagcattacagaaagattcataactctacagaaagaggtagcattacagaaagattcataactctacagaaagaggtagcattacagaaagattcataactctacagaaagaggtagcattacagaaagattcataactctacagaaagaggtagcattacagaaagattcataactctacagaaagaggtagcattacagaaagattcataactctacagaaagatgtagcattacagaaagattcataactctacagaaagatgtagcattacagaaagattcataactctacagaaagatgtagcattacagaaagattcataactacagaaagatgtagcattacagaaagattcataactctacagaaagatgtagcattacagaaagattcataactctacagaaagaggtagcattacagaaagattcataactctacagaaagatgtagcatgtagattaaaagtactttaaatgcccctttaaaaggaattttatgctacatctttctgtatttaaagttttagtaaataattcatttgtaatttcaataatacattaatttagtaaagtgaggcaaatctctagatgagctaggcctaagaaatccattttagctctattcctgcctctcattggagattctgaacttgacatgttttctagctagcaggaagttgaagttttctgaacttctcagcagataactgactatacattattggagagtatggattatatggttattttttaatttttaaattttttataaggatgaggtctctctatgttgcccaggccggtctcgaactcctagcgtcaagcagccttcccgcctcggcctcccaaagtgctgagattacaggcatgagtcactgtacttggccttttattttctgtatgtaatatttccatgtatattatggaatatatttagtttccctaaatgtggctgttgaaagattagaaaatttttgttagggttctggaagtagtatcaacatgttgatacatatcttctttttttttcttcaggaaatcatgaccagatctgaaatggctgaaaaaatgttctcttcagaaaagataatgtgattggaacccgtataagaaatgtagttaagcctgaaggactatccttcatcaagactgaaagtgagctttgatttgatattgcctaaaaatttttattgtgttatcttggaagtctgtgtatcaaaatgaagaattcagatggtaggaggttctatagtccttttaaagctgactcttgagtgtcagttgaatatccattaaattggatttggaaataacctgaggaaagtattatgataaagatctgcacagatgcctcttagctgataggtggcaggcctgtgggtttgggttctccctcttttctctggaacatatgacaattccagattaaagaaaaatgttttttaataaatacccttggtctttcttctagtcacctttgaggtagatattgtgattttctggagtatagtatatccgtgtctctgtgtcttaggtttactagatgcaataatacttctctttgacatttgtactgaagtgatttgatattaagtaaaacagttaatgtttgaatataggcatatttataggttttttccgctcccccccaacccaccctttttaaaaaatctatacaaagcccttgtttgagtctcatcatgcacatcaaatcatggagttaggtcttctctgagctcaggggaacacaagtgcacagagagagatgtcttgagggtcactaccaaagaattaccctcattgtccctcactcaggccatgtgtacatgcgatgctgctgagtgtgctggggtgggtggtggccacgtggctcccccagagcacttcctaactggcaagctgggagacccattactggtgaactttgtggaaattagaactgtatcttttacataatcttggcatattacatttcataataaaaacatacatttagttgcatgctacatcactattgattttataattaatttcttaagcttcaaccatgttttataccttatttcgttacatcatatatttgtaatgtgtaatatgaaatcttttgctttaatgtctttttttaaaatgtagaatgttctaaacttgaaaggcaattgaatgtagtatgatgaaaatgtgaatgttttgctgctttcatgaccaaagatacagggctagtggacatttagaataataattaaagctagagtcttgtatgtcttttctttgaaggagttctaaccttgtaaattgagaatgacttcagagaattttgattaagaaaacattaaaatcttaaccggcacaaacactccaatttttttcactgtgaagccgcaagcaattttttttctttttctttcaaaagcctaccttctgaatttatttcttgtttactcatttcagagagggtagtaaagaagatctatttctggtagtcatatcgcttgaaaggtattggtaaatgtgttttcagtcgtgaccatgtggaaagtgaacagtgttggcaaacattaccgagaaaatcatgcttttcaagatgcccttgctttgggatatccttcctagggagaaaaaaaaaaagtagtttaacaattgtgaattccatttcttatttcagtttctgctgcagtaatgggttcccacccactataattcccagcatttatgttctgttgtattctccccttagcccagtaacatttttatctaataccccattccccaagttttgagacagattgaccccctactcattatgtggctctagttgaattttaaaatgtggaatattgggcttgcaggcagtaggagctgcaaatctggtagagtgggagtgtggagttaatggtgagtatgttaataaagggaaactgtctctgacagaatctcagtaatgtttaccaaaacatgtctttctacagctggtaggataaatgatgctaccctgtagctcagctacaggctgcagtgcaaacttttcttccatccagagaaagcagaattccctcctagtaacctcattacaaatactgttactagaagggcatgtgctgtctgtcaccttcagtaatatttgtgccatctcttgatgactgatgacctggatcgagtatttctatgaagggtcttcttaggccccttacatacgcaagaggggtgctctagtgccatagctgtagttcacaggaaggacaccaggagaagttatacctagggctactgagcagctcatcatccctgtttctgcacagtttcctgaaactggccatcagggcctctgaggcactcaaatcagtttacttttagcatgcccccatcagggtgggtctcactgttagtgaggatacgggtctggtttgatgtttttctaggcaaaatgcttaagtgttctggttatgccattcattcatacgatgtgtgaaatttgcttaaaagggaattttcatgatttgatttagattagtatttaaatatctgctttagatagcaattaattttattgtaaaaataaggaaaaatatgtgaatatgtgaattttttaagcctgagagatgatagaatgttcccatatttttcttgtaaagaaaataatattttaacttacacatcctgtagaaaataccaccttttccccttgtattacagtacaatgtttacattactatactgtcaagctgaaagtataaaaaatgtacatatacattttgagttatgtatcctttttttaaaaaaaagttcgagtctgttgcactaggctgtacatgactaaagttgacagatgctatgctagatttataatcactagttctggtacttgtgtctttgtatgatcaaagcatgcaataagcaatacaaaataccaagccttatacttaaaagaagtttaacatattggttaatatactggttaatatactggttaaacatattgaatgtatataagtggcaaaactagatttttaaggaagtgtacattataatattggagctcagtactgcatgaagagacttcattaaaactaagaaaacatttatttggggagaaattttaggcatttaagaacttgtatttttctattttaaaaagttaaattattccgtaatttggaagaagtttcgttgaatgtaggacataaccgtttgaagggttttcatttgaaaaattgatgtattttgtgccttaatattttgttcttttaataaaaatgctctgaatttgaatgat
